United States Patent 8,030,546 (BIOTIC AND ABIOTIC STRESS TOLERANCE IN PLANTS) - sequence listing, part 3

SEQ ID NO: 6113 - DNA, 1343 bp, Oryza sativa
  Predicted polypeptide sequence is orthologous to G1510, G1779
gaacttctctcccatctctttcctcctcctcctctctgatatgtctactatctacatgagccagctacctgctactctccctctaatggagggggatcaggatcaggggctctacccagccttccatagagcaaaggaccctcctatcttgttccctttcatgatcgacagcgccgtcgagcaccaagggcaaatctatggagatcagggcttgaggaggcagcaggttttgggtgaatccaatcaacagttcaatgatcacatgatgatgggcggatcagatgtcttcctcacaccgtctccgttccgaccaaccatccaaagcatcggcagcgacatgatccagcgatcatcttatgatccatacgatatcgagagtaacaacaagcagcatgccaatggatcaaccagcaagtggatgtcgacgccgccaatgaagatgaggatcataaggaagggggcggcaaccgatcctgagggcggggcggtgagaaagccaaggagaagagcacaagcgcaccaggatgagagccagcaacaactgcagcaagctttgggtgtcgttagagtgtgctcggactgcaacaccaccaagacccccttgtggagaagtggtccttgtggccccaagtccctttgcaacgcgtgtggcatcaggcaaaggaaggcgcggcgggcgatggccgctgctgccaacggcggagcggcggtggcgccggcaaagagcgtggccgcggcgccggtgaacaataagccggcggcgaagaaggagaagagggcggcggacgtcgaccggtcgctgccgttcaagaaacggtgcaagatggtcgatcacgttgctgctgccgtcgctgccaccaagcccacggctgctggagaagtagtggccgccgctccgaaggaccaagatcacgtcatcgtcgtcggtggcgagaacgccgccgccacctccatgccggcacagaacccgatatccaaggcggcggcgaccgccgctgccgccgccgcctctccggcgttcttccacggcctccctcgcgacgagatcaccgacgccgccatgctgctcatgaccctatcctgtggcctcgtccacagctagctagctagctgatcaaaactagctagctactagtaccgttaatttgatgagggcaacaaccagagtactatgtaccactactagcaatattttgtgtgtgccttgtgatcttttgttgttttgtgttgttgaggagatcactagatcaggatgaaggagagatagtgatcacatgtctaaggacgaaataaacgagaacaaactcgctagctagctactagccgggatcaggattatattt

SEQ ID NO: 6114 - DNA, 1633 bp, Oryza sativa
  Predicted polypeptide sequence is orthologous to G1510, G1779
gaatcgtgctggacctcgcaaaattgcccctccaaccgcatcaacactcgtcgcgcgaagcgtaccatcgtctctctcatcttcctcgcggtctcatcctgatcgatctctgcgagtttatccaatatctgtactcgcaaactagctagagagatctagttagtagctaggcagttgctgcctctcatgtctaccatctacatgagtcagctctcagctgctctccctctcatggagggggagcaccaccatcaccaccaggatcatcaccaaggccacttccaagccttctccctgcagcctaaggatcccccagtcttattcccctttgtgatcagtagaagaagcagcagcagcagccctagcgacagcaccactctaagctatggttcagaccatcacttgacacagcagcagcagcatcagcatcaagccatgcttgagccccaaaatatgattggaggatcatccgctggcatctttgcgacgccgttcccgaccgtcaagagcatccgcgacgacatgatcgagcggtcgcagttcgatccatacgataccgagaagctgcaggcgagctgcgggttagccaaggtcgtcgccggcggcaagtggagcgcggtgccagcggccaagatgaagatcacgaggaagatgggtgagccgtcgtccggtgtcactggcggggctgcgacgacggtggcgccgaagaagccgaggaggaggccggcgcaggcgtacgaggatcacggccatggcggcgccatgggccaagcttttggcgtgattagggtgtgctccgactgcaacaccaccaagactcccttgtggaggagtggcccgtgcggccccaagtcgctttgcaacgcgtgcggcatcaggcagaggaaggcgcggcgggcgatgatggcctccggactaccagcgtcccccaacgccgccggccccaaggcggccgcacatagcggcgccacaaacgcagccgccgcagctgccatggaggagacggccgagtccgccaccgtcgccccgcccccggcgccgacgacgaggggtggtactctcgtcgacagcatcgggctcagctggagcaagacccatgccgccgccaccgcctcctgcagcttccggccgtcaccggtggctcccggcttcgcggcggcggtgcaggacgagatcactgacgccgccatgctgctcatgacgctgtcctgcgggcttgtccggagctgagaaagaaaagctatacttcatctctgcatgcatccatcgatcgatcgattggcaccaagctagagagaccaatcgatggagatggagagaggtgcaggctttttgcagctagtgcgttagcctgttcttgctcgctcgatcgatcgtacactgccccccagttggaatgtctcttggcgtcttgtttcctgttcgagtcttgtgatctctgttactttgtgcactgtactagagagtgagagagagagtgaggtagaaacatcaagaggagattagaggagaaagaataattaagagaaaagtgtgagctagctaggtaagatttactgtactgtgagttcaatttggagtaagctttttgggctgcttcacggctaattatgccactggctgctatatatgt

SEQ ID NO: 6115 - DNA, 2935 bp, Oryza sativa
  Predicted polypeptide sequence is orthologous to G1512
gatttggaaaattttctccacttcccctccaagttgaaagtccaccatagaccatggtctgttcttgtgctgtagcttggtgacctgccattttagccgcaatgcatgaccaaagtattccaaattcttgatccccagccccccattttccactggcatacagacgtttttccacgcgaccaagcagtgtccaccgctcacttcctcttgccctttccaaaggaatcccctgcatttgcgttcaatttcttttatcgcccatttaggcagctgaatcactgacattgtgtgtacagggagggccatcattgttgatttgatcaagcataatctgccatcgtgtgatagcatccttggcttccaaccagctaccttttttgcaagcttatcaaggattggttgcaactccatctttgttggtcttctcatggatagcggtatccccaagtatataattgggaattgctctatcttgcagcgaaggatgtcggtgatcaattggagctgctgctcgctacaccggattggtgtaattgcgcattttgccagatttgtcttcagccctgttgtgtcaccaaatcttttaggataaactcataaacatggtagtaattatatgccttggtttctccatcttaattcatttgcatgctaaacagaagtttgttactagttttatgtttcacccatttgttcttgtgatttatctcaaggccgtttacatgtggttatcctttctttgatgggaagtgtaactgacagccttaaccctattggaaaattagaaggaataattaagatgttgcttccactctttacttacacgtcgattgagtatacctgataaatgtgtagatggaatgattcttgtttggtactaatccgaataacctatatctgtgtaagtttaatcatattgatattgtggcacacaaacaatttgacaatgaaaagctgcatcaatgcaactaagctttgcacagttctactgaacttttctgcttgtgcatttttatttgtagccttggggtaccattagcaattttgtgatgtatcttggttgatctcattttcatgattcgtactattcatcagtactttgtttcttggccacaaaaacgctagctggacaactgtagaaaaacgacgtgcttggagctgtatgtatgataaggaaaggagagaaatgcatataggcaccttagttctgactgcacatatcgtctgtggatatgggctaatattatttaagaaaaaacaactccaagttgttggccgaatatttgttgtttcctgatcttatcacaagattgaatcatcatcttccctgatcactagatatgatttaaaactatataataagaaatgatgtgcttttctctttggttttgttcagtcgcttgaatacgtcaagtgctacatatggagtcaggaatctagttattccatatattattacaccacttcatcgtttgcttttcggtttattaacatagataaagaaccgattgacggctcagtttctttgaaggaaaaaaaaacacagagataatcatacttatggagcaagatcaggttgggctttggggtcggcaagctgtcttcttctccgtacaattcgctgtgtggtcactgatcatctcttattttttcttgacaaaaaatagtggtgctaatccggtcagtgtttcagcgacctggtggcgttgtccaaattaaatcgagcgtaagcagattataaatgccggattgcttaattgctttcttctttgctttcctctcaaggcaatagcaagtctattttctataaaaaacaaaggcaaactctcttcttcttgttattgtttttgcaaagataaacaaatgcaaaattcgggttgataattacgggttttgacctgtaagattcttgtatccacttcaggttgggcaatcagactagttttaccgactggtgtggtgaccggtgaccgtgtaaatccgcaatgcaatcaatcatcaatgacatttctacaatcgaaccaccgtagtggataactggatgtgatagcaacatatagatcgaagctaaactagtagtatgaccgaacaattttttttagaaaaagtaaaatttaatcaatagtagttttcttatacaatttgccctgtggttgtttatatttggtatggaggcatggagccttatttaaatcctctgctttatctgaaaatatcttgtctgatcgacgtgggaccttctggatttggacagactagttaggactaaacaacgtcctcagacagaaaaccctacggttttggtcttcttgtggttagttccactgtccatttttgctgccagcggcctatcaccagcacacgaaccggtcgcacggacaaaacggtacaacttgctttgcctgaattctgaccggtcatcgtacacgtttcggtgaccaatcatgcccggcgaaccatcgatataaggaaagattttgtttgatcgaggtggggatggatcagctttgcacgagtggaggcagcgacagcgacaagtctttggcggccggcgatgagccggcggtgagagtccgaggtgaagtggaggcggaggcggcggcggcggcggcggcggcagaggcgcaaggcggtggctgcttcgactgcaacatctgcctggatttcgccacggagccggtggtcaccctctgcggccacctctactgctggccctgcatctacgagtggctgcaccccggcggcgacgacgacggaagcaacggcgacgcgagctcgacgaggcggcgtccctgccccgtgtgcaaggccgcggtctcgccggacacgctcgtgccgctctacggccgcggccgcggcggaagttccaagagggcccgatccggctcggccatcccgcgccggccgatcgtacatcgggagcccgtcgagcggc

SEQ ID NO: 6116 - DNA, 2250 bp, Oryza sativa
  Predicted polypeptide sequence is orthologous to G1512
gaacctgcaagagagctaatctcctatatggtcttagctaccgggatctataccctgcaactgtcatcagctgggcatgaagaacagcaggcggccagctatatttatttcagcttaattctcaaagggtatatatactttggtgaagatcgatcggtgcatggttgattagagagccaactgaatgggatttcgctcagtttgatcctcatcacagtaggtgcttaattggagggagtatgaaaagctggcttgcttaattgtgcaccatgcagatcaagagcagggaatgcaagaaaatgcagcatatggtatgtaaaatgcacgatgctggtgagtaatgttttaatgccccttatttgttactttggttaattaatttctacttaattttatccagttttgcctgatcagtaccctactttaattgtttcactatataatttgcacccggttattactatattgttgtagtgtgtctatcttaccattaataagatactccctccgtccctaaatatttgacgccgttgacttttttaaacatatttgacctttcatcttattcaaaaaatttaagtaattattaattccttttctatcatttgatttattgttaaatatacttttatgtatacatatagttttacatattttataaaagtttttgaataaaacgaacggtcaaatatgttttaaaaagtcaacggcgtcaaacatttagggacggagggagtaagaagtataaggctagtttttgtaacatatatagggtatccactatatatccctctattcctttgcaatagtactgaactgctatgcttatactaggacattaattactttggttacacagttgggaggtgtcagtttagtccagtggctgtagcacaatgttgtcttttgaggtgatttttttcatcaagtttattttgcatgatactccctgatcattaagatttcttagcaacatttatgaaaccacattaaaaaaaggacgtacgcataggcagatatatagcccgtgcttcacttgaagatttgtcattcatgcctcaattttcactagctaacacagaacgtttatgtgtacaataatccatctctcttttatggtttttatgtgtgtgaccacgttcttactagatgcacgaaaattatcattttagagttttacagtttatggaatgcttgtgtgtgtgtgttgcaaatgctcagtttatggatgatctagcaacagctaaaatgatgctacggattaatattattgtttttctatctgaaacaaatagatcatcaggcaatacacacatcaattgaggaacaacagctagcacacaacttatttcatgaccacgttcttaattagtttcttactagatgcatgaaaaccatcattttagagttttacactttatgaaatgcatgacagatttcaatcctagtgatagtagaaaattttcaaataagctagctggtgcaaaatggtttctgcggccgctatgcatgtcattcccattccccagaagttgatattgttaactgttaggtgcaaacgttgcaagcaaagcgcgcatgacacacacagccagagggcttcatgcatgttattaattacgatggaacaaattactccgatcccattttagcgcatgaaaagatggtttttgctaaccagccatcttaaaatggattcatttgcaattgaacagtataaatttacatattaattgtattgttttatgctctacttccttctcacggcgagagtcctgctactatactgctggtcagtcggaccgagccatgatccggaagaccggaagggagtcattcatgatctccctcttaaaacaattaataaggctagcttgaagcttctgatcattaattaacctacgatccgtctagctatactaagctactcttcgctaatctgcttaacaactttcaggaagtttttttcaagtatgtactatggattgaatggctgcttatacatatgtactgtgaagaattaccgtgtatatgtatgcaggggcagatatactttgggggtggcgggggctcaagcctctactgttagtaccaggactatgagagttctacgaaacctccactaaattttttattttgccatacgtatatgagaagagggttatagttttatttaattagtttgttcagattccttgttattttttcatggatctaccaccgtgtttatgaataaattttggtactccc

SEQ ID NO: 6117 - DNA, 1619 bp, Oryza sativa
  Predicted polypeptide sequence is orthologous to G1519
gaagcgcggacgaggcgagaactccttggagctctgaactctctatcgcgtgaggaggtcgacggcgagagagatgcgcggcggcggcggcggggatgcgggcaccagctcgaggggcggcggttccggcggggcccccgcgcgtccgcggcggttccctgaggcggcgcagccggagatcatgcgggcggcggagaaggacgacggctacgccgcgcacgtcaccgaggcctgccgcgacgccttccgccacctcttcggtaccagggtcgccgttgcttatcagaacgagataaaattgcttggtcagtctctttattacttgctaacaactggttcaggccagcaaacacttggagaagaatactgtgatatatctcaggttgcaacctcgcacggacttccgcctacacctgctagacggattctattcattttgtaccaaactaccgttccctatcttgctgaacgcatcagctctagaattgttgcacgtggtattgccctcgaggactctcagcttgatgaccattctgaaagtgatagttctagtataggcactgcagcacaaccatccccaattaggaacagtccttcaagaagcttgagtttttctcatttgtcaaggttgagaggcagagtccataccttgtgggaatgggttcttcggaaatggccttcgatgctaccatttgctcaagattttatacagttaactatccggacaaaccttatgttcttctattttgaaggattgtattatcatttaccaaagcgagcagctggcattcgttatgtattcattgggaagccattgaatcagaggcccaggtatcaaatcttgggtatttttctgttaattcagttatgtattcttggtgctgaaagacttcgaagaagtaatttatcaacaatagctagttcgattaaccaaatctcatctggaggctatccttcatcaagaggtcgaggtgtccctgttctaaatgaagatggaaatataatcagcgacatccgccatgggaaaactgcagatttggctactagttcagaggcatccagtggtaagagcaaatgcaccctttgtctcagtacccgtcagaatcccactgccacaacctgtggccatgtcttctgctggagttgcattatggagtggtgtaatgagaagcctgaatgccccctatgcagaactccgattacacattcgagtttgatttgtatatatcattcagatttctagcaaatgattactagcaaggggtcatatcattctccagtggattcattaaaatgatactgaatccccacattttggcgagaactcttcttctgaagtgttttagtgtaccaaaagaggagagtagaaaccatccaatgaggctgaagatcaatgctgccattcaactgtattgtagagctcaaataacaaaacaatcaaacagaacaaaattttcattagagctcaaacggatacccatgtatatgtacattgtagacacaacttgattttgtagggtagaacagtggctgactggaatcattagagcaaaatgtatcgacctgaaattctgccgggaaatttaactatttgccaatattagattcgacaattattc

SEQ ID NO: 6118 - DNA, 3804 bp, Oryza sativa
  Predicted polypeptide sequence is orthologous to G1526
ggttttctccatccccaatcctctcctcctcctcctccgcctccgcctcaatcccttcctccatccacccgcctccgttgttctcgccggcggcgacgacatgcacggcgactggccggagtcgccgtcccaggaggtgctctacgccgacgagatcgccgccgtccgcgcggttcttggcgcgggcctccccgaggcccgcgtcgtcgccgcaatctcccgctgcggaggcaacgccgagcgcgccatcaacgcgctcctcgatgacgccaccgccggcgtcgaggacaaacccgagcccaagaagggtaaaggtgccaagacggctgctcctccggtgaaggcggaacgcgacgctggtggcgccgccccgaagccgccgccgcctccggtgaaggttgaggtcctcggcgacgagcccctggggagccaagaatcgaacggctgctccgcgagggtcaagaaggagcgggaggacgagctgctcgtcaaagcgccgcctccgatgccggatcgggtcaaggaggaagacggcgtcgcggccaagcgaggcgcggcgacggcgaacgccgccggcataagcctggtgccgaggccgaagaagaggtctcgcgtgcacgacgaggcggacaccatcgacctcacggcgacccacccggtgccgtacctgaacccgaggccgatccgggcggtgccgccaccggaggccatggagatgctcgagtcgcggcgtgtgcgtgccaggccgcctccgccgtcgagtgatctgaggatggtggtggcgccgcctgatgccgagttcggcgagttccccgaggagcgcgactggttcctcgtcggcaggtcgtacgtcaccggcctgtccaccaaccgcgggaggcggaggctggacgccggcgagctcgtccatttctcgttcccctcattggagaggacctatggtgggatcaaggtgtcgaacaagaaggcggctgctttggcggagatcgtgcgcttctccaccaatcgagctggagagattgggaagctatctacagaatggaccaagtgcctcgtgccactggtaagctcatccaaggtgaagattcaggggaagattgtgtttcccacggtggaattgagattgatgcaggagattttgttgtatgttagcttctacatccaccgttctgtattcaccgcaagcggcaacaactcatcatgggacctgcttgctcctgcaaatgttgattattccactaaccctctttacaggctgttcagattgctcaagctaagggcattcaccaaggctgatatcactcctgaggagcttgctgcaggaaagagatcgcggaatctaaggggtgatgacaatgatgaagatgaacccatggctatagttggattggaaaaccgacgcacagctggccaaacatttcctgagcaaggcactgatgagcaagctatttcagaggctgcattaaacaaaattgttggcactgctgaaacatatgacttggagagcccccaagcactcttgtctccgttctaaaaccataccagaaggaagctctgttctggatgtctcaattggagaagggtattgatggtgatcaagccaaaaaaacccttcatccctgttggagtgcctacaaaatcgtcgacaagagagctcctgcagtgtatgtcaatgttttcactggcgaggcaacaacccagtttcaaagtgtaactcagtcagcaagaggagggatactagcggatgcaatgggtcttggtaaaactgtcatgactattgctctaatactatcaaacccaaggggggagttagaacaagataagaggggtactagagatcgtgacaccaaggcacaaacttcgagatcctctgtaagaggaggcacacttataatctgtccaatggcattgctaggccagtggaaggatgaattggaggcacattcaacaccaggagctctttctgtgtttgtctactatggtggcgacagaaccactgacctgagattcatggctcagcatagtgttgtcttgacaacctatggtgttcttcaatcagctcacaagaatgatggcagcagtatctttcacaggatagattggtatagagttgtgctcgatgaagcacatacgatcaaatctcccagaaccaaagcagcacgagcagcttatgaattaacttctcattgcagatggtgccttacgggtacaccattgcagaataatttggaggaccttttcagtcttctttgcttcctacatgtagaaccatggggtgacgcaagttggtggaataagctgattcaaagaccttatgagaatggtgatgagaggggattgaaacttgtcagagctattctgaggccactcatgctgaggagaacgaaggaaacaaaagacaaaatgggaaatcccatactagtcctcccaccagctaatattgagattgtggagtgcgaacaatctgaagatgaacgcgatttctatgaagcgcttttcaggagatcaaaggttcaatttgataaatttgtagcacaaggcagtgttcttaacaactacgctaatattcttgagttactccttcggctaaggcagtgctgcgaccacccttttctagtgatcagtcgagctgatactcagaagtatactgacctcgatgagctagcacagaggttccttgatggggtgcaacgtgattccgcgagacgcagtgcgccaccttcacaggcgtatgtagaagaggttgttgaagaaatccgccagggcgcaactactgagtgtccaatctgccttgaatcagcttctgatgatccagtgctcacaccatgcgcgcaccggatgtgccgtgagtgcctgctctctagctggaggacgccttctggaggaccatgcccactttgccgaagccccattaccaaatctgagctgatcacattgcctagtcagtgtcgattccaggttgaccctgagaataactggaaggactcatgtaaggtgataaaactcatcaagatcctggagggccttcaggagaagagggagaagagcattgtgttcagtcagttcacttccttcttcgatcttcttgaggttcccttcaatcagaaagggatcaaattcttgaggtttgatgggaagctcagccagaaacacagagaaaaggttctgaaggagttcagtgaaagcaaggacaagctggtgctacttatgtcactcaaggctggaggtgttggacttaatttgactgctgcctccaatgtgttcctaatggacccatggtggaatcctgcagtggaagaacaagctatcatgcgaattcaccgtatcgggcaaaagagagcggtccaagtaaggcgcttcatcgtcaaggatacggtcgaggagcggatgcagaaggtgcaagcgtgcaagcagaggatgatctctggggcgctgaccgacgatgaagtccgctcggctcgtatcgagcaactgaagatgctgtttacatgagaagtcttgatcatgagtttgcaggatgttgtacagttcatattttgttccctggagacttgctagcattttaggggaaatgatccaatgttttaagggttcggacttgtgaatggggatggaatgggtgtgaaactatgtgcccattcgattttgtggatatatctccattctggtctgaacattttgtatatagtggctcttcttaacatgaaaggcctctaccctttctaaatcgtgatctattgtgctgaaatggctgttggtgttaaccagggagtaaaaaatctctactgaggcttcctttcatcc

SEQ ID NO: 6119 - DNA, 2698 bp, Oryza sativa
  Predicted polypeptide sequence is orthologous to G1526
catggacactgtcctcttgtccgtaagtgtctacatcaacagctcaatgtttcatggccaaaagcaatcgacacccaaggctgctcgggctgctaccgaggattccacgtttcatccgctgcctgcacttttcaagttaactggtctttccccctttaagaaggcagcatttactccagaagatctctattccagaaagcgtccgcttgaaacaaagagcagtgcacctgccacaaagttgactactgagaagttgagattatcgtctgatggaaacgaagatgatcatgctgaaagaattgtttcagattcagaattggatgatataattggaatctcagacagttctgctttggaggaaagggacccccctgatgctctgcagtgtgatttacgcccttatcagaagcaggcattttattggatgatgcagcttgagaaaggcagttcttctcaggatgcagctacaacgctgcacccttgttgggaggcatataaactcgaggacaagagggagcttgttttatacttgaatgtattttcaggcgatgccaccactgaatttcctagtacactgcaacttgcaagaggagggattctggcagatgcaatgggactggggaagactattatgacaatagctcttcttcttgccgactctagcaaaggatgcatcactactcagcattctactcacatatgtgaagaagctagtggactgggtgaattgccagttcagcctcatgatgatgtgaagaagctagctatccctttctcttttagtaagcttaggaaacctaaaaccccgcttattgcaggcggcaatctaattgtctgcccaatgacactacttggtcagtggaaggcagaaattgaagctcatgctacaccaggttctgtaagtatatatgttcattatgggcaaaacagaccaaaagaagcaaaccttattggtcagagtgatattgtcctgactacatatggtgttctgtcatcggaattttcaaacgagaattcaacagaaagtgggggtctgtactctatacattggtttagagttgtgctggatgaagcacacatgataaaatctcccaaaagtttaatatccctcgctgctgctgctcttacggctgatcggcgttggtgtcttactggtacacctattcagaacaacttggaggatatatacagccttttccggtttttgagggttgaaccgtggaggaactggtctttgtggcataaacttgtgcaaaaaccatatgaagaaggcgatgaaagaggtttaaagctagtacagtccattttgaagccaataatgttgagaaggaataaaaacagcacagacaaggaaggaagaccaatccttattttacccccagcaaatatcgaagtcaaatactgtgatttgtcagagactgagaaggatttctatgatgctctgtttcgacgatctaaggtgaaatttgatcaattcgtggaacaaggaagggtcttgcacaattatgcttcaattttggagttgcttttgcgccttcggcagtgttgtgaccacccatttcttgttcttagtcgtggagatacacaggagtttgctgacctaaacaaacttgcaaagcgtttcttgcatggtggtaatggtgctgtgaatggtgactcttctcttccctccagagcttacattgaggaagttgtccaggaactgcagaaaggtgaaggggagtgtcccatatgcctggaagcctttgaggatgctgtattgactccctgtgctcaccgtttatgccgagaatgtctcttgtctagttggcggagtgcatcagcaggcctttgtcctgtctgtagaaagtctatgagcaagcaggatcttattactgctccaactgacaatcgttttcaaattgatgtcgagaagaactgggttgagtcttccaagatttctttccttctacaggagctagaagttcttcgcacttctggtgcaaagagcatcatttttagccagtggactgcatttctggatctcttacaaattccactttccagacataatttctcatttgctagactggatggaaccttgaatcttcagcagagagagaaagtaatcaaggagttttctgaggacaaaagcattttggttctgcttatgtccctgaaagctggtggtgttggaataaacctaactgctgcatctaatgcatttgtcatggatccttggtggaatcctgctgttgaagaacaagctatcatgcggatccatcgaattggtcaaacaaagagtgtttccatcaaaagattcatcgtcaagggcactgtcgaggaacgaatggaggctgtgcaggctcgtaagcagcgaatgatttctggagctttgacagatcaggaagtacgcagcgcacgtatagaagaactgaagatgcttttctcctgacaaaccaagagtcgccattcgtttactgaaagccaagaataggaaggtaaaacgaggggtaagaattccaaatgttgcaaaaactcgaaattcagatatcatacgccttctggcattttgctgttgttgtatacctttcttgtgtatactaatatgtatgaatagtggcgtggaagaaagattgagagctgacagaagaggtaattcattgcatatgtatgtacaacatgggcttaattaatggtacccgtaacgtaaccgacc

SEQ ID NO: 6120 - DNA, 820 bp, Oryza sativa
  misc_feature (432)..(526): n is a, c, g, or t
  Predicted polypeptide sequence is orthologous to G1526
ttttttttttttctccctagctccattcacatacttctcaacattgcatcggaattcggaggaatacacatatacatacataaactttcttttagttttagcccgctaatatggtatacaaaaataagcaaaaggaaaaggacaggatgccggatgcaatgcaccactgtacatacctgctgtgcatgttaaccacagttaaccacaaaaatacatgcacgcatgaatgtctcctactgcctcctgaagccagcactttgtttactgacactgaggcactattacgaaatgataaacgctactactacctattgtcagcaagaggcacctattgcatttcatttcattcccatcatcatctcctcgatgctatccttcacgatcagcctcaccactttcacctccttggtctgcccgatccggtgcaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaactgtctccgtgtaaatagtgccggacaaaatgccaaaacactccataatgcacacgtaaatcaaatagcagtaatccaggaacaaagcaaacctaccgggaccgcaaaaaccaacgataaggaatacaccagtaataaataacaacatacactgcgccaaaagtcatagcctaacgttaagtacacaacaaaacaaaaaaaggcacaacaatacgctccttctcgctgtgtccttacgatctctcactgcacctaaatacacacaaagacacaacaagaaccaaacaga

SEQ ID NO: 6121 - DNA, 3742 bp, Oryza sativa
  Predicted polypeptide sequence is orthologous to G1535
gggttactcctcttcctcgctcgctcgctcgctgccttagccttgacctccatcgatattgcaaccataaagaggaggaggaagaggaggcgagaaagagagagagatcgtcttcttctccagccagccagccagccgtgattgatctcaagggggaaggcagctgcagggatcaagaagaaggagaagaagtgatcaaggaaggaaggccacggaacaaccgacagggcaggagggcgctggccggatcgccggagaaggaaccactagctagctagctagctactcctattgaagatatcgccggccggacatatgcgcaggatgttcggggactgccaggtcctgtcgtccatggccgccatggccggggccgcctcctccgccgacgcgctcttcgcctcgccgctcatccccaaccccgctctcgccggcttcatgtcctcctccgccgccatgcccttccaccacttctccaacgccgccgccaccttaatacctaaggaggaggggttgatgggcggcctccatgtggccaaggacgaggggatggacctcgagatggacatggagctcagtggcggctccggcagcgcccacctcgacggcctcctcagcttcgccgacgtcgacgacgaccacaagccgcagcacagcggccatgaccagccgcccgacgccgcccagcccagcggcgccgcggggggcaacgccaagaagaagcgctaccaccgccacacggcgcaccagatccagcagatggaggcgctgttcaaggagtgcccgcatccggacgacaagcagcggctgaagctgagccaggaactgggcctcaaacctcgccaggtcaagttctggttccagaatcgccggacccagatgaaggcgcagcaggacagggcggacaacgtgattgtgcgcgcggagaacgagaacctcaagagcgacaacttccgcctccaggccgccatccgcaacgtcgtctgccccaactgcggccacgccgccgtcctcgccgacatgtcctacgaggagcagcagctccgcatcgagaacgccaggctcaaagacgagcttgaccgcttggcctgcatcgccacccgctacggcggcggcggcggacggcagccggtgctgtcgacgtcggccctgagctgcatctcggcgccgccgccggtcctcatgccaccgctcgacctcgacatgaacgtctactcgcggcacttcgccgagcaggcgccggtcatgggctgcggcgacctcatcccgccacccgtcgtgccgcagcacgatggcgcggcggcgtacatgggcgccatgatggcgcccgtgcaggagcaggacaagcagctggtggtcgacctcgccgccacggcggcggaccagctcgccaggatgtgccgcgccggcgagccgctgtgggtgcggcagcgtggcgcggaggtgatggccgtggaggagcacgcgcggatgttcagctggccggtggacggcgcgaagcagggagacggcggcgcggtggcgagggcggaggggacgcgtgacaacgcggtggtcatcatgaacagcatcaacttggtggacgccttcctcgatgcgaacaaatggatggagctgttcccgtcgattgtttgcaaggcaagaacaatccagatcataaaccacggagctgcgtctggtcacctcggcagtggaactctcctcttgatgcaagcagaggtgcagttcttgtcgcctctggtggcggcgcgcgaggtggtgttcttccgttactgcgtgcacaacgccgacgaggggagctgggcgatcgtggatttcccggcggaagggtttgaggaggggctcctccaagcctcggtggtcaggtgccggcggcggccgtccggctgcatcatccaggacatgcccaatggatactccagggtggtgtgggtggagcacatggagatggtcggggaggagaagccgctgcagccggtgttcagggactacgtcgccagcggcgccgccttcggggccacgcgctggctctccatcctccagcgccagtgcgagcgcctcgccagtgagctcgcccgtaacatcgccgacctcggagtgatccgcacccctgaggcaagaacaaatatgatgaagctgtcgcagcggatgatcaccactttctgtgctaacatcagtgcttctggaacccaatcttggacggccctctcggattcaacccaggacactatcagggttacaactcggaagaacactgagcccggacagcccagcggtgtcatcctcaccgctgtctccacaagctggcttccttttacccatcagcaggtgtttgagcttcttgcagatgaacaacagcgctgccagcttgagattttgtcaaacggcggctcccttcatgaggtggcacatattgcaaatggatcacatccaaggaattgcatctctcttcttcgcattaacgctgcaagcaactcgtcacagaatgtggagctcctgctgcaggagagcagcacccaccctgatggtgggagcctggtggtgttcgcgacggtggacgtggacgcaattcaggtgacgatgagcggcgaggatccttcctacatccctctcctccccctgggcttcgccatcttccctgccaccagcccatcacctgctgctgcacccaccatcagctcaagcaccaccaccaccactggcaatggcaatggcgaaaccagtagcactcctccaagaaacagcagcagcaacaacaacaatgcagatgagctgctgcctcccaatggctgcctcctcaccgtcggcatgcaggtgctggccagcgccgtaccttctgccaagctcaacctctcgagtgtcactgcgatcaacagccatgtctgcaacgccattcaccagatcacagctgcactcaaaagttcagcaggtggtgctgggggtgagccggcgtccgatcagtagcaaaggagacctggaggagaggggatcggagcaacatgggatcagacaccaaaatgcctcccaatttatttcgctaacatcgcagtttgtttttctgttagctctcggtctggctggttcatcaggtgcaagggagggtttgacaagaagccaacactaacagctactcaaatctctcctctcttcccgccatatttctgcctctcaaaatgacgaaaatacccccaaccagccaacaagcaaagccatggggggcattttgatcattttgggaagctacttctgctgagaaagaaagaaagaaagaaagggtcttgtcaagctctcacttgcaccaaccagctgattcatgaatttgctgacatcagctctgcaggcattttggtcgtgcatcggtttcttgctactccatccatccctctttaggttcttcctccctttcctcatcaaaagtgagaactgcatgtgaagaaggttagctccttgttttgaatttttgtaataataagatggaagaagaagacttggtagcttgagtgtgtggtttgtgttaagatcgagctagactttgtgtaaggttgaagaagaagaagacattaagcagattgttattaggagatgagataagagaaaggaggagaggagaagtcaagagcgaaccagttgtgacccttcttcacactagaagggggtcttggttcgggaattgacttgttacctctctgcactctttgtctgtaacctttgccctatcttattattactactagtattgttc

SEQ ID NO: 6122 - DNA, 942 bp, Oryza sativa
  Predicted polypeptide sequence is orthologous to G1537
atggagacgacgacgacgacgttgggcggcggcggcggcgggcgggcgggaggcttctccgatccgccgtctccgctctcgccgccgctgtcgccggcctcggcggcggcggcggcgctggcgaacgcgcggtggacgccgaccaaggagcagatcgcggtgctggaggggctgtaccggcaggggctgcgcacgccgaccgccgagcagatacagcagatcacggcgaggctccgggagcacggccacattgagggcaagaacgtgttctactggttccagaaccacaaggcccggcagcggcagaagcagaagcagcagagcttcgactacttcagcaagctgttccgccgcccgccgccgctgcccgtgctccacaggccactcgcgcggcccttccctctcgccatggcgccgacggcgatgccaccgccgccgccgccgccggcgacgacgacgacggccgcatgcaacgccggtggtgtgatgttcaggacgccaagcttcatgccggtcgcgacaaataacgccagctactacccgcagcagcagacgccgttgctgtacccagggatggaagtgtgtccgcacgacaagtccacggcgcagccaccggccaccaccaccatgtacctgcaggcaccgccgagcagcgcacacctcgcggcggcggctggccgcggcgcggcggaagcggaaggccatggccgccgcggcggcggcgccggtgggcgcgagaccctccagctgttccccctgcagcccaccttcgtgctgccggatcacaagccgctccgcgccgggagcgcctgcgccgccgtgtccccgacgacgccgtccgcgtccgcgtcgttctcgtgggagtcggagagctcggacagccccagcagcgaggcgcctccgttctacgacttcttcggcgtccattctggaggccgctga

SEQ ID NO: 6123 - DNA, 624 bp, Oryza sativa
  Predicted polypeptide sequence is orthologous to G1537
tttttttttttttttttttttttttgcaataaattgagaaactgcatatttgattgttctatttcctctgtgctttgattggttaggatgtcattttctgatacattgccatcattcggttcaattttttgcccccagaccttgtactgacatgttgcttccataccattacgatacggctacacccagaaaaaaaaatcaagattactttcactttacatcagtacttgactaacttaatactttccctttcccaagtccaggtccaggtcaacgttcttgtgagttgtgattatccctgatgtggtgttttaattcatgtgcacataataggaggtttttgtgtcatgaatttatttccttacatgagaaccaagcagttcattttgcagagcccaaaggaagaacctcctctggtcaaacaatgcccccttatattatccctctgtgcctgattctcttcatcatccaagctagtcattccatgggagctcagatcaatgagacaagcattcctcaagggtctgaaatcaacacagctgtgccccaaagttgggtttcccctctaggggcattgcgcgtggggtttaaacccaagggggaggatttccaatggtgtgtcgc

SEQ ID NO: 6124 - DNA, 1170 bp, Oryza sativa
  Predicted polypeptide sequence is orthologous to G1538, G1545
gacagactcggacaccaccggtcacttgaattgtcaagctagctagccttctcatcagcctggctctcagtctcaaagaaagcacaaaggtagctagcttagcatcgattgaagctgaccagagagatagttaagaatttgccatagcttagtgtttggtgcatacacacaactgctctcgttgtttttgctcttttgggttcgctcggaagatgagccgtgaggaggatgagaagctgctgttcccttcgttcgccttcccggcggagtgcttcccggaagccgccacctccggtggcgagcagaagaaggctcggcagcggcggaggaggaaggtgaagccggaagcggcggcagcgttggctggagagagcggaggggatgagcaggcgaagaagcggcggctgagcgacgagcaggcgcggtttctggagatgagcttcaagaaggagcggaagctggagacgccgcgcaaggtgcagctcgccgcggagctgggcctcgacgccaagcaggtcgccgtctggttccagaaccgccgcgcccgccacaagagcaagctcatggaggaggagttcgccaagctccgctccgcccacgacgccgtcgtcctccagaactgccacctcgagaccgagttgctgaagctgaaggagaggctggcggatgtagaggaggagaaggcgaagctagcagctgtcgccgcggcgacgaccggcggcggtggtggcggcggcggcggcagcagcagcccgacctcgtcgtcgttctccacggtgacgtaccacccggcgctggcggggcagttcggcgtggaggcggcggccgaggaggccgacctcacctacatgagtgagtacgcgtacaacagctacatgctggagttggcggcggccggctactgcggcggggtctacgaccaattcagctgagcgccgccactcgccggggccggcgccgacggaggattaactagctacagtagctgttaattaatggatcgatcaattgcagggtagtaattcagtagtggtggtgtttattagtagtatcaatgatcgatatatcatcagtcgtgttgccctaacgaaaaatctttagcggtgactttgctaagccatgtagattattaaattggatgtctttgtaagtatatgtgtttagaatacc

SEQ ID NO: 6125 - DNA, 1173 bp, Oryza sativa
  Predicted polypeptide sequence is orthologous to G1538, G1545
cggacgcgtgggtggtggtgcgtggtcctcttctccatccagagacaatccagttcagttcagtttcctctctccctcctgtcctcacctcacgcttgacaagagagagagagagagagagagagagagagagagagagagagagagagagagagagagaaaggctgaactgagctgagctgatcgagctagtgtgcgagacggcatggaccgatacggcgagaagcagcagcagcagcagatgtttgcctcctacgtggacgcctccctcctagcagccagcggtgaggtgcagggcgagaggccgagagcgcggaggaggaggaggcgtggggcgaggtgcgttggcggcggcggcggtggtggcgaggtggacggaggggacccgaagaagcggcggctgagcgacgagcaggtggagatgctggagctgagcttccgggaggagcggaagctggagaccgggcggaaggtgcaccttgcctccgagctcgggctcgaccccaagcaggtggccgtctggttccagaaccgccgcgcccgccacaagagcaagctgctcgaggaggagttctccaagctcaagcacgcccacgacgccgccatcctccacaaatgccacctcgagaacgaggtgctgaggctgaaggagaggctggtggtcgccgaggaggaagtgaggcggctcagatcagcggcggggagccacacggcctccggagaaggcggagacatcatgggcttaggcggcagcggcgcctgcgtcgccgggagcccgagttcgtcgttctggacgggtacctgccagccgccgagtttcggcggcggagatcccttcggagacgatgacctggtgtatgtcccggagtacggcggttacgctgataacagtgtggttgagtggttcagcctgtatggattgatctaacgaagatcaagttgatgatggcatgtgcggggaatttagttagtcatagtgttaattaagctgtatggtgatcgatcgaactgatatggtcagctttaagtgtgtgtgtttaattatgtacataaagtgattaatggcaaaacctggccagctagctagtaatgtattaatattagtagttcgcttaaaaaagatcaagatgtgtgttcaaaaaaaaaaaaaaaaaaaaaaaaaaaaaaaaaaaa

SEQ ID NO: 6126 - DNA, 1482 bp, Oryza sativa
  Predicted polypeptide sequence is orthologous to G1539
ggtttctatttgattattactatgttcaattcgacggaatcttagaggaggaaaatccaaatgaatggatgattgatctaatcgcagctgatataccacctatgaggcacacggatgatcctggcgcaatatatgccaagtgctatgacgcggtgcgggtgtactcggtcgaggtgaagcaaatcaagtgtgggttgcggtggcctatcgaggtgtttggccatgtcgccgtgcgagacagcgtcgatcgcaagcgcaacctcgtcttcaatcgtggccgggacgattgccaaacgctcacggcggaggtgatcgatcgaccttacctcaaatcagctacctgaaaatttgctcgcacacgcacattattattgcaacatccagtgctaacgttgccttaatcagctctagctaaacattgctcacccttgcacaacactatttttctcccaagtttttcctgctaacgatgtcatcttgttatttgcgtggtacttactagttcttctgctgttatggttgtactagcttgagcaatatagatatgcagtacatactaccacatcagtattcagatagcattgcttttgtttcttagcatatgcgtgttaaatactctacagataaattgatgtcatctattaaaaaacggaggtagtacaacttaaagtagctacactatggttccccttgttttactgtgtttcatatttgaaaacaaatttgtcttggatcgaaatatatgtgtataacacatatggctgtaatcaatatttgcaggactcctctttggtgttaacagggcctagtcgatatgtcttggcaatggacaatccggactttgaagttgagctaaaggtcaagggaattgcggagactgaagacaaggttttgagctctcatgcctttacattcaactgcatctatgacgatggtagtagtgttaagaggcgcgtggcttccaacaagcgcagcacggtgcagatcacgtttgctttaattccagagacagtggaggcgacatttgaggttaaagtcgttgatgggtcattggatccttccctacgcccacatttctttgcttctactcaccaccatcccagcacggaatgtgtgttgcttgatcctcgagagggtgcaacggtgatcagcgacaataatagtgtcaaacttactcgatctgttgtttccgttgaagtgctggggggattgaagcttactgcagaggctctagatgatgaaaaagctgttgttcctaggacaacaattatcttcgaaccacaaagggatggtagagtgtatggatttcttgatcttaattgttgtaagatggtggttaaagtttcctggtctcgactttccatttgttgactgaacattattttgtagccggtgctatgttgatatgtaggaacttgtgctatccttttttatgattaatgttagctatgtactgatgtatatgatcttttgccatctact

SEQ ID NO: 6127 - DNA, 870 bp, Oryza sativa
  Predicted polypeptide sequence is orthologous to G1540
atggatcacatgcagcagcagcagcggcagcaggtgggtggagggggaggagaggaggtggcggggaggggtggtgtgccggtgtgccggccgagcgggacgaggtggacgccgacgacggagcagatcaagatcctgcgggagctgtactacagctgcggcatcaggtcgcccaactcggagcagatccagcggatcgccgccatgctgcgccagtacggccgcatcgagggcaagaacgtcttctactggttccagaaccacaaggcccgcgagcgccagaagaagcgcctcaccacgctcgacgtcaccaccaccaccgccgccgccgccgacgccgacgccagccacctcgccgtcctctccctctcgcctacagcagctggcgcgacggctccctctttcccgggcttctacgtcggcaatggcggcgccgtgcagacggatcaggccaacgtcgtcaactgggactgcaccgccatggcagccgagaaaaccttcctgcaggactacatgggcgtgagcggcggcggcggcgccgccgcggcggccccgacgccgtgggcgatgacgacgacgactcgcgagcccgagacgcttccactcttcccagtcggcggcggcggcggcgacggcgcgcatcgtcacgccggccacggcggtttcccgtccaacttccagcgctggggttctgctgctgctaccaccaacaccattacggtccagcagcatttgcagcagcacaacttttacagcagcagcagcagccagctgcacagccaggatgggccggcagcaggcacatccctggagctcactctcagctcctactactgctcatgctcaccttaccctgcagggtccatgtga

SEQ ID NO: 6128 - DNA, 1174 bp, Oryza sativa; identical to SEQ ID NO: 1973
  Predicted polypeptide sequence is orthologous to G1543

SEQ ID NO: 6129 - DNA, 742 bp, Oryza sativa
  Predicted polypeptide sequence is orthologous to G1554
aatattctcctcacataagaataattcttttcgacatcacaatttagcccaaaaattatacaatgtgatgtaattaacacctctcatattctcaaaccctctacaacaacaactcaaattactcacatgggtaactcccgtacttaatctcatcctccaaaaaaaaagcccaaaaaaagctctcaaccactgtacagaaataggcctaagttcttcggtcactgctgctgtgcagcacctggagacaattaattaatggtgctcaagatgatgatgatgcccttgccccattctgcatctcccagctatagctccccgacttcccgtcctcctcttcctcctcaccgccgtcgcagctatcgccggcggtcactgacacggcgtggctcgacgacacggtgagctggagggggccctgcggcgagccagactgcgatgtgctgtgctgcgaggtggtgtattgctccggtggcagcggccatagacggccgccaaccgtctgatggtcaccgccaccatcaccgccgtcggatgcccgccgcgtgtgcagccggtacttctgcaggtggcttttgacttcatcattagtgaggccatcaaccttcatcagctccctaatctgcttgggagttgcagcttgtgggccaccgaggcgctggagcgcggcgacgaaccggcggtggagctccggagaccaacaccgtctggccttccgttgcaccgcctgctgccgctgcgctac

SEQ ID NO: 6130 - DNA, 1947 bp, Oryza sativa
  Predicted polypeptide sequence is orthologous to G1554
cttcttcgtcttctgacctaaccctagacgaccaccaccatctgacggcggtggctgcggcgtcggggcaggcgacgcagaagcttcaggagttcttgtcacgtctcgaggaagagaggctcaagatcgacgccttcaagcgtgagctccctctctgcatgcagcttctcaatcatgctatggaggcgtacaggcagcagctggaggcgtaccagatggggagccagcatagcgccgcggcggcggcggcggcgagggcgccgctggtgctcgaggagttcataccggtgaagaacatcgggatcgacgtcgtggcggcggataaggcggcggcggcggggggcaacagcgtgtcgtcggagaaggcgagctggatggtgtcggcgcagctgtggaacgcgccggcgtcggcgtcggcggcggacacggcggcgaaggggccccagacgcccaaggagcactcggagcaccacccgctcgacacgagccccaagctgatcaccgccgccgcgctgccggagctcgcgctcgcgcccgcggagaaggcggcggacgcgatcaccatcgccgccggcgaggtcgacaagaagccgtacgcccacgacaacggcgtcgtggcgagatcgagagaagcccagaacggcgggaagccgccgtcgacgccatcggacgggcaggccgtcccgccgccgccacagccccaccggaaggcgcgccgttgctggtcgccggagctgcaccgccgcttcgtcaatgctcttcagatcctcggcggcgcccaagtggcgaccccgaagcagattcgcgagctgatgaaggttgatggattgaccaatgatgaggtgaaaagccatctccagaagtacaggttgcacacaagacggccgatgccgtcgccggcgccgccgacggcagcgacgccgcagctggtggtgctgggaggcatctgggtgccgccggagtacgcgacgcaggcggcggggccggccatctacggcgcgcacccggcgacgcagccgcactacacggcggcggtggcggcgcaggagtactaccaccaccaccaccaccacctgcagcaccaccccgccgccgccgccctggtgcaccaccgcgccgtagccccgcccccgccgctgccgcctcagcagcagctggcccctccctacagcgccaagtcgtcggcgtcggcgaggctcgggtccccggactccgacggccgtggcagcggcggcggcggcggcgccgccgcctccggagccggaagggacatgtccgagagcatcgaggaggaaggcgagggcgaggagcgggaggacgacgacgacgacgacgagatggcggcgaccaacaacgcccacgccgtcgacggcgacgacgacaacgacgagatcaacaccaccaccaccacgagcgcgggagcgattaactactaattaatcaaccaaaccaaccaatcaaatcaccacgcgtcgtaattaattactcattagtaataatactagctagtagcttaattaatcgcgctaatccgggagattaattagcgtcacctggaaaaagggaaaagtgattttttgttggcgcgcgcgcgcggagaacgggagccgagccgagccgagccgaccagagaaggagcaggagcttgagcttgtctcactcgttgatgtgatgcatatgtatggaactatggatcgatggataatgtgagggctttactttgcttttgcttttgctggtttttttttctccctcttgtttttcttccttttttgggactctcagctgttcctgatttaataatccggtagtactagtagtaaatatcaaaattatgtgatggtggagagattaaatatgagctagatgtaattgtttgggagattatgtttgttgttgttgttaagttgagaattgtgaagagccaccaataatgcataatgcagg

SEQ ID NO: 6131 - DNA, 1473 bp, Oryza sativa
  Predicted polypeptide sequence is orthologous to G1554
gattaatccgtccacaatcaaaccacttccatctctcaattctcaagcacacacacaatccaacaagcttctcgaagaattctcgatcgaggtggagtggtggtgtatgcgcgatggggctggatgtgggggaaatcggcgtcggcgcggcggacctgagcctggatctcaagatgttcgccgccaagagcttcggccgcgtcaggggcaaggacaccaccaccaccgccatgggtgactgcatccggaggctcgaggaggagatgggcaagatcgaggtcttccgccgcgagctccccctctgcgtccgcctcctcgccgacgtgattgatgtgatgaaggaggaggtggagaagaagggtggtgatcgtaaggaggatgaggaggacgccgccggcgacaagagcaactggatgagcaccgcgcagctctggactgggaattccggcggcccagacgccgccgccgctgatccagagaagcaggacaaggtgaggatctcgtcggaggcgaagtccaacggcggcgcgtttgtgggctctggcgcgccggctttcgcgcggccgaagcagagcttgatgaggaaggaggacatggcgtacgacgtcaggatgccggatctgtcgctgctctcgccgcctgcttccgccgccgccgccgacgaaagccgccgtcaggtcgtgggcttctcccaggccgcggcgagggctgccgccatggcggcgtctggccccgctctcagcctccagccccagcctcagccggcggcggcgcagcagcagcagcaggcgaggaagacgaggcggtgctggtcgccggacctccaccgcaagttcgtcgccgccttgcagcaactcggtggccctcaagttgccactccaaagcaaatcagggagctgatgaaggtggatggactgacaaatgacgaggtcaaaagccatcttcagaagtaccgcctgcacaaccggccgagagtgccaagctcaacaattgtgaaccaaccgattgtgctcatgcaagggctctgttacattcctcaagagcaaagcagctcccagtctggatcccctgagggtcctctccatttctcaggctcaggcatggccggtggcggctcatcggcggcgacggtcagctgcgaggaggaggatggcaggtctgagagctatggctggaaatgatccaagatgatgttgcatcagaaattttcatcacagctttggtgggttaggttaattgcggcgcggcgatgaaaaataataccagatcttcagggaggagtttgagaggagagactagtgtaggtgtttgtatacagtgagatcgagccttgagtgcttgagatgaaactgatggtgagttggttgttgtcatgtatatcgaaagagatgatactagctacagttttgcggcgagttttgccggttaaaggattcgggcagagctacagttttcgccctgagaattttaccc

SEQ ID NO: 6132 - DNA, 2217 bp, Oryza sativa
  Predicted polypeptide sequence is orthologous to G1560
cggcgtgatggacctgcctcgtccaatggagggcctcggcgaggccgggccgccgccgttcttgtgcaagacgtacgaggtcgtggacgaccccggcacggacaccgtcatctcgtgggggttcgccggcaacagcttcgtcgtctgggacgccaatgcgttcgccgccgtgctcctcccgcgctacttcaagcacagcaacttctccagcttcgtccgccagctcaacacctacgaaggtcgatccggatagatgggagttcgcgaacgaggggttcttgcgggggaagaaggagctcctgaagacgatcaagcgacgccggccgccgccgtcgagccccccgtcgtcttcgtcgtcgtcgtcgtcgtcgcagcaccagcagcagccggcggcggcgtgcctggaggtggggcagttcgggcgcgacggcgtggtgaaccggctgcagcgcgacaagagcgtcctgatcgcggaggtggtgaagctgcggcaggagcagcagacgacgcgcgcgcagatgcaggcgatggaggagcgcatctcggcggcggagcagaagcagcagcagatgacggtgttcctggcgcgcgccatgaagaacccgggcttcctccagatgctcgtcgaccggcaggccggccagcacggcgcccggaacagggtgctcgaggacgccctctccaagaagcgccgccgccccatcgagtacctcctcacccgcaacggcgagacctgcgccgccggcgagtcggcagctatgctggcggcggacggcgtggcggagccggacggcgacaccaccccgcgcggcgacggcggcggcggcggcggcggcgacaccgagagcttctggatgcagctgctcagcctcggcctggaggagaagcagcgagaggacggcgtcgccggcggcgtccaggagagtaacagcggcggcgctgacgtggacaacgacgaggaggatgacgacgatgacgtggacgtgctcgtgcagagcatatatcacctcagccccaagtgaaaggtcgagaaggttccacggcgaaaacgaagggtacgtttcgtttcgtagggtgacgtaatcgcaacagtagcgagtagtaggaatgtaggggtagcactgcacttgtctttctttccatttttttatagtttcggacatcttgtcgccgccctgcaagttgccaaaaaaagcagccaagccccactgccacaggcgacggaaggttcaagaagtcgagaagcttctcccgcgggggaagcttctagaggtgtccagtaagacagcacagtagctgcgggtgttcaagaagctgggaagcttctagatgtcctctaggacggtggcttcgaatgttcttcttctggaatttgcacctagtatcagctaattatgtgcgctgtattttgcccatgctactgccatatgcaactggtgcctcttatcccccaacagctactgctgcccttttaaaatttgaaagttacggagtaatttcagctgatttttaagtttcttcattagtagtttactttctgtattggttgtcaaatcttaaataaagttctacttataaatatcttggctatactagttcattttccccttgtcttttgtcatggaaggctgcctgttttgtcgtgtggtgacagttctgaacttttcatctatactggagtgctacgtggagtatatacatacaaagtgctccattttgtttgagccgtgccgtgagcgcgtgtccttgaccagggaaaaaaaatgttttgctttcaggttgcagaggacaagaggatgtcggtgccaaagatattttcaaacatactaaccgaaaagggcaccaaaatatcatcatctgaagatcttaacagtatcaagaaagtggttcccagctcatcaaatctaggagtactacgtggtaggagtatcaggctccacctgtacctggtgtcttaattaaggaaaaaagaacagagaaacgctcggagagatgattcagaagcttgacagcgagtatttcaggagtacgggtgtcgcttgctgcgagatttcacaacaggagactgtctgtcacggcgttgctgtaccacctctttaaaatggatcgtgggacaggacagttgacacgtagagtaacactcgtactacccgtttccgctaaatgtcaaaatcttgtacggagtactatctggattaaaattaaagtttatctatg

SEQ ID NO: 6133 - DNA, 2561 bp, Oryza sativa
  Predicted polypeptide sequence is orthologous to G1560
gagaagcttctccgcggccagtggcgacgctaccctacgcggcgtctagaaccttccacacctctcccgacgcctctcgacgtacggcgagggtatttttatctctccgaccaccctccgccctcgctcttcttccccccgcacacgaagaatttctcgcttcgtttcatccccaccattttttttttgtttgacctcgaaagggaaagcagaagaagaaaaaaatatcccaaaatatccccgaaattccaccacctgtagcagcagcgatcgcgtgtgttcttggttccaattcgtcgcctgatactccgattcgagttcttgatcaaagttgctggggttaatttgggttcttggttgtgaaaggcgggagggggggtcatggacccggcggcggcgggcattgtgaaggaggagatgctggagtcgcagcagcagcagcggcaggaggatggcggggcggcgccgcggccgatggaggggctgcacgaggttgggccgccgccgttcctgacgaagacgtacgacctggtggaggacccggccaccgacggcgtcgtgtcgtggagccgcgcgggcaacagcttcgtcgtctgggacccgcacgtcttcgccgacctcctcctcccgcgcctcttcaagcacaacaacttctccagcttcgtccggcagctcaacacctacatggaacaagatactggatgaagtacaagaaccagattgtttttgttctagaagactcaactgatcaccttcaaatgatataatatactgatgggcttcagaaaggtcgatcctgataggtgggagtttgcaaatgagggttttctcaggggccaaaggcatctcctgaaaacgataaagagaaggaagcccccgtccaatgcacctccgtcacaacaacagtccctcacatcttgtctggaagttggtgagtttggattcgaggaagaaattgacaggctgaagcgtgataagaacatcttgatcacagaggtagtaaagctaaggcaggagcagcaggccactaaagatcatgtgaaagccatggaagataggctacgagccgctgagcagaaacaggtccagatgatggggttcttggcaagagcaatgcgcaacccagagttcttccagcagttggcacagcagaaagagaagaggaaggagcttgaggatgccatctcgaagaaaagaaggcggcctatagacaatgttccattctatgaccctggggaaacaagtcagactgagcaacttgattcgccgtatttgtttgattcaggtgtgcttaatgagttaagtgaacctggaatccctgagctggagaatctcgcagtgaacattcaggatctggggaagggtaaagtagatgaagagaggcagaatcaaactaatggtcaggcagagctcggagatgacttctgggcagagctgttggttgaagatttcacaggcaaggaggagcagtcagagttggatggcaaaattgacggcatcgacgaactggctcaacagttggggtatctgagctctactagtccaaaatagagttgattttgtgattgttcatccaacaactactgctgcttcagtgcttttgaagatcatcttgaacaaactggaatgttggctgtgtacatccgtttggatgtagaggccggtttaatccattatctaaaaaaaatctgcaggaatgtggattagagtagtgattggatctttgccatcggggctgaatattgataatgccgatttttcattccattttttcgaatatatgtttctccatttcagccctgctacttgcttctgaattgctctgttgcttgttaaacagatccaattgactagtggaaatatgaccaactacggaaggtgttcatggtgtttcccagactatggacgccactgtctagaagctgtataaacagtctgtttgccgagcgcgggtggaggcgatggccgggaaggcggcgacggcgacggcggcggaggcggcggcgagggtttacccgtggagggagaagcttgcaaagtacaagggggagctgacgaagggggtgtgggggtactgggagctcggggcatggaagccgctcggcctcagcgcccggaagcgggcgcgcctcaggaaggaggtcctcctcgccggcgaggactggacctacgaccctccccgcggcgagatgcgcaccaagcggaagggccacaagtgcgaccgcatctccgccgagaagcgtgcgaacacggttgagctgatgaagaagatgccccagatgctccttgactacaagaaacgtagatgggagaaaaagatgaaagaggaggagagtggaaagagctgagctcaagctactcgataagaatgctgctctgcctaaataagtttgaatctgatatagtggcttcaaatgatggctggaggtgatctgtttctttcccttgttggccaccagctttcctgctgcctaaggcactttgtagtgctgatatttgattgcttctatagttcccaacacttgggtcaatgaatcatgatcttacccaggctcaacttc

SEQ ID NO: 6134 - DNA, 1994 bp, Oryza sativa
  Predicted polypeptide sequence is orthologous to G1560
gaattccactgcttccagaagcgagcgagctctcctttcctttctcctacgcctaggcttctagaagcttcctttccaaataggggctaatctcctgagctcgaagctctcctcgtcagcttcaggtggtcgggtgctgcctcctcctcctcctcctcctcctcctcgtcctcaaatctccccgagagttcgtgctttgccgcgagcagcgagctgcgatctcgcctgaatccttcgtcggcgggggggatgaattgatcacgcggtgtgcgctttctgattctgtcgggttcctttcagatgcacgagcacgtcggtgtccgcctcctctttgcttgatttgcttccgctgctgctgttaggtgcgcgagagctcgtgatggggtgaagcgtgtgttcacaggattagattgcgctcgcctgattcgctgcatcttgttcttcttgctgccgcctacgcgacttgatttcgtcacgccaaagccgtgacaggctgattgctaccttgcttggcgacctgtgctttaaattccaccattgtttgctggtgctggatgagcaaattcttggttcgtgtggctctagttggtagttcttgattgaggtgaggttctgagctgccatgaactaccgagtggtgaacccggtgaaggtggagagcgggccgtcgacgggcgtggcgaatggccagccgccgaggccgatggacgggctcgccgacggcggcccaccgccgttcctcaccaagacgtacgacatggtggatgacccgaccacggacgccgtcgtgtcgtggagcgccaccaacaacagcttcgtggtgtgggatcctcacctctttgggaacgtgctgctgccgaggtacttcaagcacaacaacttctccagcttcgtccggcagctcaatacctatggcttcaggaaggtggatcctgacaagtgggaatttgcaaatgagggttttctgagaggacagaagcatctccttaaaggcataaagcgtcggaaacctccgaattcatctccaagtcagcaatctcttggctcattccttgaggtagggcacttcggatatgagggagagattgatcagttgaagagggacaaacatctgttgatggctgaagtggtgaagctgaggcaggagcagcaaaacacaaagtcagacctgcaagctatggaacagaagctacaaggtactgagcaaaagcaacagcacatgatggcattcttgtcacgagttatgcataatcctgagttcatacgccagctgttctcccagagtgagatgaggaaggagcttgaagagttcgtctcaaagaaaagaaggcgccgcattgaccagggacctgaacttgatagcatgggtaccggttctagccccgagcaagtgtcacaggtaatgtttgaaccacatgatccagtggattcacttttcaatggtgttccatcagatcttgaaagttcatctgttgaggccaatggaggcaaggcgcaacaagatgttgcttccagtagctctgaacacgggaaaatcaagccatctaacggagagttaaatgaggatttctgggaggacctgctgcacgagggtgggctcgatgaggataccaggaaccccgctatagatgatatgaacttgctgtctcaaaagatgggctacctcaactcaagcagcaccaaatcgccacagtagtagctctggtctgatcttgctgcagctccaacgacccttgagtacttgttaatcaagcttgtcattatacttatccgctttgaggatgatcaatttgagtaggtctcctcccccatggtgatgatcttatggtagcatcagctgtacatactattgccgcaataattaccatcgtattctgttcagctttgtggaattagttttggatctgaatgtatggtactttgacagtggacttgagggtgctgtatgtacatataacagtctaactaaatgcagttgtgcgttgtaatgatgt

SEQ ID NO: 6135 - DNA, 2272 bp, Oryza sativa
  Predicted polypeptide sequence is orthologous to G1560
ggctgccaagctcgccggattcttttcttggattggagcagattggggggtgacgatggagaagatgatgccggggatggtgaaggaggagtggccgccgagctcgccggaggagggggaggcgccgaggcccatggaggggctgcacgaggtcgggccgccgccgttcctgaccaagacgttcgacctggtggccgacccggccaccgacggcgtcgtctcgtggggccgcgcgggcagcagcttcgtcgtctgggacccccacgtcttcgccgccgtcttcctcccacgcttcttcaagcacaacaatttctccagcttcgtccgccagctcaacacctacgtgagtccccccaatttccattgccaccactagtgttgttccctgcttgtcttcagttgttgggaaattgtgtgttctgttttcttgttttggatgttgttgttcagttcttggtccggacgaattacctgaacaagcgatcacatttctacagtttgagatttcaggttggattgttagataattaaaatgggtgtgttctcacttttgtggttgccattatgttttgtgccacatcgtgtgtgttgagtattgataggaatcttgacactagaattaaatggatggagcattgtaaaattttcagtgcaaattgtaaacccggcggtattggttaaataaatcggttgtattgtgcatttttccactcagtgcaagaactttgtgcatgcacaaatgcacaattatgtagcaatggagctagaaactgggatttacttattggtgctgacctgttggttgtagaaaattacgatggctacaattgttcaacggactgttttgtggacttgacattatttgcccaaactcagctatgtccaatccttttcagacacatgcatataaaccctcaattcctgaaatgttctcaatgattcagaaagaggaaaaaaatctccatggacgaactactcagtttctgacatgctgttttcttcaatttgttactgtgtagctagatggatcaagacagcggatgaagctacaagaatctgcttgtttgttctagaagactcctttgatcaccatcaaaaaaaagaaaaagtgatgtagtatactgctacctgttctcttaataatgctatgataaattttgtcgcaaaactatgtgaaaccaaccgttttacatactttgtgtgacttgctatcctaattgagttttgtctgtggcttctgtacttgaactaactatacctgtaatattctttgtgtttgcaatttgcagggtttcagaaagattgatcctgacagatgggaattcgcgaatgatggtttcctgagaggccagaggcatcttctaaagatgattaagaggaggagaccattgtcttatctccctggatctcagcaggcacttggcacctgccttgaggttggtcagttcggattagatgaagagatcgacaggctaaagcgtgacaagaacatcttactcgcggaggttgtgaaactaaggcacaagcagcaaagcacgaaagccaatatgcgagccatggaagagaggctgcaacatgcggagcagaagcaggtccagatgatgggtttcttggcaagagcaatgcagaaccctgacttctttcaccagttgattcaccagcaggataaaatgaaggggctcgaggacacattctcgaagaagaggacgaggtcgatagacatagtgccatttctcaaccccggggaggtcagccagggcgatcaactcgagtcgacattgctgtttgatccaaggccatttgctgaactgaatgatgagcctgcaaagtctgaactggagaatttagcactgaacatccagggtcttgggaagggcaagcaggatgtcaacaggactcgaaatcagccacgaaatcaggctagcaacgaaaccgagttaaccgacgacttctgggaggagcttctgaatgaaggagcaagagatgatgctgggattccagggatggagcgaagaagacctagatatgtcgatgcattagcgcagaagctgggttatctaagcaatagtagccaaaagtagatcaagtggctccgatttgtccaaccatttttgtgatagctcttattgtatatcggtgtaattgtattatagtgatagttttatagcgataggtccaatttatattgcggatccggcgtgctgtgtagtatatgtctggtgatgtaaagttgagccatcattcttaatggtatatattgacaattttttgc

SEQ ID NO: 6136 - DNA, 1956 bp, Oryza sativa
  Predicted polypeptide sequence is orthologous to G1560
gcagtagcattcaccttctccgccctcccccctccgccgcctccgccgctcccccaccttccagaaccttcctttcccgaaatagccacccctaccctaccctaccctacccacccccgccaagatccccgccgccggcgagctcgagcccttggtggtgctccggcgggcgttgtcgcggtcggatcagctgctgctggtgctggtgatgccgctctctctttcttgcgtgtacttccgggtgggaggttgatggcgatggtgaggtgttctttggcgcggttgccctcgcccccactcttatctcctctcctcgcccatgctacctaccttcctcccccgccggagctgctctgctgctcgtactagcgtgggagctgcctcttcttgttgagccatttcttgcctacaaggacagggtgcctcgccgtcgccattgccggcgtcggagccggacaaggaggttcagtgtactgtaccgtggttttgggccttctgagctatggatgatccaatgctgaatgcggtgaaggaggaggagagccacggggacggaggagggttggaggtggtggcgggagaggatggggcggcggcggtggcggcgggggtggcgccgaggccgatggaggggctgcacgacgccgggccgccgccgttcctgaccaagacgtacgacatggtggacgacgccggcaccgacgccgccgtgtcgtggagcgcgacgagcaacagcttcgtggtgtgggatccccacgccttcgccaccgtcttgctccccaggttcttcaagcacaacaacttctccagcttcgtcaggcagctcaacacctatggtttcagaaaggtggatcctgatcggtgggaatttgcaaatgagaattttctgcggggacagagacatcttctcaagaacatcaagcgtagaaaaccaccttcccatactgcttcaaaccagcaatcccttgggccataccttgaggtgggccactttggatatgatgctgagatagaccggctgaagagagacaagcaattattgatggctgaggtggtgaagctaaggcaggagcagcagaatacaaaggcaaatctgaaagccatggaggataggctgcaaggaaccgagcagaggcaacagcagatgatggcattcttggcgcgtgtcatgaaaaatcctgagttcttaaaacaacttatgtcccagaatgagatgagaaaggagctccaagatgccatttcaaagaaaagaaggcgtcgcatagatcagggacctgaagttgacgacgtcggcactagcagtagcatagagcaagagtcaccggccttgtttgatccccaggagtcggtggaattcctcatcgatgggattccctccgatcttgaaaactcagctatggatgctggaggtctggtggagccacaggatttcgatgtcggcgcctccgaacagcagcagatcgggccccagggggagttgaacgacaatttctgggaggagctgctgaacgaagggcttgttggtgaggagaacgacaacccggtcgtcgaggacgacatgaatgtgttgtcggagaagatgggttacctcaactcaaatggcccaacggctggggaatagctaatttcattcaaattataccacattgctgtcagctttcgccatgtgaatttaactgaattttagttgaatttctgcttgctactggcatgcctccctccctgtgttactgaccgtagtgatttgttcgttgttaggccatatagcctgccagtcatgtaaaatgagtaaaggtgttgatgatccacaaatgttctgttccgtgttgtcagatggtctgcctgtatttgtagtcgtgcttagtgtgtgcaatgttgtaatgatatctaatattaatctgtacttctcgtaatgacatctgatcttaatctgattgcagaagtgctttgaattgc

SEQ ID NO: 6137 - DNA, 328 bp, Oryza sativa
  Predicted polypeptide sequence is orthologous to G1591
taatgataatatatatataatataatgatgataatgatgatgatgatgatgatgatgatatgatgatgaactgttgcagctgatggatttgctgattggctggcaaagcagctgggcaatgatttggctgcgagaaaaggaaggagtttgcaactgtgggattacatgctggtgaagtatattagcatggagtttgctatacatggaataggatacctgttatatctatgtatttccaaggattattgtgttgaggctctgcgacaatattatcagatgaataccagtagccctgtgctcgtttgttaacgtaaaaaaaaaaaaaaaa

SEQ ID NO: 6138 - DNA, 612 bp, Oryza sativa
  Predicted polypeptide sequence is orthologous to G1591
atgcctcagaccccttcgacgcggtggtgcccgacgccggagcagctgatgatcctggaggagatgtacaggagcggcgtgcgaacgcccaacgcggcagagatccagcaaatcacggcgcacctcgcctactacggccgcatcgagggcaagaacgtcttctactggttccagaaccacaaggcccgcgagcgccagcgcctccgccgccgcctctgcgcgcggcaccagcagcaaccctcaccgccctcctccacggtgcctccggctcccactgctgctgctgccggtgccgtcgtgcaggtgcaccccgcggtgatgcagctacaccaccaccaccaccaccatcacccatacgctgcggccgccgctgcccaaagtcatcacctgcagcagcagcagcagcagcaagctgagtggccggcggcggtggactactgcagcactgcatcggcgtcagcgtcggcaactgctgctgacatggcgatcccgccgtgctgccggccgctgaaaacgttggagctgttcccgaccaagagcaccagcggcggcctcaaggaagattgctgcagcagctccaagtcctcctcttgctccacctccaccaattaa

SEQ ID NO: 6139 - DNA, 2016 bp, Oryza sativa
  Predicted polypeptide sequence is orthologous to G1635
gattttccccttcctgccttgcctcctcgtctccttctctgctgctctccaagctcttcctgcttccatcaggttgtctcgagaaagattggagtttttggtggtttgggttgtgcggttcttgcttttgttggcgcaagcgcatggctggttctgggacatagtgagctgagatagagttcttgtgttcggtggagtttggctttggtgaatcttcgattcaagtctggagatggcgcgttttcaggaaaccaaggcgaggaatgatcaaggacctgttgctgatcatgttgggcaccgaaacctcatggaaaacctcacagatcctctggattccagtggcatggacatgatggacgaagcgcgaattcctaaggcgcggaagccatacacgataacgaagcaaagggagaaatggaccgaggacgaacataagctgttcttggaagccctgcagctccatggccgagcctggcgacgcatccaagagcacataggcaccaagactgccgtgcagatcaggagccacgcacagaagttcttctccaaggtcatcaaagaatcatctggggacaattgcaacagcttgggtgctgcatcatcaattcagattcccccgccgcggccgaagcgtaagcctgttcatccgtacccacgcaatctagggagcacagccagcaagaacgtccctgcactgaaacagctagagaagcctcagctgcaggtgcagtctctctacgaccaggacaatgggtcgccgacgtcagtgttaacagtaccacagatacgggctgatacactgggaagtgagagtggtgggtcgccaacctcgacgattgatattgaagagagatgtcctacaccaagcatagcaactgctgagttagctatggagttgcctcctacaaatgacgaggaggtcaagggcaatggcgatcatgaagaagttacatgtgacagatcaggagttccagtccttaggctatttggcaagagggttatggtgaatgatttacatcagatgtcagcccctgatgccgggaacctgcaaactgtggcagacatggaagtggacgcttcagctgagacaccaactagtggaactgggaaattctcttcccatggtgcagcagaagcaaatacatggaacccatggctgactaacacacagcagtttctgtattatcttcctaacggacaaattttctccgtgcattctgctctcccatgcttcacctaccataatgagggtgttacttgcacccagttttcaaacccacaggtggtagcctcagatcagcagcatcaacaccaaacttctgaagctgtagattacaagggtatacagagggaaggatcttggacggagtcaaatacatcctcaagcagtgtgcctgaaacagcaactcataattcagagactacagaatcatatagaaacggaaacagaaacgaagatgaaatggtaccttctccagattcaagaaaatgtgtgagcccaggttccaactgcaggcgaggctttgtgccgtacaagagatgtgttgctgatagtgaggcgctgctgaagtcacaggcgcctcaggaggaggcagacggagagatgacgaggctgtgcttataaatttttggagcctcgtagatcactgcaactatagatgcttgctactaatattttgttcacagatgagtaggaactgatgtactgcaggaggggctgctttcctgttacaagaggcagattgaaaccgcgttagtactccacaaaacagggagtggccgtggttcttgtctggccatgtacagttcaaatattctatgtttccattttcctcgtcgtgtgtttgtaatttcgctcccattgcgggagcgttcagaggtcaatggctgtcatgcaatgacaagtattttgatagagttgtagaagggttgtactgatgtaaattatacagtaacttattatctgtaagacaataacaggcgagctaaagaaaacaacgttggaaagctttgttc

SEQ ID NO: 6140 - DNA, 1146 bp, Oryza sativa
  Predicted polypeptide sequence is orthologous to G1635
atgggtggggactgcaaggactctctgaagaatcgcatccggatattcactgaagcagtagtggtcatggtatgcccagtccttctctcgttcgcgctaaagaaggtggacctgacggccaatcgaagcaaacaaatcgtggacagcatttccccgattggagcgttaactctggaagctggcatactccctttcctcggcctctgcctctccacggtgctcggagagaggctcgcgtggctcgtattggcctcgaagctgctcatccacctatgtgtcattctcctcatggctctagcctttgtgattctgctgctcatcagcaagagtaacattgtctgcctaagcatctggatccccttcgtccccttcatcctatggctaggctacaactccgtgaaggatgaggagcatgagaacgccgacgacgccacgaaatcagcccaccacgggaagctggaaatctcggttgatttctctgctagtatcacctcccttctgttcctgggattaaaaggtcttgcgttggagggacaggccagcgccatcaaggggctggatgctcacctttccgactccctcatcgtcagtttcgtgacctgcgtcctgggtgtagtcttcatgcttgttggaacggctccaccggtgtacggcatgggccgcttggtggattccttgaggatcttggatacctctctggcaatagcgttcggggtgatcgtcgtgctaatcacaattgcacctctgaaggaggcggcgtggttagtatccatcccgtggatcctttcctttttcgtgtggttgttcatccgtttgttcgaccacgacgagggagaggacagggatgtgaagccggtgtctctagagctgaccaaggccgcgttcacagggttcttggccgtctccataccgagcttcagcaatagctccaccagcggcggctacacccacgctttcatagtgcttactgggtcagctgtcctcgctggcctcgcgtggaggctgatcacgcacgtgaagaagccgtcgcgagccatggtctgggctgaaaatgtagcttcttcgtgtgcgcacatctgtgttgcggcggctgttgttccatttgcaagcatatccatgacggtgctcaggtctctcgaaagttag

SEQ ID NO: 6141 - DNA, 2083 bp, Oryza sativa
  Predicted polypeptide sequence is orthologous to G1635
tgagtgcgacggggcctacgtaacgctcgcttctttgcctcctcgttcccttctcctcctcatctccccccatctcgtcgtcctcatcaacaacatcgaggagaaaactcgcaaagattgcggggtttgggaggcgctgattttttggctttggtgtggcgatcctgtggagtgtggtttggtttgggaggagttcggttttttcagaatggagatggcctgtttgccgggaaacgccatggcaaccgacgaaaacggtgccgacgatcgcgccggcggcgagagcaccgtggatcatctcaggagccatatgaactacggcgacatggatttgtcaggggaagagcacgtgccaaaggcgcgaaagccgtacacgatcacgaagcagcgcgagaagtggacggacgaggagcacaggctgttcttggaagccctgcagctgcacggccgcgcatggcgccgtatacaagagcacataggtaccaagactgccgtgcaaatccgtagccacgcgcagaagttcttctctaaggtcgtcagagaatcttcggggagtaacaccggctcgggcggcgcgtccgccgcggcggcggcggcggccatccagatccctccgccgcggccgaagaggaagccggcgcacccgtacccgcgcaaggtggacggcgcggccaagaagcacgtcccggcgctcaggcagctggagaagccgccgttgtggatgcagtccctgtccgagcaggaggagggctcgccgacgtcggtgctgacggcggcgcaggtaggcaccgaggccctgggcggtgggttctcgaataactcgagcggcagcgggtcgctggctccgtcagccgccggtacggatgagcatgtcgacggtggcggctcgccggcgtcgtcggtggacagagaggacgggtgcctctcaccgagcatcccgactgctgagttggctatgcaggcgccaaatactaagatgtcaattgcaaccacggatgccaaagaagcatcctcagaagcatcagtcttcaggctattcggaaagagcgtagtggttaaggattcagaccagctgcacctgcttaatggcagtaacattgcaacgagtggttcagttgagagagcaaccagaaacatactagtaccttcttttgctgctgccccagaagggagctcgtcgaatccatggccgagcagcatgcaacagtttctctacttccttcctcgatcggatggtttcgccgcgcaacctgtcatgccatggttgagctacaacgggagccttccatgcgcgctgttctacccggcggcggcggcggctgcgaaccagcagtgccaccgtgattcagagggcgtagagttcagagtctcgcagagggaaggatcgctgacgggctcgaacacggcctccagcgtcgtgcttggatcgtcggcggcggtaccggcggcggcggcggcggctcagaattcggacgtcgcggagtcccgtggccaagggaacagcagggaggcggcggcctcgccacggccgaccaagtgcgagagctcggcgtccgtcaccctgctgcagaggggcttcatgccgtacaagaggtgcgcggcggagagcgagctgctgcgatcggaggccgccggaggagaggaggccgtcgccgacggtgagctgacaaggctgtgcttgtgacaactgactcgtcgcacggacacgtcacgccacagtacttctattcgtaggtgacaaataacaaatctgacatgagattaaggcgggaagaagaggcatgtcctgctgttaggatgttgctcgagaccactttagttttccagaaaatggaagagcaattctggtttttactcgtcgatatagtattgtataatctgtaagataacaacttttgtacttttttttttactttgcctgtaattttatccccaactcgaatacgttcagagttgagtggctgtcaatgttgccttttatcaacctgaatctcggacaggggttgccataggctaactacatgtaatctaggcttgtatctctccacaaaatgcaatggaaagacgaggaaatgttggatgc

SEQ ID NO: 6142 - DNA, 2082 bp, Oryza sativa
  Predicted polypeptide sequence is orthologous to G1635
tagtgcgacggggcctacgtaacgctcgcttctttgcctcctcgttcccttctcctcctcatctccccccatctcgtcgtcctcatcaacaacatcgaggagaaaactcgcaaagattgcggggtttgggaggcgctgattttttggctttggtgtggcgatcctgtggagtgtggtttggtttgggaggagttcggttttttcagaatggagatggcctgtttgccgggaaacgccatggcaaccgacgaaaacggtgccgacgatcgcgccggcggcgagagcaccgtggatcatctcaggagccatatgaactacggcgacatggatttgtcaggggaagagcacgtgccaaaggcgcgaaagccgtacacgatcacgaagcagcgcgagaagtggacggacgaggagcacaggctgttcttggaagccctgcagctgcacggccgcgcatggcgccgtatacaagagcacataggtaccaagactgccgtgcaaatccgtagccacgcgcagaagttcttctctaaggtcgtcagagaatcttcggggagtaacaccggctcgggcggcgcgtccgccgcggcggcggcggcggccatccagatccctccgccgcggccgaagaggaagccggcgcacccgtacccgcgcaaggtggacggcgcggccaagaagcacgtcccggcgctcaggcagctggagaagccgccgttgtggatgcagtccctgtccgagcaggaggagggctcgccgacgtcggtgctgacggcggcgcagataggcaccgaggccctgggcggtgggttctcgaataactcgagcggcagcgggtcgctggctccgtcagccgccggtacggatgagcatgtcgacggtggcggctcgccggcgtcgtcggtggacagagaggacgggtgcctctcaccgagcatcccgactgctgagttggctatgcaggcgccaaatactaagatgtcaattgcaaccacggatgccaaagaagcatcctcagaagcatcagtcttcaggctattcggaaagagcgtagtggttaaggattcagaccagctgcacctgcttaatggcagtaacattgcaacgagtggttcagttgagagagcaaccagaaacatactagtaccttcttttgctgctgccccagaagggagctcgtcgaatccatggccgagcagcatgcaacagtttctctacttccttcctcgatcggatggtttcgccgcgcaacctgtcatgccatggttgagctacaacgggagccttccatgcgcgctgttctacccggcggcggcggcggctgcgaaccagcagtgccaccgtgattcagagggcgtagagttcagagtctcgcagagggaaggatcgctgacgggctcgaacacggcctccagcgtcgtgcttggatcgtcggcggcggtaccggcggcggcggcggcggctcagaattcggacgtcgcggagtcccgtggccaagggaacagcagggaggcggcggcctcgccacggctgaccaagtgcgagagctcggcgtccgtcaccctgctgcagaggggcttcatgccgtacaagaggtgcgcggcggagagcgagctgctgcgatcggaggccgccggaggagaggaggccgtcgccgacggtgagctgacaaggctgtgcttgtgacaactgactcgtcgcacggacacgtcacgccacagtactactattcgtaggtgacaaataacaaatctgacatgagattaaggcgggaagaagaggcatgtcctgctgttaggatgttgctcgagaccactttagttttccagaaaatggaagagcaattctggtttttactcgtcgatatagtattgtataatctgtaagataacaacttttgtacttttttttttactttgcctgtaattttatccccaactcgaatacgttcagagttgagtggctgtcaatgttgccttttatcaacctgaatctcggacaggggttgccataggctaactacatgtaatctaggcttgtatctctccacaaaatgcaatggaaagacgaggaaatgttggatgc

SEQ ID NO: 6143 - DNA, 1795 bp, Oryza sativa
  Predicted polypeptide sequence is orthologous to G1638
gaaggcccaatcaccagctgccactctcaagaacctgactttggatcgctatcccttttgcttcttattagtgctcagggaaagaaagctatagcagtagctaaataagccagagagaggctaagagagagagaggtgaggggagagaagaaatcctcgcagaattcgagcaagaaccgagggagatcgatcgcctcttgtcctcgttccgaggcagagatcgacctgaagtgagctgagctgcggcaaggaggaggaggaggaggaggaggagaaggagattggagatgatgatgagggatgtgtgcatggaggtgctgcctccgatggaccactacgcgtcgagggggaactggttcatggcgcgcaagtggtcgccggaggagaacaagcagttcgagcgggcgctcgccgggctggacctgcggtgcccggactgggaccgggtggcgcgcgccatcccgggcaggtcggcgctcgaggtcatgaaccacttcagggacctcgagctcgacgtccagcagatcgagaatggcatggtgcccttcccggtctacggcgccgccgccgccggcggcgcgttcacactgcagtgggatggcgcccatggcgtcggggacttcaggaacgcgtaccggttcggcggcggcggcggcgggaagcggcacttcggccgtacgccggagcaggagaggaagaaaggcgtgccatggacggaggaggagcacaagttgttcctcttaggactgaagaaatatgggaaaggggattggaggaacatatcccgcaatttcgtgcagacgaggacgccgacgcaggttgccagccatgcgcagaagtatttcatcaggctcaactccggtggcaaggacaagaggagatccagcatccatgacattaccacggttaacctgacggatgaccggcctccctcgccatcacagtcctccttgatcagcaatcagtccaacacatcaactctgaccgcagcggttgcccccttctcatcgacggccgatgtcaagccacagaatgccgcgaatgcgtccttcaattcgccaagccggacacttgggatggcgggttacgggatgggattgcaagatcaaggattgcagtgtggtggtcctctacatgatcagttggccgcgagccgaagcatattgttttagatgaaaccaatccaggcagcaccatggatcagatgtctagtgtaatattgccctgcttgtagcttcatcactacctgtattgaagtaattaattatggggaatttttcggaacataacagagggggtgtggagggatctttgtgccatgttggtgactgataacctgtgatccataattgttggcaatactgagaatgtaacgaaacgaacgtcaagaacttgatgccggtggtattttcagacagtgattgctgctagtgctgaacactgatcatgcatgaagtggactttgtattcaatcatggatccagcttttgtgaggtggatgaggagaattctattcactatgttcttctggtcagtgatgcactgagaaacaccggttgccatctgattgaggggtttcagatcatgctgtacttcacacatacttatccacagttctatcaatttgctcattggtgctccccccatttgatgtttgcatagaatttatttggataaacggaaaataagtttgctctgagtcattcagcattattactactttcagttgctcatctagtcaacttttcttgtttgtagcttcatttttataataaaataataacttctttttttt

SEQ ID NO: 6144 - DNA, 1527 bp, Oryza sativa
  Predicted polypeptide sequence is orthologous to G1638
atgatggcagaggcgcttcgggaggtgctaccgctgccctacttccccgggcagccgtgctggtacttgcaggagcggcgaggtgcggaggcgtggtcggcagaggagaacaaggtgttcgagagggccctcgcacaggtcgacctggactcgccgaacaggtgggagatggtcgccgcgatgctgcccaggaagacggtcatagacgtgatgaaccactacagggacctcgagaacgacgtcggctccatcgaggcagggctggtgccgttccctcactacagcagcagcttgtccccggcgtcctccgggttcaccctgcaggactgggacggcagcgacggcgggttcaggcgcggctgctacctcaaacgcggccgcgccccggaccaggagaggaagaaaggcgtcccgtggacggaggaggagcacaagtcgttcttgatggggctgaagaagtacgggaggggagactggaggaacatctcgcgctacttcgtgacgagccggacgccgacgcaggtggccagccacgcgcagaagtacttcatccgcctcaactccggcggcaaggacaagcgccggtctagcatccacgacatcaccacggtcaacctgccagaagaagacaccagcaacccctccccatcgccgccgtccgtgctcaccaccgcctcagaccagctcggctccctcgtggacacgaaacccgttcccccgccaccgtcactcggcgcgcaacggcacttcatgtcgccgctgccgggagcgctcggcgtcagccaccacccctacggcaacgtgaagctagagcccaatgcctcgttcttggccggcggcgatgcaatgcggacacttgtgacggcggttctcagcggcggagaaccgcacaaggaggaacacagagcaccgcctccgatcatatctacgggaacgacgaggctccggccaagtcgcagtcccgtgtcagtgtgtgattggctagccagttggttgcagagttgcttcatgcgtctcaggatcgcaaagtactggacggaagggccactaaccggttactgttttgatcaggaacaccagggctttccgagaaagagaaagcgaaaggctctgcttgatcgatgcgactatacaattcactgcatgaatctttcacttgattgtttgttcggcaagccgcaccgaccagcctcagccggaggtcagtgtatctcaacgccgacgccgtcggcgatcccgattcccgaccgaatgcatggtgaaataggagatcacagaccggagataaagtggcaccggtgctactgccgctttgtgttgtgctccagcgacttttgttcgtgcgaggtggaggaaagtgccagtactggcggtggtgcgctcctttccagcatttgctctgccattgggcacggcagggagagtgaaagcatcatcgacgccatcgcgcttttggggcgtcatgtccgccctcgccttcgtgcaaatattcagattctgcaaatggacgatataattgaggaataa

SEQ ID NO: 6145 - DNA, 857 bp, Oryza sativa
  Predicted polypeptide sequence is orthologous to G1641
cccccggcgcgccgcaacccccggcgaggaccggcacccggcgtaccctggtccgaagacgagcacagttgtttctcgaggggttggacaggtacgggcggggagactggaggaacatctcgcggttctcggtgaggaccgcggacgccgacagcagggtggcagacgccaacagcgcaagaagtacttgcatgcccgcgcaagccaaacgcccggcagccacagcagactgcacatagcgcaaagagcatccatgacatccaccaacccccttgaaccaggctgtcgggccggaccgggccgaaccaccccaaccccccccctgtgtgtcctgttgcccaaaaccttgcctttttgggaattttataaaggttggaaaaaaccaaagccaaagggggggttaaggccggaattggaaccggttggttaaccaattttaataatgcccttaaccaccccacccaaaccaattaagggccataagtttaaggttaaccttgtgccaaaaaacccgttttgttccacctttggggccttccttcctggaatcccaattaaacccgttggaaccggcccttaacctttgccccggaaaaccaaggaaggccttgtttgaaggaagccttcccgctccggccaaccaccggtttttggccttttaagtttttccaaccattaattaagaattaacttaattcccaagaacttaatggggttttaaccgtggccaaccttccgttcttaagttttgtgaatccaaggccgaagaagccccggttaatatggtttttgtgcctttgttttggaaggaatgaagcctgtccgaaaccatttaaccatagccaaaaaaaaaaaaa

SEQ ID NO: 6146 - DNA, 1988 bp, Oryza sativa
  Predicted polypeptide sequence is orthologous to G1641
gacgcgcacacgggcgaaaccccaaccaagctcctcctcagctcagcttctcctgtgctctgccctcctcttctcgcaggagtgagagaagccgaggaggaggaggaggaggcttttgtttggttgagacgccacaaactccaccaagggccaatcaacgaacgcctcgatttcttttaagcggcgtctcaaggtggaggccgaatcatctgtggccactttggcatctgccggaatcgatgctgtagcatccataaataccgcccttctctgccgccccccatctcccctccccctcttcttccacctcccaagagctcgcttttgagaaagaaaggtgaaaaatcttggtcggttggcccggccagccagccagccgcctcgcggtcgcggagatgatgaaggagtcgtacatggaggtgctcccgccggcgccggcgcactacttcgtcggccaggctgcggcggcgggcgggtggttcttgccggaccggcgcggcggcggcggagcgtggtcgcaggaggagaacaaggtgttcgagcaggcgctggcggcgctcgaccggaacgacccggagaggtgggagcgggtggcgctgctgctgcccggcaagacggtggccgacgtcatgacgcactacgacgacctcgagaacgacgtctgcttcatcgaggccggcctcgtccccttcccccactacggcgccgccggcggcggcggcggctccgggttcactcttgactgggacggcggcgatgaccccgccggccttgggttcaagcgctcctgctacatggtcggcggcaagcgcgcgcgcggccctgaccaggagcgcaagaagggcgtgccgtggacagaggaggagcacaagttgttcttgatggggctgaagaagtacggcagaggtgactggaggaacatctcccgcaacttcgtgacgagccggacgccgacgcaggtggccagccacgcgcagaagtacttcatccggctcaactccggcggcaaggacaagcgccgctccagcatccacgacatcaccaccgtcaacctccccgacgacgaccacggcaacccctcgccgtcgccgccgccgtccgtgctcaccgcgcactcctcctcctccgccgccgccgtctcggagcagttcggcgtgctcgtcgacggcaagcctccgccgccgccgctcggccgtggcgccgggcaccaccacttcatgccccatccctacgcccaggtgaagatcgaggccggcaattcgcacgtcgccggcggcggccgcctcgacgactccgttctggtgcagatgcaatgcggccagctgatgcagcctctcggttgacaaccctgttcctggagcagcaacccacgaccaaccatgaaaatgctctcgtctcttggtgtgctcgaggagggagatgcaactcgtgctcttgcttccaaccatcaatggagttctgaaaacgaaatgatcgcaacagcacgaaggacaagtagtaacagcacagtagccaggcattgcgctgctgctaaattaagctccctactaccgtgtatcccggatgatgagaggaagaagaagaagaagaagaagaatcacgagatagaagaaaaagaagaagaagaagaagaagcatattggacatggcatctctgcatttcgcatctgtgtacataagaccaagaccaaggttaaataattagttcacaattgatatttgatactccattgattatctcctgtgctatgggaggaggcacaggatgggtactactaccagctagacaccgtttttgttgatgtactattagtcaagttattattgtcatgcaagtattatttggagatatagcacgtagcagcagcatattgtctctgttttttttttttgtcaaggctctctagtgttcagttgagggtattagcattggtcaccctctcattgacccttgctttattaatgataattatggtttttatctgctc

SEQ ID NO: 6147 - DNA, 884 bp, Oryza sativa
  misc_feature (1)..(85): n is a, c, g, or t
  misc_feature (695)..(695): n is a, c, g, or t
  Predicted polypeptide sequence is orthologous to G1641
nnnnnnnnnnnnnnnnnnnnnnnnnnnnnnnnnnnnnnnnnnnnnnnnnnnnnnnnnnnnnnnnnnnnnnnnnnnnnnnnnnnnnttttttttttctagattggctgccatatttttatttattaatatagtctggatcaccatatatatgcgctatctttatgaatagctaattagatgttcataacatgtgtgttccattgttcagcaggaacatcgatcagcttccggccacacaaacttatcacctatcagctgctccctcctcctttggagttgcagcttcagccatcttcatctgctgatcatcccaggccttctgcgactgcgcctgcatctccatcatccgctgctctatctcggggttgtacagcagcggaacccagaacggtgtgtcgacgttgttgttcacggcggcggcggcggtgttgttgttggagggggtcgtcgtcgtcgtcgccgccgtcggcttccatggccgcggcgatctccatcatgtggaagtagttgtcggcgtacatggagatctgctccggcgtcttgcttctgacgaagtacctcgagatgtttctccagtcgccacgcccgtacacacgcatcccagtcagaaacagcctgtgctcataatcagtccaaagcacatcgtcatcagcattgtccgggttcaacaactcaccggtcccgggcataatggncgaaatccgggtaccacccaatgggcgcgtccgagaaacaaaaaaaggcggccgattcgagctggggaacaggcccaaggccccggggaaaggggcgcccaacggcagaaccattcgggcgcctacccaaagccgtaaccgaaaagaaacacggaggctaaacaatctggcacccaacaacaaacatca

SEQ ID NO: 6148 - DNA, 1637 bp, Oryza sativa
  Predicted polypeptide sequence is orthologous to G1652, G2776
tagatagctagtagagttctttttctttggagacatggaggactcgagcctgttcatggagtgggccatggagacgctgcagcacctgcacccgctgccggcgacgccgccgcctgccggcggcgggtacgccggcgacaacgcgacttttccgtcgctccaagcgctccgcgagtcgtcggtgtcgcagaacggcatggccccgccggagccaacggcgcacgaaggccaccgagcctccaacagctggagctcgggcgacacggacagcgtgtccggtggcggcggcggcgcggtcatggagcacgacggatggtcgacgtcgccaaattcggtcaggtgcgccgctggcggcgggggcggcggcggcggcggcggcctctggcccgtgagctggaacttctcgtcggccatgacgcagccgtgcaacgatcaggccacgccgtcgaacccgccgacgacgacgagagcgcgctacggcggcggcggcgttcgatacctgccggccgccgtgtcgccatcgccatctgcacagacacggagagcctcctccaaaggcaacggcggcggtggctccggctcctcgtcggcggcgccgtacgcgcaggagcacatcatcgcggagcgcaagcgccgggagaagatcaaccagcggttcatcgagctctccaccgtcatcccgggcctcaagaagatggacaaggcgacgatcctctccgacgcggtgaggtacgtgaaggagatgcaggagaagctcagcgagctcgagcaacaccagaacggcggcgtcgagtcggcaatactcctcaagaagccgtgcatagccacgtcgtcgtcggacggcggctgccccgcagcgtcatcggccgtggctggaagcagcagcagcggcacggcgagaagctcgctgccggagatcgaggcgaagatctcgcacggcaacgtgatggtgaggatccacggcgagaataatggcaaggggtcgctggtgcggctgctcgccgcggttgaagggctccacctcggcatcacgcacaccaatgtcatgcccttctcggcatgcaccgccatcataaccatcatggcaaaggtggaggacggggtgagcgtcacagctgaggacattgtagggaagctaaacactgtgctccagcaaaacagcagaaatagcgcgcgagaaacaaaaagctgacaaacagcaacaaacgacagctgctagctagcttggctagctactcaatcaggcatgttgccattgattccagaacagtgtaaacacacactctctctcgatctgctcgtcgtgtacttgcgtgcatctggcccgtgatgcatgcatttgcacaaataaatctagcactggatacaatttatcttagtgcaataagtttaaatatatcatatttagtactagatttagttttttggacggagagaatactagctagagctacgaatgcactctctatagccgaataatcttaagatgtaccggttcaactttttttaaagatgttcataggagataagatgtgtgcatgtacatttatatcaatgagtgttttgcatgttatgagtatcatcatttgtacaatgttttttttaaaaaatattatgctgatgttgatcgattggtc

SEQ ID NO: 6149 - DNA, 1086 bp, Oryza sativa
  Predicted polypeptide sequence is orthologous to G1652, G2776
atggcctactccactaatcagataatgatactccaacatgcatggatgctcgtgggtgaagctaacagccagttaataattagtacagtagcacactcttggtaccagagcaacagtatagaagtggtcttatggtggttctggtccaggattgcacaaactccaactgaatatggattcttcggccaagcaatggcttgcagaactgacgaggagaatgatgatgatcctagagcgcttgagcatctggaccctctcagcatgcagcaactcgctgaatcccttgccaacgagctttttaaccagccccaagaacaacaggaagaacagcatggataccataacccatcactgagggtcctcccctttgtcggggatattaacaagcccgagggccacacaccagcagctgctgcaattcgtgacagcttcttctccctcaccaatggctcgtccagctcactcaacttctcggcgctggagcagcagcaggatagtggtcccatgacaaaattctgctcgccgctgtcagagatgaagagaggcggaaggagggcgacctcgagcatgcaagaacatgttatcgccgagagaaagaggcgagagaagatgcaccagcagtttacaactctagcatctatcgtccccgaaatcactaagacggacaaggtctccgttctcggcagcaccattgagtatgtgcaccatcttagggagagggtgaagatcctgcaggacatccaaagcatggggagcacgcaacccccaatttccgatgctcgcagccgtgccggctccggtgatgatgaggacgatgatggtaacaacaatgaggtggagataaaagttgaggcaaatttacaggggacgactgttctgctgagggttgtgtgccctgagaagaagggggtgttgatcaagctgctgaccgagctcgagaagctcggcctgtccaccatgaacactaatgttgtgccatttgcagattcatcactaaacatcaccattacagcacagattgataatgcatcttgtaccactgtagaacttgtgaagaatctaaaatcaactctcagaaatttttag

SEQ ID NO: 6150 - DNA, 1970 bp, Oryza sativa
  Predicted polypeptide sequence is orthologous to G1652, G2776
gcgatctccataggagtgtgatttgagctctcaagaccccccatctttggtttcgaggaattaatcgtcgagggaagaagggaagtagaaatggcgacgcagtggttctccaatatggtgatggatgagccgagcttttttcaccagtggcagtcggatgggctgctggagcagtacacggagcagcagatcgccgtcgcgttcgggcaggccggcgaggcggacgcggcggcggcggcggcggcgatgatggtgcagcagcagcagtacgcggcggcggcggcggcggagcaccggccgcggaaggcggcgaaggtgaacaccagctgggactcgtgcatcacggagcagggctccccggcggactcctcctcgccgaccatcctctccttcggcggccacgccgacgccgccgccgccgcggcgttcgccagcgcggggcaggcgcagagcgccccgtactacggcggcgcctccgccgcggccttgaagcccaagcaggagctggacgccgccgccgcgcccttctcccaggcgcgcccggtcaagcggagctacgacgccatggtcgccgccgacgtcgccaaggcccccgccgccgccgcctcccggcctgcctcccagaaccaggaacacatcctcgccgagcggaagcgccgcgagaagctcagccagcgcttcatcgccctctccaagatcgtccctggcctcaagaaaatggacaaggcgtcggtgctgggcgacgcgatcaagtacgtgaagcagctgcaggaccaggtgaaggggctggaggaggaggcgcggcggcggccggtggaggcggcggtgctggtgaagaagtcccagctgtccgccgacgacgacgacggctcgtcctgcgacgagaacttcgacggcggcgaggccaccgccgggctgccggagatcgaggcccgcgtgtcggagcgcaccgtgctggtcaagatccactgcgagaaccgcaagggcgccctcatcaccgccctctccgaggtcgagaccatcggcctcaccatcatgaacaccaatgtgctccccttcacctcctcctccctcgacatcaccatcatggccaccgctggagagaacttctcattatcagtcaaagatatcgtcaagaagctaaatcaagcattcaagttatccctgtgaaggacttgctttcctgatcaagtctaatctagatcaaatctttggtttttaatcttcctactacatttttatcattagccttgagagaaatctgaggctgatggttctaattaggtcctttccctgcttctgcttctgaagagagtttgcttgcaatccaccacagagcacaccccctcaaggatttagccattaaccacctgtttttgctgcatgggtgcagagaatttgcagattacctaaatatccacctacaagtcttctattttctctcccatcacatttttttgcatggattgagctagtcactccatgttcttgggagagggtagaaacgtaaaaaagagacctgtctttttctagggcctgtttatcaaggggagtttgactttatcaaaaaaaccttattttcatttctccccttctgcaatgttgccctttgatttcaccctgtttttctatgagaggattgaggtttttcaaacccaaataccaacctttgctggcatctcatacactatcctatcacacactgttcccaaacccaaaaggcttcaaattgtggagaaaatggtgccttccttttttcagctctgaggtggacttttgcaagctcttgattcagaagtagtgtagggtgtgtgtctctcttctcttttttagggtcatacaagctggccccagcttgattgcaccctttgcttgtagtctcctttgtgggttttgttgtaacaggatcaagatgtagctgttccctcttgtttacacaagtataaaaataaataaatgtgcttgttgtt

SEQ ID NO: 6151 - DNA, 534 bp, Oryza sativa
  Predicted polypeptide sequence is orthologous to G1655
atggcgtcctcgccgacctccacggcgccacacgaccgcaagctcgatcccgccgcctcgccggcagccaggtggcggacgaggcgggagcaggagagctactcctccaagctgctcgacgcgctgcgcctggtccgcgccgccagcggcagaccatcacccgcgtcgtcgcgcgaggtgcgccacgcggccgaccgcgccctcgccgtggcggcgcgagggcggtcgcggtggagccgcgccatcctcgcctcccgcgcgcgcgcgtgcgcgctccgccgcgtgcgcctcggcgcgccgcccccgccgcccgccgcgcgtccggcgccgcgctcgcggccgccgctggcgagcaaggcgaaggtgctggggcggctagtgcccgggtgccggaagctggcgttcccggcgctcctggcggaggcgtcggactacattgctgcgctggagatgcaggtgcgcgccatggcggcgctcgcgcaggcactccagtccgtggcacccgcgccgccgccgccgccgtcgtcgtcgtga

SEQ ID NO: 6152 - DNA, 512 bp, Oryza sativa
  Predicted polypeptide sequence is orthologous to G1655
ctgcgggcggcggcggtggcgcggagggtgcgggagctgcggcggctggtgcccggcggggaggcggtgccggccggccgcctgctgctccgcgccgccggctacgtcgcggagctccgcgccagggtggagctcctcagggcgctcgccgccctgctgacggcctcatgcgccgccgccgacgacgacggcggtgcgtgtacatgacgagacggcggcgccatggccggcggccggcgacgacggtgaacaacgacgatcgatcgactcctcccgatcctacgaatacgtagagagattcggcgtataattaagagtataaatattcagagaaattaatatatgtatatgtacgtacatgtcgtcatgcatatataggctgaggaatttcgggggttaatttttgcctcaaatactccttaatatttaagtgttcggccgattcgtattctttgtaatgtttatgtgtatacatgttatgatatttttgagcgcttgatttttttttaaaa

SEQ ID NO: 6153 - DNA, 2113 bp, Oryza sativa
  Predicted polypeptide sequence is orthologous to G1660
gaggtggcctcctccccgcgattcccgtgtgaatttgctctttcttcccggatttttcgactttcttcttcttcttggtttgctcttcttctttcttggcggtctgcacccattcggagtccgagctcatctccgagtccatggcgcctctcgccttcgatggctggaactgaaatactaggcattagcgccacttatcttgcttcgatttggtaaattttgctcgattccttcatcgtggagttgtgctgttcttcgtactggaggtgtgtcctttttaatgattgctaatattcttggaaagcaggcacgcctgccattgctgaactcgatgttttctcatcgattggtcgggatattgccgttgatagattcccctgcagtgctccttttcgtctcttccattctcctctcaaattcgccttgacattttggtcggcactgtacttttgtggtggtggccactggccaacaatgttcaggcctggaacgatcgcctgtgtggctaattcggcgcgcattttgctgaaaagtttgcgggcttttatcctgtttgctgctctaccgggtcactgctctgccagttttgtctcaatttctgtgatgctttctgtgccatagctttcaaatgttggctttggtaaggaggggattgagataggttgggttatctgagtgcacacttcactaaaaagtttggatccttttgtccattctgctgtgattccgtcggaatttggcaattttcgcatcgggtggattctccccagctaagctacgagcaatgcttctcggactagagaaaaatcagcacaacggggaggacacatcgcctgaggccaacgattccggcgagctggacgaccagaggagcatggagtgctccacctccaccgaaatgtcgagcaacagtggccacagatcaagaaaccgagctcaggacgacgacagcttcgactccgagagcagctcgtcgggcccgccgacggtgaagaggccggcggcggtgaccgccttgctgccaccgttctctaggccgacgccgtcgaagtgggatgatgcagagaagtggatttctagccccacggcgaaccgcggtggccgtgtggggagtgcagctggggctgcgccgaagaaatcggcgctggcatttcctgaacatgtaagccggcctccagccgttgctaaggtggttgctgaggtccccatcaacactggaaccttggtgaagaattcagttgctctcgcacagcctatttcatttaatcctgcacaaagtgcttcgatagttgatgaaccagctcctgcagttaggtctgtttcgatgagagacatgggcacagaaatgactcctattgccagccaggagccctctcggactgggactcctattatagcttctagtccaacctcctctcggacaccaacaccacaacgtaatgcagaaatcagtattggtgaatttggtccaaataagatggaaatgtctgaggaggaactacaaatgaatacaagaaaggaaatcatggatcttggccaacggctgggaaagacaactatagctgcatgggctagcaaggaagagaaatctacaacaagtttcgcaaatgtcataaccgacaaggctgtagaaatcgacagagaggctcgtgctgcagattgggaggaggcagagaaagcaaaatatcttgcaaggtttcagagggaagaggtaaagattcaagcttgggaaaaccaccagaaagcaaaaattgaagctgaaatgaagaggatggaggcaaagatagagatcaagagagctcgcgagcaggacaggctttcgagcaagttggcagctgcaaggcaaggcagaggcgaggagggaggccgctgagtccaggaagaaccaagaagcagcaagaactgaagagcaggcggctcagatccggaaaaccgggcacataccttcctcaatctcctgctggtgctggtgcctgtgattcttcactctgccatgatcatctgttatttgggtagaagaaaaatacttgctccttgcacgaccatgtaaaatattcgctactggttggttcatcgttcagtgatcaatgccaatgagtcgccatttttgtcc

SEQ ID NO: 6154 - DNA, 1874 bp, Oryza sativa
  Predicted polypeptide sequence is orthologous to G1660
gagcttttaactgctcgtctcatcactctccacctctctccctctctctctcttcctcgcgctcccacgccacgcagcagccgcagatctccacccgcctccggcgagcccgccgccgccgccgccgccatggagtacgagcgcatcgagaagccgttccccacccagggcggtgggttctcgccgaagcggctgcgcgcgatgttgctgggggtggagaagcggcggaaggggcaggaggaggaggaggagggggacgccggggaggtggacgacgagtacggcgcggtgcccaagtcctctgtcagatccgacgccgactccgatgcgcgcagaggaggtagcatgtgcgaagaatacaaggatgtagatgtggtgagcaccatctcagaatcttcatcctcgttggagacagggagtgggcaccgatcgcgtgacacccactccatgggttcacgagtaagggtgcctgaggaggactcctgtgactctgagagtgtggcttcaaactttgagttccataaggagcgaggggcctctgctcggtctgtgacggcggcaatcgttcctccattctcaaagcctgcaccatcaaagtgggacgatgcccagaaatggatcgccagcccgacaacaaaccgtcctggtagggctggtggagtgccacagaggaagatggaaaaaactagctttggtggcgggaggctgccggctacgaaggttgtgttggaggccacagaggagatagatactaagagggttgatccaagccaagagaaaagggaaattgggtggcaaaaagcggtgaattgggccccacctgatccatatccagaagttgagacttgtgcaaagtctgcacttgctgaagaaattacagtagctgattcagctgttacttttagtcgccatgattcatctgccacgcttcagagcgcgacaacatgcatacctcccccaccaacagtccgatcagtgtcaatgagagacatgggtacagaaatgacccctattgcgagccaggagccatcccgaacaggaacaccggtgagagcaacgagtccagattgttctcgcccaactactccacgaaaaacaataggccccaatgcaatcggtgctgttattggccatggtgaatgtagcaacgtggaattaagtgaacaagaattgcaaatgaagactaggagggagataatgctcctcggcactcagcttggtaaaaccaacattgctgcatgggcaagcaacaaggaagaggaaaaagatgcatcactttcgcttaaaggagtgcccatggaccaatctacacagaaggtaacagaaattcgtgcagcagcgtgggaggaggcagagaaggctaaatatttagcaagatttaaacgagaagagattaagatccaagcatgggaagatcatcagagagcaaaaatcgaagctgaaatgagaaaaattgaggtcgacgtggaaaggatgcgagcccgtgcgcaggacaagctgatgagccagctcgcatcggcgagacacactgccgacgagaagcgggccgcggcggagctgaaacggagccgtgcggctgcaaagacggcggagcaggcagaccacatcaggagaaccggcaggatgccgtcctccattggctgctggaactggtgctcgtagtagcgtagctaagctcaagcaactgaagcaagcaaaaagctctcctcactatgtctcgcaagacttgaagcgccatcatctgtttttaccgtgatcttgtagaatattgtcttttgattggtttcagtagatataagtcagaagaagacgagtcacttgtaagtaactatggagcagtatataagatgcaagcttcttgcctttttctgtgc

SEQ ID NO: 6155 - DNA, 1390 bp, Oryza sativa
  Predicted polypeptide sequence is orthologous to G1662
gtgaaccaaagaaccatcacttggtaccagtagtgcaacaacttgttcagtcgagaggaataccttctagccttctagtagccaggatggccatggagagagcttggaagccaagggaaattgctgacacttttggcattgagatggatgaagaggaggctgcggctgcggcgataccgcctccgcagacgccattggagcccatggagtacctgtcgaggtcatggagcgtgtcagcgtcagagatatccaagatccttttcaacgggagcaagaagagctttgccgccaagcgtctgccggagatgaccataccggaaaactctgtggtcgctgcgtccattgttcccagccatctgcaacatatagacacaagaaggaattcaatcagcagccaccacctgccaattgggaggtggttccaacacaaggaggcaagccgggtcaagcagagcagcaaagagaagctgcgagccgagaaggcccatgtacacgccatggtgtcggtggcccgggtcgcagctgccgttgctgcggttaccgcggccaccacgagctcagatatccagacctccaagatggccgcggccatggtgtcggccaccgagctattggcttcgcactgcgtggagatcgcgcagcacgcgggggcacgccatgagcaggtggcctgtgccatccagtctgcagttggtgttagaagctctggtgatctgatgacactcacagcagcagcagctactgctcttcgaggagccgcaacaatgaagcagagagtgcagcgagagatgagaagcaatgcgagtgttcttccgtatgagaagggtcactcatggagtcctgacatctggtgcaaggagggggagttactgaaacgcacaagaaaaggagatttacacaagacacgagtatctatatacatcaacaagaggtcacaggtcatattgaagttgaagagtaaacacataggaggagcactatcaaagaagaacaagagtgtggtttttggtgtgtacaacgagcttcccacatgggttgaggcagggaaacatttcacagaggagagatgctgctttggcctgagcacggcacaaggtctggtagagtttgagtgtgagaacagcacaagtaaacagaggtgggtcgatgatgtgaagaatctgcttcggcaggtcgctgcagaagagcaagtggaaaataagttgggatcagtgaagctcagttgatgtagttcatacatgtgtacactattttcatgttggcaggtggtataccatagaaggtgccttattgatgccaggcgtatatattgttgtactcttaaattgtcaggtagttttgtactgtacacacaaaatgataagatacataatagatcatatgttagtcc

SEQ ID NO: 6156 - DNA, 1206 bp, Oryza sativa
  Predicted polypeptide sequence is orthologous to G1662
atggaagggcacatgttggggaggatgaggaggagggatcacctgctgctcatggatgctgctcctcctccggcggcggtggcggcggcggtgcagacgctgatggagcccatggagttcctgtcccggtcgtggagcgtgtccgcgtcggacatatccagggtgctcaccggcggcgtcggcgcgaggcggagcaccaacttcgtggtggatcgcctctccgggatgctcatgccggagacgctcgcgctcgccgccgcctccagcacaaacctgagcccccgcaaacgctattccaggtgcaggagcgccatctccgcgcaccagcacacgatcgggaggtggttccaccacagggacgggagcagcagcagcagcagcagcagggtcgacaaggcccgcgccgagcgggcgcgcgtgcacgccgcggtcaccgtggcgagcgtggcggccgccgtcgcggccgtggcctccggcgcggcgaacgacccggacgacctcgacgacgccaagatggacgccgcgctggcgtccgccacacagctgctggcctcgcactgcatcgagatcgccgagctcgccggcgccgaccacgaccaggtcgcctccgcggtggaggccgccgtcgacgtgcggagccccggcgatctcatgaccctgaccgcctccgcagccacagctctgagaggagcgacggcgctgaggctgagagcgcagcgggaggcgaggagcaaggtggcggcggtggcgccctacgagaagaccggcagctgccgcggcgacatatggtgcaaggaagggacgctcctgaaacgcagccggaaaggcgctttgcaccggaagcgcgtggccgtctacatcaacaagaagtcgcaggtgatcgtgaaactgaagagcaagcacatcggcggcgccttctccaagaagaagaagagcgtcgtgtacggcgtcgacgacgacgtgcaggcgtggccggcgccgcacgcgtgcggcggcggcgccgtgcctcctgctccggagacggcgtcgtcggagaagtgccagttcgggctgaggacggcgcagggcgtggtcgagttccagtgcgagagcagggcgcagaagcaggactgggtggagtcggtgaagaatctgctccggcaggcggccggcgggacggctcagctcgagcactccttcgaatctctccggcttagcgcctcgtaa

SEQ ID NO: 6157 - DNA, 1790 bp, Oryza sativa
  Predicted polypeptide sequence is orthologous to G1666
gagccttgtggacagagaaattaaacagttaagttctagatttctatcgtggtgatggcatctgctcctccagttcaggaagaagccctacagccagggacgaaccacttcaggagccggcttgctgctgctgtgaggagcatcagttggagttacaccatcttttggtccacttcaaccagtctcccgggagttctgacttggaacgatggattctacaacggcgaggtaaagacgaggaagatatccaacttagaggacctcaccgctgaccagctcgtcctgcggagaagcgagcaactgagcgagctctactactctctcctgtccggcgagtgcgaccaccgggcaaggaagcccgtcgccgcactgtcgccggaagatatcgcggacacagaatggtactacgttgtctgcatgacatacgcctttcgacccggccaagggttacccggcagaagctatgcaagcaatcgatctgtttggttgtgcaatgctcagtctgcagatagcaaaacctttctacgtgcgctcttagcgaagagcgcgtctattcagacaattgtctgcatccccttcatgagtggcgtgcttgagctgggaaccactgatccggtttcggaggacccaaacttggtaaaccgaatcgttgcatatttgaaggagcttcagtttccgatatgcttagaggtaccgagttctactccttctccagacgaaacagaagatgccgacaccgtgttcgatggcctcattgaagaggaccagatggtcatactccagggagaagacgagctaggcgacgtcgtcgtcgctgagtgcgagaccaacggcgccaaccccgaaacgatcaccatggagaccgacgagttctacagcctctgcgaggagctggacctggacctcggttcttatcagctagtcccgacgtcggcacgggagacggtggctgcggcggcggcggcggctaacgatgtcgacggcgttgcatactctcacgcctcgtgtttcgtgtcatggaaaagagcgaacccggcggagaaggtggtggccgtgccgatgactgcaggcatagagtcacagaagttgctgaagaaagctgtaggcggcggcaccgcatggatgagtaatattgatgatcgtggtagcgtggcaataacgacgactccaggaagtaacatcaagagccatgtcatgtcagagagaaggcgccgagagaagctcaacgagatgttcctcattctgaagtcactactcccctccgtccgcaaggttgacaaggcatccatacttgcagaaacgataacctacctcaaagtgttagagaaaagagtgaaagagctggagtccagcagcagggagccatcgcgttggcgcccaaccgaaattggacaggggaaggcgccgtaagatcaccgggaaggaggtctatgagatcggtgtcagtggtggtacctcgtcggtacctcgtcaacaccgtacgtatatgatatgcatgtataagatcaccgggcaggaggtctctgagatggatgtcatacggtgttgacgaggtaccgtacgtatgatatatagttatcgttttcattatggaaaaaaaattccgaattacctcgtgtactataaaagacgcgaatattagggaagaatctaatatcaaataattagaaggggtgaggtttcgaatccaggtcgtctatcacaccaccttgtgaagctagccggaaaacccctaagcgtttttttacctccatgtactattggtgccatctgaattaccgcttactaat

SEQ ID NO: 6158 - DNA, 5601 bp, Oryza sativa
  Predicted polypeptide sequence is orthologous to G1672, G2802
ggttttgctcttctactgctcatcctcctcctctactactcgtcctctttgctctattcacagctagcaacaagaaggaggcttacacatgcatgtgcacggtctctgccggacgcatatgaatcaggcatgaatagggggcacatcagcagctcggagctcatcgacgccaagctcgaggaacgccggatctccacggccaagcactgccccagctgcggcaacaagctcgactgcaaaccggattgggtggggctaccggcaggagtcaagttcgatccgacggaccaggagttgatcgagcacctcgaggccaaagtgagggaagaaggctcaagatctcatcctctcatcgatgagttcatacccacgatagaaggggaggacggcatatgctacacccaccctgagaaacttccaggtgagagtgagagagctaaggtagctatagctcaaaacattgcaccccccgcattgttttgatacagatatattcctggctttttgcaaaactttatcgggttttttttgctttccatggagtgatatatattgtatgctgggattgtttcgccatgaattatgggtcgtggttttggattttgggatatggcatatattcccttgttgttcttgatgtgctctcccccctctctattcttattactagtgtttctctacatgtgctcttggccggtatatgcaaagagaattattgtttatggaaagttgtgcctagtctcatctcccactctctcctctctgtcatgatggtaagatgcttctgaagtttccaaataggtttctttcctctcttcctctttttcagagaggtttgttgcatctgtcaagaagcataggccacccactccacactatactcttggatctcacaaaactctctatactaccttgatcctgctaattattctgtttgtgctgatcgatcgatggagcaggtgtgacaagggacggcctgagcaagcacttcttccaccggccgtcgaaggcgtacacgacggggacgaggaagcggcggaagatccagacggagtgcgacgtgcagaagggggagacgaggtggcacaagaccggcaagacccggccggtgatggtgagcggccggcagaaggggtgcaagaagatactggtcctctacaccaacttcggcaagcaccgcaagccggagaagaccaactgggtgatgcaccagtaccacctcggcgacctcgaggaggagaaggaaggggagctcgtcgtctgcaagatcttctaccagacgcagcctcggcagtgcagctggtcctccgaccgcggcggcggcgccgccgccaccgcatccgccgtgacgacggcggcggtgcagcaggatcagcagcgcaggagggacagcggcagcggcagctgctcgtcgacgagggaccacgaggtgtcggcgacgtcctactcgacggccgggtacgccgtcgccgccgccgtcgagatgcagcatttgaagcatgccgccgaccatttcagcttcgcgcctttcaggaagagtttcgaggaggttggtataagtggtgatcaggtacactccaatcagcttgggaggtcggagcagcagcatgctggccaggaacaacagccgcaccggccgttgcttgcaaccacgacggcggtgcctgccacggccttcctgatcagccggccgacgaaccctgtatcaaatatagtgccaccagcaatgcagcatgcatctgtcgttcttgatcatgatcagttccacgtgccagcaatccttctccaccacgacaaatttcaggtgtgatttcatctcatcttatacattttctcctcaaataaaacatttccattatctaaaataattccctaaaattaatactaatttctctttttctagcagctgggtaatagattgggcacggtagctgttgaaaaaaaaaactataggaacacatatatgcatgcatttatgaagaatattctttacatattcagaatgttaaatttaagtaaggagtaacaaaccatctccaacaaaaaacaatttcagcttgaaaacaagcaatggactcgctaggcagtacatttcatacttcccatctagacaaacttaattagtacggcttggtctaaagtccacattttcctccttcaagctaagagtttcttgctatcataggatccctttgaattctctaaaaataaactaaaaaccattctcagctttcaatttcaataaaaagaatcaaggatttgtgataatcttaagtgtcaaaattagtcatttttagttggtcatactaaacatattgggcaataatttatacaaataattgtgatatacaaaatattaaaaaaaattctagttatggcacttctaatgttgatttgtacatatgtagggtttttcaagtcgtgtaattactatttgatatgaactatgtttttttatatatataccaaggaagttgcatatggatgaaattaagctgtctgaagatgcattttctagactataaatatagagcctagacaattctggaaggattctttgtttacccatatatatatgtgtaatctggtaatgaatctgctttgtatttccaccgttcctatatatatgtatcactttaggtaaatctatatacaattgaactgtttatttcatatatatcaagatactaatgcattgtctcagctcattcttcatctctttggtgatttacttaattatattattgtagctcctttacttttttttttcgttttgctctttactaaagaatgctttagctactgttctatcccaacataattaacaacgaacatgcaacacagcagcagcagcaacaaaagcttgacaggaggtctgccggcttggaggaactgataatgggctgcacgtcttcgagcacaaaaggagtaagtttctcttgcatttttatttgattgcctcctcagcatggatccaagccgataatttaccagtcagaggctctacgcatgcagtaaagcattcctgcacatatccaattggaattaatatatatgcatgtacgtagcaattgcatgtgagacgcatgcatgtgtcccttttaaacggttttaatctgaacattagctcaggccaaatttaatataattgtagttatttatatatactgatttaaacatataatacatgggtgggaaagctgcaagctatgtcttataggcgaggtgaggggtttagaaaagaaagactgctcaggagggtcctgaggaaacttcagtgtggggcctcatagtttctttgtcgtcctagccagcactttgaaacaggcccttcaccttgacagctttttcctctcatttgtttccctatttttaaattcgccattttaggtgtgcttttacagcaagcatgccgacgagagagagagagagagaaatcttcagtactcctagtgagatagtagatagaagaaacatcatgaatatatgcaaacaaggaccaccctttgctttgcttttgagtgccaaagggggagagccaaagaccagcgtaaaaacaagaccatactttccttgctttcatgaccgtataggtgaaaacgagagctttctctccatgtcagtagcccctctcctcgcttttctgactgtatggctataagaatagttgtttactgttatctcttgcgaaaagagcaaaagaaaaggaggaaatattattcgtttcttgctctcttttgtctcttttctatgaaatgaattcacactgacaccatgcatgaggataagagaatcattattgtgaaatttgtttgcattaatcgttgtgaacttgttcttgtattacattactaaaaattaaaatcttgacatttacaaggtagtatatacatgcacgttcaggtaatatagaacaaaagtgtacttatttttgtcaaaactccattggatgattagacatgagtagtacatccgtctcaaaatataataacttttagctacgaatttaaacaagagtatgtctagattcgtagtcaataattgctatattttcgaacagatcaaggtagtaatgatatgtgtattgcatagttattcaatgagatcgttctttgacacgttggcctcattaataatatggtgcaatgcgttatattggagatcaatcattctgaccccgactatatactccgtataagtaagtgacaaaaagagttatgccttactacttttcccctcctttgttttcgcgttgaattatatgggagattaattaataaagtactgtgacaacacaactatagtactactagtctactaccgtggtatctgctatatctctcacaagagatccgaattggctaccttgatattatttaaatgaacatttctggtatcatctggagtgtaaataagagcaagtactataaaacttgctctaaggtagtccgtacttgaacagttgaaaattttgaattatttccctactgacattttaaagtgataccgtatctttcttattcaactgttgcacttcactgagctgttcttttttgacccccccttttccatattctattgcaggaagcttcaattcctcactcccaagagacagaatggccttaccagccatactggactcctgacaaccaggatcatcatggatagtagcaacaaggctggtaaatagtgaagatcaataccaaaagaaaactaaccacattctctttcaccttgtgtggtctctgtcttcttgaatatacaacattgctttcttgaagaatgtatgtactacggttgggagaagaaatagattaaagagatctgtatagatctgcctccatgaaaaaagggagatcaaattaactgtgcaaggacactccaagatagaagagacaaagttgttgaaagaaaagaaaagagaggacaaaaaaagtttgggcaaaggtattgttgtgcttaattacatcagaatgaaggctagacatgctagatgcagtcaatattaatgcaccccaatcgaagcataattataattacattttggtttatcacagcttttgatatgcattagatatttttcaactgtaaaaagtagtattgtttgcatgtactgtgatgtacattacaccccctggccggtcccttctctctctagatgggtgtgtgcgtgtgtgtttttcaccttgcttaccttgtgcttcaaatgcatccagggggactaaattcccaacttaataagttctttttcctttctagaggcgcaaaaattgtttagcgtttgggtactgatgctacttactttgtaacgagagttgaattcatctgccatgcatgttggtttcaaggaataaactggcgttgacatgcatgatttttgtggtctatatatatcacatatatatcagattactcgatgatctaactagttagtttactgctgtacctgtacatatggatttaagaatcagagtggtgttggctatatattaagagttatgcttgcatactgatactgatgtacatatacgtaagcacagaaaattcctttgttcatgtaaaaaaatatcagctctcaatatagacatgtgttgtatttat

SEQ ID NO: 6159 - DNA, 881 bp, Oryza sativa
  Predicted polypeptide sequence is orthologous to G1718
caaaaaagaaaaaaaaggctcacctacctcgaaccctttggcgccatgcgcatcatcaacccaatccaccgatcatcgagaaggcgtcttttcctcctctatatcaaatcgagcgagaacgatagcgagagcgaggcagatggtagcaaaagcatcgcgaagaattattaagaggaaattgaagagatcgggtaatgtcgctcaccaatgctccctcgtcgatggtgtcgatcgtgacgccggtgacggacagggacagcgggcggacggtggcgggcgtgccgccggtgctcgtcggggcgtccgtctcgtcggcgccggagctgcgggggcgggcgtacctggtgcaccacgtcttctacgaggacggcagcgccagcgccgacggtggcggcgtggccccggcgtccagggcatcgatcgcggcgctgagggaggtcgaggaggaggatgacgacggcgaggaggcgtccgactgcgcgatctgcctcgacgacggggaggagtccagggagacgtgcgggagcgggaggaggaaggagatgccgtgcgggcaccggttccacggcgagtgcgtggagcggtggctggggatccacggcagctgcccgctgtgccggcacgagatgccgccggcgacggcggcggaggcggaggaggaggaggtggtggtggcgatggtgcatggggagagggtggtgatgagggggaggcgcgtggtgctgagcgtgctggtcatgggccgggcccacgatgacggcgagggcccggagcaacgcggcacggatccgattcctcctcttccgcgtgtgctcatagatgatgtggattaattaataactcctctcaaatttaagaaagggtgatctggattaactagg

SEQ ID NO: 6160 - DNA, 991 bp, Oryza sativa
  Predicted polypeptide sequence is orthologous to G1743
ggtgtgagcgcgggagcacctctcccgacgagccttcccttctcctcctcgccttcgcgtcagcccggcatggggttcccggtctgctgctactccgagctgctgctccccaagcagctgctccacctcctcctgctgctcggctacatccgccgcttcctcctctgggcgttccacgccgtcggcctcggggacctgctggatctcggggacgagcagcaggcggtgctgcaggaccacgcgcgcgagcaccgcgcgccggcgcaggcgctgccgccacagcagcagcaccgccgcgccgagttccggacggtgccggcgatggtcatcgaggaggttctgccggtggtgcggttcgacgagctggtggccgcggccccggcggtttgcggcggcggggactgcgcggtgtgcctcagcggcatcggcggcggcgacgaggtgcgcaggctcagcaattgccgccacgtgttccaccggggctgcctggaccgctggatggagcacgacgaccagcgcacctgcccgctctgccgcgcgccgctcatccccgacgagatggccagcgcgctctgggccgccgccggcgtgcccgacgcctccgacttcgacttctcctacttcggcgcgcccctcacgccgatgcccacgccgactctgctacggccgcacgagctgctgctcactggccttggcggctaccagtaaccagtgaaccgccgctgttggttcacggagttggcaatatccacctactgcacagcagggcaccggcgacccggaatgcgcagtttttacaacgactgaattggtcgtcgtgttcggggaagaccaagaacaggaggcgccttcaactgtacataggcaaaaatgagtaaagcaaaccccccgaaaaaggctagatgattagtagatttttatttttgtttttgtttttgtacagaagattccatcttccaggtttgagaagtagtgaatctttgtgctgatt

SEQ ID NO: 6161 - DNA, 1033 bp, Oryza sativa
  Predicted polypeptide sequence is orthologous to G1743
ttccccaccacgcacgcaccgcacagacgcaagctcacctcagctcagctcacaattcggctgtatccaagatcgccatgggcttcccggtgggctactcggagctgctcctcccgaggctgctgctccaggtgctcctcctcctcggccacctccatcgctttctcctctgggccttccacgcagtcggcctcggcgacctcatcgacaacccgcccggcctggcggccacggagcaggacctgatgctgcaggggcgcggcggcgggatggcggagggttgggcgtcgtcgtcggcgctccagcaccgccggcccgagttcagggcgattccgccgatggccatcgaggaggccctccccgtggtgcggttcgacgagctggtggcgtccgccccggcggcggtgtgcggtggcggcgactgcgcggtctgcctcagcggcatctgcgggcgcgacgaggtgcggcggctgtccaactgccgccacgttttccaccgcggctgcctcgaccgctggatggcccacgagcagcgcacctgcccgctctgccgcgcgccgctcatccccgacgagctcttgcccgccgcctccggcctgcctgacccctccgactacgacctctcgtactacccatccccgctgccgctggcgcccaccccgacgctgctgcgaccacacgagctgctgctcaacggcttgggcggtttccagtgagcccgccaatccaccgccccggtcaatttcgttgcaaccggcatgacagagctgcctcaactacggcacacgggcacataggcgtcctgatttgtacataggcgccaaggagaactccccccaaaaaaacacaagtaggaatagtttgctgctatataggtcgattccaccttccaagcctgcgaagttgtgaatccttttttttttgcagattactagtagtatattaaatttgttgaagcagagcagtgccacagtttggtgcttgctaatttggcaagccgtttaatccaatctccccacgctattcaaatctt

SEQ ID NO: 6162 - DNA, 1088 bp, Oryza sativa
  Predicted polypeptide sequence is orthologous to G1743
ggccctctaaaaccagacactgctgctgcgtgtctgtgtgccgcgccacctatgcacctcgcgcgcgcggcaagcgctcctcctgccggcgccttcccctgtccctcgcttgcctccagctgcagcagaggagcgcgtgtgcgtgtgtgtacggtgcatgagctttccgctggtgtgcttctgccgccagatcccgcggcccatcgtcgcgctgttcaagctgctccaggccgtggcgctggccttcgtgctgatactctgcttcctcggcctctacgagttcccctacaccgtcgaggaccacgcgccgctcatccacggccgccgccgcgatcccctcggcgacgacggcctgcagcccgaggcggtgaagcggggcctcccgctggtcgagtacatgcaactcgccgacctgtcggcggattgccacgacggcgagagcggctacccggccacgtgcagggtgtgcctggagaggttggaggcgacggacgaggtgaggcggctgggcaactgcacccacgccttccacatcggctgcatcgaccggtggatcgacctgggagaggtgacgtgcccgctctgtcggtcccacctgctgccacgtcaacgaaggggcctgcttggcagtaggcggttcggctagattgtctcgcggcacggcgccatgggggcagtttcgtcatttcaggctgtacatctcgccattgttgctggatgggtgcaggccaaccgcagactgattccgatcaggacgactaaccaccaagcagtaccggtgctaatcaattgatagttgtgctcacgcgaaaattaatggcattttggaattccacgggtgtactttaacgcatagttgcatccgacgagctaggtaacgtgcacccgtttagagcgagtacaatggcaggctacaagtaagctataagcatacgtggaagagagaagagataagagagaaggaaaacaggctatatatttacagccagcttcagcacggaatctaatacattgtgcgtgtatgagatgtaggatcatatattaatagtgtactactccctccatttcacaatataagtcattctagc

SEQ ID NO: 6163 - DNA, 675 bp, Oryza sativa
  Predicted polypeptide sequence is orthologous to G1743
atgacgagcatgagagggaaaggccgtagaagggagcggaggagaaagaggagggcagaggagaggagttgcagtgtggtgtgtggcatgtcactcactcactcactcaacaacttcttcttcttcttcttcttcttcttcttcttcttcttcttcttcttcttcttcttcttcttcttcattctcagctggactacaaagaatataatggggttcccggtgggtggctactccggcgtgccacggctgctgctccacctcctcttcctcctcacccacctccgccgcctctcctcctgcctgctccgcctcgccggcgccgacatcgacgactccccaaccgccgtcgacgccgaatatgacggcagctacagctacagctcccagtcgtcccagctgctggagctggacgaccactccccggcgctgcgcttcgacgcgctctcatcatccctgcagccgccgctccacgtcgccacctgcgccgtctgcctccgcgacttccacaagtccgcccaggtgcgccgcgcccaccgctgccgccacgtcttccaccgcgcctgcctcgacgcctgggcccaccacggccaccgcacctgccctctctgccgctcgccgctgctgccctcgtcggcgccgcccgttctcctgccccttccactccctgcctcctag

SEQ ID NO: 6164 - DNA, 700 bp, Oryza sativa
  Predicted polypeptide sequence is orthologous to G1743
caccaacctgagcacctgaccacatcaagcaaaagcaaagcaccatttcattttccaccatacaaacccatgggcttcccggcggtgtactactgcgtcatcctcccgcctccgctccactccctcctccacctcctcgagtgcatctcccgcggctgcgccctcccggccgcgctgctcttctccggcggcgacgccgacgccgaagccgagctcgccgcaccaccacccggcgccgccgccaccgccgcgcgcgcccaggccgacgggatcaagagccgcctccccgtcgtcaggttcagcgccagcggatccggctccgacggggaggaggaggacggcgccgccgcggaggcgtccccgcgctgcgccgtgtgcctggccgccgtggaggagggggcggaggtgaggcagctgggaaactgctcccacgccttccacctcccctgcatcgatcggtgggtcgacatgggccacttcacctgccctctctgcagatctctcctctgattaatctatcacttccttgttaattattcttttcctttctagtttagcttagctcaatttagcttccagatactttcagcagtttggatcttactagcatctactaccaccactaggctgtttcacataccacgtaatgatgtacacgcttaattaattattctattattatcacaccagagaaaaaaaa

SEQ ID NO: 6165 - DNA, 2240 bp, Oryza sativa
  Predicted polypeptide sequence is orthologous to G1750
gtgacccggagtacaactacaacaacggcaatcgcttatcttgggatgacaatgccaaagatgaaacatatgcatatgtgcagcacaattacagttcgtatgatcgctcttatgatcagtcttacagtcttgatgccgtttccgatgaaactacttggtttcctaatcagaactaccagcacgtgtacaaagaggaggaatctcagtatcaggaaatcttgtccagctcttgtgcagaaagtaagatttcagctcagcctatttattgttacaaccagcagtttagtgaacaaccgctacatgttcttgttgagcccccagaaacagtttattctcagaagttggagtactatgagagcttctcaacatacaaccaccataacagcaacgatgattcagatatgttgggacattcatatgacatacagctgcccgatgaacatgtgccagatgaaccatttgaaccaattaagccttcttgggctatgcattcgggatactatcagtcctgcacagatggggcatctgctgaattcgaaaatcatactttaagctccagtgaattcagtggtattgcaagcttatttgcaacttccttctaccctcaacaaacacaaatttatgggtgtcatggagatgagaatgtttccttgcagcaaaattggcagtgcaactggaatgtggtttctgaaaatgatttccaatcggtaagcgtaacggtgtctatgtctgtgaacgtgcttttttaataccctatactcttatttttatcgctccattttactcctatttgtgtactgttgaatgtgtgtcatggtcggtacacatgtagttgaagtgctaaggatggcgcacagggggcagaaccaagcggcagcagatagaccatcaatgcatttgccgcacctatcgtacctccttagttgtttgattcaatttgtttaggttgagatttgttaaactttttaggtttgttaggggctggctttatttaagggagcttggcattatctttgaaattaagagcaaattacaagtctactctctcatcccctgttctctctgcctctccccttttttggtgctgcctggtgccatctcattcaaccatgggtagtaagactgttaacctatctagctacttcccactcctatcttattagatcactccctaacgcccgaatatattatattgttcttggcctcatgggtggctgatgacgatcaatgaaaacttcagacatgtctgtgagtgatgctttttttccccttgcaaacgatagaattatgaattagtatctgttttcgttttggatgctgtaaatttaaaatgtctggacctttatagtatgtcccgtgtatcctttcacattcttctgaaatatttatttttgctatttaatatgcaatccatgacacaatttgttttgttgctcaagaatggccatcacatgatctcatttgctgaagttcaaaatggcactgcttggctgcgattttttgcggctgcagctgtgcttaatgtctgtggctgtggtgcacagccgtggctactagcagcagacgcagccacaaaaatgacagccaaacaagcccaatatatctctttcagatttagttaatacttggttgctctttgttccatatattctgatgttagtgtaacttttatccacattcatgatctaccacacttgccagtgttagtagtaattgggatttacttgccaaaagaataattctcagactccagcagataagtgaggttaactctgtctttatggtatagttttcttaacaaatcagcaatctcagtacccttgctagacgattttaatgagtgttaatagtttggttgtttgtgctttgctggtattgttgctagatttcaactgaaacaatcttgtatggtgcccgcatcacatttttatggttgaaacatgagtgtgcaactgtgcatgcgatgtctccatgttgtcttttgaactgaaatatttctccatttttatttgcagggttacgattccaaccatatgaatggctacttctggccgtttggagatcattcagcataataccacatagtctatattgttgtaatttcactcttatcttttttatgtacatttcatttaaatttacccggccaaatgtaaatgaaaaaaatatatataagaggttatgcaccaatgtatctaggttcagcatataatgtaagatcattgacgctgttgttgacc

SEQ ID NO: 6166 - DNA, 917 bp, Oryza sativa
  Predicted polypeptide sequence is orthologous to G1752, G2512
atactcgatctattatttggcggcggctgcctctgcttgcttgtgactgtcgtgtctgtgcgtgtgtgtgtacgtacatactccagtatatatatgcattgctgcatgtcgcttcatcctcaccgccgccacggcgacggcgacgtcgacggatcagcatcaggatcaggatcagcgcgcctcaccgccggcctcatcaacttcctcgaatcgcgtcgcgccggcgccatgagcaccaccaacagctcatcctctgtctctgtcccagccatggacgcccatggacaggaggaggaggaggagccgatgcaggtgcagcaacagcaggcgttccgcggggtgcgcaagcggccatggggcaagtttgcggcggagatccgcgactcgacgcgcaacggcgtgcgcgtgtggctgggcacgttcgacagcgcggaggaggcggcgctggcctacgaccaggcggcgttcgccatgcgcgggtcggcggcggtgctcaacttccccatggagcaggtgaggcgttccatggacatgtccctcctgcaggaaggggcgtcgccggtggtggcgctgaagcggcggcactccatgcgagcggcagcagcggggcggcggcgcaagagcgctgcacctgcaccggcggatcaggaaggcggaggaggggtgatggagctggaggacctgggacctgactacctggaggagctgctagccgcctctcagcccatcgatatcacctgctgcacaagcccaagccaccactccatctgatctctactcgtattcctcacacgcgcagaggatgcacatcctctgcactacacttgtactagcagtggttaacatgtggatccggttccatgctctgattgttgcttatatttttcaaggaatataaacaaatccgatcctgagtt

SEQ ID NO: 6167 - DNA, 899 bp, Oryza sativa
  Predicted polypeptide sequence is orthologous to G1752, G2512
cttcctggaaagggaataatcaaacacgccccgtcacttcgccgcacacatcacagtgatcgcagccgctaagtcaaacattcccagctcacagagtcacacacatggagcaacacagccactgctggtactacggcggcggcatggctgtcaccgcagccgccggtgccggcgcggcgtcgtcgacatcctcggaatcgcagccgtctggctacgactacgagacggcggggagcgccgaggtgtcggcgcccggcggcggcggcgggcttcatcggcgtgcggaagcggccgtgggggaggttcgcggcggagatcagggactccacgcggaacggcgtgcgggtgtggctcggcacgttcgagacggccgaggccgccgcgatggcctacgaccaggccgcgctctcggcgcggggcgcggccgcggcgctcaacttccccgtggaacgcgtgcgcgagtcgctccgcgcgctcgcgctcggcgcggccggaggctcgcccgtgctggcgctgaaggggcggcactccaagcgaaagcggcggaagagatcagagctggccggtgccacggcgacggcgaacaagacgacgacgacgacgtccgccacgaccggcggggagcacaagcagatcgtcctcgagctggaggacctcggcgccgactacctagaggagctcctctggatgtccgagcaaactagccattgatgatgatgcgaacgaacctgcaaaaacatagctctcgcgcgcgatcgatcgcgagttcaatacttcaactcgatcacatccatgccttgcaatgcagtgtgtgaactcgaccgatcagttggtagtggattccatgtgaaaaaaggctgcaacgtaactgcttcaaatcgtgacataaaattggactc

SEQ ID NO: 6168 - DNA, 1492 bp, Oryza sativa
  Predicted polypeptide sequence is orthologous to G1752, G2512
gaaccaatcagcagctaaaagtcaatccacgccaccatcgatctctctatccaatccaagcgcgcaaatcaatggcagagcatttcagccacgccggcatgtacatcggctacacggcagacgccgccgcgtcctcctcctcctcctcctcgtcttcgtcgtcttcctcctcggagatgcttcggttcgacacgggctggcccgacgagacacctgcgccatcctccgtggcggggaggaggaggagcgcgggcggtgatcatcgtcaaggtcggggacagacggaggcggcggcggcgttcatcggggtgcggaggcggccgtggggcaggttcgcggcggagatccgggactcgacgcggaacggcgcgcgggtgtggatcggcacgttcgacagcgccgaggccgccgcgatggcctacgaccaggccgcgctctcggcgcgtggcgccgccgcggcgctcaacttccccgtggagcgcgtccgcgagtcgctccacgcgctctccctcggcgcggccgggggctcccccgtgctggcgctgaagcggcggcactcgaagcgaaagcggcgcaagaaagctgaactactcgccgccgccgccgccaccgccgcgacggcgaatgccacgccgcagacgcggaggatcagcaagagcacggaattgactactgcgacgacggacgagcagaagcggttcgtcgtggagcttgaggacctcggcgccgagtacctggaggagcttctctggctgtcggagatcaatggtggtagtgaccctgctgactgatcatccaaaaggttggcaatttgcaaggcacctcttgcgaattacatttcgcgcgcatgcagttgcaatggaacgtgcaaactgcaaaaagctgcatgcaagtatgcaactgcaactggaagtactacttgaacacatgcaagtatgcaactgcaagtactacttgaacacatgcatgtgtgttattgcatcctactacttgctgtctggctctctctagagtgccaataaagtgcagacaatgcaacacatgctggagcaagcaacaatttggtggtcaccaccatattatacgcacaacatgctgaagtattttcaaggtgtgtactttgggcggggactgaactttatgtctttatcggacacaaggacctacttcccaaaagctagctagcttgatgcatgcatcttgccccatgggtacacataataatattattaaactttgtatggcatgtgcccaaattagtactatcaacatttatatgtactagtatgaccgtgattttactctcgaaattcactgtacttaacaactttctatgctccctcgagtaattaaggtaaaagagagtaactcaaaaatacgttaagctaccattaaacactttcagcttgttgttaaacggaatactagctagtgtgtacaagaagatgaactgaatgaacaaaaggaaaatctagcggggaattggctcgag

SEQ ID NO: 6169 - DNA, 716 bp, Oryza sativa
  misc_feature (452)..(452): n is a, c, g, or t
  Predicted polypeptide sequence is orthologous to G1765
ttttttttttttttttttttttttctttccatcacatatacatttaatttatttgtttagaagtatgtcttgaactagcttttgcatgggaaccaatatactctagtttttgttaaatcttttctccacataagtttatagttagcttatagctcaccattaacgttgatatgctactatcaagaagctaacaggggttctaattcctttgtcatttagtagttgcacagagccaaatgcagcacatcatcatcctcccccctggagcaaattaaaatctgggcagtgggtcgtttgtttaatagggtggccaatgcttcaagaatgcggtgaatgttattattcctcacgcccctcatccctaggagaatgtttttttgtgggcccctccatgcaactcctctccaggggaaggatcataccacatggtggtgatgaggttgtgtgtgtgncattgtatgagtacttctacattgagaagaatcattgggggacaactttttggtgatcaagagctggtgggtgccattcagccattgtatagtactccattaacaggaataaccccagagcccatggtacagaacaggaaaaagaatcattgggggaacactttttggtgtgggcaggggaaacttgccaagtaaaaaagttgctttttttacccctttgacatgaagggaagagggacatcccaaagatcagggaggatcaag

SEQ ID NO: 6170 - DNA, 680 bp, Oryza sativa
  misc_feature (640)..(640): n is a, c, g, or t
  Predicted polypeptide sequence is orthologous to G1765
ttttttttttttttttttttttttgattgccataagaacttagaagccacataagtacattatccgataatggaaaatggcggcaacgacggtaatgggtctgcggtgccagtggtgagctggaagcatgagctggtgtcacggctacagttaagtcctagcttccactttgtgccgacggacaaggagctcgtggacttccacctccgcggtaagatcaagagacgcaaaccgcctctctacctcatcaatgaggtcaatatcatgcgtcatgattctgaaatgattggtaatttaatcttctttagttgattgatcgctttgaagttatgtatatctatgaaccaattgatttgtgataacacaatatgcatgcatatagaaatacaagggctatggggaaggtatgtggtactttttcatggtgagggggccctcgaagactaaaaacacggttgagttgaccacaaaaaacattattaccgtctcacattatcaaataacttatgacgatacctacttctttatcacttcacaccagtgctattgttccatagcctattccgcatccctacccttcacaatgcgcgaccgttatatattgggtgtaaagcactccataatgcgctactcatccccntcgggcgtctcccgtccgcacccatggcgtagccacagat

SEQ ID NO: 6171 - DNA, 1405 bp, Oryza sativa
  Predicted polypeptide sequence is orthologous to G1765
gaatatctcaagagagctagctagagctccatttacaaccattacaagattgcatcagagaagatatcttcatagataattgttggagcaagaacacaagaaaacacgtaggttcaattataatcgatcgtggagatggtgaccagcaaggagtttgcatgggatcaggcggccatggatcagaagatcaagagcgacgtcggcgaggtggtgctcgccggagacgaggaagaagacggggacgtggtgctcccggggttcaggttccacccgaccgacgaggagctcgtcacgttctacctccggcggaaggtggcgaggaagtctctcagtatagagatcatcaaggagatggacatctacaagcacgatccatgggatctccccaatgcgagcacggtaggtggagagaaggagtggtacttcttctgcctgagagggaggaagtacaggaacagcatcaggcccaacagggtgacgggatccgggttctggaaggcgacggggatcgaccggccgatctactccgccgccgtcaacagcaactccggcgagtcgatcgggctgaagaagtcgctcgtctactaccgcggcagcgccggcaagggcaccaagaccgactggatgatgcacgagttccgcctcccgccggcgatcgccgccgccgacgcctccccgtgcatgcaagaagctgaggtctggaccatctgcagaatcttcaagagaagcatcacctacaggaagcagcagcagcagcaggcctggaggccgccggcgacggtgaccgtcaaggccccaccgccgggggactcgagctccaacaccggcagcttcgagtcggacggcggcggcgacgagttcatgaactgcggcctgactccggccatctcccagcagcagcagcacggcggccgtcatcagatgatgagcacgatgagctgcaacggcggctacttcttcaacgacggcatccatcacagccacagccaccacaagcttcatagtcaatggggctccctacaaatggcgccgccggagccgaagccggagccggagcagaagcctctgagctcgccggcgatgacgatcgccttccatcaaaacgaccatggcttccccgccgccgccgcggatttctacaaggatgggtacttggaagagattgcgaggatgatggaggtggctgatccaagtccaacaggattctatgactgtagatattgatcagtaggaacagggtttcagaatagatgctagatatgcagaattcgccgacaagaacagtgccccctttgtgtgagaggctgacatgtagggcccatgctgcagaggctgctatcactattagtcttgtacttttgttttctgatctaatatatacactccagatgggatgtgaactgtc

SEQ ID NO: 6172 - DNA, 1118 bp, Oryza sativa
  Predicted polypeptide sequence is orthologous to G1767
agaaaccgttccccccactttcccctctctctccactttttacggattaggcggcgacgatgatggcttgcgtgtgcggcaggcggttgaccgacgattgcaggacgacggcgggcgggcgatggcatgggcttcctcggcttcctctggcggcgggcgacggcgacggcctgcgccagcagcgagcgacggggatggcctacgttagcggcgggcgacgggctcgccggggtgacctccgcccgggtccagcagcggtggccgtcccccgccttgatccgacatcggcggtgggagtttgagacggagctgacttcgatggcggtgggtcgtccggactggtcgccggcgatggaggcgtggtggcgcatcgtccgtccgtgagttggtgccgcctcctgggatctgccccgacgacctaccgccaaatccaagccctcgaccatgaaggaaccgttccaggaggccggtagcctcactgctctggccttcctccgtgacggctgagatcgtgtggtggtggcggagaaaagccgagtagctgatgaagcggagaccacatagaggaggagttggaagaggataactcgccgacggcgtgagttcctgccgagcggtgggagaccggcgtgtcctgggcgcggtgcacgcggtcggcggagttatcgctggcggcattcagtgatgacgtcgccgacgacgtgcggtcgcttctccggcggtacaaggtggctggttgatgcgggactacggcagtgacatggacaacgccgccgctgccggagcattccttgcgtggaaggagcagcctgtcgtgtggacgagtgcgtggatgccttgagatcgattgatccaacaagtccaaatccgccattgctgcaaatgatcgagcctgcgattcatttgattcatttgtttaatttgattctcagttgattcctctgttctttttttttttttgaactagctgattcatttgtataactgaatattccagtgacttgtataggaggtagtgatagattatttgctttaccggttaacactgaatctcacgttcttgatgcatgttatgtatatatctgtgtcctctatgcaattatgagcttgtttgcatt

SEQ ID NO: 6173 - DNA, 2279 bp, Oryza sativa
  Predicted polypeptide sequence is orthologous to G1767
tagatggatacgctgtttaggttggttagcctccaagccgcctccgagcagcagcagcagcagcagcagtcggcgtcctacaactcgaggagcacgacgtcgagcgggtccaggtcgtcgtcgcaccagacgaacgcgtcctacagctactaccaccacagcagcaacagcggcggcggcggcggaggcggcggagggtactactacggcggccagcagccgccgccgtcgcagtactactacctggagccgtaccaagaagaatgcggcaacgccccacaccaccagctttacatggatgaagacttctcctcctcgtcgtcgtcgaggcacttccaccacggcgcgcgggtgcagcagcagcagccgccggcgtcgtccacgcccacggggacggcgccgacgccgccgctgtcgacctcgtccaccgcggcgggcgccgggcacggcctgttcgaggcggcggacctgtcgttcccgccggacctcaacctcgacttctcgtccccggcgtcgtcgtccggcggcgggacagcgtcgtcgggcgcggttgggggcggtggcggcgggaggtgggctagccagctgctgctggagtgcgcgcggtcggtggccgcccgcgacagccagcgcgtgcagcagctcatgtggatgctcaacgagctcgcgtcgccgtacggcgacgtggagcagaagctggcttcctacttcttgcaggggctgttcgctcggctcacggcgtccgggccgcgcacgctgcgcacgctcgccgcggcgtccgaccggaacacgtcgttcgactcgacgcggcgcacggcgctgcggttccaggagctcagcccctggtcctcgtttgggcacgtcgccgccaatggcgccatcctcgagtccttcctggaggtcgccgccgcggcgtcgtcggagacgcagcggttccacatcctcgacctgagcaacacgttctgcacgcagtggccgacgctgctggaggcgctggccacgcggtccgccgacgagacgccgcacctctcgatcaccaccgtggtgtccgccgcgccgtccgcgcccacggcggcggtgcagcgcgtcatgcgggagatcgggcagcgcatggagaagttcgcgcggctcatgggcgtgcccttccgcttccgcgccgtgcaccactccggggacctcgcggagctcgacctcgacgcgctcgacctccgcgagggcggcgccaccaccgcgctcgccgtcaactgcgtcaactcgctgcgcggcgtggttcccggcagggcccgccggcgcgacgcgttcgcggcgtcgctccgccggctggacccgcgggtcgtcaccgtcgtcgaggaggaggcggacctggtggcgtccgatcccgacgcgtcgtcggcgacggaggaaggcggcgacacggaggcggcgttcctcaaggtgttcggcgagggcttgcgcttcttctcggcgtacatggattcgctcgaggagagcttccccaagacgagcaacgagaggctggcattggagaggggagcagggcgcgccatcgtcgacttggtctcgtgcccggcgtcggagtcgatggagcggcgggagacggcggcgtcgtgggcgcggcgcatgcggtcggccgggttctctccggtggcattcagcgaggacgtcgccgacgacgtgcgatcgctgctgcgccggtacagggaagggtggtcgatgcgcgaggccggcacggacgactcggcggccggagccggcgtcttcctcgcgtggaaggagcagcctctggtgtgggcaagcgcgtggcggccatgatcggatcgtcgtgatcgatggatcaaagctcaccggtgagtggaacagcatggaagaaaagagctccatagctaagcaagcacgcatgcatatccaccatgcatggggtaagctagcaagctctctcgtgtgtgtcacgatcgacattaatggcggctcacacaaaggcatgtagggttttgaaacagcgtagggagctacagaaatggatcacgtacgtacgtacacattgggttgcagcgatcgaggagggagatgatagttttagttcctagatttgcatccatttttattcatcgatcgccaacaagttcttggcgagaagatgattttgatttgcttgcttccatcttcttgtttatttttccccctttcgtttgtgtttcttcttaatttgtaagggttaacgacatttttcttcactctggagaaattttacgtgcatggtttttatcatgcgtacctgc

SEQ ID NO: 6174 - DNA, 1812 bp, Oryza sativa
  Predicted polypeptide sequence is orthologous to G1767
atggataccctcttcaggttggttagcctccaccaccatcaccaccaccagcacgcggcctcaccgtcgccgccggaccagccgcacaagtcgtacccctcctcgcgagggagcaccagctccccctcctcccaccacacccacaaccacacctactaccaccactcccactcccactacaacaataatagcaacaccaactactattaccagggtggtggaggcggcggcggagggtactactacgcggaggagcagcagccggcggcgtacctagaagaatgcggcaacggccaccagttttacatggatgaagacttctcctcctcgtcttcctcccgccagttccactcgggaacgggcgcgccgtcgtcggcgccggtgcctcctcctccgtcggcgacgacgtcgtccgcgggcgggcacgggctgtttgaggcggcggacttctcgttcccgcaggttgatatcagcctcgacttcggcggctctccggccgttccgtcgtcgtccggtgctggcgccggcgccggggcagcgccgtcgtcgtcggggaggtgggcggcgcagctgctgatggagtgcgcgcgcgcggtggcggggcgcgacagccagcgcgtgcagcagctcatgtggatgctcaacgagctggcctcgccgtacggcgacgtcgaccagaagctggcctcctacttcctgcagggcctcttcgcgcggctcaccacctccggcccgcgcacgctgcggacgctcgccaccgcgtcggaccggaacgcgtcgttcgactccacgcgccgcacggcgctcaagttccaggagctcagcccgtggacgccgttcgggcacgtcgccgccaacggcgccatactcgagtcgttcctggaggccgcggcggcgggcgccgccgcctcctcctcctcgtcgtcttcatcgtcgacgccgccgacgcggctgcacatcctcgacctgagcaacacgttctgcacgcagtggccgaccctcctggaggcgctggccacccggtcctcggacgacacgccgcacctgtccatcaccaccgtcgtgcccacggcggcgccgtcggcggccgcgcagcgcgtgatgcgggagatcgggcagcgcctcgagaagttcgcgcggctgatgggcgtcccgttcagcttccgcgccgtgcaccactcgggggacctggccgacctcgacctcgccgcgctggacctccgcgagggcggcgccaccgccgcgctcgccgtcaactgcgtaaacgcgctgcgcggggtcgcgcgggggcgcgacgcgttcgtggcgtcgctccggcgcctggagccgcgcgtggtcaccgtcgtggaggaggaggccgacctggcggcgccggaggcggacgcgtcgtcggaggccgacaccgacgccgcgttcgtcaaggtgttcggcgagggcctccgcttcttctcggcgtacatggactcgctggaggagagcttccccaagacaagcaacgagaggctgtcactggagagggcggtcggccgtgccatcgtcgacctcgtgtcatgcccggcctcccagtccgccgagcgccgggagaccgccgcgtcgtgggcgcggcgcatgcggtcggcggggttctcgccggcggcattcagcgaggacgtcgccgacgacgtgcggtcgcttctccggcggtacaaggagggctggtcgatgcgggacgccggcggtgccacggacgacgccgccggcgccgctgctgccggagcgttccttgcgtggaaggagcagcctgtcgtgtgggcgagcgcgtggaagccatga

SEQ ID NO: 6175 - DNA, 600 bp, Oryza sativa
  Predicted polypeptide sequence is orthologous to G1767
cgagaggctgtcactggagagggcggtcggccgtgccatcgtcgacctcgtgtcatgcccggcctcccagtccgccgagcgccgggagaccgccgcgtcgtgggcgcggcgcatgcggtcggcggggttctcgccggcggcattcagcgaggacgtcgccgacgacgtgcggtcgcttctccggcggtacaaggagggctggtcgatgcgggacgccggcggtgccacggacgacgccgccggcgccgctgctgccggagcgttccttgcgtggaaggagcagcctgtcgtgtgggcgagcgcgtggaagccatgagatcgatcgatccaacaagtccaaatccgccattgctgcaaatcatcgagcctgcgatgcatcgtgcatgcaatacacaatatggatcatgcatatcgcacgtgcgggttgaatgggaagaggaagcagcgcgcgcgtgtacgtacttagggtttttcagccagcaacgtacgtgtgtagcagggagaggaggtagcaaaacacatcagatggattaagttaatcaatcaccagttattactagaaaattatttggaggaattaattggcatttattgtcttgc

SEQ ID NO: 6176 - DNA, 1978 bp, Oryza sativa
  Predicted polypeptide sequence is orthologous to G1772
gtcgcggcgatcaaaaaaacccaacccctcctctcctcgccgccgccgcccatggccagcgaccgccgctactactacttcgaagaagacgatggcgatggcgaggaggaggtggagtggctggcgatggaggccgacgaggacgacgtcggcctgctcgaggaggacgaccttcacctgcggcttcccgacgaccgccccgcggattgctgggccatcacacaagagtcacttcctgctgcccagcaacaagacctgtctatggtaatgaacttgctcaacataaagcagcaccttgcacgcacactccttatccaccaccggtggaagatgcattgcatttatgatcaccttgacagaaaggggcgggaccgcatgctcagtgaggcatgcattattttgccgaagaatagcatgtcagcagctagctcaacaagtgttacctgcaatgtgtgttttgaggacttctcaatgactgatgtctcgaccatggactgtgggcattgcttctgcaatgactgttggacagagcacttctttgcatccattaatactggcaacaagcagattcggtgcatggaggttaagtgcaaggccatttgtgatgaggacattgtgcgccgcctcctcagtctgaagtaccctgctgcatctaagcgcttcgatctcctcctacttgagtcttaccttgaggacaatgactcagtgaagtggtgccccagtgccccacactgtggccgcgcaatccaggtaggcaccggcgagaggtactgcgaggtcgcttgcccctgtggtgtcagcttctgcttcaactgtgcagggcaggtgcactcgccttgcccatgtgccatatgggagaagtggaaagctaagggccatggagactcggatagcgtcaagtggattcttgccaacaccaagagctgccccaagtgctccaagcccatcgagaagaacggtggctgcaaccttgtccattgcaagtgcggccagtgtctatgctggctctgtggtgggcctaccgggagggagcacacttgggatagcatctccggccacagctgcaaccgctacaaggaggaaaacggcgacaaggtggacaccagcagacagcagatgcagcggtacacgcactactgggaccgttacaacatccacgccggctcgtacaaggtggagcagaaggatcttgggcctgccgtcgaggagcaggtgaagaagctggagtcgaacctaacaggtccgaagatgaactgggacggtagctggctcgccatggcgtaccaatccctgctcgcatcgcggcaggtgctgtcgcggtcgtacgccttcgcctactacatgtttggcggcggcgaggtgaagacgcgcccgtcggagcgggcgagcctcgccgtggcgcagaacctcttcgaggaccggcaggagcagctggagcgccacgttgagcatctctccaaggagctcgccacggacttgctggggctgccggaggaggagatcgtcctgaagaaggtggagattgccaacctcgccaagatcgtccaggcaatctgcgggcagttgtacaggtgcatccaggacgaactcctgccactgctcgtccagcccatgaacattgccgcgtaccagccggacggccctgacaaggccaaggagttcatcggggcttgacatacagacaaggctagcttccagtttggcagctgccgctaacctcactgtgcttatcaggtaagttatatatatatatgtgtgtgtgtgtgtgtgtgtgtgtgtgtgtgtgtgtgtgtgtgtgtgtcagtatgtagatttgacttacttacgcctgagcgaaggacgtaatgttcattcgaaattaaagtgctatacttgccttattttttggttgttggggcgtattttggtttcaaaatagtattctaagcattgaccattcttctcataagatagataattctttttttttccgtgaggc

SEQ ID NO: 6177 - DNA, 1995 bp, Oryza sativa
  Predicted polypeptide sequence is orthologous to G1772
atcaaattccaaaaaccctccgcgagctccgacgacgcggccgccatggacggcagcgacgacgagtgctgctactactacgacgccgtcgacagcgatggggacgaggaggaggaggaggagataataatgctggacgaggacgacgtaggcttgctcgacggcgccgcgctgccgccgccggaggaggaggtggagcaccgcgcgatttgctgggccattacaaaagaatcccttgcagctgcgcaggagcaagacctgtccatggtgatgaacctggtgaacgttgagcggcacaacgcgcgcgccctcctcgcccaccaccggtggaagatggagcgcatctacgaccgcctcgacatgatgggccgggacgccttgctcagggacgccggcgtcgttgtgctgccggagaagagcagcagcagcggcagcagcatggccatggcgaagacgaaccccccgggaagcgtggctgtcacctgcaacgtctgctttgaggagtacccactcggctctgtctccgccatggattgtggccactgcttctgcaatgactgttggacggagtacttcgctgcggcggtgagcgacggcagcaagcagatgaggtgcatggaggtgaagtgcacggcgatctgcgacgaggcggtggtgcggctgctgctgcacgggaagcaccccggcgcggcggcgcggctggaccgccgcctcctggaggcgtgcgtggaggccagcgacgcggtgcggtggtgccccagcgcgccgcactgcgggcgcgccatccgggtggacggcgggggcggcggcgaggagcggtacgccgaggtgtcgtgcccctgcggcgccgtcttctgcttccgctgcggcggcggcgcgcactcgccgtgcccgtgccccatgtgggacaagtggggcgccatgcgcggcggcggcgaggtcggcaacctcaagtggatcgtcgccaacaccaagagctgccccaagtgctccaagcccatcgagaagaacggcggctgcaaccatgtcacttgcacctgcggccagcatctctgctacgcgtgcggcgcggcgacggggacgttgtacatgcacatctgcaaccgctacaaggaggagggcggcggcggcggcgtgaaggtggagatgaccgccggtgggcggcagcggctgcggttcatgcactactacgagcggttcgagatccacaccgagtcgtacaaggaggagcaggggaagctgggtccggccatcgacgctctggcgcggcggctggaggcggacgccacgctgccgtggtcgggcaccagggacgcccggtggccgtcggcggcgcaccggcggctgctgcggtgccggcaggtgctcccgcggtcgtacgtgctcgcctactacatgttcggcggcggcgcggcgacgcggcgcgagcgggaggaggcggcggcgcagaaccggttcgaggatttgcaggggcagctggggcaccacgtggaggtgctgtccaggacgctggcggcggcggcgcggccggccgacgcggcggaggtcgtgaaggcgaagcgcgacgccgacaacctcgcccgcgtcgtcgaggggctgtgcgccgggatgtaccggtgcgtccaggacgagctgctgccgctgctcgtcgagcccatgaacatcgccgcgtaccatccggacggcccggccatggccaaggagttcccgccggcgaccagcgtgaccggcggagcaccgccggcgacacgccactaagccacaacgtgtcgagttcattattactatacgaagcaaggttgtaaacggtcgatgggtgaagggaagcaggtggttttgggaaaaattctattgtccaaacatgtttgtggtttggcatggtggatttttggattaattactagctaagtagtataggaaatatcctatattgatacagaggaaatgatggattattttgtgctgattaattagtctaattgttcgacgttgtgc

SEQ ID NO: 6178 - DNA, 2482 bp, Oryza sativa
  Predicted polypeptide sequence is orthologous to G1777
gaaaccagtccctctttccggccgcaccaccaccgcctcccctccgtttcccctccctcacttccccttccgcgactgcgagcttctccgccgccgccgccgcccccaatcgcccgccgccccgcgccgcgattgcccctcccggtgcccctcccgcaggcgccgccgattcccccgacccggggaagccccggtttgccgcgagctgcgtcgccggtgggggtttgatttggggctgatccgatcgcccccccctagatggtgaccgacgccgaggaggtctccccgacggcgtcctcgtcggaattggagcaggaggacgatgacgatgactgctacctgagcgatcaggaggacgacgccttggaggagtccgtcctccaggtgctggaggacgaacgcgacgaggattgccattggtcctccacctccgtgatcaccaaggaatccctcttggcggcgcagagggaggatcttaggaaggtgatggagttgctagggttgagagagcaccacgcgcggacgctgctcatccactacaggtgggatgtcgaaaggattttcgagctgcttgatcagaaggggagggacaggctcttctcggaggctggtatccctctccaacctgctaataatcccggctcgccctcctcaacggaggtaacctgcaatgtttgctatgacgatgtgcccctctcggacgcctccaagatggactgcggccacaactactgcaatgaatgctggacaggatatttcattgtgaagataaatgagggacaaagccgccgtatcaagtgcatggctctgaagtgcaatactatctgtgacgaagcaatagtccgtaagctagtaaatgcaaagcggccagatattgcagagcgctttgaaaggttcttgttggaatcttatattgaggacaatgatacagtcaagtggtgcccaagcacaccgcattgtggaaatgctatacgcgtcaaaggtgatattcactgtgaggtggaatgtacatgtggacgccagttttgttttaattgctcctcagaagcacattcaccatgttcctgtgtgatgtgggagctctggatcaagaaatgccgtgacgagtcagagaccgtgaattggataacagtaaatactaagccctgtcccaagtgccacaaacctgttgagaagaacggtggctgcaatctggttgcatgtatatgtgggcaagcattctgctggttatgcggtggtgctactggcagagatcacacatggtcaagtattagtggccacagttgtggtcgattcactgaagatcagtcaaagaagacagagcaagctaggagaaacctttatcggtacatgcactaccacaacagatacaaagctcacactgattctcttaagcaggaagcaaagcttaagggcgacatccaggggaagatttccatttctgaaaacaaggattccaagataaaagattactcttgggtgataaatggattaaacagacttttcaggtcaaggcgggttctttcatattcttatccttttgcattctacatgtttggtgatgagattttcaaggatgagatgacttctgatgaaagagaactaaagcaaaacctatttgaggaccaacaacaacaattagaattcaacgttgaaagactatctggtttccttgagagggattttcaaaattttagtgatgatgaggttatggatacaatgaagcatgtcatcaatctttccaatgtggttgatagactctgcaagcaaatgtatcagtgcattgagaatgatttgttgtatccactgcgtacgcctcataatattgctccatacaaatccaagggccttgacagggcctcagagctcaatgtttgttgggattcttctgaacaaggtttgcaaccaattaactacagtcaagatgaacacaagagtcagcctggtttatctggttcatctatttttggaaagcggcaacttggctcaagttctaataacaatgggcggcctcacaagcgagaaagaaatgatgcccatggtggggttgccctttttgacctcaatgtgccagctgaagtggcagacaagatatgaaacttaaataacttacagcacattccgttgcaagtgtacagctgacccgggcttcttcagctacataaaggaaaactctgctcttttttgttgcgttagagtgtcgacatggcaagtttaaacggggggctataataccaacaatagggtagcgttcacttattctcttgtaaatcatgacaagaattggtggcaatgtgcaatgtgcacgttgcatagctcttataatgctaaatctacccctcgggcaagacgatggcattttggaagataaaattttgaaatgtccttttgcaaacatgcaaggtaatgtatgaagcatattggaagtgcctgcggatgcgtagcacctggaaattaatagaaacaaactaattgagtcgcg

SEQ ID NO: 6179 - DNA, 392 bp, Oryza sativa
  misc_feature (29)..(29): n is a, c, g, or t
  misc_feature (35)..(35): n is a, c, g, or t
  misc_feature (44)..(44): n is a, c, g, or t
  misc_feature (284)..(284): n is a, c, g, or t
  misc_feature (326)..(326): n is a, c, g, or t
  Predicted polypeptide sequence is orthologous to G1777
gggcccgggccggggtgcgggtcctggcncagccnccgagcccncgcctggatggccgggcccaggttctccgcctccgccgtgggcgagtcgccgtgggccgtgtgccggtcgtagtggtgcgcgtaccggagcaccttgcgcctcgccccgtccaccttcctcttgtccgccgcgtcgtcgtagcggttgcagcggtgcccgtcgatgctggtccagttgtgcgccagcccggtggccgcgccgcacagccagctgcaaacaacattcatgcatggtcgtcncatcaatggcgatcgaattgccaaggtgaattaagaatcttngaagtggatttttgtccctcagagggggcatcatctcgttttgtacatggcgtttataaggtaatt

SEQ ID NO: 6180 - DNA, 3376 bp, Oryza sativa
  Predicted polypeptide sequence is orthologous to G1784
gtccccccccccggctctctctcccttcactcggctcccagattcccacggcggcgaaccacacatctccgtcctctcccacggctgcgaccacccctcctttgctccgacgaccagcggcgcggatctggctgtacagcacgacctcggatcccacggcggcgactccccctcctctctgtcctctccgacgacggcgcaaggcggtgcaccatccctcctctcctcccacccccaccggcacggatcgggaggcggcgtggccggcgagcaccgtccgactcggatcgaggggcgactccctcccccttccggccggtagcgccacccccctccatctatcctcctcgtcggggcggcggctcgacgacggcgaggggagcgttgcttcgcttcggggcacggcctccccaaggcggtttggcccctctcccgcagaagccgagacggaaatagacgcaacagtccgattcggatcggagccggggggaacccggtgctatatatgccccaccaccgtcgaccgccgcagacccagggtcgtcaagtttgaaggcaacatgatgcagcaagacagcaagaggaagaggtccgtgctgccggagacggctacgttggccccgggaagcaagaggaggaggaggaaatctgtaccatcccgtcatgcggccgcgatgctacctgacgagttgctgacggaggtgtgcctgcggttgcccgtcaaatccatccttcgcttccgggctgcctgccgctcctgggacgcaatgctgtcttccgaggaatttggtcaactctacgcagcgagagccgaggagatgtcgtcagctcctaagctgctattcgtctcacctacggcaaatttcaactccaccgcggtgtacaagtgctcaccatcgaagcccaccgatgacctgctgctcacgcttgatgatgttcgcggaaactatgtggaggtgacacccgcaccatgccatggtctctccctcctgtatgatggtattgccccagcttactatgttatgaatgcaaccacacgggcagtcacacggttgccgcctttccgagatgtggcttttgccactgctggtcttgggtgcgatgcccggacgaagaagtacaaggtagtgaggctttttgaagggaacttgcttgagaaggaatttttgaagtgtgagatatacacacttgggggcgatgaaggggatatttggaggcctgccgctggtggagtacctttccggttctacagttttgctcgttctgctatttccaatgcggtgatgaacaaactgcagccacttttcttcaatggatatctgcactggttgatcaacccattgcatcacgttaaactaccaagagcttctattttatcattttctctcactgatgaaaccttcagatggatccgatcaccaccctttgtggcatctggagtgcatttggtggagcttgatggtaatctgtgtatggtccgagaccttcgtgataggtcaactgctgtttgcaagttggaaatttggaagcttaaggactataactctggtgattggtctttggatcatcgaattgatttaacagggcagttgcctagggatttacttgagccacagatagtgaaagttatcggttccgctggtagttgcagatcaggtacgaagataatcatcgccacatccaagcacaaagtttgttcctatgatcctgtttctagaactctggaaaccattacctcaatctcggagacctgcacatcctatcaaaatgagaaatctgatattagattcagtttatttaaagaatgccttaccccagtgcataaaacaagggaagagattgccttcgcaactcccttgtctaaggctactaaggagatcctactccgactcccggctgaatcagtcttgaagttcaaaccagtctgtaagcaatggcttgggctgataaagagtgaaagatttatccgtgcatactttgcacacaagaacatggacaagaggccaaaaatcatgcttgtgggtaagggctctggaaaatcacttttcaactttgttcccttaagtaaatggcttcaagaggcatccaatcaaggcacactgtttcttgacacaaaggtggtttgctccaagccttgccgtggattgaatttgatgagcttcgtggaggaggactatctgttcaacccgtgtacaggttaccacagggtctactggaacagagagtggcatcagcaccaaccatggaaaatgcctacgggttgccgtgaacaagaagacaatccttttgcagttggcaataagaatgttggtttggggttcagccaggtgattcaggatcatgttgttgtggggattttctatgaccggaaagactacaactctcgtgagtattctttaacatgttctctatggagctgtggttctggatacttcgagcaactcccgcagccacctctgcctgtgaatgacatgccacctgtctctgtggatggagtgctgtactggatgagcgaaccaaggttgggtcagagttatgaacgagccattgtgtcttttgacattgccgctaagatatttgaagtcatcccttgcccttcaagcattgcaatgtgggaccccagaagtcgctgccatgcatttgtggtggagcttctaggaaagttgtgtgctgttctttcaaattcagttgcagatgagttagatatatggaagtgggatcatggtctatggactagagcatacacaatcaatttaaaattctggccagattactcacttgcaacgaatgttgtagtgcctatggcagttgaccttacagatggaaggattctgctgaatactgggaggaagcttggtttatataatccatttgatcaaacaattgaaaacttgcttgcacttgatcaggtgtcacttgccacacctaaagtgcagcaacagcgcactggaggtcatcttaagtgccacattaccagatgcgaagatgttcctaggaagttttctccgtggaaactatctatggctccatgtgagaactttgctacacctccaagtgcctcatcagggaagaatctgttgtcctccagacaccaatatgtgaaggcactaaatagtgtgagcccaaaggttatgcctgtggttcctatgttgtatgaggagagcctaacttattatccctttgctgcccgagcgagagtgttgtttagttgaagtggtacctttgtcaaatctaccatttcatgtgtcagataggtcctccatgtttggccataccatgtcaccaagtttttataatgtaatattttgatgtttatgtcacgtagctgtcagaattatagttgtgttgcataatttatttgacttgtatttcaagc

SEQ ID NO: 6181 - DNA, 504 bp, Oryza sativa
  Predicted polypeptide sequence is orthologous to G1786
cagttttgctatactgagtatccaaaccacagtgtctggcaaaacatgtctgcagcagtctggtgggctgcaccacacaatgctgcacctgatgcaaggacacagtagacacgtggtgtgacaaggcacataagcgctaggcaaggctgacacgactgccctagccaagtgtttgggtggatgctgctactgtggatgcggaatgtctggctgcaaagctgcaaagctgctgattgggctgtttgaacgtggccaatgtctgaggatgatgcggtgatgctgacccctgagggtgactgatggtcgcaaccccagtgacccttgaccacccctgtggcaggtggtgctgtggtaatggagtgtgttgaaccagtgatgagtgggtgtgcaggaaagttgaaaaatgaagctgccagatatcatcagaggtgacatgtgaaactttgggggatataaaatagaaataaagttgtctttcatatgtaaaaaaaaaaaaaaaaaaaa

SEQ ID NO: 6182 - DNA, 462 bp, Oryza sativa
  Predicted polypeptide sequence is orthologous to G1786
tttttttctttttttttttttttttttttttttttttttcgacccaacccagtccccctcttcaaaactcaaagctttcaaaacctgaatactacagggattaccggattcaatcatgaatgaatctaccctgttcaattttcgatgcaaacctgccttacccctaccggtccctcaggcaaggaatttcatgcctccaaccctcaacaggctcataaacaaaaatcatgaacctgcccctcaacatgtcataacatcaggctaaaacaagcggaaaaatatgtaccaattgaaaccaattttgccgtcaaaccaccggcttttttccaaatgacaaccgcgaattctcaaatccctgaatgaacaactgcgtccccgttgcgggcaatggcaaccatggacctccaggtgccacaacttcctttaggagggcctttgcaattgggacaagggcttggtttg

SEQ ID NO: 6183 - DNA, 680 bp, Oryza sativa
  Predicted polypeptide sequence is orthologous to G1789, G1911
tttttttttttttttttttttttttttttttctagcaggcacaactttataatcactagcacacaagtacagaagtcttacatcactgatgtttactacataatttagctggaaggtttaacaaccacacacaatgccaaaggcaggctagtttctgcaaaatcgacactgatttgctttacaacctaaagtatgtacaaacaaggcttttcttcttttatttataaccaagcgaccacaatctttttaggcaataacaatatcaatatacttccttgattccttcagtaacttagccacagctagcagggaatataatttatatgggaatttttttcctgttgtcgggaacctcaaatgcttccacccctatcagttccatgctccctgggtattgtacttggggaacgggactcttcttgcctctatcagcttgaggtcgccctcgaggatctcataggggcggcacacctcatcggctgtcttggtgcctcccatggcgcgagacaccttgtgaaagaggtcaggcgcaccctcgccgtattaggcaagagcctcctcgaacagcttgttctcctttttgctcactctgagcccatgttgacactgttgctgttgcgggaggagctgtttgacctagaaaaatccttggattggactacggcttttctttggaagga

SEQ ID NO: 6184 - DNA, 598 bp, Oryza sativa
  Predicted polypeptide sequence is orthologous to G1789, G1911
aatatcaaaacacagcagagatcgatagatctcttctgaagtccaaaaaaaacttcagtctagctgcacactagttagcaagttacttagcgttcaacttccaaagaagacagtagctagctagtttaatcaaatccaagctgcaggatgtcttctgctgggtcacgtagctcgtcccgcaacagcaacatggcgtcagagtggagcaaagaggagaacaagctgttcgagcaggccattgcctactacggcgagggcgcgcctgatctctggcacaaggtgtcccgcgccatgaggggcaccaagacagccgacgaggtgcgcctccacttcgagatcctcgtggacgatatcaagctgattgaggcaaggcgagtcccgttccccaagtacaatacacagggagcatggaactgaccgactgaggggtggaagcatctgaggttccagcaaggaaataactccaatataaactatattccttcctgtggctagttgttgaaggaaagcatattgatatattgttactgtgttaagaagattgtggtcgattgcttggttataaataaaagaagaaagggattgtctgtatatactt

SEQ ID NO: 6185 - DNA, 282 bp, Oryza sativa
  Predicted polypeptide sequence is orthologous to G1789, G1911
atggcatccagctccaaggcctcgtcctcgtcgtcggcgtcggcggcgtcgtcggagtggacgaagcagcagaacaagcagttcgagcgcgccctggcggtgtacgacaccgacgccccggaccggtggcacaacgtcgcccgctacatgggcggcgccaagtccgccgaggaggtgcgccgccactacgagcggctccaggcggatgtcgagcagattgaggccggcggcgtgccgttctccttgggctacggcgccacgccacaggccggccgccgctag

SEQ ID NO: 6186 - DNA, 666 bp, Oryza sativa
  Predicted polypeptide sequence is orthologous to G1789, G1911
atggactcagagtggagcaaaaaggagaacaagctgttcgaggaggctcttgcctactacggcgagggcgcgcctgacctctttcacaaggtgtctcgcgccatgggaggcaccaagacagccgatgaggtgcgccgccactatgagatcctcgaggacgacctcaagctgatagaggcaagaagagtcccgttccccaatggtatgcacgatgcaccattttgtgattattggtttgcacataggctgcgcgacgaggccgcgggcgaccggcggtggcggtggcggtggcggtggcggtgcgccccttcacctgcggcggattcgcccttgccgggacgacttttgagccgcccaaccaccgagcgcccaaggcctgatgggcttatttctcccaacggcccatataccttcacgggccgtcctgcttcgctggaccaccggatgggtcacgtcgccggccccgctaaactcggtgacggcgacaaaagctcctcaaaggatgccatgggccggggtgctagcttgccgacaacactcctcgtccgatgggcagtgacatgtaccaccaccaccactcgcaggagaaatgatcaggcatacagtcgcggcgcgccgtatcggatccccgtggcgttggccattgccattgccatcctgggttaa

SEQ ID NO: 6187 - DNA, 919 bp, Oryza sativa
  misc_feature (919)..(919): n is a, c, g, or t
  Predicted polypeptide sequence is orthologous to G1789, G1911
atcggccatttggccgggggctgcaaacactcgataaccagttcagaaagagaattgctgtgtgagactcgatggcgtcgatgtcggtgagctcgtcgagggcgccgcagtggacggcgaggcagaacgagcagttcgagcgggcgctggcggtgtacgacagggacacgccggagcggtggcacaacatcgcgcgcgccgttgcggggaagtccgccgacgaggtgaagctctactacgacctgctcgtggaggacgtcaagcgcatcgagaccgggaaggtgcccttccccgcgtacaggtgccccccgcccgcgattgcaggctgaaagcacctcgatctgaacgactgcacctggagatctagctatgcggcatgaataatatcctagtctgcactctgtactacgttgatcaatcgatctcccgcgagcgtgcttatttgtaaatttatgcacgcgtgcaataatgtaattaatatatgtgtaatagcatatttgggggtaatgaatgacactcctaaagctattaagttgaagtgccaaaaaaacacgaccgagcacgcacacaacatgtcggacgtctcggaccaggcgagtctaactccaggcaagataatgctatgggacgacattcaactccctgggcaaacgccccatatgagcggcccaccaaccaggcgcgcgtacaaccgcgcgagggaaagtggccattcaattaccggatagtaccgtcagggtcacatagagacgaatctactacgaagctagtgaggagcgtaaccagtatacgtacagaacacagagacatactaacatgatgtcatttctttcttttttgccgcctctcattctcttctctctctccctcgtcatgatggctagcaatagagagaaggcaacaacaaaaggtaagacan

SEQ ID NO: 6188 - DNA, 577 bp, Oryza sativa
  Predicted polypeptide sequence is orthologous to G1789, G1911
cgtcgaagacacagcaagatctttacattagagctttcagtagtcagtgtcttaccaaggccactcttgaagatgtctgggtcccggagctcctcccccaactcgaagtctgagtggagcaggaaggagaacaagatgttcgaggaggcgctcgcctactacggcgaggacacgcccaaccggtgggacaaggtggccagcgccatgggaggcatcaagtccgctgaggagatccgctgccactacgaagacctcaccgatgacgtctagacgatcgagtccgggcgagtgcagttccccaagtacaagacgcagggatactggacctgaggatgaaccattggaagctccgatagacagaagatgaagttgtataaactagatccctaagaaagacttgctctaggaggaaccaaattaagtaatccagcattgcttagagaataaaggaagagaaggggtgtgtatgcatatagtattgggttatgagcaaggttaagtccccatgctgttgtagattctcgtctacattcgtcaactgcagtattcattaactctgtgaactaaattatgaagt

SEQ ID NO: 6189 - DNA, 1289 bp, Oryza sativa
  Predicted polypeptide sequence is orthologous to G1793
aatatgaccaggcaggagtatattgcatacctaagaaggaatagcagtggattttctcgtggtgcatcgaaatatcgtggtgtaaccaggcaccatcagcatgggagatggcaagcaaggatagggagggttgcaggaaacaaggacctctacttaggcaccttcagcaccgaggaggaggcggcggaggcgtacgacatcgcggcgatcaagttccgggggctcaacgccgtcaccaactttgacatgagccgctacgacgtcaagagcatcctggagagcagcacgctgccggtgggcggcgcggcgaggcggctgaaggaggcggcggaccacgcggaggcggccggcgccaccatctggcgcgccgccgacatggacggcgccggcgtcatctccggcctggccgacgtcgggatgggcgcctacgccgcctcgtaccaccaccaccaccaccacggctggccgaccatcgcgttccagcagccgccgccgctcgccgtgcactacccgtacggccaggcgccggcggcgccgtcgcgcgggtggtgcaagcccgagcaggacgccgccgtcgctgccgccgcgcacagcctccaggacctccagcagctgcacctcggcagcgccgccgcccacaacttcttccaggcgtcgtcgagctcgacggtctacaacggcggcggcggcgggtaccagggcctcggtggcaacgccttcttgatgccggcgagcaccgtcgtggccgaccaggggcacagcagcacggccaccaaccatggaaacacctgcagctacggcaacgaggagcaggggaagctcatcgggtacgacgccatggcgatggcgagcggcgccgccggcggcgggtaccagctgtcgcagggctcggcgtcgacggtgagcatcgcgagggcgaacggctactcggccaactggagctcgcctttcaatggcgccatgggatgatcgatgaagaggagcaacaggagctagtatagctaattaggggatcgatcgattaattaagctagatcaagtcaagtttaggttagacgaatcttgatcacggttgtgttgcaactcgtttggtcgttgatcaggttttgcttgactgggtgtgagtgacacacacgcaaggtgctgccttccggaagctgggtaatggcaggtaagggtataagctagtaaagtttgtgttgtaacttctaagttaatatccttgcttgctgttagttttgggtatagtttcagaaggatcatgccaatcctcagaggagatacacact

SEQ ID NO: 6190 - DNA, 966 bp, Oryza sativa
  Predicted polypeptide sequence is orthologous to G1793
atgaagctgcagggggcccatgcagctcgtcgcatccgagtcctctccaagctccgtcttctagggtttgcgccgcgacgagctctcgaagatttcgccgaggagaaatccaagaagaagaagattcacctcgcggcgatggccaccgtgcaacccgccgcctcggaccccgcgcctcctcctcctccggagacggaggagcagccggccgcggcggggggcgaggagatcgcggcgctcgacgagcagctggccgtcgcggacggcggcggggatgatgggaaagcggctgcggcggcggagggaggaggaggaggaggaggagggaagctggtggcggagaccatgcgcaagtacgccgcgccgcggtcgtcgcggtaccacggcgtcacgaggttgaagtggagcggcaagttcgaggcgcacctctgggacaacagcagccaggtcgagggccgcaagcgcaaggggaagcatggaagctatgttactgaagagaatgctgcaagggcacatgaccttgcagcccttaaatattggggtgcagggccaaacaccaaacttaacttcaatgtttctgattatgagaaagaaatcgagaggatgaagaccatgtcccaagatgaatttgtggtgtacataagaaggcagagcagctgtttctcaagaggaacttcatcatataggggtgtaacaaggcgaaaggatggtagatggcaagcacggattggtaggattggagaaagtagagacaccaaagacatctatcttggtacctttgaaacggagatagaggcagctgaagcttatgacctagctgccatcgagcttcgtggtgcccatgctgtgaccaactttgatattagtaactactgtgaagatggtttgaaaaaattagaagcctcatcagaggttccaaagctactagagggtccatcgaaggctgcgaagctcgctggacgatag

SEQ ID NO: 6191 - DNA, 837 bp, Oryza sativa
  Predicted polypeptide sequence is orthologous to G1793
atggccaccgtgcaacccgccgcctcggaccccgcgcctcctcctcctccggagacggaggagcagccggccgcggcggggggcgaggagatcgcggcgctcgacgagcagctggccgtcgcggacggcggcggggatgatgggaaagcggctgcggcggcggagggaggaggaggaggaggaggagggaagctggtggcggagaccatgcgcaagtacgccgcgccgcggtcgtcgcggtaccacggcgtcacgaggttgaagtggagcggcaagttcgaggcgcacctctgggacaacagcagccaggtcgagggccgcaagcgcaaggggaagcatgtgtacctaggaagctatgttactgaagagaatgctgcaagggcacatgaccttgcagcccttaaatattggggtgcagggccaaacaccaaacttaacttcaatgtttctgattatgagaaagaaatcgagaggatgaagaccatgtcccaagatgaatttgtggtgtacataagaaggcagagcagctgtttctcaagaggaacttcatcatataggggtgtaacaaggcgaaaggatggtagatggcaagcacggattggtaggattggagaaagtagagacaccaaagacatctatcttggtacctttgaaacggagatagaggcagctgaagcttatgacctagctgccatcgagcttcgtggtgcccatgctgtgaccaactttgatattagtaactactgtgaagatggtttgaaaaaattagaagcctcatcagaggttccaaagctactagagggtccatcgaaggctgcgaagctcgctggacgatag

SEQ ID NO: 6192 - DNA, 1104 bp, Oryza sativa
  Predicted polypeptide sequence is orthologous to G1793
atggagagctctttgaaagaggagaaggctgcgggcgaatcaggggatgatgagaaggcggagaggagctcccctatcaatctgaattcgttgccagcaactgcggcgtgtgcggcgaccgccccggatgaggatggcttgcactctgcagtggagtcaggagctaaggattcgaacaccacgaagggagttgagtctcttggtactggtcacaagaagatcccgaaacgtgaggtagttgatgaagttgatgttcagacctgtgccgaaggaaagaacgattcagtggtcccttcaagcagcaagaaccctatcaatgataagaatgcaaaggcaaatgtggcagagaatggacagtctgctgatggtatccctgaggatcagagagttactattcttagtgttgtcaagaaggatgagcctgctgatgatgttagagattcagttaatcctgtaacagtcgtaggttatagagatgagaagggtggaactagtggtactgctggaactacggctgtgcgacctgcaggcacccggtcatctagtttccatggtgtgaccaggcatagatggagtggaaaatatgaagctcatctgtgggacagttcgtgcagaatggaagggcggagaagaaagggaaggcaagtttatttaggaagttatgataccgaggaaaaagctgccaggtcatatgatgttgcagctcttaaatactggggccaaaatacaaagctgaatttctcggtttcagaatacgaaagggaactggaggacataagggacatgtctcgagaggaatgcgtaacatacctaagaagaagaagtagctgcttctcaagaggggcttctatttatagaggagttactagaaggcagaaagatgggaggtggcaggcacgcataggactggttgctggaacaagagacatttacctgggaactttcaaaactgaggaagaagcagcggaggcttacgacattgctgctattgagatccgtggcaaaaatgcggtgaccaactttgatcgaagcaactacatggagaagggtatgcactgtatagaaggggcaggcttgaagctgcttgcgtctaagccagaatga

SEQ ID NO: 6193 - DNA, 992 bp, Oryza sativa
  Predicted polypeptide sequence is orthologous to G1794
atgccctcagcaagatcaagtgcacgttcgatctcgacgtcgccacgcgaaatcccactggacggacagcgttcttgaatataatcttgatcgatgcggccgccggcaatggcggcgctcttcgaggccgcggagacggcggccatcgtggctgcgctgacgcgcgtcattgccgacggcgggcgtggaggcggcggcggcgtctgcgtgccgccgcccgcgccgtcgttggtcgtgccgccgcgggcgggaacaggcggcgggcggcgcgtcgacgttgcgcgggaggaggagatgcgggagatcacgccggcggggcaaacgtggccgaggcggcggcggcggtggtggtggcggcgccggcgacagcgcgcaggtaccgcggggtgaggcggcgaccgtggggcaagtgggcggcggagatcagggacccgaggaaggcggcgcgcgtctggctgggcaccttccgcaccgccgaggacgcggcgcgcgcctacgacgccgccgcgctacgcttccgcgggcgccgcgccaagctcaacttccccgaggaggtgtcccgcccgtggcagggtcacgatgtcgatcacatgtcctgctcgccgccgtcgatctcgaacgctcgctttctgggttcgtggaccttcggaccgccgcagccgccatcgcggtccgtcgcggcggcggcgacgactctgcttggtgggagccatggaggcaacggagcagagaacgggagggaatagcgcgcgagacaaaaagggctggagagatgggaatcgtcgtcccgggtactcctagtccacagaacttgaattagactcgcatttcgttttttttcggcatagtagtatttattttgttttaagttggtggtgtagccttttcttttcttcttcttttcgttcttcttggataatgctgctgcattttgttcgatattatcggtagtactgtttggtgatgttttaatatatttctaaataaaagtt

SEQ ID NO: 6194 - DNA, 1521 bp, Oryza sativa
  Predicted polypeptide sequence is orthologous to G1794
aacggaagcttagctgagttgggtttggtctcgccgctggccggagtagagcggtccatgtgctgtaccggcgacgaggtggcgggacccggagagcagcggcggcggccgctcgacgccgacgccggcggcgacaagggcgcggtggcgacgacgtcgtcgtcgttgttggcggcgccgatgctgtcgcggcggaggcaggcggaggagatggcggcgatggtgtcggcgctggcgagtgtcgtggccggcggcggcggcacgtcgttgccggcgaagaggccagccgagagagagcccgaggagggcgccgccgtggagggggtgtggtggtcgtactgcagtgagctcgccgccgccgccgccgcgccgtcgccggcggctccatttccggccggtacgctacgtgccatcgccggggcaacactcgcctgcgtcggcggcggccggcgacgaggaggagctcccgtcgccgtcctcggccgactccagcggcggcacggcgaggaagcggtacagaggggtgcggcagcggccgtgggggaagtgggcggcggagatccgggacccgcacaaggcggcgcgcgtgtggctcggcaccttcgacaccgccgaggacgccgcccgcgcctacgacggcgccgccctccgcttccgcggcagccgcgccaagctcaacttccccgagcacgccaccctcccaccgccgccgacgacgacgacggccgccgctcaccggtgcccgccaccgccgcggacggacgcgctgctggagtcgcaggagctctctcccggcgccggcggcggtgacccgtactctcagtacgcgaggttcttgcagggctccggcggcgacggtggcgaggcggcggcgcggcccggcggtggcgcctcgcaaagaacgccacccgccactacactgctctacagcttcgagggagacgctgcttccgccgcctgcctctggcagccggagagcggcggcggcgggatggggtggccggcgacttcgccggcggcgtggttggagtacggtttctacccgccgccggagcggcgcgacacggacacgtagggttaatcacgatgtgatcctgagcggaataggcggtgacgctgacaggtggggcctacttttgccaggtgcggtcaacggtcaacctgaagttgacgtggcatgccacgtaatgcggcggtcaacgggttcagacggaagtgggtcatggacggcacgagacgccgtcagaaataaatgctcgaaactgacacgatggattacattgttcgtcaaattctcagagggccacatagttgcaggagggggaattattattcagcattgtttttttcgtaaaattcatcgctccaaaaacatcacacatctcaagcttgtacgaatgaaactagtgcagtctgaagattttctttttctggttttatagaacaaaagatttttgaagaaacccaatcctatgaaaaaaaatttcttatatgaaaggaatgggcatccaaaattcctgt

SEQ ID NO: 6195 - DNA, 1161 bp, Oryza sativa
  Predicted polypeptide sequence is orthologous to G1794
atgtgcttcgacctggcagaccaacgtggaccacgcggcggcggcggcaggccggtgaagggcggcggcgacgggcgtgcggcggcggcggcggcggcgacggcaatgacggtggcgggggcgtcggagctcatgtcggggtattaccaggcgcaggagatgtcgacgatggtgtcggcgctggcgcgcgtcgtggcgggcggcggcggcggcggcggcgacggcgacggcgaccagtgggcgtggtcgtcgccgtcgccgtcgtcgtcagcggcggcggcggcggcgcgtggcgtgcaggagaggaggcgggaggagcaggcaatgcacgagctggcgggatacgcctgcgggggcgcgccatcgccggagttcgcaggatcggagcagagctcggacacccagagcgcgagcgcggcgaccatggacgagcaccactcgccggtgggcggcggcgggaacgcggaggggcccgacacgccgcggcggcggtaccgcggggtgcggcagcggccgtgggggaagtgggcggcggagatccgggacccgcacaaggcggcgcgggtgtggctcggcacgttcgagacggcggaggccgcggcgcgggcctacgacgaggccgcgctccggttccgcggcagccgcgccaagctcaacttccccgaggacgcgcgcctctacccgaccgccgccaccaccaccaccgcggcgccgcccccggcgccggtcgcggcggcatcgccttccgcggccatctaccccggcgcctcccagagcgccgagtacctgcgctaccagatgcttctgcaggggaggcttaccaccgccacccccaaccaaggcacccttcttccgttctacggcggcggcggcggcggtggctccatgaccaatccctacggaggcggtggcggcggcgccatgagcggcttcctcggctcctactactctttccctaccccctctgtttccgtggccaccgtcccctcctccacctcctccgcgccgggcaactactactcgtcccacggcggctcgcaccagagcatgtcggcggcggaggagtggaactgggagaacgccctggtctacccggcgacggcggcgtcatggtcggagtcgagctatcaccaccacccgccgccgccgcacacgcagtag

SEQ ID NO: 6196 - DNA, 651 bp, Oryza sativa
  Predicted polypeptide sequence is orthologous to G1794
atggcggcgctcttcgaggccgcggagacggcggccatcgtggctgcgctgacgcgcgtcattgccgacggcgggcgtggaggcagcggcgccggcgtgccgccgcccgcgccatcgttggtggtgccgccgctggcgggaacgggcggcgggcggcgcgtcgacgttgcgcgggaggaggagatggtcggcgtcgtctccgcgggagatcacaccggcgaggcaagcgtggccgcggcgggggtggtggtggcggcgccggcgacagcgcgcaggtaccgcggggtgaggcggcggccgtggggcaagtgggcggcggagatcagggacccgaggaaggcggcgcgcgtctggctgggcaccttccgcaccaccgaggacgcggcgcgcgcctacgacgccgccgtgctccgcttccgcgggcgccgcgccaagctcaacttccccgaggaggcgtcccgcccgcgccgcccgtggaagggtcacgacgtcgatcacatgtcctgctcgccaccatcgatcgcgaacgctcgctttctgggttcgtggatcttcggacctccgccgccgtcgcggtccgtcgcggcggcgacaacgactctgcttggtgggagccatggaagcaacggagcagataatgggagggaatag

SEQ ID NO: 6197 - DNA, 2174 bp, Oryza sativa
  Predicted polypeptide sequence is orthologous to G1796
gaatcatgtcatgcgagcagcagcagaagcagcatccaccatgggaagagagatgcgttggaggaggcgagaggaagaagaagaggtggccgtgtggctaaggcccaaacacaagggcccatgagcataaccagttccttccgttacattaaaccctagacgctcctcctctcctgcccgcgcgcagttctgctgcttgctgctccggcgctggccctctcttctcccttctccgaccttgcgcctccctcaggctgaagatcgattacatcgcaggacaggacgcgcaatcgactttgcaggtactcttccttccttcctcacaattgtctcctggatcttggtatgtactactgcttaaatcgcctctcgacaaacggatcccctcgtttccttctgctctgcaaataatccacccgctttttttttaattatttccctagctttgaagatattttaagtatgtctccgtcgacgattgatttctcgcggcggtttcttaatctgatcgtgggcaaccgcacccctggtgtcaaatcgctatggtgcttcgacctgatgcgccagcagctgttctatccggcaacacctccaccgccacacaaggttgaggaattctggcaaaagtttagaccgccgggcacaatgatggacagcatggggcttcccttctcctgcttcaccttccgagcttcagctctcaacgtcaacggccaatcgaggatggactgtttcccgcttgctggcggcgaggtgatttgcatggatcagtctggccgcgcgttcctcgtcgacgctgatgcgtgccaggtaggaaccatgcccagtcttcacaaccccaagtcgatgcccttggccgtcttcgtccccaatgccaaggctgacaatgactatgaccatgatggctatggcagcagcctctttgtcatggagaggattcccaaaccggagttgggcttcaacagcgatcagtttgaggccttcatataccgcaagcctacaatatccaactacacaaaggcctggcactgccatcaactcccacccccgccttttgtccgtgaacccaagcactggcacagctgcagcaacccagagatcagctcctacgctgtgcttggcggtggctcacacatttgcttatctgtcaatggcatcggcacctactgcctggagacagcaagccacacatggagccaagttggcaagtggacactgccgttccatggcaggattgattatgtgcctgagttcaacctctggtttggcctctctgctgaggcccgtcgcttggctgcggctgacctctctgccatggactcctagccacagctagtgggcccttggaaggaactcaacctgccagaggaatggagggaatgcaaggatcctcaacttgttaaccttggctcaggcaggttctgcatcgctaggttcttccgcagcaacagtgactttggggatgaacaaattaccgtgtttacaggtgtggaggtagtgccacacgtcggcgatgccaatggctatgcaaataagggcagcaatgggaaagtgcaactccaaatgatccctcactgatcaaaatgtcacatatctaatgctactaccatcgatgttgtgttctgactaatattagtgctggcatccttttttatttgtttatattttatctgaataagagatgacttagaatattgttgtaagagatggtctccctatgatctctatttactagtagtgcggtattgtatcctgcaatggtagattctaaaattaactgaatttagtcccctttcctaagctcaacgagtggccaggagggctgaggtagaagaacccgactgaaggggtatattggtcaacccaagtaaaaaaatggtggaaatccagtgaattggcaaatatggcaaagaaaaggtttggtatcgcctagggatggccttttaacgaatccaatccgtggaatggcatttgagcgaaaccctcttttggtagtggcagaatgtccaatttctcgtttcgttcaacacaattgtgtgttactgaaaacatgtgtgatgtttggaatttcagttcaaggtgttgataatcacctcctaccctgttgctattgtgacctgtctggctgacagataattaatctgtcatgccacaaattacatgatgttcctgcc

SEQ ID NO: 6198 - DNA, 1251 bp, Oryza sativa
  Predicted polypeptide sequence is orthologous to G1804
ggtttccatgaacatggacgagtttgtggctaacatatggaatgctgaagaattccaggctaccaccggaggttgcaagggtgccatggaggaagccaaggtggtagacagtggaagcggaagcggtggtgcaggaggaagcggtttatgtcggcagggatcattttccttgccgctaccgctgtgccagaagacggtggaggaggtgtggactgagatcaaccaagcccctgcacacacctccgctccggcctccgcgctccagccacatgccgggagcggtggtgttgcagctaacgaccgacaggtaacactaggtgagatgacacttgaggatttcttggtaaaggccggggtggtccgagggtcctttaccgggcaagcggccatgggatctggcatggtcaacgggccggtgaaccccatgcagcagggccaaggcggtcctatgatgttcccagtaggaccggtaaacgccatgtatccggtgatgggtgatggcatggggtaccccggtgggtacaacgggatggcgattgtgccaccgccacctcccgcccaaggtgccatggttgtcgtgagtcctggatcatcagatgggatgagtgccatgacacatgctgatatgatgaattgtattgggaatgggatgatgattgagaatggaacaagaaagcgtccccacagagaggatggctgcgccgagaagacggtggagcgccgccaacggcgcatgatcaagaaccgtgagtcagctgcacggtcccgtgctagaaagcaggcttatacggtggagctcgaagctgaactgaactatctcaagcaggagaacgctcgtctcaaagaggcagagaagacggttctactgacaaagaagcaaatgctggttgagaaaatgatggagcagtccaaggagaagatgaatgcaaataggggtggcagccagctgcgccgcagcggcagctgcatgtggtgaaacgggcatagcggtgaccggcgagtggcacactcatcctgcttctggtgtggcactagcctctgaggctctgaagaggatttgcacattaagtcttctttcagactaagtgatgtgaaggtattatggtagtagttgatatacatatatgctgtgatgcttgtaaacctgcctggacccacatgtcttgccatcgtgttcaccggtccttgctgcttatatggttacatgtcgctgtttgtacaaaacaacgatgaataaaattatacaatagt

SEQ ID NO: 6199 - DNA, 1416 bp, Oryza sativa
  Predicted polypeptide sequence is orthologous to G1823
atgagcgcaccgccgccgccgccagacgccggcggccgtcgccggccgccgccgatgacgacgctcgcgccgccgcacgggctggtggtcgtcggagacgacgccgtgcggcgcgccgtggtggcgaggcttggagtgaacttccgagcgacggtttgctcggagatcaacgccgccgtggagatgctgcgtgagagaatgaaagaattcgatttcgtggtgatttcagaagagttgatcattagaagctcaaggccagagatcatgaaatttttacgcgagacagggctgaggctactcgaggaagaaggacaactactcgaccccgtcgtcgtcgggcgatctgccacggtcaacagagagattccacaggcggcgtcgtcgtcgtcgtcgtcgtcgtctaggctgcaggcggcatcaccgcacggtgacagcagcaacggcgccccggcgacgacgaccatggcggcaacggcggcggtggcggcgatagcctcgtcggtgaaaagggcgaccaacaaccggaggaaacaacggcgcgccaaagtgcaatctggccgccagcatcggcagaggaagcggaggctcgtctggacagacgagctgcagaagatgttcagggaagcatttaaccagctctcgctgacacaaaatttgaattcttatcactctgttttgataataaagatccaagaggactatgaaaaaaatacccggtgcccacaaaaatactttaagttgatgaaattgatgattgatccgatgaatgatttaagtctaacccgagataacattgctagttatctccagaagcataagaaacgtcttcaaaaagaatatcagaaacatcagaatcttcttgaacaaaaagaccaacagttacctattgttgacaataccaataccagttctatccaacaaaaaaatatgcattatgaatcctgctacaatgaacatagtaacaagcaacccaagttgaaggaacccacgttgttgacagctaattatcatgggcttagaaacatgcatcatcatcacaaaaacatcatcaacatggaaccttccaatgtactgcggcctcctaacttgaacaatgcaaagggctttaatatgcccttcaacaaggaaggagtcgatgaagccatatatcagagccaactaatggcacatcaagtttatgcaaatcatgttgatgcaacagcacaaaccacctgggaagtaacgatgacgcaagatatgcgccccatatctcaagtacatcaacatggttgtgaaacaacacctgtcgattcctctaataatacaaatggcatatctgaaaatgttgaaacctttaagagagtttctattacatctaagagagatattgcttatgtgaactcaagtcgtaccatccggtttagtttatttgaataa

SEQ ID NO: 6200 - DNA, 1131 bp, Oryza sativa
  Predicted polypeptide sequence is orthologous to G1823
atggtaattgatgaagataaatgccatgctgattctacaagctacatgctttctgcagaactcaacttttctgtcactgtatttacaagccccataaaagcactagactttcttcagaatcatgcagaaggtgttgatttggtgctggcagatgtccacatggaagagatgaatggttttgatttccttaaagttgcaagagagcttcataaatccattcaagtgattatgatgtcaactgaaacgacaatgtacacaatgaagaggtgcgtcaaacttggagctcaatttttggtcaataagccccttgatgctggaaccattaagaatttgtggcaatatgttgacttgaaagttctaagaatggagaagatcaaggacttgcttcaaggtattggagatgaaagcacttgtgccaatgaaacgaattctcttgctgaaaacccgaagaatgatactaagaagaaatattatctcatgtggactccacatctacagaaaaagtttttacatgctcttcaaatacttggaaaagatgcttcaccaaaaaatataaagaagatcatgggtgtggacaacattgattgtaggcaaattgctgctcatctgcagaaacatcgactacggctaacaaaggatttgaagaaagcatcatttacaacggataccagcaaggatgaatcaaattctagaatagggcctgcagagagtcatcacgtgtgccgcaacgcaagtacactgcagcctcgttccaacactcaacctacagaaacaaccatgcaaatcctctctgaagacgctgaatatgacgatgtttacgccgcgatgcgaagagccttacagtatgggattgtctttgatgagtccaagcattccagtgatccttctggtgatgaggatgaacaagttgtggtaggaggagatcaagatggatgtgccaatgaagccaatgacatagactcatctggtgatcatcatcaggttgctgctgttgtcactaaaccatgcaacgcaaatgcttcacaagagataatcaacaagatgactaattctgatggtatgcaagccaccaaaggaagcaaggcagcagttttccgccttgtggattattcagaatccgatagcgattag

SEQ ID NO: 6201 - DNA, 1706 bp, Oryza sativa
  Predicted polypeptide sequence is orthologous to G1832
ccacagccaccgagcggattagtggaacaaaccctagcctgagtagattcttcctctagctttcgcgagccgtatcgtatccattggatggagccctagagcaacaagaagaagccaagaatatttgcgccatggagggtggtaattccagcaagggcgccatggagggtggtcaccgctgccgccgcccaaacgtcgacgacgatgaccagatcgaggagggagagatctgctacgactgccacgtctcgggctccgagaccgacgacgacgagcaccacagacgcgccgtgctccctccccgcgacaatggcgatggctgcgcggagcacaaacggtgccgcctcgacaatgctgctacggcgcccgcaccctctgccgggccggtgctgaccaccagcaacggaagcgccatcgtcgccatcgcctccgctgccgccgccgcagcagctgcggcgtcgacaatggcgcgggaggtgttcgcgtgccgcatctgccggaaggagttcgacacccggaaggccgtggacgggcacatgagagttcaccgtcagcaatccattgccacccccaagtataatgccgcagacaactctcgtgtcactgtggtcgctgagcccagaaccgatcttgatctttccggtccacacgggagcagcagcgcgccgccgtcgccaccagcgccggccaatcctcccaatcataatcaggccgtcggtcaccaaccagcggctgccgcgccgaacgccggcgtcgtcgtcgtcgtcgaaggggcgccgcaaaaaagtctaccatacatgtgcaagatgcagggctgcggcagggcgttccccacgcaccaggggctaggtggccacgctgccggccaccagaacaggagcaaggcagcggcggcggcggcctccgagcagggcagcagcggagcgggggccgacgggtgccacggcggcgccgacagcagcaagcatcggtgcagagaatgcggcatggagtggaagacaggtttcgcgctcggcggccacatgaggaagcaccaaactaaggagacggtgaccgtgaacgagaaggagccgaatgtcgctggcaagcacatctctcttggaccaccacctttgccggaccttactccggccgccgctgaggtaacttcgtcggaaccacttgatcagccaccactactgtcaatggtggtgggtgcagaagttgcagcaccggcgctgcttgcgctggccaacgaggcagcggcattgccgccacaggatgatcaggcagaggaagaggcggctgcagaagccgctgcaccggccgaggcagcggcattgcgaccggttgaggcaggggcagaggcggccgatgttggagcagcaccagaggagccgctgctggcgcctattgccggcatgggaaccgtgcgtattttcggttttttggttgagaagccggcacctggagacggcagtggaggagagggttcagcgcctgcatagatcgtcctagttatgatatttgattttgtgattttctttagctatcttcagagccattaggatacttgatttagaggctttctttattatgttcaccgcatagtagttaagataatttttgcttttcgatagcagaagtgttttcttcgttgtactagctagttggccgggttttcgaggttaaagactataagaaacttacagttatatatggtgtgc

SEQ ID NO: 6202 - DNA, 859 bp, Oryza sativa
  Predicted polypeptide sequence is orthologous to G1832
atccatcaggtcttccacatacattttgctgtctcgccaccggagacaggtagtatagctatggccggtcaggtgttcgtccatcacctcggcggcggctccggcggcgacgaccccacccacccatggctgtccctcaagtcgtcccatgagatggacgacgccgtggcgagctggcgcgagaagctggcggacatggccgccgccgacgaacgcgccggcaggtacccgtgcccgctgtgcgaccgccacttccccacggagaaggccgtgcacgggcacatgcgcagccacccggggcgcggctggcgcggcatggagccgccccgcgagccgtcccccggcgacctcgccctcgccgccgacgggaagcggtaccgctacgtgtgcgaccgatgcaaggcgccgttcgagacgcggcaggcgctgggtgggcaccgtgccagccacagcaccaagaagggctgctcctggcacgccaagcagctcgccatggccaagccgcccaagaacgacttcgacctcaaccatctctcacttgaggccatccaggcggcggcgcaagaggaacaagctgctcaagaggggaacaaggatgaggagcctaagaattaattaattaggaataattgaacttgcttagggttcgttcggtcggtcgatcgatcgacttcttgtgcttgcgttgcgtcggtctgggcttgtgttggttcgtagctagccaactccatggctcatgcagcatatgcacatatgtctctttctcttctttttcttttttagtttttgtttctctttgattttttgtaagctcgatcgatcgacaagaaaaataaacaaatattgcaacctggatgat

SEQ ID NO: 6203 - DNA, 432 bp, Oryza sativa
  Predicted polypeptide sequence is orthologous to G1832
aggggttatggttctcctgcctttgggcatggaaagctacttgatctatctatgcaagagaattctaggctggagaggaatagttcccgctgacgggatgacctcttgaaagtaatgcgccttcgtgccgatgatatgctggatgaactagacggaatcgcagttgcatgaggatatgtcctgaatcacctgctttgacatccaagatgatgtgcttgaacctaccgtagagccggctacgagtaggaaggtgccctcgggggaaggagctcgagaggctctccgttgatgcgagtggacatggcgggtattctaggaggagtccagcgcgacagcaattgtagatagtttagctcagcacgtcctgtgctccagtaggagacttttcggggcctttggccccccggacgaaaagtatacataacataacat

SEQ ID NO: 6204 - DNA, 200 bp, Oryza sativa
  Predicted polypeptide sequence is orthologous to G1837
tttttttttttttttttttttttttttttttttttttttggccgaaagaccgaatgatattatgaaaatggtaaatgaacttgaactggtccagaaaggataaataggaggaggggagcccgcccgaaggtggaaagcggcggccccccaaaccccaaattcctttcattttccctttttttttcccccatcccaccccc

SEQ ID NO: 6205 - DNA, 178 bp, Oryza sativa
  Predicted polypeptide sequence is orthologous to G1837
ttttttttttttttttttttttttttttttttttttttttggtttaaaacccgcaatatcagtttcgggtgcaacaaaaacttggtggggcttccctggtcgggatgctaaataccggtacccaggggtaccagacaaaaaatgggattttctactccttcaatccatgtcaagggcc

SEQ ID NO: 6206 - DNA, 417 bp, Oryza sativa
  misc_feature (56)..(56): n is a, c, g, or t
  misc_feature (114)..(114): n is a, c, g, or t
  Predicted polypeptide sequence is orthologous to G1837
aaacccttcgccaactggttttcgggcctttttttttggcttttatgcaaggatcntaccccctttttacagtgagagtttccattatactggcctgccatccccccaatgaancaggtccttatgaggttgtgtgcaccctaaatttacctgggtattaaaatagttgcatcctcatggcttcatgagtagctgtgcatcccattgctaaattttgttgctagatggttgcatatttgattatatgtttttatatttattgatattttgatgtttaggaagttttttaccattggagtgggtttatttattaaacaaatgtgattttgcatttgatttgcatcccgagcaaaatgttcttgatgttttgcaaaaaaaaaaaaaaaaaaaaaaaaaaaaaaaaaaaaaaaaaaaaag

SEQ ID NO: 6207 - DNA, 1660 bp, Oryza sativa
  Predicted polypeptide sequence is orthologous to G1838
agtctcctttcgtttttttttcctccactcctccgcctcttcttccgccgccgcgacgcgccgttgataggtctacgacgatgtcgccgccgacgaacggcgccatctcgctcgcgttcccgcccatggggccgctgccggcggacgcgctgatctacccgttcgacggcctctcctacgacgacttcgtcctccctgtcgccgccgcaccgcagcatccgctccccgtcgccgtcgccgaccccgcgcccctcctcctcctgccgccgccgtcctcctgcacctgcaacggcgccagcagcggcatgggcgccgttgcgccgcgcacgttggctctgggcgccaccaccgacggcagcgtgatgacccccaccagctggggcagcgacggcggcggcggcggctcctcctccgcgcgggccgtgcgctcgccgtcgccggtgctgccgctggtgcagggcaccggccagaggacctcctgctaccgcggcgtgaccaggcacaggtggacggggcgatacgaggcgcacctgtgggacaacacgtgccggcgagaaggccagaagcgcaagggccgccaagtttacttgggtggctatgacatagaagataaggctgctagggcatatgaccttgctgctctgaaatattggggtgctaatgctaccactaacttccctaaagaaagttacgtgaaagagattgaggagatgcaaaagatgagcaagcaggagcttgtagcctcactaaggaggaagagcagtggcttttctagaggtgcatcgatctacagaggtgtaacaggcaccaccaacatggccgctggcaggcaagaattggtcgtgttgcaggcaacaaggacttgtatctcggcacctttgcgaccgaagaagaagcagcggaggcgtatgacgttgcagcgctgaagttcaggggcgccaacgccgtcaccaacttcgagccaagccggtacaacctggaagcgatctctcagagcgacctcccgatcagcgtgtccgggaggcggcacaacagcagcagcaacagcaacaatccagcaccagaagcaggaggccaaatcactctgatgagcagcccgccgatctcccagcagtcgagcagcgcgccaccgtatctcatccacaacctcctgcagttccagccatgtggtcccccatacgcaccaccaccaccaccaccaccaccaccaccaccacaggctcttccgctgccaggatcgtacaactttgcagagccagtaggcttctactggccctacggcgatggggaggagcagaaggttcagctcaacagcaacatggttggaatggctagtggtggctttcttcatctggccaatgctgccaactgatcccagcgtctgcaattgctggtgttgtgtggttcttgtggagattccgagggagtgagattttgggtggatataggaagggggtcttttggcttttgctgctgccatggactaacaacctgaacatagataacagctggagtagtgaacttgactatgctcgttacaacaacagtgggtctaagctcaaaatgagcttgtggtatgccccagatatgcttagttgttaattaatggtttattttgaacaaaagtggttcatactttctaccatgttgtatccttttt

SEQ ID NO: 6208 - DNA, 1189 bp, Oryza sativa
  misc_feature (551)..(551): n is a, c, g, or t
  Predicted polypeptide sequence is orthologous to G1841
gtcgccggcgacgtacggacggcggcggcggccgtgatttcatgtgcggtggtggcaaggtggcgagcccgccgggaccacgactgccgcggctcgccggcgccggcggcgaggaagaagaggaggaggcggcggctggaatgctgtcgaggcatggacaggcgagggagatgtctgtgatggtgtccgcgctggcgagggtggtcgccggcggcggcggcggcgaggcggaggagtggtggccgccggcgtacggcgcggcgccgctgccaccgtctacttcccctgcatctcacgagcacgcagcagccatggcggcagggcagtacgcgccggcgacgtcgtcggcgatggcgtcaccgcgcgagcaggcctcctcgccgtcgtccggcgacgccgccggcggcggcggcggcggcggcaggaagcggtaccgcggcgtgcggcagcggccgtgggggaagtgggcggcggagatccgcgacccggtgaaggcggcgcgcgtgtggctcggcaccttcgacaccgccgaggccgccgcgcgcgcctangacgacgccgccctccgcttccgcggctgccgcgccaagctcaacttccccgaggacgccgcgctcctgccgcctccgcctccgcctcctgcgccggcgccggcgccgccgcagtcgcaggggatggtcggcgtcggcgaggagtactccgagtacgccaggttcttgcagggcgccggcgagccgccgcatttcctcgagcagataatggaggactcgcctcggccatcgacggcggccggcgcgtcgtcgtcgtcgtcggggcagtcgtcgtttccgttgttctacagcttcgctggacatgagcttggcggcaacgaagcgaaccttgcccgcccgccggagagcggcggcgctggtggtgacggtgggaggggctcctcgccgccggtgacttggccgggctatgggtggggtgcgccgccgccgtgggacccatcgagatagcgcgcgaacgaaggatgggtttggagtttggactatctccactctccacgtgtagccactgtagcaccgccacgtcttttgccaatttaaatttcccgccggaaattctctacacgttcgttgattcatcttgatttgtactcctacttaagttaaaattttgttaaattagaacaaaaaaaaaaaaaaaa

SEQ ID NO: 6209 - DNA, 735 bp, Oryza sativa
  Predicted polypeptide sequence is orthologous to G1841
atggcgttgtcggagccggacctcgcggcggagacggaggcgatcgtgtcggcgctcacgcacgtcgtcgcgtacggcggcggcggcccgccgccgagcgaggagaccgccgcgtccgcggtgacaaggacagcgccgtggcgcgcggacggcgcgcggcagggggcggtgccggcggcgaggaagtacaggggggtgaggcggcggccgtgggggaagtgggcggcggagatcagggacccgcacagggcggcgcgggtgtggctcgggacgttcgccaccgccgaggacgcggcgcgcgcctacgacgccgcggcgctccgcttccgcggggggcgcgccaggctcaacttccccgaggacgccgccgcggccgacgagcgacgcgccacggacgccgcggccgccgcggcggcggcgtcgtcggcgcccgccgcgctgctggagtcgcagccgggcgacgtcgcggactgcctcgactactccaggatcctggcgggggcgccggagcggccgacgagctccaccgtcccggacgggttcttcggcggcggcgggaacggccgcttcttgcactcgtggagcattggcacgtcgccgtcgccgtcgggctcgggctcgggcggagccggcggtggcggtggcggtggcggtggcggcgcccctgttcgtcctctgtttcatggcggtaacggctgggagcaacgcggtgacagtgcatacaacggtttctag

SEQ ID NO: 6210 - DNA, 1559 bp, Oryza sativa
  Predicted polypeptide sequence is orthologous to G1863, G2334
aagctgaaagattttacttgcgtcagctccggctaccgtggtcaatgtgcacaatatttcatttggtcctcacctcagccctgtaggcatgcaggcagcaggccttcagttactgcatcccttcggaatcgttaaatgaacagtattcaagcagccgcaggagtatgtgtccggtgtcccactgacaccgataagcagcgacaacgtcgacactcaacatatcccatcccttccttatcccaacgacctgcacgctgcattttcatcactagcatcagtgtattcaaacctgcagcttacactgaagagtgaagactgaactccacagatatgttggccgagggaaggcaagtctacttgccgccgccgccgccgtccaagcttcctcgtctctccggcaccgatccaaccgacggcgtggtgacgatggcagcgccgtcgccgctggttcttgggctgggtctcggtctgggcggcagcggcagcgacagcagtgggagcgacgcggaagcgtctgcggccaccgtgcgggaggcgcggccgccgtcggcgctgacgttcatgcagcggcaggagctggagcagcaggtgctcatctaccgctacttcgccgccggcgcgcctgtgccggttcacctcgtgctgcccatatggaagagcatcgccgccgcctcctcgttcggcccgcaaagctttccctccctgacgggcctggggagcctgtgcttcgactacaggagcagcatggagccggagccggggcggtgccggcgcacggacggcaagaagtggcggtgctcgcgcgacgtggtgccggggcacaagtattgcgagcggcacgtccaccgtggccacggccgttcaagaaagcctatggaagcctctgcagcagtcgctcccacatatctcccggtccggccggcactccacaccgtcgccaccctcgccaccagcgcgccatcgctgtcgcacctcggtttctcctccgccagcaaagtgctcctcgcccacaccaccaccggcaccacgcgcgctacttgatctcattgttatctccgaggattatgccggtgcactgtctgtaacctttttctcgtaatcacgcctcggtttgttcccaatgcatcgtcacgcattgctagtttgacagtttgctaccgctgcctctgtgtgtgcctgtgcgtgtggcagccgaggtgtttttgtttggttgggtggtgggaggcgcgccccggtgcggtggtgggcgtggcccccggctacctagtgctggttcctgcgtgtgcctgtcgaacctgtggagcgtggtcggaagtacggtacgcactgtccggtctcatatgccggggcagaggggttcggtccagtgtggtgcaggcgtgcggattgggatcacatgcagtggctactgcaacttatgcagtcctaaagacaccattgaattataaattaacgtcctagatctttccttgatactgttcacaaataacagtgaaaagttccttcctgtagcaggtactatagcaattactgtttaaaataactgtagcatttgtttc

SEQ ID NO: 6211 - DNA, 894 bp, Oryza sativa
  Predicted polypeptide sequence is orthologous to G1863, G2334
gacaactcactgccccccgtcttctttcttcattcctcttcccaccaagaaccccaaaccttacctccattgagttcgaaaccgaggagcgaggagctacaagccgagttgtcagaatggatgaggagaaggaagccgactcgccgcagccaccgtccaagctgcctcgcctctccggcgctgacccgaatgccggagtggtgaccatggcagcacccccgccgccggtgggtcttgggctggggcttggactcggcggcgacagccgcggcgagcgtgacgtggaagcgtcggcggcggcggcgcacaaggcgacggcgctgacgttcatgcagcagcaggagctggagcaccaggtgctcatctaccgctacttcgccgcgggcgcgcccgtgccggtgcacctcgtgctccccatctggaagagcgtcgcgtcctcctccttcggcccgcaccgcttcccttccctggcagtgatggggttggggaacctgtgcttcgactaccggagcagcatggagccggacccagggcggtgcaggcgcacggacggcaagaagtggcggtgctcgcgcgacgtggtgccggggcacaagtactgcgagcggcacgtccaccgcggacgcggccgttcaagaaagcctgtggaagcctccgcggccgccaccccggcgaacaacggcggcggcggtggcatcgtcttctcccccaccagcgtcctcctcgcccacggcaccgcgcgcgccacctgaccagtgaccagaccggcgcctgtttgtttgtttgtctcggcgcatgggaaaacccaaatccgcagggattatgtcatgtcctgtaactctttttttcctcgcaacttttgaagccaaaacaattctcaccgtgttcgatggc

SEQ ID NO: 6212 - DNA, 414 bp, Oryza sativa
  Predicted polypeptide sequence is orthologous to G1863
ggatggagtatatttggaaaacccccttgtgttatacctcggaccacggcgcctgcaactaggctgttcttttcactttgaatgtcttcttttctactgtcctcacttattgttgttcttcgctttatctattaccctcgggaaaaccgcgagatttgattcgaataaggtttctcaccctctggcgaagtggcataacgcccgacgacccggtgtggctgtgggcctgagttttcgaggaaacgtgctcgtagacctgcgagcaggctgggctttgtgtggaaggggttgtattttgtcaatggatctgggttggccaggtgcagatatgaacagtaccaagcaagctgtagttacaacgacaagggataaggtatccctttgacctagtgaacacgatgattattggaatac

SEQ ID NO: 6213 - DNA, 2160 bp, Oryza sativa
  Predicted polypeptide sequence is orthologous to G1868
gctggttttgcaaacatcccacacacacacaaagcagtgacagtgagtgccaatgctgagctcttgtggtggccatggccatggaaatccaagaagcttgcaagaagaacaccatggcagatgtggtgagcagcaaggtggaggaggaggaggagggcaagagcaagagcaagatgggttcttggtgagagaggcaagggcatccccaccatctccatcttcttcatcatttcttggatccacaagctcttcttgttctggaggaggaggaggagggcagatgttgagcttctcctcccccaatggaacagcagggttgggcttgagctcaggaggaagcatgcagggggtcttggcaagggtcagggggccgttcaccccaacacagtggatggagctggagcaccaggcactgatctacaagcacattgctgcaaatgtttctgtcccttccagcttgctcctccccatcaggagaagcctccatccatggggtactaccttttttattcagctcatgtgattgttattctgttctgcgtcatatcccctttctgttgtaaatagctcaagataggaataaaggaataagtacttagaaaatatgaaagaagaaaatgcaggtcatatggttgcagttgcctgttagtttcagatgtataaaggtgtcccagattggggttctgttgtgttgaggttggtagttatatcttgttgtctttcttgggacaggatggctttgtgattaattagtttgtaaaggcagtaatcgaagtccctttctggtactaaaagcagtattggctgcaaatctaggcattataatgatttgaagattgcattgatactagaaatgtactgcttttggatgtttgcatgatgctcatgtgctaatatttccagttaccaatgtggtgcttcttgagtttagatataaaactcttctcttacattgggattctgatttttttttagttgtgcctctagtcttttccacaacaagatctccaaatgtagtcataaagtgttctgattccctttaactggcgtcatgtttggtatgtacaaactaagttcttatgcagacctgggaggaatgttgctgaaatagtgcaagaatatatcgttttgaggtggtttatatatttctgacatgaaatgggcattctattttgcaccaggatggggatcattccctcctggctgtgctgatgtagaacccagaagatgccgccgcacagacggcaagaagtggcggtgctccagagatgctgttggggatcagaagtattgtgagcgacacataaaccgtggtcgccatcgttcaagaaagcatgtggaaggccgaaaggcgacactcaccattgcagaaccatccacggttattgctgctggtgtatcatctcgcggccacactgtggctcggcagaagcaggtgaaaggctcagctgctactgtctctgatcctttctcgagacaatccaacaggaaatttctggagaaacagaacgttgtcgaccaattgtctcccatggattcatttgatttctcatccacacaatcttctccaaactatgacaatgtagcattgtcaccactgaagttgcaccatgatcatgatgaatcttacatcgggcatggagcaggcagttcatcagaaaaaggcagtatgatgtacgaaagtcggttaacagtctctaaggaaacacttgatgatggacctttaggtgaagttttcaaaagaaagaattgccaatcagcttctacagaaatcttaactgaaaaatggactgagaaccccaacttacattgcccatctggaatcctacaaatggctactaagttcaattcaatttccagcggcaacacagtaaatagtggtggcaccgcagtggagaatcttatcactgataatggatatcttactgcaagaatgatgaatcctcatattgtcccaacacttctctaaggctgtgtttgaaagttcatgttggattcgcaaatgattgaaagtacgtttatggatggttctataagttcctgttgtttccttcgttatgtgttcttgtgttcctcacctttttatcttttggttgaggttggtatgttgtaattttctcctgtgctaccttgtaatatgctgaagttaaatgctcttct

SEQ ID NO: 6214 - DNA, 1810 bp, Oryza sativa
  Predicted polypeptide sequence is orthologous to G1868
ggttggcttgcactgcctagcttgttgctcatctccttggtgtatctggctgcaggattgagctcagtgagcttgagcagcagcatgcagggtgcaatggccagggtgaggggtcccttcacgccgtctcagtgggtcgagctggagcaccaggcgctgatatacaagtacttggctgcgaatagccctgtaccacacagcctcctcatccccatcaggaggagcctcacatcgccctactcgcctgcctactttggctcaagcacattgggatggggatctttccagctgggctactccggcagcgcggatccggagcccggccggtgccgccggacggacggcaagaaatggcggtgctcgagggatgcggtcgccgaccagaagtactgtgagcgacacatgaaccggggacgccaccgttcaagaaagcatgtggaaggccagcctggccatgccgcgaaagcgatgcccgcggcggtggcagcagccgctgcctctgctacccagcctagtgctccggccgcccacagtggcggagctgttgctggcctcgctatcaaccatcagcaccagcaaatgaagaactacgctgccaacactgccaatccttgctctctgcaatatagcagggatctggcaaacaagcataatgagagtgaacaagtgcaagactcagacagtctctcgatgctgacttccattagcacgagaaatacgggcagcctgtttccgttctcaaaacaacataatccttttgaagtgtccaactcaaggccagattttggcctagtatcacctgattcactgatgagttctcctcatagctccttggagaacgtcaatttgctcacttcgcagagtctgaatgaacaacagagttcagtttcccttcaacactttgtggactggccaaggacacctgcacaaggagctctcgcatggcctgatgctgaagacatgcaagctcagagaagccagctctcaatatctgctccaatggcgtcttctgacctgtcatcagcctcaacatctcccatccatgagaagctgatgttgtcaccacttaaactgagccgtgaatatagtcctattggtctcggttttgcagcaaatagagatgaggttaaccagggagaagcaaactggatgcctatgttccgtgattctttgatgggcggaccattgggagaggttttaaccaagaataacaacatggaagcaaggaattgcctatcggagtctctgaatcttttaaatgatggctgggattcaagctcagggtttgattcatccccagttggtgttctgcagaagaccacctttggatcagtatccagtagcaccggaagcagtcctagactggagaatcatagtgtttatgatggcaacagtaacctgcgggatgatctcggttcagttgttgtaaatcatccgagcatccgcctggtgtgagcttcttgatcaacaaaaaatgcaacaagatgacaggcatgaggaaacgattcaatcagtcttcaccttgttacatatcgttatgacgtcttcaagtgtgagcatttacctcggtgctttgtcattcagactaatcttgtgtttttggtatttctgctctgttatttttcctttgctttgtaaccttcaccttggatcttgacgtgatatgacgtgtggtatggatggatttggtactccattgtggcatatcatcttaaaatatcccatgctgtgacgccataatcgcggatgaatgtaatccgatccttgtcttgctttctggtagtattcaatggattgtttgtgagctgat

SEQ ID NO: 6215 - DNA, 3434 bp, Oryza sativa
  Predicted polypeptide sequence is orthologous to G1868
gattaacaagcggcgagcgctcgagctgggtgcgcgagcggttggcggcgacggccggcggccggcggcgaggtcgagcgaggaggcgggccggcgaggcgcgcggtactttgtgcctcgaaacgagtgggcctttattttttttttggttctgtttcggctcgtcgcggatttcgcacggtttgcttcgttcttggtgattttcttgaagcgtcgtcttctccaatcgatcgcttcctgtagcttctccacccttcttctgtggtggatacagatttgttcttggaagcggctgggatttcggttaacgatgccattggtttctattctaacatatgctttctcttgtctcttgtgtctcttgtgtgttcagattgggcttgttggtgtcggatttgattgtggtttcgtggctgtgatgacaatcaaacctcgtttctcgatgctgagacttgatttgttcaaggaccagaactgtgctgaccttaatttgtgcgtgtctgagccaccccaaacacaccatgtccgaatcgatttctgcgaaagttagtatgtctgcacgatgccactcgatgctactactagtatttaggtgtctttattagctttttcctcttctatgtttattggctgtttcttgcatttgcgttgttgtagtgtggctgtgaggactaactactttgtttctcgatgctgacttgattcaatcaatcaaggaccaaaaaaatttgatgacctttgtgcgtgtctgagccactgcaactcagttttttcagtcttcgcttgtgtgaagatatcatcttgccttccgtgttttgagcctgaacgataaagaagagatgtttcttggtgctgattcgactcattttaggatggaattttgacgaggctcatgcgtgtctgaagtctgaaccattgtaaaacttggatgtagttgttgttttaggtgtctgaagtctgaaccattgtaaaacttggacgtagttgttgttttttttcctaaaaaaagagaacttttttctctcgttttttctctgctgtatttgaatttgttcattttttccagctgttgtacacttgtacttcatattgggatactgaatgttaggtgcgatcaatgtagtagtgcttgcatgtttgacaaactcatggacattaactcaagttatctaaaacattgagatccttggaatagttatgctggaactattgcatggaaattttacaactcgctatatgctagaagcgaatccccgtagttcattttcctcaatcagcccagtagatttctagctaatggtatctgataaggggcaaattgttttttcaaggatacagctgaattcataagaactgaaaatcgcaattagctggtattacattgcagaagcttgagaacagaaagaagggaataacatgcatgggtaacgccaatactaaagctatcccatggtgagctcattaacgacttgatctccatttcctgaagattcacattgcatgatcctcgaggttcagtaaccaaccatatggccttgcttctggtttcatgattgaatcgtcaggatttttggagtttgtcaagatctcacctagaggtccaccttgaggcatctcccaagaacttgagatgctatcctcttgcatttgtgccatattaggtgcatggcagctgacgcgtgggtcctctggcgaggaatagaaagttgatggaactgtcatgacattggaatctttgcttttctgaaactccattttctcgtccttaggcaagctgaaattctgaaggactgactgaaggcatccacgatcatgcatcttggtgaaaggaatgcttttgttgttctgctggttgctgctctcccaaggcttcaacatggtatttgaagaaatcgattcactgtctcctgctgtattgaacttctccggtttgttctgttgcttcaactgagagaacagggacaatgttggctgttgattcgttaaatttagcagtgggccattgttttcttcagcagctttgtttcctttctctttgttcgccattgtcctgcaaatgtgtacaggtcttcaaattaaatgattattactttctattaaaactgaaataatctagttgttttcctttgtccctgactatattgcagcatttgtattccattctttataagagatttttttccaccagaaccacaacgattaccttctatcatgaaaatgtaccagaaaatcttaaaccatcaataggatatgcaaaaatggtggaaaaaaatactgtgattcagtctgtagcactaaaatacttgcacgttgagaatattaaaccaagtttaaggatgtattaacctgttcaaactatctgtccaatagctgatactgcgtggcttcatttcattaacttttgccttcttgaagctgccctgcccgacagaagatggcaatgagccagcacacggtgtctctttcacagtctttctactttggttttccacaggctctcttgaacggtggcggtttctgttgatgtgcctctcacaatacttgtggtcggccatggcctcctttgaacaccgccatttcttgccatctgttcgacggcatcttccaggttctgggtcagagtctgcatttgggaagccttgatagagaggcctccagctcactgcagtacaataagtgaacagaaaaaaacactgtccatcatgagttgcagagaaatacacagatcaatggccttacatacatacatgcacacatgatctttgcttctaacctattgcaagttaataacatggaagtgtgtatgtatgtggtgatgagcaaggccagacctgatggcaatgtgtgagcagccttggcgaatctgagcatcttctgttcatcaagaaagggggaagggtatgatgcagcagcagcctgggtgaagctaccagcagcagctctcttgatgaggctcagatcaccctccttggtggatggcactgtgagtccttgcaagcccaacacctctccaagctccatggcagcagcagagaagtcagcaaacatcttggaaggacaggaggaggggagaggaggaagaagaagaagaggagggggtgagcattgctggggacagtcacagtgaggctgaggttgagagtgaggagggtgtagtgtgtgctttctagtaggaggcaggaagtgtgtggtgatatattatgggatggtggctctttgggagactagaggtagggctaggtggtggcccttaaatagcaggagtcctttcattcttttagtggagtaactttttttgctgtcatttctttattttatttttattttattgattttttgggctcaatgtttctgtgaagtgatactgctgggtactgatggggaggagtaattggttcataaaaaggtagtagtagcagcagcatgtttattct

SEQ ID NO: 6216 - DNA, 1616 bp, Oryza sativa
  Predicted polypeptide sequence is orthologous to G1868
aaaagagccaccatcccataatatatcaccacacacttcctgcctcctactagaaagcacacactacaccctcctcactctcaacctcagcctcactgtgactgtccccagcaatgctcaccctctcctcttcttcttcttcctcctctcccctcctcctgtccttccaagatgtttgctgacttctctgctgctgccatggagcttggagaggtgttgggcttgcaaggactcacagtgccatccaccaaggagggtgatctgagcctcatcaagagagctgctgctggtagcttcacccaggctgctgctgcatcatacccttccccctttcttgatgaacagaagatgctcagattcgccaaggctgctcacacattgccatcaggtttggattttgggagggaaaatgagcagaggttcttgttgtctaggaccaagaggcctttcactccctcacagtggatggagctggagcaccaggctctcatttacaagtatctcaatgcgaaggcccctataccttccagcctgctcatttcaatcagcaaaagcttcagatcatcagctaacagaatgagctggaggcctctctatcaaggcttcccaaatgcagactctgacccagaacctggaagatgccgtcgaacagatggcaagaaatggcggtgttcaaaggaggccatggccgaccacaagtattgtgagaggcacatcaacagaaaccgccaccgttcaagaaagcctgtggaaaaccaaagtagaaagactgtgaaagagacaccgtgtgctggctcattgccatcttctgtcgggcagggcagcttcaagaaggcaaaagttaatgaaatgaagccacgcagtatcagctattggacagatagtttgaacaggacaatggcgaacaaagagaaaggaaacaaagctgctgaagaaaacaatggcccactgctaaatttaacgaatcaacagccaacattgtccctgttctctcagttgaagcaacagaacaaaccggagaagttcaatacagcaggagacagtgaatcgatttcttcaaataccatgttgaagccttgggagagcagcaaccagcagaacaacaaaagcattcctttcaccaagatgcatgatcgtggatgccttcagtcagtccttcagaatttcagcttgcctaaggacgagaaaatggagtttcagaaaagcaaagattccaatgtcatgacagttccatcaactttctattcctcgccagaggacccacgcgtcagctgccatgcacctaatatggcacaaatgcaagaggatagcatctcaagttcttgggagatgcctcaaggtggacctctaggtgagatcttgacaaactccaaaaatcctgacgattcaatcatgaaaccagaagcaaggccatatggttggttactgaacctcgaggatcatgcaatgtgaatcttcaggaaatggagatcaagtcgttaatgagctcaccatgggatagctttagtattggcgttacccatgcatgttattcccttctttctgttctcaagcttctgcaatgtaataccagctaattgcgattttcagttcttatgaattcagctgtatccttg

SEQ ID NO: 6217 - DNA, 648 bp, Oryza sativa
  Predicted polypeptide sequence is orthologous to G1868
tgggtagttgctccttcctccccctcccccgcaaacaccgacctaccatgtcccttctcccctctcctctctgagctcagctgcatccatccatccaaactactcacagatgccactcttcctcaaccaccctcccatttaatgccctccacctcctcctcaagcccaggattcgggaacctgctagccatttttgctccaggacagtacagccagatgctgctgctgcagctgctgggttgctgcggtggtcaggtcaccccggttcttgattcttgacgaaggatggcaatggcgacccctacgaccaacggcagcttccttcttggatcaggtggctatcccggtgcccagattctaagcttctcctcctcaggtcacagcggcaatgggttggattgtggaagctcagatgtggcaagaatgcagggggttttagcaagggttagggggccattcacaccaacacaatggatggagctggagcaccaggctctgatctacaagcacatcgtggcgaatgcgcccggagcgggcggctgggccctcccatcaggagaaggctcaaccaccaggggaccaagtgccccccgggggcaaccgggcccacgcccgggaaaggggcgcacacccgggcaacgggaagga

SEQ ID NO: 6218 - DNA, 862 bp, Oryza sativa
  misc_feature (1)..(59): n is a, c, g, or t
  Predicted polypeptide sequence is orthologous to G1868
nnnnnnnnnnnnnnnnnnnnnnnnnnnnnnnnnnnnnnnnnnnnnnnnnnnnnnnnnnnttttttttttggcaaaaattatgacaattcagtcagcaacatagaacaaattccacaagaaactgagatagtacaataccacattaccgctcgcttaaaaacggagggaactcaaagcatgaagtgacaaagattaaagaaaaataatacatgagctaggaaatcatacagggtgtgctctggggacaaaaacatcagtagatagcctcatggctgttccctgatgatcagaccggcggtttcacagtgtttggacagtctgggcattcaccaggcctgaagtgagcaagccattgcagaggctgcctgcaggactactaacagtgctgctgggcactgaactgaagctagtcatctgcaggactccggtgggcgattgcagctgtggacttgtagtatgtccatcagctaagaggttcaaagatggcgggtggcggcttttgcctttgtcgtctgatgcgctgctggtgttggtgaagaactcacccagaggtccaactatggacgcttcccaggagcccggtatccaacttgctcgcgtgatgcacccgccatcgatgaaccgctactaatggtcaaagagccagaagagaaagggggaaacgagtacccaggaaggaatgaagcagagcaaagcgaaccgagcaaaagagagtaaagagagaggagagcaaaaacccaagagggcagacacaagacagaacaggaaaactcaccaaccagcggaaaagagaaacgagcaacacacaaagaaaaccgcacaccccgtcggcacactccattacgacacaaataacaacgcg

SEQ ID NO: 6219 - DNA, 2284 bp, Oryza sativa
  Predicted polypeptide sequence is orthologous to G1880
aaagctggtagaaagctgcctcccctctcctctcctctcctctctcatctcccccctttggtgttgtctgtgtagcagcaaagccaaaaaaaacaacactgctccaaacacctttgctcctcatcctcctcctcctccctctcgattcctagctgtactcactcactgcatctcctcctccccttttcgtttgtttattctcttctccggcttcctcgagctcgccttagctagaagcctgtggccccgtgatctctcactgttgtggcttatatagagatagatatccggctcggttccattgatccgttcttgtggagttgtgtgatcagagctggagagattggctaggttggaggaggaaggggaattcttggttgtaagggaagaggtgggagtggtcaccggcggtgcgcgcgcggaggcggacatcatgctgagttcttgcgcgccgacggccgtgccgccgcaggatgcgtccggtgcggcgacggagccgttccggtctctgcagatcgccaccgccggtgccgccgcgaagaagaagcggcggccagccgggacacctgacccggacgcggaggtggtgtcgctgtcgccgaggacgctgctggagtctgaccggtacgtgtgcgagatctgcaaccaggggttccagcgcgaccagaacctgcagatgcaccggcggcggcacaaggtgccgtggaagctgctgaagcgggaggccggcgaggcggcgcggaagcgggtgttcgtgtgcccggagccgacgtgcctccaccacgacccctcccacgcgctcggcgacctcgtcggcatcaagaagcacttccgccgcaagcacagcggccaccgccagtgggcgtgctcccgctgctccaaggcctacgccgtccactccgactacaaggctcacctcaagacctgcggcacccgcggccacacctgcgactgcggccgcgtcttctccagggtggagagcttcatcgagcaccaggacgcgtgcaacgccggcaggccacgcgccgccgaggcgtcatcgtccccgggacgcggcggtggcgtcgtggttggtgcgccggcggcagcatcgtcgtctcagcagcagcagctttttgcggtgccggcttcgttgtcgcggacggcgtccagcgccagcccgtcgagcgacctggtggtgagcccggtggcctggcctgctactggtggtggtggtccggcaatggtgagtccccgtgctgcggcgccggctcctgctggcggtagcatcgcggcgttccaccaccggttcactgacccggcgctgtcgccaccgacgccgtgtggtggccggcgaggaggatgccacactacccacagcctggagctgcagctcatgccaccgcgcaccaccaccacctgcgcaggcggcagcctcggtggtactccagttgccaccgccgttgggtactacgcttcctcttcgccgcattcgcctgctgctgctcttccgtcgcggcagccggtcgccgacgcaatgcggctgcagctctcgatcgggttcggcggcgcacgcgatgatggcaacagcaacagcagcagcagcagcggcgaggtgtcggcctcggcgacgaggctgaaggaggccgcccacgagcagctgcgtctggcgatggccgagaaggcggccgcggacgaggcgcgcgcgcaggcgaagcggcaggcggagctcgccgaccaggagctggcgaccgcgcggcggatgcggtaccaggcgcaggtggagctcagccgcgcgcacgtgctccgcgaccacgccatacgccaggtcgacgccacgcagctgcagatcacctgctacagctgcagccacaagttccgggcgagagcggccgccatgatcagctccgacgtcgccagctacgtctcgtccgtcgtcaccgagggcggcgacgccgaggtcgacaacgacggcaacttgcaccgccgccgcctcaacgctgacgatggcatgccaaggggccattctaggacgatggcaatggacctcaactagctcgcaaaaatcactggaagaaaaaacaatctttttttttcttttcttttgtgccagattgctctccttttgttttaccaatgagctagctggtggtggtatgtgctcatgtgcatgcaccatgcaatggcgatgtattgtaattagatgcagtgatgagatcacaagctccagtgcctagtggttgtgttctctcgcatggcagattggctgggcaggaaaaagctaaaaggggtctactactacgct

SEQ ID NO: 6220 - DNA, 976 bp, Oryza sativa
  Predicted polypeptide sequence is orthologous to G1893
cggccatgatcgtcatcagctgctccggtacggttgctgcagctgcaacaaacagcaggaggaagaggaggaggaggtcacggttgccttgcgcataggcctaccggccgtctcgtcggcgtcggcgtcgccgtcgccggcgatggcgaaccatggggctagtgcttctagtacaggagttgctggagatgatggcggcggcggcgccatggccggcgtgggtgtggaggtggagagcgtgcggaggagcggcggcggtggcggcggcgggcagtactggatcccgacggcggcgcagatcctcgccggcgccacccagttctcctgccccgtctgccgcaagaccttcaacagatacaacaacctccagatgcacatgtgggggcacgggtcgcagtaccggcgaggcgggacggcggcgctgcgcggggcgcagccgacggcgatgctccggctgccgtgctactgctgcgcggcggggtgccgcaaccacatcgaccacccgcgggcgcggccgctcaaggacttccgcaccctgcagacgcactaccgccgccgccacggcgcccgcgacttcgcctgccgccgctgcgccaagcgcttcgccgtccgcggcgactggcgcacccacgagaagaactgcggccgcctctggcgctgcgcctgcggcgcccacttccgacacaagcgctccctcaacgaccacgcacgggccttcggcgccgcccacgcccacgccggcgccggcgccggcgccgaagacgacggccgcgccgccgccgccgccgccggtgtgctgcgatgaccttaatttatatatatgtgagtgcgaaattaattagctgattattggttagtttcaggttatttttttagtagaaaattaatttgtttgtgatcgatcatatatatatgtggaggactctcttaattgtttttttgtttggtttgatttgatttgatgtgtattgcatgc

SEQ ID NO: 6221 - DNA, 1756 bp, Oryza sativa
  Predicted polypeptide sequence is orthologous to G1893
gaatctctcttccatctctctctttcttccagaccgtggcatgcacggcttgacacagacgctctcgtacgtcgtcgtcgtcgccgtcgtcctcctcgtcggcataaagcagtctccactgcaaaccagctagctgtagctctcaattcgtaggtgagatcgacgcgcatcgcgccgcgtctacgtttgtatatagagggggagagaggatcggaggagccgatcgagctgaagtagggatggtgctgagggcgtgcacaatggtggaggggtcatctttcgtcgtcggcggcggcggcggcgtgccgttcttcgagtggctcaagccgcggtcctcgccgccgccgtcgccgtcctcctcgtcgacggctacgacgtcatcgtccctcaccgcccaacgacaaccgcgtggtgctggtaccatgctgtgcttgcctcttcttggcaggctcggagaggagcccgttgatgctggcgatggcggggcgatgaacaatcctcctgtcaaggaagaggtgagcaatactacagacgactatgccggtgttgatctcaacatcggcttgccggcgacgaccggcgggggtagctctgaagatgcgcccatggatgaggatgaagaagacgatgatgacgacgaggaggaggagacggaggatgatgaggagaaagcagctgggcttgaggggtgcaaggtggaggagaaagaaagagagcaagtacatagcgagggatcgaagtattacgtgtccgtgggaggaggggaagatcagagcagcaacgccggcgatgtcgacgccggcgccgcctgccgtggccggcggtattggatcccgacgccggcgcagatactcatcggcccggtgcagttcgtctgccatgtctgcaacaaggccttcaatcgatacaacaacatgcagatgcacatgtgggggcacggtcgggagtacaggaaggggccggagtcgctcaaggggacgcaggcgacggcgacgctggcgatgctgaagctgccgtgttactgctgcgccgccggctgccggaacaacgtcggccacccgcgtgcgcggccgctcaaggacttccgcacgctgcagacgcactacaagcgcaagcacggcgccaagcccttcgcctgccgccgctgcgccaagccgttcgccgtcaagggcgactggcgcacccacgagaagaactgcggcaagcgctggttctgcgcctgcggctccgacttcaagcacaagcgctccctcaacgaccacgtccgctccttcggcggcggccacttccccgtcgccgccgccgccgccgccgcacatgcggcggcggcgccgcccaagcagcagcagcgaatcatacgcttcgacgacgcaatggcgcaaatgcatggcggcggattaatgaactaacagtgttaattgttcttgatcgttagctagctatagctaattgcatgtacacttcccccttagtttacacacacacacacacccacacaaaatgcaataagattatggagctaggttgccgaggagaagctaaaggcagtgaagcagctgaattttcttctggatgatgaccggagtttgcatgcaatcgggggactgactgatcacataaggtttgttagttacccgtagcttggtaatttgcaaggaagaaaatttgtcagcttcacagcctaatgctggtttggcagccaaatgtatcaatgtatcactcgtgcatgacttaattttaagaagatctgttaatt

SEQ ID NO: 6222 - DNA, 1961 bp, Oryza sativa
  Predicted polypeptide sequence is orthologous to G1893
gatctctttctctctctcactctctctctctagtgaagttgccttccctctctctctcactctctctctagtgaacttgcctttctttcttcctccacaacctcatttacacctttagggctagatgcacacacacacacaagacacaactactttacctctccatctctctctatttataactgtagtttgccttcttctccatccattatgctatctcctcttctccttctcctcctaccttgagctagctccttactaccaatcctcttccatgggagatccctacaccaacttcttgagaggctaccaccaccaccaccgctcccaccaccccctccacttccctccgccgccgccgccgccgcctccgccctacgccgcctccttctccggcctctactcctcctacctccacccaccacctcccccttcctcccctccgatcagggaagccctccccctcctcagcctcactccctccaccacccacgacgacgatcaccaccaccgccgccatgatcaagatcatcaccaccatcacaagcaaggccaagaaaagaacagccatggcggcggcggcgccgcttcttgcagcaacaacgacgacaaacgagaatcaccatcagcagcagcagcagccgatgatcaggcggcggaggtgaccgtggccctgcacatcggcctcccgagcccgagcccctccgacgccgccgccgccgccggcaaccaagctgcagcagcagcagcagcagaagcatcggcagcaggtggaggaagcagcaggatgcaagtggaggaggaaggaggagaggaggaggatgaagacgaggcggcggcggcggcggcgacggcgacgctgccgctgggttgcgcgtccatagggatagggaagctgaccaaggggcagtactggatccccacaccgtcccagatcctcattggccctacccagttctcctgccccgtctgctacaagaccttcaaccgatacaacaacatgcagatgcatatgtgggggcacgggtcgcagtacaggaaggggccggagtcgctgcgggggacgcagccgacggcgatgctgcggctgccgtgctactgctgcgcggcggggtgccggaacaacatcgaccacccgcgggcgcggccgctcaaggacttccggacgctgcagacgcactacaagcggaagcacgggatcaagcccttcatgtgccgcaagtgcggcaaggcgttcgccgtccgcggcgactggcgcacccacgagaagaactgcggcaagctctggtactgcgcctgcggctccgacttcaagcacaagcgctccctcaaggaccacatccgcgccttcggccgcggccacgccgcctgcggcatcgactccttcgacgacctcgacgccgatgacgacccctcctccgacctcgaccacgcctccgcctccgcttcgcgagtagggtgagtgtttgatcgatatcgagatcgagatcgagctgagctaattaatttccatgataattagttaaccgtgctgctactactactatgtctgtgattctgtgtacaccacgggattggaatggagaggatatgggggtatagatgatgcatgatactgcgaattttcaagggttttttttttaattttgggggtatattaatgaattagttgatgatgaggaacaaattaattactacatttgcagcaagctagcagatgtgtgtgtacgtactttgttctctagaaagtactacgtacgacttgagttctaatcgtttggttggatggagatacagaaccctatagcggcttcattgtatgtgcagacttttcatttgatttggtatatggtcaaattggtgatacgggttaattaagattaattatctgtgtcattttgagaagatttatatctatacatatatatatattagagcactatatatgcatgcattcaagc

SEQ ID NO: 6223 - DNA, 1741 bp, Oryza sativa
  Predicted polypeptide sequence is orthologous to G1893
atctcccatcttccccacgccaccaaaccccgagaacaagaaagctatataccatctctcatgcgagtaaataattaagtgagagctctctgtgtgcgtataagtagagatcgatcggtataatcgaggactacatgaggatggggctgcggacctgcagcgccatggaaggtgaggtcgtcgccgcctcgcctttcttcgagtggctcaagccaccgccgcggccggcgtcatcctcgtcgtggtcgtcgtctttctcctcgtcgtcctcgatggcttccagggatcaagaaacagtagtacctggtgaagatggcggaggtgaaattcaagaagatcataagagcggtatgacttgtttgccgctgctcagcatgctcgaggaggggaattcgaagaggcatgagcaccctgtgaaagaagagatcatgagcagtgcacacgcagccggggtagtggagcctggcgtggagttgaatatcggcttgccggttacaggatctagcgctcaggaggtcaccatggaggaggacgatgaggaggaggatgacgacgacgtaggggaggaggagatggacgagtggaagcctatgcatggcggttgcaaggtggagggggatgaagagcagtacggcgaggcggtggcgtcggtggaagggtcgagcagcatcaccgccgtgggggatatgttcggcggggtcggggcggagagcggcgtggcgatgagcagccggtattggatcccgacgccggcgcagatcctcgtcggcccggtgcagttcatctgccatgtctgtaacaaaaccttcaacagatacaacaacatgcagatgcacatgtgggggcacgggcgggagtaccgcaagggcccggagtcgctcaaggggacgcagacactggcgatgctgaagctgccgtgctactgctgcgcggcggggtgcaagaacaacgtcgcccacccgagggcgcggccgctcaaggacttccgcaccctgcagacgcactacaagcgcaagcacggcgccaagcccttccgctgccgccgctgcgccaagcccttcgccgtcaagggcgactggcgcacgcacgagaagaactgcggcaagcgctggttctgcgcctgcggctccgacttcaagcacaagcgctccctcaacgaccacgtccgctccttcggtgcccaccacctccccgtcgccgaatccgccgccgccgccgccaccacccccgccgacaaagaccgcatcataagcttccaacggtgagaaatatcgatcggtcgaggtcgacgatgatcgatcatgatgtgtaggctgcagttacctggttcgttactaagtctatgtatacgtgagcactgctgctcgcgtatatatctacttagtaagttaaccatgcaattgtccagcatatagacaacaagttaatcaaactatagctactagctagagagtaatgtatgctgatatgtgcatgcatccgtggggatttaggaggaaatttaagcagactattagcacacaataattaaggtggctttcagccggtgccgatcgaaagctgtgagcctgtgaagtagatgaattttcttctgccagagtgtgagctgtttagtgaggctatgtccccagctttgtatcggagaaaatttctcagcttcacaggctaattaaacaggtaatttggaacctattttaatttacatgcatttattaaacgattattgatcaatgagagagct

SEQ ID NO: 6224 - DNA, 2015 bp, Oryza sativa
  Predicted polypeptide sequence is orthologous to G1893
cagctccgtcgtcgccgcgcggggcggctcttcgccgacctgaacaccaaggctgcggcgggagacccgatggacgtggagggctccggctccggctgctgcgccgccgaagccgccgcggcgggggacgacgacgcggacgtcacggtcgcgctgcacatcggcctgccgagcccgaccgccgccgccgacctcatctcggggctctcgtcagcagccgggagaagatcctccaccgcgcgtcgtgacgaggaagaggacgaggcggaggaagccggcggcgcgagcagggacgacggcgacggcggcgacgccgccgacgccgcggcgccgctagggttcgcgtcgacgccgatcgggcgtctgaacaagggccagtactggatcccgacgccgtcgcagatcctcatcggccccacgcagttctcctgccccgtctgcttcaaaaccttcaaccgatacaacaacatgcaggtcagccagcaatttcttcatttctcttcacagcttaattctgctagctgctactgttcttgcttgctctagattatcgctgctccatttaattttattcttttttgcgattctttgtgggttattgctgttcagttttgtcgcaattcaagactaataagtgattaatttacttagaattagacatagcatcatgcgtgatccccaaactgtaccactagtggtcctcttgttcgtcttcccccgtttttgtcgtcatggtatgacaaagcatatgtcttcttcagtagattgataaatcccttttcttaggctagaataaatccgatctagctagaactaatttttttttctttcaagcatatcctaattgcaatcacctaacaaataaatgataccgacagtaggcgacgcaatttttaccttttctttctaagatctggctatgaaaaatttctacagtagtagttcaggaaagctttatggctcttgaacgaacgctgcatatctagctgggtgtaattacttgctagttcttttgtcggaataatgtttgacaatgcgtctcactcgttctatatatacctcttgatcccattaacgtatgcttcttatacttagctagttactcagcctcgatcagcatgcgaacgaaaacctgcactacctttatataaaaacaaaaaactgaattttatttttgccgggttgactgaaagaattaggccgaccgaattttattaggattggtaagaagaaagcctgaacctaattaattacttaagagttatctgtttacagtgattaattaagtgatatacatatgtatctatgtaaaaatatccatatattcaccaacctctctttgcattatagatactctgctagctgctaaacctacatattatctgagaaattcttgacaaaaaacgtcccacacaacatgcagctgatcttggaattatcgtacactagtaaatctcgattatcaagtgtgtcttgccactccatagccgggctagctagcttaagaacatgaatcccgtcttttctttctctgaacattaatttgttcttttgctcgatctgtcagaccaatgaacgatgaagcatgaagctcctattccaaagtcaattttttttagaaacacagtataaacgtaatcgctcataacacgtgtacattcatccatatgaacacatacacgcacaccatatttttaatgaacgacaaagtatgaaggtcctatttccaaagccatataatttgaactacagagatagctattttttttccattcgaaaaaaaaaatccattcaatgagatagctatattttgaaactggcgacctattttcaaagccatctagtttgaaacggagggaacatgaaagctagagagcagttcagttcagttctccttcgattccatggctgctagtgctagctcgtacctttttgtttagcttatcgttgaaatacgacgagtactagcaactgctagcaagcaagctataagagaaggagatttgctccggtcc

SEQ ID NO: 6225 - DNA, 1317 bp, Oryza sativa
  Predicted polypeptide sequence is orthologous to G1893
atggaagacccctacactagcttcttcaagaacccttactactactactgcacctcggctagctccttccccaccgcgcccgccgccgccgccgccgccgctcacctccctccgccgctgccgccgccttacgctgccctgtatcctaccgccggtggcgtcggcgtcggcgtcggcgcgcatcatcatcatcagtacccgccggccgcattcttccacccgccgccggtgcaccagcagcatcaggcgccgccgtcgccgccgctgcgggaagcgctgccgctgctgtccctgtcgcccacgccggcgcgccgcggcggcgtcgtcgacgcagcggctgactcggactccgacgacgacgacgacggcgactgctgctaccaccacctgcaggatcaggagggggcggcggccgggtcgacggccacccccgccgccgccgccgcgcgcgcgccgctcttcgccgacctcaactgcatccccacctgctgcggcgacgacaacgacggcggcgacccgatggacgtggaggtcgccgggacaacggcggacatcgacgccgcggtcgccctgcgcatcggcctgcctgccggcggcacggaggccgatctcctctccgggctcaccggcgccggcgtcgaacacgaggaggaggaggaggactgcaaggtggacggcggcggcagcggcggcgacgacgaggtggtgccgctagggttctcgtcgacgccgatcgggaagctgaacaaagggcagtactggattccgacgccatcgcagatcctcatcggcccaacccagttctcctgccctgtctgcttcaaaaccttcaacagatacaataacatgcagatgcatatgtgggggcatgggtcgcagtacaggaaggggccggagtcgctgcgcggggtgcagccgacggcgatgctgcggctgccgtgctactgctgcgcggcggggtgccggaacaacatcgaccacccgcgggcgcggccgctcaaggacttccgcacgctgcagacgcactacaagcgcaagcacggcctcaagcccttcctctgccgcaagtgcggcaaggccttcgccgtcaagggcgactggcgcacccacgagaagaactgcggcaagctctggtactgcctctgcggctccgagttcaagcacaagcgctccctcaaggaccacgcccgcgccttcggccacgcccacaccgccctcgacgccgacgacgacgacggcgccgtctccgacgccgacgccgtcgtcagaccttcgtcctccatggctgcctcctccctgcagccgccgccgcgctag

SEQ ID NO: 6226 - DNA, 693 bp, Oryza sativa
  Predicted polypeptide sequence is orthologous to G1893
aaaaccttcaaccgatacaacaacatgcagatgcatatgtgggggcatgggtcgcagtacaggaaggggccggagtcgctgcgggggatacagccgacggcgatgctgcggctgccgtgctactgctgcgcggcgggctgccggaacaacatcgaccacccgcgggcgaagccgctcaaggacttcaggacgctgcagacgcactacaagcggaagcacgggctgaagccgttcctgtgccgcaagtgcggcaaggcgttcgccgtcaagggcgactggcgcacccacgagaagaactgcggcaagctctggtactgcctctgcggctccgagttcaagcacaagcggtccctcaaggaccacgcccgcgccttcggccacggccacggcgcgctcggcggcgccgccgccctcgacgacgacgacgacggcgccgtctccgacctcgaccacgactcctcctccaccgcccccgccgcccgatccctctaatcgcaaagacctgcttcggtccagcaaaaagtatctcgaagtactagtacctcacattactaaatcgtttctgatcgttggatttagctggataagatatgtattattggatccagcgattggaaacaatttggttaccataatgtatcggtaacctcgaggtatttttttattggaccagagtgaatctttcattgtaac

SEQ ID NO: 6227 - DNA, 648 bp, Oryza sativa
  Predicted polypeptide sequence is orthologous to G1902
atggaggtggcggaggggaggacggtggcggcggcggcggcaggtggtggaggattgggaggaggggcgaggacggaggcggaggggttggcgtgcccgaggtgcgagtccaccaacaccaagttctgctactacaacaactacaacctggcgcagccgcgccacttctgcaaggcgtgccgccgctactggacgcgcggcggcgcgctccgcaacgtccccgtcggcggcggcacccgcaacaaggtcgccccggcgccgtgcaccggccgccgcaagcgcgccgcccacgccgcgcacgccgcggcgccgccgccgacgacgacggcgtcgtccgcgccgctgccgctcatgccgccggcggtggcgtacgagctgccgttcctgccgccgccgccgccgctgccgctggcggccgtggaccccgaccgccgcctgctcgacctcggcggcagcttcacctcgctgctcgcgccggcccagctgcacaacggccacttcaccaccggcttcctgctgggcaccatgtcgtcggcgccgccgccgccgccgccgccggccacttctacaccgtctcccgcgccggccgcacacccgccggtgtcggacagcatctgggccatggggtggccgcacctctccatctag

SEQ ID NO: 6228 - DNA, 402 bp, Oryza sativa
  Predicted polypeptide sequence is orthologous to G1903
ctgcgtgctgctccgaccaacagagcttcgtcgagaacggcttcccgggcatgagctactttgagacgtcgggctcgtcggtggtgtacccgcactaccacaagtcgacggacctgcctgagtacgtggactttgagcagatgggcctcatcaccaaggccgccgcggcagcgctggccaccttcgcccagcccttgtaaggatgatggtcgtgatgtgattgtacgttttttatatgttctttcggctgtcttgatcgatgctgcagcgcccaccagcgagctcacccgccctatcgctgcgtggctgtgtgacccacaacgttgagttcgaacgcaggctctcatgttttggtgtttgttgttgtgtacaagaagaaaagaggccgttctttttacaacc

SEQ ID NO: 6229 - DNA, 1406 bp, Oryza sativa
  Predicted polypeptide sequence is orthologous to G1909
gctccatggctttccaccttcgcttcctcctcctccttgccctctagctactagctcacactgtcacagtcaccacacagctactagaagtaagatttagctagattattcattaatctgtactaattgatattgctaagcagctgcagcagcagcagctggttggggggaggaagaagaaggagagtgttcgatcggcggcggcggcggctcaccggtccgacatgcgcaggggttcaccgtggtacgactactactactcctcgtcgtcgtcgtcgtcgtcgtccccggcgcggagcaagcgcgcgcaggcgcagctcgtcgtcgtcgtctccgccgccggcaagaagctaccctggccctcgccgcggcgtcgcgggagccatgtcgtcgccgttcctgggctcttcttcctcttccgcttcgtcgcccctctcttacctgaccccgcctaggcctcctcctcctcctcctccccttctcatggggcagggatacgccgctgctgccaatggcggaattggcggcggcggcgtcgaggcggtgaacgcggcggcggcgccgaggcagggtggcaggcacgccgggcacccgccgctgccgaggccgccgccgaggcagtgcccgcggtgcggctcggcgaacaccaagttctgctactacaacaactacagccgcacgcagccgcggtacctctgcaaggcgtgccgccgccactggacggagggcggcacgctccgcgacgtccccgtcggcggcggccgcaagaacagcaagcgcgccgccggcggaggcaaggccggcgccacagcctcgacggcggcttctgcccatgtcgtcgcgccggcggcggcgccgccgacgtcgtcgtcgttccccgatctcctgaggcagatgctgatggcgccggctaccgccggtggcggaggcggctacagcatcgaccagaccgcgtggcagcaaatggcggcgttcgcggctccacctcaggccgccaccggcgatgtcggcggcgcggtcggagcggcgtcgacggcggcgccggacgcgaactgcggcggcggcggcgtgcagtactggaacgggtggctgcaagatgacatgcccggtctagatggttcatgttaagtaacccgtgcttgtattgatacgtatacgtatacggagctacggatatatataccgaatacgtatacgtatatatatgtgtgtgtatatgcatgtatagcctatgtatgcatacatgcatacacatgcgctatgaaagtatatacgtatgtcgtatgcgcatactaaattagcgtaacaagagcctatgactgtactagtgtagtttggattcaggttattaactcgtgggtatatgttgacctactgtagttaaatttgtgtatttgtgcgactct

SEQ ID NO: 6230 - DNA, 1626 bp, Oryza sativa
  Predicted polypeptide sequence is orthologous to G1909
actaccataactaccccacccaacaccatcatctgatccatttccacaaagcttctgaaagccaacacatacctcactgcctttgccttcttctcagcttcaagaagccttttgagcttgtgatttctacatcatccatccatttcatcaccatgatccaagaactccttggagggacaaccatggaccagctcaagggcgccagcgctctgaaccacgcctccctgccggtggtgctgcagcctatcgtgtccaacccgtcgcccacgtcgtcgtcgtcgacgtcgtcgcgctcgtcggcgcaggcgacgcagcagaggtcgtcgtcggcgacctcgtcgccgcacgggcaggggcagggtggcggcgcggcggagcaggcgccgctgcggtgcccgcggtgcaactcgtcgaacaccaagttctgctactacaacaactacaacctcacccagccgcgccacttctgcaagacgtgccgccggtactggaccaagggcggcgcgctccgcaacgtccccatcggcggcgggtgccgcaagccgcgccccatgccggcgccggtcgccaagccgcccatgtcttgcaaggccgcgccgccgctcggcctcggcggcgggccagtgtcctgggcctccgggcagcaggccgccaccgcgcacctcatggcgctgctcaacagcgccaggggagtgcagggccacggcggcagcaatgtccaccggcttcttgggctggacaccatgggtcacctccagatcctgccaggcgctcccaatggcgccggcgccggcacggcggcgtcgctctggccacagtccgcgccgcggccggtcactccaccgccgccgcacatggactcccagctcggcatggggacgctgggccaccacgacgtgctgtcgagcctcggcctcaagctgccctcgtcggcgtcgtcctcgccggcggcgagctactacagcgaccagctgcacgcggtggtgagcaacgcggggcgcccccaggcgccgtacgacgtcgccaccgcgtccctcccttgcaccaccgcggtgacctcactcccgtcggcgctgtcgagcgtctccgccgccgcgccgaccagcaacacggtcgggatggacctgccacccgtgtcgctcgccgcgccggagatgcagtactggaatggcccggcggcgatgtcggtgccgtggccggacttgcccactcccaacggcgcgttcccatgagatagacgacggcgacgacgtcgtctcatgcaagcatgacattactagctagtgtagctctcgatcggtttagctttaatcatcatcgatcttgtgtggtttcggttaatcagtgtgaggactctgaggggtttaatcaagggtgttttagttactggtgtttttgttaatcagtggggatcgatcaagtaaccttttttactgtttacttattattaggtttttacctagggtttggtggtaactgggtatagtgtttaagtcgtgatcaatgcatagatggggttgtactatgagatgtgtacgtgtgttgtcggtttcgttcaggttgatccatgtatggatgtaaggtttacattccctgcaagctcgtggacgtacttatctcagctgc

SEQ ID NO: 6231 - DNA, 996 bp, Oryza sativa
  Predicted polypeptide sequence is orthologous to G1917
ccaaagctaaagctgttcggcttccacacctccaagcaggagacgatggattagcacaagcacggctaggagcaggacaggagtagtactcgactgagcgtctgagccggagaacgcgccggccggtctgcggcaacggagacggagctcgatcgcagaggaggagctaggcggccagcgatgacagagctagctcgtagacaatctgatggaggcgtgcccgctgctcattgagtaaagctcgagcttgcttccgccaagctcgacgaatgggtgcgccaaactcgcggtagtcatggcgctcgagctcctccccgcgcatgtatcttcggcgagctccgcctctccactcggagttgcttcgtccctgtgccgctgccttcgccggagaacgccgcccccactgccgcctccaccaccaccgccgtaggtgctggagctcgatttggttgcgcgcttgcggctgtcatcctctacggcggtggaatgggtattggaggacggtgtttgcaggcggcgaatctgcagctccgtcagggacgagatgtcgatgggtgtgcggtggtcctcgctgggcagatggatgagccatgcgcccatgccgaaggagagagagacagtggagaggaggaaggaggaccggactgatacatgggactaactaatctatacaggtggcatcctaatgtgcaaaaatagtgtagaaaaccactcgagggtgtcttttgtactgtattgaaagtttgagggggtcaaatgtctgtctggttttaaagttgtggggtgtgctttagacaagctaaagacttagagggtgtaaaatagacttatccctttaattctgagagagttctggatgttggtgtcggctgccgtagtgtctctagccagtgttggctgaaggaaatctgttattttggtttaagttctaacttgtaagctggaatgcccggcaaaatgctatatttgcttcaatagaagcagggtcattggctg

SEQ ID NO: 6232 - DNA, 2533 bp, Oryza sativa
  Predicted polypeptide sequence is orthologous to G1927, G2184
ggagttgactcgccatttcgccatttcgtcgagaggttgctgtgccagtcaccaacccattccggcggcggcggcggaggagaccgagatggggatggagaacccgccgctccggtggccgccggggttccgcttcagcccgaccgacgaggagctcgtcctctacttcctcaagcgccggatcgccaccggccgccccaccccctacatcgccgacgtcgacgtctacaagtcccacccctcccacctccctgagaggtcggcgctgcggacgggggacaagcagtggttcttcttcagccggatggaccgcaagtaccccaacggctcgcgggcgagccgcaccaccggcgagggctactggaaggccaccgggaaggaccgctccatctgcaacggcggcggcggcggcaccgcctcggggcgcgcggtggggagcaagaagaccctcgtgtaccaccacggccgcgccccgcgcggggagcgctcggactgggtcatgcacgagtacaccctcctcgccgacgcgctcccgcccgccgcgcgcgaccgcgaggcgtacgctctgtacaagctgttccacaagagcggcgccgggcccaagaacggcgagcagtacggcgcccccttccgggaggaggattggctcgacgacgacgaccaccaccacgaccagcttcctgctgaggcggctcttccggctccagccacaactagtggtagagctgcaacaactgaggagcatgctgactttgagcttccgggtggggatcttgatgtgctccttgcgcaaattgaaaatgatcaggatataatcgaagcgcaattggatttctcaactcatgttacttcccaagttcagattcagcatcgtgttcatcaaggttggctcagtgatgatggcggaaaatcagatgttgcggatgctacgactagtggcagtgctttgttgatggcagagaatacgtgcgctgaacttccaattgatggtctcgagcaacttctgatgcaaatatcggatgatcaacagacagttgaaatgctctctggtttctcagcatccgttccccaatcgcagcttcaacatgattatcatcagggttgtcttggtgttcatagggaggaggttggtgttgcagattctaccactgttagtagtgctgtggtgacagaagaatgtactgtccgtgagcttcaggatattgaagggcttctgatgcaaatagaaaatgaccaggaaaatgccgaatcactgccagatttctccacaccagttcatctccatgattgtcatcaggccgccttcggagattttcaaggaagccagagggctacattcaacattgcaaatctttctactatggtgcaggaaagcccaaattttgatctgcaaactggtccaagtaatcaaattactgagtctattctcaccaccgagccaatgaatggagaaacaaatgctgtggaagaaacaagtcctctgcgctctatgtcagtattgggtagttatgataggcaggatggtgatgatgaattccttgaaatcaatgatttcttcgacccagaagatttagaacagattttgggcagtacaagaagtcagaacttgattcctgctgatgatggagtgtttgatagtttgcaatactctgatgctccaatgtttctgcctggttcatttgacagaactggtgtggtggctgaaaaccattatgttgaatttggtgctagtggaattcagaaccagggatttcagcatacaactgaattattggcacataatcaagtcgctctaaatgtgcggaaccatatgaaggacaaccatgttgtcttctcacattcatcagatgctaccattattcatacagtgaatgagcaaccgcctaaccggagttcaaatgcttcacaatcatggttcaatggggctctatctgccttgctcgattctgttcctagcagtccagctatggctgctgaaaacataggtcttaacagaacactgcaacgcatttcgagctttaggtcacaacaacctgcaagagaagaagttagcagtactcttatcaacaccagaagaagaggcggtgggctaattttcatctcgttaatggttttacttgttgctatcatgtggacctttagcaatgggtctgcagtcaagcttagcaaggggttatggaagtttccctctacataataggatgcacccggttatcctggtggccagtgcttcttactacttcaagtactaattcttgttttgctatcctttcctctattcctttacattgaaaaaggcaacaatctaggaaaatattagaggattatgtggtgttagcacttactttcagaatattatgcgagagatgttaaaacaaaacaaaatgagaaaaagaaacatctgaggtgaacttctggatgtttttgtcctcatcattttgatgaaagtatatattgaatgtaattaaacgatgatggattgttgagaagtgcagttgctgtgcacgataaatgaaaaatccatttttgttgc

SEQ ID NO: 6233 - DNA, 2362 bp, Oryza sativa
  Predicted polypeptide sequence is orthologous to G1928
acacacacttgctcctcattcctctctcctctcctctcctctctctcatcaaccctagcttgatagttgattcaaccagccaatatattcgatctccccttctcttcttctctcgatcgatcgggtgatgagaagccaattgagaatttgagatcgttcgatcatcacctcgtttcttgctgagattatagccaagctccatgattccgtctatgccggtagtgacactgcaaggtgcacaccagtagatagctagtggcagcagcagcagcagcatcagtggagctagtcgtcgtcccggccggccttgccgtcagagatcgatcggtgtaagttacagggtgcaagtgcgatcgatcgccaccggcgcagcgagatctgattgatattgatccatcgccgatcgattgatcatacgttcagatatcataatcagcagcagctggtagaattcaagagaagttcgtccagatgatgctcaaggatctggccgaaattcagcagcagcagctgctcgccgccgccgaggagaacatgtcgaacctgacgtcggcgtccggcgaccaggccagcgtctcgtcccaccccgctcctcctcccgccaagaagaagcgcagcctccccggcaacccagatcctgaggcggaggtgatcgcgctgtcgccgaggacgctgatggcgacgaacaggtacgtgtgcgagatctgcgggaaagggttccagcgagaccagaacctgcagctgcaccggcgagggcacaacctgccatggaagctgaagcagcggaaccccaaggaggtggtgaggaagaaggtgtacgtgtgcccggaggccggctgcgtccaccacgacccggcgcgcgccctcggcgacctcaccggcatcaagaagcacttcagccgcaagcatggcgagaagaagtggaagtgcgacaagtgctccaagcgctacgccgtccactccgactggaaggcccactccaaggtctgcggcacccgcgagtaccgctgcgattgcggcaccctcttctcccggcgggacagcttcatcacgcacagggcgttctgcgacgcgctggcggaggagagcgcgagggcggtcacggcggcggcggcggtggcggggcagcagcagcatggcggcgggatgctcttctcgcaggtggcggatgtgcttgatcaccaggcggcgatggcgatgggggggcatgggctgatgcaagagctgtgcctcaagagggagcagcagcagcagcagcagcagttcgcgccgtcgtggctcacggcgcagcagcagcagcagcagctggaggcgatggccggcgcggggaatccggcggcgatgtacgggtcggcgaggctggaccaggagttcatcgggagctccacgccggagagcggcggcgcgcagcaggccggcctcagcttcgggttctcgtcgacgtcatccgcgccgccgcaccccgccgcctcctcggcgcacatgtccgccaccgcgctgctgcagaaggcggcgcagatgggcgcgacgctgagccgcccgtcgagccacgcccacatggcggcggcggcggcggcgagcacgcacaacagcagcagcagcgccgccaccaccaatgctcctcctcctcctcctaccagccacgtgtcgagcacttgcgtcggcgccggcggctacgggctcgccttcgaagcgtcccacttcatcgcagcagacgagagcagcaggggcgccaggtccgatcgtgacaccggcaatggcgtcgccggagccggcaacgacggcctcaccagggacttcttgggtctccgagccttctcccacggcaacataatgagcatggccggcttcgatccctgcatgtcgacgacgtcggcgtcgtcggcggcgccgtacgaccaccaccaccacagcaacaagccatggcatagctagtaaccacctcggccgccatggatgaatagcgaatgaatcatgcaagcaaatccaaacaaattttgttcgtgggctactcatcgatcgttcgacaagaactgcctgatgatgatgatcatgtcaagattatttcatagctgggtaagtgagtcgaatttacccagctctctctcttttgatgttccaattgaggtttaataattcgatgttcttttgggagggtatgggctgttcaattcatatatatggaacttttcaaattatatactgttgtttatgctagctatatatcatagttaattcatcttcctactgtaataatttttagccattctcagctcataaagctgtgtagagctactgccattagagctccatttgtaatcagttgttaccattaatcattcccttaaatttctagttcctg

SEQ ID NO: 6234 - DNA, 1626 bp, Oryza sativa
  Predicted polypeptide sequence is orthologous to G1928
tggcccgattcctactcgtcactgtgccaactgaaagcgcaggcggcagcgagaacactggattactggcaaagtggcaatgagaaaggagcacggcaagccagccaaggcaggtatatctgagcagaaggcagtaggagtgcaagtgctgcaatcgatcgccatggatggatggaagcaagcaagatggaggaggagggaggaagaagaaggacctggagaagatggtgccgcaatcgcacttgtactcgcgggtgccgcagatcttggagtgggccttccagtcggagtggacggcgtacttcttggagcacttgtcgcacttccacttcttctcgccgtgcttgcggaagaagtgcttcttgatgccggtgaggtcgccgagggcgcgggaggggtcgtggtggacgcagctggcctccgggcagatgtacaccttcttcctcaccgcctccttgctcccccgctgcttcagcttccacggcaggttgtgcccccgccggtgcagctgcaggttctggtccctctggaaccccttcccgcagatctcgcacacgaacctgttcgtcgccatcagcgtcgccggcgacagcgccaccacctccgcttccgggtctatatataggttcgatcaattgctttcgcttaattgccgagaaaattaacggagcccggatcgatcgaggagctagctatacaagaacgcacctgggttgcccgggaggctgcgcttcctcttgttgctgttgttgccgttgttgccggaggatggcggcggcggcggcggcacggtggaggcggaggaggtcaggttggacatgctgctctcctgctgctgatctgctgcctcggcggcctcttccaccaagaacaatcctcctccctcctcctcctcctgctgctgctgctgctgaagatggtgatgaaacataggagcttcgatcttttcttgctacatagcatgcagcatctgcctcaccatggaagcaatgaattttgggaggctcaagtgaagtgatgaagaggatgcattaaaactgaagaatggaggcaggagacaggagggcatgtaggatgaagggagttcagagaatctcaaggaaggaacaaacaagaaggaggaggggagggggggacaaacaaggaggaaactagggtggtcaatgactctaaagcaattttcagattcttctttctttcccttcctcctcctccttctcctctctctctctacagtctacacacactcagagcagaagcagcagcatcaccaagtgtagaacacaacaaggatgctcaagagaagagagagagagaagcaagcagctggaagctagctagccaggcaagcagcagccatgagagagagggagagagagagatcaagggattgggggagaggagcagtagcagtgtgttgcttggcaggcagcagctgaagtagccagaggggagagtggagaagcaaagctgagcaaatggaagaagagaagggcaccaaaaaccaaatcccttttcttcttcctcctctttatctgctcctgcctgctgatcctatactttactttcagggccctgtgtgagccagctaaaaagattaaaaagatttgtagagcagttcagact

SEQ ID NO: 6235 - DNA, 693 bp, Oryza sativa
  misc_feature (51)..(52): n is a, c, g, or t
  Predicted polypeptide sequence is orthologous to G1932
gcaccagtggaggtgatggggcttgctagaacggggaagggggggggggcnntttggctgttgttgggatgcacacgtttaggagtgtggtgcattgttggctttcagcaggttgcgtcaggcagcgcatctgaagctggtttcaggcctgtaagcatgcagagcagcatggtggggtgctggcaggccaggtcaagtgggtgggcaggtacagccagctttgggtgacattcaatgcagcagcagtgtccagagtgaactggtgcagcagctcttgccaggtgcagcaggctggtcgccaagtggtggcggacttgttgaggccacccggcatgtacagactggaaaaaagacagcgttcctgagccacaagttgtgggcccggtgcactgcacgtgtatgcctggcatttggaatgttggtgctccagcttgttgctgctggtgtttttttgtgcgtttggttgctgtcaatgtcttgaagacatgacccagttgcaattgccgggtagaggcggcatgcattgtgcagatcaacagggaaaccacagtttgcacttgtgctgtgtggttggttggggttagtcaggtgatgcaggctttgattccagtggattgtccaaccaatgggcctgtcataagctccccaaactggacggaagtgcagctgtcgtaaccctcaagtagtgaaaaa

SEQ ID NO: 6236 - DNA, 1397 bp, Oryza sativa
  Predicted polypeptide sequence is orthologous to G1935
ggcctcgcctcgccgatcgatcgacggacgacggccggaacatagctgtagatcgagctgaatcgccggcggcggccatgggacgggtgaagctgcagatcaagaggatcgagaacatcccgaacaggcaggtgacgttctccaagcggcgaaacgggctgatcaagaaggcctacgagctgtccgtcctctgcgacatcgacatcgccctcctcatgttctccccctccggccgcctcagccacttctccggccgccgcaggatcgaggacgtgctcacaaggtacatcaatctcccagaaagtgacagaggaggaactatccaaaacagagagtatttgatcaacatgctcacccagctcaaatgcgagagcgacgtcaccgaggatctcactaacacgagcagtaaggcgccggttaactccaacattgaggagcttcagcaagagatcaggagatgccagcaccagatgcagctcacagaggagcaattgaggatgtttgagccggacccggccaggtctgcatccatggaggacgtcgaggccagcgagaagttcatcgccggcatcctcagccgcgtcgaggagaggaagaggtatttgctgtgcagcatgggctcgttcgacgtgacggcgtcaacatctgccatgcagcatctgtatctaccgcagcagcatcagcacggggacatcactgataatgggtttggaagcgatgaggtggcctcgtgggtctctgaggggatgccgccgacaacctcgtcggtggcgtcgatattcgccggaacttcagattccatgatgtcttttagagatcaagcggtgtacgacacgatgagacaagatgcatgtgtggatcagacagtggtcccggagatggggatgtgccatgtggaccagcagaaccagagtgacgactggcaggcgtacacgtcggcggagttcctcaacgcgctaatcccgcccacgccgttccctctcgacgacgaggatacgatgggcccgatgttggcgtcatcaccgctattgatgcccggcatccatgaccagcagccgccggtggaggatatggcgacggcgggctgctcgcaagcgccggctaacgatggcaacgggttatacgcagctgaggacattgctccggttaacgttggttaattagatgcttttgtactagaaatttatggaatatatagtgttgtcatgttactagtgtgccaggaattgaagctaaggatttttagtttggaattttttttctttgatcatgatgggctgggtgtgccacaattaatgttatatgatccatataatacaccatgcacaatgtaagataatgttacgtactagcatgtaataagatattatccagtaagatcgagttatttatcatct

SEQ ID NO: 6237 - DNA, 1014 bp, Oryza sativa
  Predicted polypeptide sequence is orthologous to G1935
atggggagggtgaagctgccgatcaagaggatcgagaacacgacgaacaggcaggtgacgttctcgaagcggcggaacgggctgatcaagaaggcgtacgagctgtccgtgctctgcgacatcgacgtcgccctcctcatgttctccccctccggccgcctcagccacttctccggccgccgcggggtggaggacgtgattctccggtacatgaacctctcggagcacgacaggggagaagccatccagaatcgggaggagattcagcaagagatatattcttcccagcaacagctgcaaatcaccgaggaccgccttaggatgttcgagccagatcctgcggcgttcggcacatccagcgaggtcgacggatgcgagaagtatctcatggaattgctgacccgagtcgtcgaaaggaagaacaacttgttgagcagtcacatggcgccgttcgatgcaacgacagctgcgatgcagggtgcagatgggacgcagatgtacgtgagccaggcggacgggttggccacgttcggtggtgacgctgccatgtggggcccagatggaggcgcggatcctggccatccgatgttcagtgcatctgatccgttgatctacctcagggaccacgacgtgtacgacgccaactcacaggtggccgggctgcacggcggcgacccgtgcgcggccggcggcgccgcggcggcggcggccgcggtggggtgcgtcgacgacgacgtcgccggaggccacgccgccgccgccgacgcgtggaggcaggcgtacacctgcaccgagctgctctccacgctcatccccaccacgccgttccccctcatgccgcattgcctggggccggaggaccagtacctgtcgatggagcatggcatggtggcggcggcgcaggagccggtggaggcgtcgacggcgagctgctcctacgttcccagcgacgagaactccggcacgccggtcatggcgtacgacagcaacccgccgccggcgaacatcgcctga

SEQ ID NO: 6238 - DNA, 528 bp, Oryza sativa
  Predicted polypeptide sequence is orthologous to G1936
tggtgcaaatcaaagaactgctcctcagtggatgttgcctttacttctaggcctgtacggaagtgttacttctgctctaaaagctgcggaattcctcgagcactgttggcctactggagcgctagacagatcgagacgtcctcatccacatatcttctctcgccatttctctcgctgactctgtactctctctttcctcatccacatatcttctacagcggagtcgacgggagaaggggcagcagccgccgggcggggtcgacggcggccgtcgggctggggaggcgacgacggcttgcggcaagtggaggactcgatttgggggtttctttgttttttaaaaaagaatttgtgattcattggatctgtgttatttgatatgtgatgtaattttttttagaatttgtgatgtatttttttgataatttttgacatgaatcttatgatttgtgatgttgttactttgatttggagatgtagggagcaactcgatttggaatttatgatgattttgtgattttgatgaaa

SEQ ID NO: 6239 - DNA, 1856 bp, Oryza sativa
  Predicted polypeptide sequence is orthologous to G1938
gaagattttcttattcttcttcttctcctcctctctcttctcctcttcttgcacctcctcaccttctcctctcctctcctcttcttctccatcaccatccacccatccaactggtccaactcctccaatcgtttgcttcttcttcttcctcttctcgctgttcttggtggaggaggagattagggtttgattagggtagatagagagagaggggttgggtttggttggtgtttgtgtggagatggaccccaaattccccccacccccaccgctaaacaaaacggagcccaccaccaccaccaccaaccagcagcatcaccacgatgagcagcagcagcagcatcgcctccagattcaagttcatcctcagcagcaggagcagcaggatggaggtggaggaggagggaaggatcagcagcagcagcagcagatgcaggtggtggttgcggcggcggcgggggagaggaggatgcaggggctagggccgaagcggagctcgaacaaggaccgccacaccaaggtggacgggcgggggcggcggatccggatgccggcgctgtgcgccgcccggatcttccagctcacgcgggagctcggccacaagtccgacggcgagaccgtccagtggctgctccagcaggcggagccggccatcgtcgccgccacggggaccgggaccatcccggcgtccgcgctcgcctccgtcgccccctccctcccttcccccaactccgccctctccaggtcgcaccaccaccaccaccacatgtgggcggcagcgccgcccacggcgtccgccgggttcgccggtgcagggttctccggcgccgactccggggtgatcggcgggatcatgcagcggatggggatccccgccgggatcgagctccagggcgggggagcgggggggttggggggtgggggtggcggcggcggtggccacatcgggttcgcgcccatgttcgccagccacgcggcggcggcggcggccatgccggggctagagctagggctctcgcaggacggccacatcggcgtgctcgccgcgcagtcgctcagccagttctaccaccaggtcggcgccgccggtcagctgcagcaccagcaccagcatcaccatcagcagcagcagcagcagcaggacggggaggacaaccgcgacgacggcgagtccgatgaggagtccgggcagtagtagccgcgccacctgaatttgttcatccacgcgtcgtctcttcggaggagaaaagagaattctaggaaggacatgcagctaatggaggggggaatggaatgcttttgttactgttgggttgttcttcatgggggtttttatgtctgattttttttcctcgtgtggtgtcgaagctcgaaagaggctactactttgctccggcgacttgttgggatggatcatgatcatcttcagttgttactcctgctgctccatggatggttgccggtttatccccctccaagtgtttaggtgaaagctcaatatttcgcactcgacagtcaacacatgacatgatcttcgaaaggttgcttgatgagcttatgtatctgtgtttgtgttcatttttgcaggtgtataatagccgagagctggatggactggatcatcgctgtcgagtgagtgctttatttgttattgcaggtcgttgtgtagatattcaggtatttttgcagttagagaggtcttctttttttcctttttacgagagtgatgatccgcttatgtgcgacaaatacgatgtccgtcaaactgatcctcacccacgggctgtttctgcaacgcaaatatgatgcatatacatttttagaggcctgattttatatgcttattcttttgtggc

SEQ ID NO: 6240 - DNA, 612 bp, Oryza sativa
  Predicted polypeptide sequence is orthologous to G1938
atgagggcccacatggaggcgccggaggggcggaagatgtggggaccgccggaggatgcgagggcacgccgcgagggagaggatccgctatcagcagcagcagatgcaggtggtggcggcggcgtcgggggggggggggaggaggatctaacgcgggagctcggccacaagtccgacggtgaaaccgtccagtggctgctccagcaggcggagccggcaatcgtcactgccatggggacgggtgtcggcgctgacatccgtcgcaccctccctcccttccccaaactgcgccctctccaggttgcaccaccaccaccaccacatgtgggctgccgccgcggcgttcgccggtgccacatcgggttcgcgaccatgttcgccgcccacgtggcggcggccatgccggggctagagctaggacactcacaggacggccacattggcgtgctcttcgcccggtcgctcagccagttctaccaccaggtcggcggcgccagtgccactggtcaactgccacacccgcaccaccatcaccaacaccatcaacagcagcaggaggacggggaggatgaccgcgatgacggcgagtccgatgaggagtccgggcagtag

SEQ ID NO: 6241 - DNA, 2051 bp, Oryza sativa
  Predicted polypeptide sequence is orthologous to G1946
gaaattccccaccctcaaatccccccctacccacgggccccgatcccacgcctccccctaaccctacccatgctcacgctgtcgcgcccctgaccctcaccacgcctccccatacggatcgcctcatggaggccgccgttgctgctgcggctgcggccgccggggcggtgacgacggcggtcgcgcctccgcccggcgcggcggtcagcaacggggtggcgaccgcgccgccgccgttcctgatgaagacgtacgagatggtggacgacccggccaccgatgccgtcgtctcatggggccccgggaacaacagcttcgttgtgtggaacacccccgagttcgcgcgcgacctcctccccaagtacttcaagcacagcaacttctcctccttcgtcaggcagctcaacacctacggatttaggaaagttgatccagataggtgggagtttgcaaacgaaggttttcttagaggacaaaagcatctactgaagaccatcaacagaaggaaaccaactcatggaaacaaccaagttcagcagcctcagttgccagctgctcctgtacctgcttgcgtagaagtggggaagtttgggatggaagaagagattgagatgctcaaaagggataaaaatgttttaatgcaggaacttgtcaggctgagacaacaacagcagacaacagatcatcagctgcagactttgggcaagcgtcttcaaggaatggagcaacggcaacaacaaatgatgtctttcctggctaaggcaatgcatagtcctggcttcctagcacaatttgtacagcaaaacgaaaacagcagaagaagaatagttgctagtaacaaaaagaggaggctaccaaagcaggatggttcgttggactctgaaagtgcttcattggatggacaaatagtaaaatatcaacctatgatcaatgaagcagccaaagcgatgctaaggaagatcctaaagctagattcttcacatagatttgaatccatgggcaattcagataatttccttcttgagaattatatgccaaatggtcaaggtcttgacagctcttcatcaactcggaattctggtgttacccttgcagaggtcccagctaactcaggtttgccatatgtagctacaagctctggactttcagctatttgttcaacttcgactcctcagattcagtgcccagttgttttggacaacggcatacccaaagaagttccaaacatgagtgcggtgccttctgttccgaaggctgtggctccaggcccaactgatatcaatattctggaattcccagatttgcaagatatagtagctgaagaaaatgttgatattcctggagggggctttgaaatgcctggtcctgagggtgtattctctttgcctgaagaaggtgatgatagtgttcccattgagactgatgagattttgtacaacgatgacacccagaaacttcctgctatcattgattctttctgggaacagttcctggtggctagccctctatctgttgataatgatgaagtcgattcaggtgtactagaccaaaaggaaacacaacaggggaatggatggaccaaagctgaaaacatggctaaccttacagaacagatgggcctcctgtcatcacaccatacaggatgatgaggtacaataggacatacttagccaccatttgtcaaggtaccctgggatctcggtaataaactcccacatcatcacctacccttatgtctatgttatgttctatcattttgctgaaacaatactgaaacgtcaccctatatgtgggaggatactaatcttccacctatgaaacacggtttacccgaggggtttacctgcttgtatctaggtttggcaggcgtaagaattgatcaatggtaacttgtcaaatctgtatgatagctactttgtgttgtagctactgatagctttttttttttgttcttgcctgctctatctgattgcaactaacttctggtagtactggcagtctgccacactgtattgattccaaaattaagtaactttgactgtttcagattc

SEQ ID NO: 6242 - DNA, 1705 bp, Oryza sativa
  Predicted polypeptide sequence is orthologous to G1946
gtctagtacaccagacgacaacacacacacaaaaaaaaaaaagaagagaaaaaccgaacgaaaatcccctcgcgcagacgactactacatccttctcgtctcatcccgtcgacccgccgccgcctcaatctcgaagcctcggcgaggctagggtttctgcgtctccatgggctctaagaagcggtcgcctcagcatccggccgccgcggcgccccctcccgccgtcggcggcggcggcggcggcgaggtctccggcgatggtggcgcctcgacggcgaacgggccggtggtgccgaagccgtcggaggtggcgccgttcctgacgaaggtgtacgacatggtatcggaccccgcgaccgacaacgttatctcgtgggccgagggcggcggcagcttcgtgatctgggactcgcacgccttcgagcgcgacctccacaggcacttcaagcacagcaatttcaccagcttcatacgccagctcaacacctatggatttcgtaaagttcaccctgatagatgggagtgggccaatgaaggttttattatgggccaaaaacatcttctgaagaccattaagaggaggaagaagtcttctcaggaatcacctagcgagatacagaaggcgcctgtcaaaactgcacctggtactgaaaatattgagataggaaaatatggtggccttgaaaaggaggttgaaacccttaagagggataaagctcttctcatgcagcagcttgtagatctcaggcactaccagcaaacatctaaccttgaagtgcagaatttaattgaacggcttcaagtaatggaacagaaccagcagcagatgatggcacttctagcaatcgttgtccagaatcctagttttctcaaccagcttgtgcagcaacagcagcagcagcgcagatccaactggtggagtcctgatggaagcaagaaaaggagatttcatgctcttgagcagggccctgtaactgatcaggagacctctggccgtggggcacatattgttgaatatctcccacctgtcccagaaacatcaggtcaagtaaatccagtggaaggagccatttgttcggccaactcacaaccagttccaagtcctgcagttgccacacccatggacatgcaaacgtctaacgttgctgatactctcggttcatctgaggagcctttcgctgataactctactctacatgaatgggatgataacgacatgcagcttctgtttgatgataacctagacccaatacttccaccatttgagaatgatggtcaaatgggccctcctttgagtgttcaagattatgattttccgcagttagagcaggattgtctgatggaagcacaatataactccaacaatcctcaatatgctgatgtcattaccgaagcttgattggtggtccaggagcatacttgcagtaacattagttcttcggtgaccaacctccgggcgcatctgcaccattggcatcccgaaatggcgtcctcagggtgtaccgatgaattatgctaacacagaagaagatataactctaatctggttgaccatacagaactacctttcttgttcaaggcactttttggggacaggggacgccttttcgcagttctcgtcgtcttacactagcgatggttgctaccatcgaattcatttggtgtatatactgttgttcgtcttataaaacatgagcagttttgt

SEQ ID NO: 6243 - DNA, 1293 bp, Oryza sativa
  Predicted polypeptide sequence is orthologous to G1948
gacgacacccatccctttcccgcctcaaaccccccaaccccaatgctcagagaactccagccctctccatcaccgtccctttccggcttcgtctccccaaccggcggctcaccgccgcggcggtgttccaggaccagaccaacccaagaaacccagcgagcaagggaggcgacgacgatgaggcgtacggcgaggtggaccgtattgtgtccagccgcaccatcaagaatccggtgttcgcggaggacggctcggccaccacggtcaccgccacggagtacctcgtcgagtggaaggacgggcacgagccttcgtggatcccggcggaggccatagcggcggacgtggtggcggagtacgagacgccgtggtggacggccgccaagaaggcggacgcggcggagatcactgcgctactcgcggacgagacgctgcggcgtgaccccgacgcggaggatgcgcaggggcgcacggcgatgcacttcgccgcggggcttggatccgaggagtgcgtgcgcgcgctcgccgaggccggggccgacgtggggcgacccgagcgcgccggcggcgggctcacgccgctgcacatcgcggtcgggtacgggcgtccggcggccgtgcgcgcgctgctggagctgggcgccgagccggaggcccccgacgggcagggccggacgccgctggagctggtccaggacgtgctcgcgaagacgcccaagggcaacccggcgacgttcgagcggcggctggcgctggaggcggcggcgaaggagctggagaaggccgtgtacgagtggggcgaagtggagaaggtggtggacggccgcggcgagggcaagtggcgggagtacttggtggagtggcgcgacggcggcgacagggagtgggtgagggcggcgtgggtggcggaggacctggtgaaggacttcgacgccgggctggagtacgccgtcgcggaggccgtcgtcaacaagagggaggcggcggaaggggaggggaaatgggagtaccttgtcaagtgggtggacatcgaggaggcgacgtgggagcccgcggagaacgtcgacgccgaactcctccaggagttcgagcagcggcaatctggggtggctgctggcggtgatgctccgccgccgccgccggtcgccgggtgacagcgtgtcgccgtcgacggagggtgttcgattcttcctggttttgctgtgtttaacagaacgggataaaatgtttgtgctgctgcaaaatgtatcattagcgctttgataatttttgagttgagcagaactttaacct

SEQ ID NO: 6244 - DNA, 719 bp, Oryza sativa
  Predicted polypeptide sequence is orthologous to G1950
ttttttttttttttttttttttatagatggaggtcttagttgcgcctccgtgagttggaggctttgcaaacactacagccgtacagtcgattctcggagtttggggttagttggatttacagttactttgacgtgcttagttcaaccgaaggagttactagtactgttacaggcataacgcaactcgatgaggtaattaaattgagcaggtaattccttaattctgatgaatcatctttaaaaacttattattttagttttgttcttttggcgcttatcaagctgaaattaaaagtatgcacttttgttttaccacatgtcaggaaatctactatcctatactttcacaaggcaatctgaaaaatgatcagtgcggattttcttttgcttgttacaagaaatgtgattttttttccaatgattccaataggcgctacgcctcttggctatgcaatttatggagggattggggatactgggagctatcttcttgatcatggtgcaaaaccagataagccaagtgaaaaagggtgtacccctctccatctagcagttgaacagggtcccatgtcagtgcatttaccttattgaacatgcgcatggctgcacaacacatgtgtttaccatattatttattgctaggagaactgcaacacttgaacgttctttaaaatgcacggtatccattagtatattcgaaataggacttgaccccggtg

SEQ ID NO: 6245 - DNA, 1010 bp, Oryza sativa
  Predicted polypeptide sequence is orthologous to G1950
tcggtatatggctcatttgagacgcgcacgagatgagcagagtccggagagaaacgcaaacctgaggctcgaagcgtatttctcttctgcgccttcgcttttgcctaagcacgatgtctgctacaatggacatcgacggcgccgccgccagcgccgccgcgggcggtgggagacattcggagaaggagctcttcagcgcggcggagtccggggacgccgcggccttctcctccctctcccccgccgacctcgccgccgcgctcgccctccgcgatgaggacggccggtccctcctccacgtcgccgccgcctccggccacgcccaggtggtgagagtgcttgccgcgatgggcggcgacgcggcggccagcgttgtgaacgggaaggacgaggaggggtgggcgccgatccacacggcggcgagcagcggaaaagctgagatcatctccatcctgctcgatcaaggtgctaatgttgatttgacaaccgatgctggccggactgctcttcattatgctgccagtaaaggacggcttaatatagcagaaacactaatagcgcacagtgcaaatgtcaacaagaaagataagtttgggtgcacacccttacatagagctgccagtacaggaaatgctgaactgtgtgaattcctaattgaggagggggctgatgttgatgcagttgacaaaacaggacaaacaccactaatgcatgctgttatttctgaggacaaagcggttgctcttctgctagttagacatggtgctgatgttgccattgaggacaaggaaggctataccgtacttggtcgagcatctgatagctttagacctgcactaattgatgcagccaaggcaatgcttgaaggctgaaaatgttatgctgcacaaaggttaacgaaggggaacaaattttggtatcgaaaacctgtactaattttttttggttgaatcctgtcttttttaagtatgaaccattctgatctagaatcagatttgatcaactggacc

SEQ ID NO: 6246 - DNA, 640 bp, Oryza sativa
  misc_feature (54)..(54): n is a, c, g, or t
  misc_feature (65)..(65): n is a, c, g, or t
  misc_feature (79)..(80): n is a, c, g, or t
  misc_feature (95)..(97): n is a, c, g, or t
  misc_feature (105)..(106): n is a, c, g, or t
  misc_feature (125)..(125): n is a, c, g, or t
  misc_feature (134)..(135): n is a, c, g, or t
  misc_feature (145)..(146): n is a, c, g, or t
  misc_feature (160)..(161): n is a, c, g, or t
  misc_feature (171)..(171): n is a, c, g, or t
  misc_feature (212)..(213): n is a, c, g, or t
  misc_feature (234)..(235): n is a, c, g, or t
  misc_feature (242)..(243): n is a, c, g, or t
  misc_feature (262)..(264): n is a, c, g, or t
  misc_feature (280)..(281): n is a, c, g, or t
  misc_feature (314)..(315): n is a, c, g, or t
  misc_feature (318)..(318): n is a, c, g, or t
  misc_feature (327)..(328): n is a, c, g, or t
  misc_feature (337)..(338): n is a, c, g, or t
  misc_feature (342)..(342): n is a, c, g, or t
  misc_feature (350)..(351): n is a, c, g, or t
  misc_feature (360)..(361): n is a, c, g, or t
  misc_feature (370)..(371): n is a, c, g, or t
  misc_feature (385)..(387): n is a, c, g, or t
  misc_feature (404)..(405): n is a, c, g, or t
  misc_feature (423)..(423): n is a, c, g, or t
  misc_feature (438)..(438): n is a, c, g, or t
  misc_feature (447)..(447): n is a, c, g, or t
  misc_feature (459)..(459): n is a, c, g, or t
  misc_feature (480)..(481): n is a, c, g, or t
  misc_feature (488)..(488): n is a, c, g, or t
  misc_feature (509)..(509): n is a, c, g, or t
  misc_feature (532)..(532): n is a, c, g, or t
  misc_feature (553)..(554): n is a, c, g, or t
  misc_feature (564)..(565): n is a, c, g, or t
  misc_feature (582)..(583): n is a, c, g, or t
  misc_feature (598)..(599): n is a, c, g, or t
  misc_feature (611)..(611): n is a, c, g, or t
  misc_feature (621)..(621): n is a, c, g, or t
  Predicted polypeptide sequence is orthologous to G1950
acaaccgatgctggccggactgctcttcattatgctgccagtaaaggacggctntaatatagcangaaacactaatagnncgcacacgtgcaaannngtcaacannagaaagatttaaggaaatnagctgaacnntgtgtgaatnntccttaattgaggnnagggggctgnaatagttgaatgcagttgaacacaaacacggacacaacacnncacttaatagcatagctgttnnatttctnngaggacccaaagcggttgnnnttctttctgctagttnnagacactggtgctggaatagttgccacttgagnngancaaggaagnngctataccnngtancttggtcnngagcatctnngatagcttnntagacctgcactannnattgatagcagccaagnngcaatgtcttgaaggctngaaaaatgttatgcntgcacaaanggttaacgaagngggaacaaattttggtatcgnnaaaaccntgtacgtaattttttttggtntgaatctctgtcgttttttaagntatgaacccattctgatctanngaatcagatnnttgatccaactggaccnnataattcatactagnnccaagaattatntgtagtaacntgtcatgtcaaaaaaaaaa

SEQ ID NO: 6247 - DNA, 649 bp, Oryza sativa
  Predicted polypeptide sequence is orthologous to G1950
cgacagggagatccccaacaacaacggcttcacgcccctcaacgccgccgccgtcaagggccacaccaaggtggtggagatcctgctgcaagcgggctgcaatctcaacgcgcgcaacacctacggctggacggcgctcaacgtggccgccgatcacggtcaccaccacatcgtggagctgctgctggcggccggctgccaggtcgacattcccaacaacagcggcttcaccccgctcaactcggcggcgctcaaaggccactctcgcgtggtgcagctgctgctgcacgccggcggcaacgtggagagctcctccagcaagggctcctccgtgctctattccgccgcttgcaagggcttcgaccaggtggtcgagtacctgctggcctggggctgcctgctcgatagccccaacaactccggcttcacgcccctccacgctgctgccagtaacggccacgtcaaagtcgtcgaactgctcttggctgctggcgctgacaaggaaacccccagcaagaatggctggactcccctcaccactgccgcttccaagggctacagtcgcatcatcgagctcattttaagttattaatctcatcttttcgaaaataaatcaacacatcaagatgagatgaaggatcaaaaatag

SEQ ID NO: 6248 - DNA, 1859 bp, Oryza sativa
  Predicted polypeptide sequence is orthologous to G1957
catggtcactttctctctctctcttcccaccatatccccaattccccatagcttagaagcgcacaagactcaatgcaaaccgctctgattcctcctctctctgctcttctccctctccctagctagagcttggcttgcttcctccaaacacagctcgagatcaataggaattcataggaacaacaatacaatacatacacgcatacataggtagatcatatccccctctctagtatcctatagcttacttctttgtaacagtgcctatcctcgaacatcttgcagaggaggaagaaggaagaagaagaaggaggagttgggagagaggagcaagaaatacagccaagaatttgaggaaatagtgatagttttctatggagttcactacaagcagtaggttttctaaagaagaggaggacgaggagcaggatgaggcgggaaggcgagagatccccttcatgacggccacggccgaagccgcgcctgcgcccacgtcgtcgtcgtcgtctcctgctcatcacgcggcttccgcgtcggcgtcggcgtctgcgtcagggagcagcactccctttcgctccgacgatggcgccggggcgtctgggagcggcggcggcggcggcggcggcggagaagcggaggtggtggagaaggagcacatgttcgacaaggtggtgacgccgagcgacgttgggaagctgaaccggctggtgatcccgaagcagtacgccgagaagtacttcccgctggacgcggcggcgaacgagaagggcctcctgctcaacttcgaggaccgcgcggggaagccatggcggttccgctactcctactggaacagcagccagagctacgtgatgaccaaggggtggagccgcttcgtcaaggagaagcgcctcgacgccggggacaccgtctccttctcccgcggcatcggcgacgaggcggcgcggcaccgcctcttcatcgactggaagcgccgcgccgacacccgcgacccgctccggctgccccgcgggctgccgctcccgatgccgctcacgtcgcactacgccccgtgggggatcggcggcggagggggattcttcgtgcagccctcgccgccggccacgctctacgagcaccgcctcaggcaaggcctcgacttccgcgccttcaaccccgccgccgcgatggggaggcaggtcctcctgttcggctcggcgaggattcctccgcaagcaccactgctggcgcgcgcgccgtcgccgctgcaccaccactacacgctgcagccgagcggcgatggtgtaagggcggcgggctcaccggtggtgctcgactcggttccggtcatcgagagccccacgacggccgcgaagcgcgtgcggctgttcggcgtgaacctcgacaacccgcatgccggcggcggcggcggcgccgccgccggcgagtcgagcaatcatggcaatgcactgtcattgcagacgcccgcgtggatgaggagggatccaacactgcggctgctggaattgcctcctcaccaccaccatggcgccgagtcgtccgctgcatcgtctccgtcgtcgtcgtcttcctccaagagggacgcgcattcggccttggatctcgatctgtagcgacctaaagagagaaaaacaaaggaaagttcatcaacgattcttttttcttcttctgttttgatttggtttgttcttcttctcgcagcaacatcgatctcactttctcttgtgattccattataacctgaaatttgatgacagcattaggatttgacatttttgttttgttggccacttaattggaatctttctgttggtttgagaagatatagagaattattaggaaacttgaaagttttcccc

SEQ ID NO: 6249 - DNA, 1941 bp, Oryza sativa
  Predicted polypeptide sequence is orthologous to G1958
gcctcgcttctctctctatcgcaggcgaaggcgaaggcgaaggattcgggctcagctcctccgcctccgccgatctctcgccggagatgtgtcagccctaggagaggagaagctttctttttttggaaaatcgagtcaacaaaaggtcttgccaattaacacagtgaaggataattctggcttgagtgtttgtaaatggagagaataagcaccaatcagctctacaattctggaattccggtgactgtgccatcgcctctgcctgctataccagctaccctggatgaaaacattcccaggattccagatgggcagaatgttccgcgggagagagaattgagaagcacacctatgccacctcatcagaatcagagtactgttgctcctcttcatgggcattttcagtccagtaccgggtctgttgggcctctgcgttcgtcccaggcgataaggttctcttcagtttcaagcaatgagcaatatacaaatgccaatccttacaattctcaaccgccgagtagtgggagttcttcaacgctcaattatggatcacaatatggaggctttgaaccttccttgactgattttccaagagatgctgggccgacgtggtgtcctgatccagttgatggcttgcttggatatacagatgatgtccctgctgggaacaatttgactgaaaacagttctattgcagctggtgatgaacttgccaagcaaagtgaatggtggaatgattttatgaattatgactggaaagatattgataacacagcttgtactgaaactcaaccacaggttggaccagctgcgcaatcatctgtcgcagttcaccaatcagctgcccaacaatcagtttcatctcaatcaggagaaccttctgcagttgctataccctcgccctctggtgcctccaatacctccaactccaagacacgaatgagatggactcctgaacttcatgagcgctttgtagatgctgtcaatctacttggtggcagtgaaaaagctactcccaagggtgtgttaaagctaatgaaggcagacaatttgaccatttatcatgttaaaagtcaccttcagaaatacagaacagctcgatacagaccagaattgtctgaaggttcttcagaaaagaaggcagcctcaaaagaggacataccatcaatagatctgaaaggagggaactttgatctcactgaggcattgcgtctccagttagaactccaaaagaggcttcatgaacagcttgagatccaaagaagtttgcagctgagaattgaggagcaagggaagtgccttcagatgatgctcgagcagcagtgcatacctgggacagacaaggcggtggatgcttcaacctcagcagaaggaacaaagccatcttctgatcttccagaatcttctgccgtgaaggatgttccagagaacagtcagaacggaatagccaaacaaacagaatcaggtgacagataatgaggatgtgatgagggtctctccaagatgtggacccaagtggccattgaatgggctcgatggctatctgactgatgtttggcaaagctaaaattaaatcgtttttgccttttcacggggaacagaacattgttgtgaacagcatatcaaagcttgccccagcgcttgtagctagactttagttgtacagtaccccaaacacggcagcgacgattccgtgttaatgggatgatctttaggtttcagaaggcagcacaagcaaatttgcactgatgtactctttgtcaggtggtttgacttcttgctttctttgttgttagggactggatagcatggattaggaatttgattatgatgaactaattcaagaaattgccataatctttggtaccttgtgcgcctggaacatgtaaatggtaccaaacaacaatatgatatgtttaccttcatgttctatttggcttc

SEQ ID NO: 6250 - DNA, 2003 bp, Oryza sativa
  Predicted polypeptide sequence is orthologous to G1958
ctctcgatcaatctctcctccattcccgcatcctctctctctctccctcctcaccctcacctcatcgtcgcgacaccgaggggaaaaaaaaaagcgatcgccccaatcagattcccccccccccctcctccccacttccctcgtcgcctccgaaaagccaagccgctccccgccgcgccgatcgcgccgccgcagccccagagtgatggactaacattttgggcgagtttgatctgtagaaaggcattcaaactattttatgggaaagaagcaaatcttatgcactatttgcagaattgcagtgagggaagtttgatctgaggcagttgcaaaacaagtatttctggagagatgtcatcctccttgcctattctaccgaaatctttgaaagatatcccaagatcccataatacccagaatattctgatgccagggcaactgccaaatgattctatgcctttgcaccagagtgcaactcaatcttctatttcgcacccaagagccagtgttgtcagatcatcatattcagcaatgttaggatatgctgctaacccaattgattctgtgtctagccatgaggggcattttatggctgctccctttatttctcagtcgtcgaatgctgaaatgctccagtatttatgtaataataatacccatgggggacacactgtgccaacctttttcccagctcctgcctgtggcgcgccagattacatggatactataactgtccctgataatcacacccagagcggctcctctactgttacatctgatgctgctaaacaaaatgaatggtgggcagatataatgaatgatgactggaaagatattctagatgcaacagctactgattctcagtcaaagtccatggcccaaccttccaattctgctgcatcacagcctgctttcaatcagtcaacttcatcccatagtggcgatatttgtcctgtcacaagtcctcctcccaacaacagcaatgcctctgcaagtaaacaacggatgagatggaccccggaattgcatgaatcttttgtccatgctgtaaataagcttggtggtagtgaaaaagctactccaaaaggtgtgctcaagcttatgaaagttgatggtttgacaatctatcatgttaagagtcatctgcagaagtaccgcacagctcgctacaagccagacctatcagaaggtaaaacacaagaagggaaaactaccgatgagttgtctttggacctgaaagcgagcatggatcttactgaagcactgcgccttcagatggaagttcagaagcgccttcatgaacaactcgagattcagaggaaattgcagcttcgaattgaagaacaagggaaatatctgcagaagatgtttgaaaagcaatgtaaatccagcacacagagtgtgcaggatccatcgtctggagatacagcaactccatctgagccaagcaattctgtagacaaggacagtgaggctgccttggacccaaacagaataggagacaaccaccctaaaaattctaccaatgtaggtgccaacctgaaaactgcagcaaccgagtcccctgattccccagtaattgcaactgatggatcggagctcccccaagagaagcgtcgtagagtgcatgaatcttgacagttaactcatctgaatgtagagtgcattcagattatagctgttctgcccatgtacttggtaaaagaaaaatggttccatctatattggctgaaattctagtgctgatccaagtctattgagctgaactatttaaaaggaacataaaaaagcctaatagagaaggggaactgtttggtgtccgcttgtattataattcagtagcaataactcaaatttatctccggtactatgaaataaggagaatttgagatctagccatcttcctgggtacaatttttatttcagggagtcagttgtaaaaggctacggaactccctcttcctccttgcagctcagaagatattgagctaaaaaaaaaaaac

SEQ ID NO: 6251 - DNA, 501 bp, Oryza sativa
  Predicted polypeptide sequence is orthologous to G1958
attttgctcttcattcatttgtgctgtgctctccacgcgccctcgcctctctttcctccgatcctccgcttcgttcgaatcccacaggtgaggtgacctcttctctccagtctcctctccttagtaggattaggatcattacgaatttaggatcgagaatataggattatgaaccagtagtattaggattatgttttcttcgattctttttctccttcaaatcaattcccaattcgatttagggttgacggatacgcgagcagggatagccctcccgcccgcagaaagattgggctttcttggtttccctgtcgtaatcccttctctccagccaacgcggtgaaaattttgtttcggtgggggtggggtgggtggttgccgggtaggtgctggtgcatctgctttcagtttcaccaccaccatggattggccgctaaacatatactgatatacacctgtttcctgtcccctacccctaggctagactactagggagaattc

SEQ ID NO: 6252 - DNA, 1224 bp, Oryza sativa
  Predicted polypeptide sequence is orthologous to G1958
atgaatcagcttcgcaatggaaaagttccccaatatctttcgccagctataactgtagtaccagaactctctgaagttacatttcctagtttttcagagcatagaccatcctatatcgaaagggagcagtgtggtagttctatcaactcatttgatgcttctactccaatgtgtatgttagcttccaactttacatcagatctttatatcaacaaaagtgaatcacctaacggcaagctttcttctgaatcatatgctattgatacctctggatgtgattcttccttgccgccaacacagtcattatacaagggtaatccaagttctttaaggatggtttatcctaaagtatctgaacagaatagttggagtcaagaaccactgcctggaccatttgtttgtccaactagtgttgatttcttcgatcaacaagatatgactatttttgaccaacaaatacaagataacattgcagcaagtcctagcaccaaccttgcaaagcaaaatgagtggttctcatctggcacttccttgcagtatttggaaagttcggtgtctgctggttctgtgctgaaggctgttgatgcgacaagtacaacaccttcaaattatttgcattgtcatgcacagagaaatacatcaaatcctcccaacttcaatgaaatttgttctggtaatatcgcttcttcaaacattgctccaaccaaaccaaggatgcgatggacacctgagctccatgagcggtttgttgatgctgttaacaagcttggtggaagtgaaaaagcaactccaaaagctgtccagaaagttatgaaggttgacggcttaactatataccatgtaaaaagccatctacagaagtatcgcacagttcatcatcgacctcaactatctgatggtgaatctgcgaaaagtggccaaacggatgaagtttcttctcagcccttgaaaggcatggaaaccacctgtgaaggattaagggtccagattggcttgcagaaacaacttcacgaacaacttgagatccaaagaaagctgcagctgcaagtagaagaacacagcaagtacctcgccatgataatcgagaagcagagcgagagcctaagacaactgggagcattaccaagatctctagatgcacccactcaggttttggataacagggaaacgtgcgagggacaaacaggagatgctgattcagcagagcaaaaacctgagaaatga

SEQ ID NO: 6253 - DNA, 738 bp, Oryza sativa
  Predicted polypeptide sequence is orthologous to G1968
atgtttggcccggcgcgcggcgcggtgggccgtgggtcgcgcctcgcgtgcgtgcgggcgcgcgcgtacgtctgttttggtaccattgcaatggcgaagattcgcgggaatgccaaagccaaaccgagcagaggccaccggctgagtggcagacgcactttcaccagcgttgctgttgctgcgcctgcgccgatgagcgaatcgaagaccatgtttgacgccccaagatggatgtctcgtacaacaatctatacagggaaaacgtcatccttacttgttcagttgccccaaagtttccattgtgactacggatccatgccttatactgatagtcttgatgctgttgctgcttgcctgcgacctcgcgaaatgccgtgctactactacagtcgtttaataattaatcaattgggctgtgtcggagaaaatggaaggaatggatcggaccagatccatgaaccatgcggcatgcgcaagaagccagcagaaggcaatggcctactcacgctgtcacaggcctctgccttctggtccattgacgtgcggtttcaacgcagcgtgctgcgtgcaccgtgctttgtcctcggtcctccaaaacccaagttaacctgcttcattcgaacacactctggcatgatactagtagctggattttggtcaccggaattcagctcgtttcggacgttatttccacagctatacagtgtcgagaatttcttgctgggaaatttgcattga

SEQ ID NO: 6254 - DNA, 737 bp, Oryza sativa
  Predicted polypeptide sequence is orthologous to G1968
ccgggacagaccagtttgacctcactgacactgactagccacccaatcccgcgccattgacgccattgttgccgccatgccatcgctgacgcgatgtccctatcggcattgcgtcgtcgccattggagtcgcgtgctgcagctagctggtcctcgcgaaagcaacgccatggggaatccatggaatggaggagaagaagaagaagaaacccaaagcgacatcgacatctccgatgcttctgctgctcctgctgctgctgctgctgcgaattaatggcgggatttcttggtgagatcaatcttctccatctccatgatcacgatgggattgcagactcgttaacaacttcacagcgacatggcaccgaatcatccgaatgaatcggttgaatggaaacgaaaaaggcctggcacgattgggggcaaaaaaaaaaaaaaacccattctttcctgaaaacttctcttcttttttgttctttcttttttttccctggcagtgtgcacgaattggcgctgtgtttgttctatcttttcgaaaaaaaagtttttctttttctctttggtcataaggattctttattggtgtgtatagattagtcaccattttagtgttagtaggtgaggattagggacgacagtgtatttattgatgttttcttcatgtgttcagacactgcaaagatgagatttttaaggcgtaagttgccggcacaaatgcaaagttaatgtgaaaaaaaa

SEQ ID NO: 6255 - DNA, 544 bp, Oryza sativa
  Predicted polypeptide sequence is orthologous to G1990
tgcaggaatcggcacgagggaagaagaagaaccaccgccgtggagacgtaggcgcagcgctcccgattccgcgcgccgccgtcgccgtagccgtcgccgccgctgccgcgccgcggtgtcgacgaaggagccctccgcttgcggccgcttgggtggtcggatctaacatctagggtatgtaccttgaatcctggatttccctgctccgatttcatcttcttggcgtcttcatctctgggacgaacccttgttttctgtatatatgtatataataatagtcagcccgcaatcgtttctgtgttgattagctgggggccagaatttggttggattactactattagtcctgatgttaaggtattattatatacgtcaatcttttgctgctgctgctgctgctaatatttggtttcgtgctgcttcgttaatcgtatttggttttaccttttcgccaatcattgagtttataatccttgtagctattgagtttaatatcaggccgaaatcttggctgctggataggatggcagattgtcctttcctg

SEQ ID NO: 6256 - DNA, 1807 bp, Oryza sativa
  Predicted polypeptide sequence is orthologous to G2011
ggcccgtcgccctcgcacagtatgtcggtttcgaacccgaagcctataaattccgcgccaccaccacctcctcctccacaatggaccacaacaccgaccctcctccgaccaccatggtggacgccgcggcggcgctgctgctggagcccaagctggaggggtacgacgacgacggcggcggcgagccgctgcagccggccccgttcgtctctccgctggaccagctgatgcagccgccgcggccgctggaggcgctgctgcaggggccgcagctgccgccgttcctgtccaagacgtacgacctggtgtgcgagccggagctggacggggtcatctcctggggccacgccggcaacagcttcgtcgtctgggacccctccgccttcgcgcgcgacgtgctcccccaccacttcaagcacaacaacttctccagcttcgtccggcagctcaacacctatggttttcgcaaggttcatgctgatagatgggagtttgctcatgaggatttcctacgacatagcaaacatttgttgaagaagattgtccggcgcaggtcctcaccaacacaacaaagtggtcttcagcctggctcttctggtgaatccggtttagaccctgaactcaacacactgagaagggagaagagtgcattgcttcaggaggtgaccaggctgaagcaagagcaccttcagacaattgaacaaatgagcacgctgaatcagaggctagaatcagcggaagatcggcagaaacagatggtctctttcttggccaagctcctccagaacccaactttcctgaggcaacttaagatgcacagacagcaaaaggaaatcgactccaccagagtgaaaaggaaattcctcaagcatgtaccacatggcaacattgactcaggtgagtccagctcacaacacactggagagagcaatttagatttctcccctacgtccctggaccttccagccacgcacagtgacatcttagaccttcagaattttcttttggaagatggggacctcaatcttgccatgctgccagagaacataggacttgatggaatcgaagcaccagacgacatcggggcgttggttcagggatttgacacacaggaggaacttgagcttggtagcggagttgagctactggaaatacctccagcttctggtcctcgtggccaagatcccacgattggcagatccaagggaaagaatgtattgtctccaggattggatgctacctcttctgaagctgattgcctcggatcattttctgacaatatggggatgctttctgactccatgttacaaacagcgggtaaattgatggatgcagatgatgacgagcgaatttggggcgtcgatgcttcgtcggctttacaaagttcttgcagtggcactagtcagcaagcatatggtagtcttgttagtgatccctatctgatggagatggctaataagcctgaaaaattctgggagctcgattttcaggcactggatgatggagatctgcagctggacaagtgtgttatcgatgaccctgctcttcagcaacagagaggaaatatgaattcgtagatcaaacgcagcttgggagagtaggacctgatgttttatctacctaaaaactatagttcactatgaacattgctatagttatttgatattcaggaggcttgttaactcctgaatatgcgcactatggcattaagaagtagcagtagcagcagtagtatggttatgctttttgttttccattcattcaccctgctgtttttgaatggaaattgttgttgtgtggttttctc

SEQ ID NO: 6257 - DNA, 3124 bp, Oryza sativa
  Predicted polypeptide sequence is orthologous to G2030
gaggggccatcttcctgttacttcaaccacaacaagatatgtcttccaccaacaaaatagacacccacaaccgaaacggatcgagcaaagagaagaaatccaacccatcttcaagttcagagtaccagctgaagaatcaccttctgctgctggccactctggtcgcaacggtaacatatgccgcggggctcaacctgccaggggggttctggcaggacacacaagaagaccatctcgcgggcgacccaatcctaccaggcaaccacaaagaacaatacatcatgttctactactgcaacgccactgcgttcgccgcgtcactcgtggtctgcctcctcctcctcgtcctggacaaggagaactcaggctgcgcagctgccctgcgagtagtcatgctgtttgacttgcttggtctaatgggggcctatgctgccggaagctgcagagatgaattcactaccatctactcctcggtgatcatgtcgatggtatttgcctatattgtgccttctttgtttacctatgcagtgtccaagttgaagaagaaagacaaaaatcatgggaagcaaaacaaggattcgggtgaaccaaaggatactgagaagcaaacctggtatcctgatgaacacaagcgcgaagaactgcatgaggtcttgatgctgctagcaacatttgcagttaccatcacctacgtggccgggctgaacccaccaggtggcttctggggcagcacccaggacggccaccgggtgagcaacccagttctgcaggacatcaactccagacgctataaagcgttcttcgtctgcaacaccacagcgtttgtcgcatccctgctcatcatcatgttgcttctggacaagagggtcaacacggagcaaatgtcattgcagtttggtgaactgtatgggtctattgttgtggttctcttcggcctcgttggagcctatgctgctgggagctgcagggacaccgatgacactgtatacgtcatctgtttgattgctgcaattcttgcatacatcttcctccaggtggctgttacacaattcttaaaaaagaggatcaagaatgatgggcatactgaacgaagtatatcatctgtaaagtcactgatccgtaatgaagatggtagcaggaacacaaaacgcaatattgcaatggaaaaggctcgctcccttgtcatgttacttgctactcttgctgcaagcatcacataccaagcagggctagatccaccgggtggtctctggccagatgaccgggatgggcataagggcggcgacccaatactcctcacgacaaacccggcacggtacaaggtgttcttctacagcaattcggtggcttttgtgacatccttagtggccataataatggtccaaagtaaacatgtactgaagaaccacactctagaggcagctatgctgctggatctgttcgccctcataactgcatatgctgcagggagttgccgggacgtgagcacatccatctatgttgttgctctggcaggtggtgtcctcgtctatgtggtgattcacataatcttcttcacactagacaacatggacaatgaatatcatgatcctgatgaggaggataagaagcgtgaagttttgctgctccttgcaatcttggttgccacgctcacttatcaagctgggctgacacccccaggtggcttctggtcagaggatgataatcttgggcaccaccaccgagcaggctatccaatcctgctcgaaaactatccaccgcagtacgaggcattcttctactgcaacgcgacgagcttcatggcatctatagctctcattatgctccttgtgaacccaaacctatacaggccaggcataaagtgctatgcgctttatgtgtgcatggtggctggaatgttcggcctcatgggtgcctacgctgctggaagctctcggcgtctgcgcacctccatctatgtattgacattggttggtgcagtgtttgccttggtagccttgcaggtagccatgttctggaacaagaggacctctaaaacaggaggcaacatgacgaactcctctgcgcaagaaggtggcagcacagacactgaagcctcacaaccagcacctctgataaaagggatgggatccacttcacaagcaactcagatcacagatattacagatgctgcactgagaaacactgacaaaggagaggggtcatctgaacaaggaggcagcagaataaattctgtcacttctgaaccaggagcccatggcacaggaaatggagcctctctacaagaagccaacagtgaagaagataaatctggatcaaccgagaaggacatgcgggagtacttgatgctgctaggggtcctggctgcaagtgttacatatcaagctggcctaaaaccaccaggtggcttgtggcaggaaaatggcaatgggcaccttgctggccactacatcctccacgacatcaacaagcgccggtactatgcattcttctatagcaattcgatttccttcatggcttctattgtcgtcatcgccttgctgcttccaaggatgctgaacaacctagaaataccggtctggccaatgcatacggccattttgctggatatgctcggtctcctgtgtgcttacgctgcaggcagcaccatgaggtgggagacatctagaaatatcattgctttggttatccctgtgctggtgtacatggcagcctgtacagcgctatcatttttccataaggaagatcaaaaacaaatatctgcatcgacctgccaggcatccaccaactcatagagaagcatcaacatggcgtcatcctttatcaatttgttctaggagaaagagactacctacagggaactagttactatctttctcattttgaaatagaaagccatcaagtatgagtagaaaaggacctgaagatgggtgttgaaggcatacatacacccacacctccttcctagctactgaaccatgccacagttcctctactagattttcaatttaattcaactgaagccattgtgtatgaattaggacgcttaagttgtttgttcgtgtgtattttccaggaggtattatacaaacatcaacctatatgaattattgttggtttttgc

SEQ ID NO: 6258 - DNA, 2818 bp, Oryza sativa
  Predicted polypeptide sequence is orthologous to G2030
gattagcattgatccattcacaacttggagtacctcctttctgcttctatctctcctgcaaatggagaatagcgagcaagagaggacggactcaccattggagtgtgatttgaggaagtacctccttctgttggccacccttgtggccacggtgacatatggtgcaggattcagcccgccggggggtgtctggcaggacaccgaggccgggcacctcgctggtgactccatcatccgggatagccagtatcgccgataccttatgttcttctactgcaacgcgactgcattcgcgctgtccatcgtggtcatcatcctcatcttcatccttgctatcctgcatgagaaggggaagttacagatccccatgcttccactgcgagcagccatggtggtggacctgctaagcctcattggggcctatgctgcagggaccagtcggggtgttctcacagccggcaacgtctctgcacttgtggctactttcatctatatggtggcacagatggtggtaactttatggcttgacaagaaacagactcaggatataagctcaggtgatgagaagaaaaaacggcaccgcaaggtactgatgcttctcgcaacatttgtggcaagcatcacatacatggctgggctgagcgcaccgggtggctactgggataacaaccaggagggccaccatccaggcgatcccgtcctgtgggaacaccactctcgccgtctgagggcgttctttgtctgcaacacaattgcatttgtcgcatccctgctcatcatcatgctgcttctggacaagaagcagcggatcttcttacccctcgacaagataaagatcaccatcaccgtacggacttatgtgctctacgcgtacatcaccattgctcttttaggccttgtgggggcctatgtggctggcagctgcagaaagcctgacactaccatctatgtactcagtctggttggtgctgttcttttatgcataggcgccctccaggcagtcctattttttctgccacaactttcaaacatatcctgcttgccaataattgcaaagttatcatgttcaccgggagggccatcagatagcagttccagaaagaatacaagcagtaagacagatattctggagaaggcccaatctcttgttgtactgcttgccactcttgtggcaactgttacttaccaagcagggctagtcccaccaggtggtgtctggcagaaaaaccaagatgggcacatggctggcgaaccaatactcttatccacacaagccaaacgttacaaggtgttcttttactgtaactcgacagcctttgcagcatcattggttgtcatagttttggtccggtataaacctttgctcaggcgccgcattctagagataactatgattttggatctgtttggtctcatgggtgcatatgctgctggaagctgccgggacataaccacatcagtttacatcattgccttggcaggcggtgttctagtctatgtggtgattcatgttgtgttcttcacgcttgaagacaatgacaaggagaaggaagttgggaacacgaattctgtacgaaatggttcagttgtgcgcacccaaaataattcagctgagggcaatcttgctgagaaagattcatgtattgacaaaaggcgcaagaggctgctccttttcgctgttttgggcgcgaccctcacttatcaagctgggttgaccccaccgggtgggttcagagttgtggatgatggttttgggcgccatgctggtgatccaatactcttttacaactttccacgccgttacaaggcatttctctattgtaactcggtaagcttcatgtcatctctttccctcatcatactcctcgtgaacccaaatctgtataggccagctatacaaagctatgctctttcggtttgcactgtagcaggcttgtttgctcttctgggagcctatgctgccggaagcactcaacatctgaaaacatccatttatgtctttgtgttggtagctgtggtgcttttcattatgatcatactcctggtgtgtttctatcaaagtgagagcaaagagaagcgagatgacatatccaaggagcccgttgagaaagacaaggacagagccaaataccatgccaagcgcaagtacttgatgttgctaggggtcctggctgcaagtgttacttactcccaggctggtctgaacccacctggcggtgtgtggcagggtaatagtgacgggcatggtgtgggtcactcggttatgcatgacaataagaggtatcgctacctcaccttctcctacagcaactcaacttcttttgtggcatctattgttgttatcatcctattgctaccgacggaactgctaaagaagaacaggtggctaagggtgatgaatattacaattgtgctggacttgctcggcctactgctagcctacgtggctgggtcgagcatgagatgggaaccttctggatatgtcattgcatttgttattggtgcactaggctgtgctgcaatccacaagtttttgtcatttgtcagaaggtctcagcaacaggggcaaggaaatgatcagccttctcggttaccagaaggcggcagtcaagcttagatgttgttggcatggtaacgagcggattagagggctcaagtgtagcaaacactcaaaaagtactgccatttttttcttatctccttttcgaggaaataatgttgctatttttggaatttttttaaaaaataatacgattttaatagaaaatcgcaaaaatataggtcggttcgacgaaatcgtaaatttagcaccctgtcg

SEQ ID NO: 6259 - DNA, 723 bp, Oryza sativa
  Predicted polypeptide sequence is orthologous to G2030
atggacaccggcgcagttgaggacggccgcgccggcggcgagctgtgtgacaacagccggcaaaacggtgtcgacgacgctgagctgggtgagaccagccggcagaagaacggtgtcgacgacgctgagctgggtgacaaccggcggcgggagaacggcggcgggcgccgcagtcacgcgccggggttcgaggcgaacaagaacgacacgctgctggtggtggcgacgctgatcacggcgctgacgtaccagctggggacgaacgtcccgggcgggtactggcaggacgacgccgccgacgggagccacgccgccggcgacccgatcatgcgggacaagaaccggcggcggtactggctgttcatggcagcgagctgggccgggttcgggagctcgatgctgctcacgctggggctgctcaccggcgtgccgtcgaggtcgcgcgccgtgcagtggccgttcctggtgtcctactccagcctcgtgctcacgttcatcacgtcgcagtcgcggacgccgctcgccatggacgtggtgatctggggcgccgtcatggccgtgctcaccgtcggcatcaagtaccgccgcctcgacaggctccgcttctggagatacgaaagcgctatctctgatctcgccgggcacagattcgaggaggaagactaccctgttgtcgactacgagtcagaccttcagaccgacatgtccacaacagttagatag

SEQ ID NO: 6260 - DNA, 1888 bp, Oryza sativa
  Predicted polypeptide sequence is orthologous to G2035
gggcgagctcgcacacgcatcccgacgccgccgcgaggccgcggccgccgccggcgacgatggatctcccgccgctctcccaccaggcgctcttcgccgccgtccgatccgcggacgccgccgccgtcgccggcctcctggccgacgccggggcgtccgggcccaccacccaggcgctcgccgccgcgcagacggacgccggggagacggcgctgtacgtcgcggcggaggccggctccgaggagatcgtccgcctcctcatcccgctctacgacctcgaggccgccaccgtccgctcccgcctcgacctcgacgccttccacgtcgccgccaagcaaggccacaccggggctgtgaaggagttcttggggcggtggccggagctatgttcaatctgtgactcttccaatactagccctctttactctgcagcagtaaaagatcacttggatgtagttaacgccatactggacactgatgacagctgcataaggattgtgcggaaaaatgggaagacatcactacacactgctgcaagaatcggttaccatcgtattgtcaaagcacttatagaaagggatccggggattgttccaatcagagataggaagggacagactgcacttcacatggctgtaaaaggtaaaaatacagatgtagttgaagagttactgatggctgatgtttccatactcgatgtgcgtgacaagaaggcaaatacagctttgcacatagctacacgaaaatggaggccccagatggtacaacttctgcttagctacgaggcgcttgaagtcaatgctatcaataatcagaatgaaacagctatggatttggctgagaaagttccttatggtgagtctaaaatggaaataattgagtggctgacagaagctggcgcaaagaatgcacggaatgtggggaaaattgatgaggcatcagagcttaggagaaccgtgagtgatatcaagcacaatgttcaagcacagctcaatgagaatgccaagacaaataaaagagtgacaggaatagccaaagagctccggaaactacacagagaagctgttcagaacaccatcaattcagttactatggtagcaaccctgattgcctccatcgcattcgtagccatattcaatttgccaggccagtactatgttgatagggatagtgggggagacattggtgaagcccacatagccaaccttactggtttccgagttttttgtctgctgaatgctaccgcccttttcatttcccttgcagtggtcgtagttcagatcaccttggttgcctgggaaaccggtgctcaaaagcgggttatcaagattgtaaataagctgatgtggtcagcatgccttagtacatgtgcggcttttatctcattggcctatgtggtagttggcccccagaatgcctggatggctttcaccatatcagccatcggagggccaatcatgattggtactctcttgttcctggcctatctgttgttgcgccctcgcttcaagtttggtgaagatagacagcggcgcatcaaaagggcaagtggcagcaagtccttctcctggtctatccatgaggggatatcagacctggaagcattctctgatcatgagaagagaatttatgccctgtagattgtaaaaggtcttgctttagctgcatgtaacacttaagaacatgtaattggatgaaaacaatcatccctgtatatagttgctcagctgttttaggtctgtggtgaggtggcccaagcagacctttttctgcaccatcttgatggtttgtgtacttggatacttggtacctgctaatgtgtactagtattagcacttaacaatgaagagcacctatgcagtttgaagctatggttacaattccatcc

SEQ ID NO: 6261 - DNA, 1709 bp, Oryza sativa
  Predicted polypeptide sequence is orthologous to G2041
tcaaatgttctcaagccaggtgttgatgtctgtgtgcagtcatctcatacacccgaagcaagttcacaaggaggaacaaacttctgtgttactgcgtcatgatgcaaggcttatcacaatcaagaagaatcatcaagaagataagtgtctctgcttgtttgttgttatactctacaagaaccagtgtcctggcaatgcagaaaaagtgataactgatagaagagcagaggtagtaaccataaacgatattttcctcctgcaaaagcttcaacctgaggtccatgaaggaagcatgaaatggagtttttcaaaggatcgcctctctcttaataaaggcaggctaataagtgctagattctcctcaggaattacacatctgatagtcttgtcgatcttgaggggaatggaattcaacatcaaattggtagaaggccagatcgtttatcaaataatcaaaggagatcaagcacaatggaatcttgattccatggccatccctccaggcttcgggaatacaatggagataatatcattccaattgcgtgatgaggccttgcgcccaacaatcacaaatatccctatcactcatgtgaaaaagaacaatatcacagaagacatgagattcactgtgaagagtgaaatggatagtgaactggatagggcattagatgttgagatcttgtatgagcatgtggatctgaggcgttcaaagcgcttgaagactcagccagatcgctttacaagttacgatacacctaggttccttagtggctacaagaagaaagaagcaagttcatcacccaccaagcatgtaaggggagctgtgcattgtgattcaccggtagacgattccaaaaaagaagtagaatcatgctgtgtagagattccagggaatgttacacagaagcaaacaggtgtacactctcccatggtcgatgaaaagtcaaactctccagaaggacagcataagaacacaactaagagaactacatgctctcttgtgaaggaaaaagcaagctctccagaaggacagcatgagaaaacaacaaagagaactacatgcgctttgcctgtgaaggaaaaagcaagctctccagaaggacagcataagaacacaataaagagaactacgtgctctttgcctgtgaaggaagagccaagctcagtggaaatagaggagaaaagctcaaaagagcaaagtgcaccggagtttcacattccacggacacctgcacagaataaagagaagcataatcgtcctcctttctcatgtaagccgaagctatttacttcatcaggcacccttggtgttaactgtgaaccagcattctgccaaaaggtgggcgggaaaagaaagaggcacatgtgcgagagagaatacaaacaaatgattgaccaatgcataggaaacattgagagtgaaatggagagggactctatgtttaacttcgatgccaatatgatgaattacgttcagcattcttatcgagaagaggattttacatggccaccttctgctgataaccaagaggtggaggaggatgagcttgaagaactgtggaaagaaatggattattcactgacgacattagcacttcttgagcaaaagcaggtgatggctcaaagtaggataaacatgctggtggataattttgatgggttgaggctggattgtttaactttgacggatgattacagatgctattatc

SEQ ID NO: 6262 - DNA, 1604 bp, Oryza sativa
  Predicted polypeptide sequence is orthologous to G2041
ttctaaactgcggtcgttattaaataattttcacagaccaacctggacaaatatgcgccttatggattctttggacaaactattcaagtggcatgcacatccaagcgtcctcctcatgacatactcatctttcttagggatgacgaaacaagactcaaaagtgcgaaaccgataccgagaatttatcgcagaggtcctgatgaacaaccctggactcttgattcttgacgaggggcacaacccaagaagcaacaagtccaagttgaggaagctgctgatgaaggtgaagactgagttcagaatcctcttatctggcacggccttccagaacaactttgaagagtacttcaacaccctatgtttggccagacctcggtttatcggtgatatcatgagtgaactagtgccagagaggaaaagagaaacagttggcaggagagccaaacatcaagaagcagtggcacgccgcgcctttgtggagaaagtgggccagaagattgagtctgacaacaaacatatcagaagtgatggtatcagtttgctaaacaagcttactcgtggattcatagattcattcgagggagcgaagctgatcaaccttccagggatacatgtgtataccgtgttcatgaagcccacggacattcaggaggagatgctggcaaaggtaacaatgcccaagctcgggtcgtcccggttccctctagaggttgagctgctcatcacgattggctccatccatccttggctcataaaaacgacgaaggccgtcagcaccttcttcagtccagccgaagtgaagaaggttgagaggtacaagcgagacttcgcggcggggtgcaaggccaaatttgtgatcgatctgctgcacaagtcgtcgttcagaggggagagggtgctgatattctgccacaacgtgtccccgatcacgttcctggtgaagctgatagagatggtgtttgggtggcggctcggggaggaggtgctggtgcttcagggtgatcaggagctgcctgtccggtccgatgtgatggacaagttcaacggcgacagcgcggggaagaggaaggtgctgatcgcgtcgacaacggcatgcgcggaggggatcagcttgacaggcgcgtcgaggctggtgatgctggactcggagtggaaccactccaagacgaggcaggcgatcgcgcgggcgttccggcgtgggcaggagaggacggtgtacgtctacctcctggtggcatctgggacatgggaggaggagaagtacaacagcaacaggaggaaagcttggatgtccaaaatggtgttcctgggacgctatgttgatgattcctcgcaaaaccgtgtcactgacatcgatgatgaggtcttgaaggagcttgccgatgaagatcacaccggcaccttccatatgattgtcaagcaagactgactctacttgtacctactaatattagtatgaactacgacttacaactgctactgttagctcttaattagtactagtacctccttaggaggaggtgatggcctgatataaaatgtactgctaccatcaggtatcaggcacctcaaccttcaacttcaactaagtgcacttctcctcc

SEQ ID NO: 6263 - DNA, 1914 bp, Oryza sativa
  Predicted polypeptide sequence is orthologous to G2041
atgcagttcaatggaaatgactacaaggacagacctggatgcagcaatatttgccttgatgatgatatacttgatccttctcttcttgcaaacttggcaccagagttgtcagaattgaagaactcagggagcgtgtggagtgcaatatctgatcttgatccaaagctgcttcctcaccagagaaaagcactagattttctgtggaaaaatttggcggggtcgatacaggttgaaggaatggataactcaaatgtcagtacaggtggctgtgtgatagcacacactcctggatctgggaaaacactgctgcttatctcatttctggtgagttacatgaaagctcacccaagaagccggccattggtccttactccaaaagctgcaattcatacatggaagagagaatttgagaaatggggcatttcacttcctttacatgtgttccaccatgctaacagaagtggcaagccgttgggggcaatggattctaaactgcggtcgttattaaataattttcacagaccaacctggacaaatatgcgccttatggattctttggacaaactattcaagtggcatgcacatccaagcgtcctcctcatgacatactcatctttcttagggatgacgaaacaagactcaaaagtgcgaaaccgataccgagaatttatcgcagaggtcctgatgaacaaccctggactcttgattcttgacgaggggcacaacccaagaagcaacaagtccaagttgaggaagctgctgatgaaggtgaagactgagttcagaatcctcttatctggcacggccttccagaacaactttgaagagtacttcaacaccctatgtttggccagacctcggtttatcggtgatatcatgagtgaactagtgccagagaggaaaagagaaacagttggcaggagagccaaacatcaagaagcagtggcacgccgcgcctttgtggagaaagtgggccagaagattgagtctgacaacaaacatatcagaagtgatggtatcagtttgctaaacaagcttactcgtggattcatagattcattcgagggagcgaagctgatcaaccttccagggatacatgtgtataccgtgttcatgaagcccacggacattcaggaggagatgctggcaaaggtaacaatgcccaagctcgggtcgtcccggttccctctagaggttgagctgctcatcacgattggctccatccatccttggctcataaaaacgacgaaggccgtcagcaccttcttcagtccagccgaagtgaagaaggttgagaggtacaagcgagacttcgcggcggggtgcaaggccaaatttgtgatcgatctgctgcacaagtcgtcgttcagaggggagagggtgctgatattctgccacaacgtgtccccgatcacgttcctggtgaagctgatagagatggtgtttgggtggcggctcggggaggaggtgctggtgcttcagggtgatcaggagctgcctgtccggtccgatgtgatggacaagttcaacggcgacagcgcggggaagaggaaggtgctgatcgcgtcgacaacggcatgcgcggaggggatcagcttgacaggcgcgtcgaggctggtgatgctggactcggagtggaaccactccaagacgaggcaggcgatcgcgcgggcgttccggcgtgggcaggagaggacggtgtacgtctacctcctggtggcatctgggacatgggaggaggagaagtacaacagcaacaggaggaaagcttggatgtccaaaatggtgttcctgggacgctatgttgatgattcctcgcaaaaccgtgtcactgacatcgatgatgaggtcttgaaggagcttgccgatgaagatcacaccggcaccttccatatgattgtcaagcaagactga

SEQ ID NO: 6264 - DNA, 1104 bp, Oryza sativa
  Predicted polypeptide sequence is orthologous to G2052
tcttcttctgcccacgagaccggaagtatccgaacgggtcgcggacgaacagggcgacgagcaccgggtactggaaggccaccggcaaggatcgcaagatcgcctgcgccggcgaggtcttcggcctccgcaagacgctcgtcttctacaagggtcgcgctcccggcggcgagcgcaccgactgggtcatgcacgagtaccgcctctgccaggacctcgcccatggcgtctccaacttcatcggggcgtacgcgctgtgccgcgtgatcaagaggcacgaggcgggcctccatggcgagccgccggcggcgaaggcgaaaggaatgatcagcaaggtgtcgagcagctcgtcccttgtcaccgtcgaacaccagctcagcagccggggcaacgcctcgccgtcgttcacgcccaccaacaatggcagcccgctcgtcgacgagatgttcgtcggcggcggcggcggcgacccgttccagctgcttccgagctgcgtcccgtaccatggcggcgacgcgtgcgggttcgacttgccgccgctgtgcatgcctcagactcaggacccgttcttctccgacgccggcttcacgcaggcagcgcctcctctctacggcgacgtcatgggaagcgtgtcggagcacgagctcaagtgggacaccctgggcggctactccggcggcggcggtggggagctctggaacgcggcggcggcgccgctgctgtgcaggcaggccagcgacggcgacgacctcacggcgtggttcacggccgccgacgacaacatgtccgtcttctgaacgagtcaaccatgacacgtgtgctcccgggttagttacacatggcggtatatttttgagccattcctaactggggccccacgtgtcagccactacagacatatgtcatctattatatatgcataaatatgcctataatctgtatggatacagaggtgatgagctttcttttagttactggctgtaatacatcttctctgtagcatcatacagcagagctgggttatgtatcctcttcagttaatgtacttgtaacactgatctgtaagctaaaaggtagtgttgctggtagatcaatcttcatctc

SEQ ID NO: 6265 - DNA, 614 bp, Oryza sativa
  misc_feature (41)..(41): n is a, c, g, or t
  misc_feature (196)..(196): n is a, c, g, or t
  misc_feature (313)..(313): n is a, c, g, or t
  misc_feature (391)..(391): n is a, c, g, or t
  misc_feature (399)..(399): n is a, c, g, or t
  misc_feature (531)..(531): n is a, c, g, or t
  misc_feature (557)..(557): n is a, c, g, or t
  misc_feature (559)..(559): n is a, c, g, or t
  misc_feature (573)..(573): n is a, c, g, or t
  Predicted polypeptide sequence is orthologous to G2057
gaccgacggagaatgttgagaatggactggatggagtgccntggggactagacattgcttttgggctgcaagcaccaaggagtttgcatgggggaacctggatatacgggctacatgactgctttgcttgatgaaacccttggctggaaaagatagttggatggtgctgctgctcgacatgttgttgcgatgagtntgatgacaggtgtgatgcatgtgttgattgaccacactggcctgggcacctggataatatacgaagattcataattagatataaagtgtggaatggaaagacccattgcaactgttnagatgatgtattatgggtgggaatgcttgccggtgagggcaatgaaaagaaatatggaccgagttgttgtgggaacgntgctgatnagcggggcataaaatcccccagggtgttgctgtggtgtggtgccttgtgtgtgatgtgttctgttctttggtttatgcgtacaggttgtaccaatcctgggataatggtcttatttaaagtttaccatgtanaaaaatatgcttgtactggaaccgtncnggctctgagtaatntttttgttttggtttagacacaaaaaaaaaaaaaataaaaa

SEQ ID NO: 6266 - DNA, 1137 bp, Oryza sativa
  Predicted polypeptide sequence is orthologous to G2067, G2115, G2294
tgactggagttagcgagcactgcgcactgagcacctcgacacggcgcgcgcgcggccatggtgaagaacacgagcaacaagtgcattgctgctgccggcgcgacggcggcggccggcttaggcggtggcgcggcgtcgtgcagcggcggcggaggtgatgggaaggtgacgacggcggcggcagcggcgttggcggtgaggccgtacaagggggtgaggatgcggagctgggggtcgtgggtgtcggagatcagggcgccgcaccagaagcggcggatctggctgggctcctacgccacgccggaggcagcggcgcgcgcctacgacgccgcgctgctctgcctcaagggctccgacgccgtcctcaacttcccctcctccgcctcgtctcgccgccgcctcgacatccaccgggggggcacggactcggcggcgggcgacatgtcgccgaggtccatccagcgcgtcgcggccgccgcggcggcggcattcgacgccgccgccgccgccgtcgtcgtcgacgaaagctgctcgtgcagcgccgaggcgatgtcgtcgacgccgacgtcgggagcgacctcgctgtccacgctgggaagctccggcggcggtgacgtgctggaccacgcgacgacgccgtcgtcgtcgtcgtctgccgcggccaacgtttgctcgccgccgctggagggggaccatgagctgtggacggagctggacgcgttcgcgtcgccgaagttcatggatctaatggccgccggcggcacggcgttctcgtcgccgtgggaggagcccgaggaggacggcgagctgatgaggctgtggagcttctgctagcttagctaggagcctaggaaatcgatcgtgaatccattcgcccatgcaacacaatactaccattgatccaatcaatttctcctctctttgagcatcgaaagctaggttaattaggccttggtccatggcttcagttcttccatagattcttcttcttttctttgataatatcttgattaattaatatggttgtaatttatataagtattttacggtgttacactgtacgggttgttgaatgagactgtgagtgcattggatactggttggatttgttccatttctgttctaatttaatttctt

SEQ ID NO: 6267 - DNA, 1497 bp, Oryza sativa
  Predicted polypeptide sequence is orthologous to G2071
ggattaaacctgatttccccttgctaattcgggccatcgcatcactcccccaactaatcacactcctctcttctccgcttcctcttctcgtatatttataaccccacttcccttttcttcctctttcttctcatcttggtttcttcctagtttcgggagaggattttagtgagggatttgaaggattttgaggtgggagaggagatggagttgccggcggatgggagcgcgctggcgaggcaggggtcgatctactcgctgacgttcgacgagttccagagcgcgctgggaagcgccgagaaggatttcgggtcgatgaacatggatgagctgctgcgcaacatctggacggcggaggagtcgcaggccatagcgccggcggcggcggctgcttcggcggcggcggtggttggggacgcgcagcagcagcagcagccgatccagaggcaggggtcgctgacgctgccacgcacgctgagccagaagacggtggacgaggtgtggcgcgacatcatgggcttgggcggcagcgacgacgaagaccccgcggcggcggcggctgcggcggcgcccgcgcagcggcagccgacgctgggggagatgacgctggaggagttcctggtgcgggccggcgtcgtgcgggaggacatggggcagaccatcgtgctgccgccgcaggcgcaggcgttgttccccgggagcaatgtggtcgccccggccatgcagctcgccaacgggatgctgcctggtgtcgtcggcgtcgcccccggcgccgccgccgcgatgacggtggcggcgccggccacgccggtggtgctgaacgggctggggaaggtggagggcggggatctctcgtcgctctcgccggtgccttacccattcgacaccgcgctcagggtgaggaagggccctaccgtcgagaaggtggtggagaggcggcagaggcggatgatcaagaacagggagtccgctgctaggtctcgcgcgcggaagcaggcttatataatggagttggaagctgaggtggcaaaactgaaggaacagaaggctgaattgcagaaaaagcaggtggaaatgatacagaagcaaaatgatgaggtcatggagagaatcactcagcaacttggaccaaaggcaaagagattttgcctccgacgaacactgactggtccatgctgaagccagagtctccggtttcgccgtggcgctcagcttcagagttgcttctctccttgttggtgaatggtgatggctcagtctcttggacggtcgaatgctggcgtcgattactcactaggtttagctgcgagatcgttgcgtgagcaaaggcatactatctaatctgtttaactccttatttagggaaatctggcatggtgaaaacggggcatgccatctgtgtttgttgtttttgtgcagctgttgcatctgctctgtatgttgctgttgcgttgacatgtcatcccgtttacagttcagtgattctgttctgtaccc

SEQ ID NO: 6268 - DNA, 1331 bp, Oryza sativa
  Predicted polypeptide sequence is orthologous to G2094
accaccattccctcttcttctcctcctccttgcttctcccgccccttaacccctactgctccctcccagtagccggtgctaaccctagcttgctagctagattgctctctctggtagtagtagatccgtggagtggagatctgcccgcggatcgagcggcggcggcagagcaccagccgtgtctgcggcgcggtgtgcgcgggtgttgcggagcggcggctgagcggaggtgtgggaggagggggagtgctgcggcttccggggtgttagatccgccgatcctggcgccggagatggattcctcgtcggtcgagaaggtgaagcttccgatccgtgggttcttggggggctcgatctgtggctggaatggcgccttggctgggtggttttttgacgctcgatctgtgggttgcaggggagtgggtcgatagatccggacgagcgcacggcctccggcgagcccaaggcgtgcaccgactgccacaccaccaagactccgctctggcgcggcggcccctccggccccaaggtgagatgagatccgatctgctcctcctgctcttccctttctcgatctgtgcatttttttcgcctgggttttcggtggttgatccgcccgatctgtgtttttttttttgctttgatccagtcgctgtgcaacgcgtgcgggatccggtaccggaagaagagacgggaggcgctggggctcgacgccggcgagggcggcgcggagcggcaggagaagaagaagagcaagagggagagaggggaggaggtgaccatggagctccgcatggtggggttcgggaaggaggtggtcctgaagcagcggcggcggatgcggcggaggagacgcctcggcgaggaggagaaggcggccatcctcctcatggccctctcctccggagtcatctacgcctgaaccaccaccctacctacctacccacctagcaacagcaagagagagagaagcagaggaaaggaggcagccatgggaaagagtgatttgcttgcttaacatgcatgatctcaaccgggagagactagacagatctctaccctttttttttcttctcccctgcttagtttttccagctaattagttcgatcaaagtggaagccaagttaataatgatgatgatgatgtagtagctgctgttcttcctgttactgttacttgttcttgcctagctgtaatgttactagtagtgtttttagtagagcgtgtaacgttgcaatgtaagaaagagcttatgatccatcttctttctcttgttctttgcaagagattagctcctggatctgcaccaagtaatgcagtttttcagctg

SEQ ID NO: 6269 - DNA, 434 bp, Oryza sativa
  Predicted polypeptide sequence is orthologous to G2094
ggcggatgcgccgcaggaaatgccttggcgaggaggagagggccgccatcctggtcatggcactctcctcgggcgtcatctacgcctgaacctccaaccgaatcaacctctggcgccatggcaggaagaagaagcagcgattccttcccctctctttttttccctccccccggcgctatggcagtcaccgaagctagctaataatcaatcttgtcttgtggtgtagtagctcttgttgttcttgccttaagctgtaacgacgtctgtaatgcgactctttgtctgtgtctctgtactagtactagtagtagtagtttaccgcctaacattcaagtttggtttctctgcaatgtaacaagagaagaagaagaagaggaagaagaagaaaaaaagagctaaagctggagcttgagcttgagctttggttattgatc

SEQ ID NO: 6270 - DNA, 455 bp, Oryza sativa
  misc_feature (346)..(346): n is a, c, g, or t
  Predicted polypeptide sequence is orthologous to G2110, G2574
aattatgattagatgaacgatgggtgtcagtggcggaaatacgggcagaaaatctcaaaggggaacccttgcccgcgcgcctattaccgttgcaccgttgcacccaactgccctgtacgcaagcaggtacgtatatacgcgtataaatacgtatttacgtttacaaatacgtatatgattcgaatgatgcgtacttaaattgaagcgaaaatttaaatttgtgttggttttgtgttaatcgatggatcaggtgcagagatgcgcggacgacatgtcgatcctgatcacgacgtacgagggcacgcacagccacccgctgccgccggcgggggggcggaatggcgtncacaacgtcggccgcggcggcgatgctgacgtcttggctcgaccaactccacgatgcaccggcagcggcggcgttcaccacaactgccgttcgcctcggccgttggggg

SEQ ID NO: 6271 - DNA, 1383 bp, Oryza sativa
  Predicted polypeptide sequence is orthologous to G2110, G2574
gctctctccatgcccaggcgagggagtccgccgcctcgcctcctcacgcgagccactgctgtcgccgcaccatcgtactgtcgtcgccatcctcctctcgctccggtcgatgcatccgccaacgaggaggccgggaccgtcggatccggtgaccccggcctcctcgtcggcggaggggagaccgactgtcaccctctctactcttctccttctacgtccggcaccgctacaacgacggccgcgcggatcgcgtgaggcaacgggtggctgctccctactcttctccctctccctctccattctcttcctttgcagatcggcggaggcttgcaacaacaacaacggctgcgtgggtgagcaatcgaggaggccaggaatcaccagatccggaaggacggcggcccggttcggagagggagcatcccgatctgtggcattgaggcccattgtaagtgtcgatggcggtcgttccttcacagtgatccagggccgctgggtctattgagctcggtatcgacggcagcagcagctcgggcaagatggaagaaatgtgtcagacactgcctcctccgagagcatacaccagcgacgaggccaaagtcgatcttccgcaaccccgtctggcattataacttaatcacttcagcttcagcttgcttggagcacgccggcgcagggtttcctcgacgggtcttggctctgccgtgccctcctcgcgccgccctttcatactgacagttgttcgaggttgcctcccccgctcatggcgacctccacctcagttggagttgggaagctcctttcccgacgtccccacaacacggtgaccttggcctcaacccggtgctgctacgctcagctcaacgattgctcaaactacaatgggcaataacaatattgcatttgagggcctcatttttggttgccctcacctgagcatatgtaggatacagcctgtgatgatgccgttagtacagagttgttccctctctcagcctcccaccatcttctcctgtctctctctgagcatcacctccattgctgtcaaggtgatgtttgagctcaatcggtcaaagaaggttgaatatgtaaataatttgccaacatgattttctcatattgggtggtttagtaagttaacacttaataccaatcacttcatttcagcttctcactaacaagcagccaaggtctcttcacggattattgtccatggatggccaagcttttcagcaaaatgaaaaggtgaaatataatgaaatattattcccttgctccataaagcttcagatgtggagtgagcttgctgctctgcaagctgacattccatttttaaatgtagagtgtgcttgaattaatcaaagaagcagatttatatacatc

SEQ ID NO: 6272 - DNA, 1524 bp, Oryza sativa
  Predicted polypeptide sequence is orthologous to G2110, G2574
atggacgtcgtcgtcgagagcccgccggtgagggacgagaagaaagtcgacgtcgccgcgattggaggcgcgcctccaatagtctttgagagttttgcaccatcgacgcagagagattcaaccatcatcaagaaggaggagaagatggaggcagcgaaggcggagatgggcgaggtgagggaggagaacgagcggctcaagacgatgctcacacgcatcgtcagcgactacaagtcgctgcacacgcacttcctcgacgtcgtcaaggtcaaggagcaaacggcggcggagctctccggagacgacgacgacgacgagcccgacgacctcgtctccctgagcctctgcacgaggcccaacgccgccgcgacgcgccggaagggccacgagaggacgccgtcgtccggcggcggcggcgacgacgggcggctgtccctcgggctgagctgcgctcgcggcggcgttgcctccgacgacgacgacgacaagcaggcgagccgccgcgcgttgccgccgatgcccgtgctgaacctcagctccgacagcagcggggacgccgccggcgccggcgccggcgagcctacccagccgaacaaagcgtccaggagctcgagcggcggcggcgatggcgccgacgacgaggtgctgcagcagcagcaggccaagaaggctagggtttccgtcagagtcaagtgcgacacccccacgatgaacgatgggtgtcagtggcggaaatacgggcagaaaatctcaaaggggaacccttgcccgcgcgcctattaccgttgcaccgttgcacccaactgccctgtacgcaagcaggtgcagagatgcgcggacgacatgtcgatcctgatcacgacgtacgagggcacgcacagccacccgctgccgccggcggcggcggcgatggcgtccacaacgtcggccgcggcggcgatgctgacgtctggctcgaccaactccacgatgcacggcagcggcggcgttcaccaccacctgccgttcgcctcggccgtcggcggcggcggcggcgtcgggctgctcggcccgaccaccatctccaccgccacgtcctgccccaccgtcacgctcgacctcaccgcgccgcactcgctcctgcacccgtcgtcggcgtcgccctacgccgccgccgccgcggggtacgagtccagcagggcgctgccggcggcgtggagcagcgggtacctggcgtacggcggcgcggcggcggcgcagccatactacgccaagggcgttgcgccgtcgccgttcggccatcatttcggcatgatgggcatggcggcggcggcggcgaggccggcgccggagcagctgttcggcggccagacgacgtcgccgtacctgcagagagccatcggcggcggcggcgtcgcgccggcggccgtgacggacacgatcgcgaaggcgatcacgtcggacccgagcttccagtcggttttggcggcggcgatcacgtcctacatggggcgcggcggcggcgcggcggcgccgaacaagtga

SEQ ID NO: 6273 - DNA, 791 bp, Oryza sativa
  Predicted polypeptide sequence is orthologous to G2111
gtttttgccctcaaattttcgtacgttgtcccattttttatccatcgtcgcgtcggcttggttgccgcacgtcgctcggagatggagatgtacaggcgctgttctgcatctgaccgaggaagcgctcgtgagtcctgaatttttttttttttttaccagctgggccatctgcccatcgccctaggcctcttgggcttcttcctgcctggccggtcctgctcctgcccagctaaatagttaatgattttttttctgttgtattctctgctttttggtataaataaacgggagaagatcctgtacatgatttatgatgaatttgataattttatcaacccatgcgtttttcatgtaacgtttgtgttgtgtacccttttcactaagccacttttaactgtattcattattttctttggtgattcaccagttgaatatgtaatatttgtatttctttacctattatacatattactagaaaacatacccgtacgtggcaacgggtgaaatctattttaatcttattattgttattattgttatatggtttattattgttatgcttttagtaatacagaaggaatcatataagaaatctatttaaaaaagaactcgcatgctaactactcctaactgtagctcataattttctaaaaatatatatatccaacctaactctcacagtaaattccattttaactaaaccatataacaataataaaattaaaatagccttcacccgttgcaacgcacaggcattttttagcatatttataccaaattttggaactaaa

SEQ ID NO: 6274 - DNA, 513 bp, Oryza sativa
  Predicted polypeptide sequence is orthologous to G2114
gcagaggacgtcacagttccgtggcgtcaccagacatagatggactggaagatacgaggctcacttgtgggacaacacttgcaggaaggaaggccagaccaggaaaggaaggcaagtttacttaggtggctatgacaaggaggagaaggctgcaagggcttatgatttggcagcactcaagtactggggtccaacaactcacataaattttccattgagcacttatgagaaggagctggaggagatgaagcacatgacaaggcaggagttcattgcccacttaagaaggaacagcagtggcttctcgaggggagcatccatgtacagaggggtgacgaggcatcaccagcacgggagatggcaggcaaggattggaagggtcgcagggaacaaggacctgtatctcggcaccttcagcacgcaggaggaagcggcggaggcgtacgacatagcggcgatcaagttccgcggcctgaacgccgtgaccaacttcgacatcagcaagtacgacgt

SEQ ID NO: 6275 - DNA, 3299 bp, Oryza sativa
  Predicted polypeptide sequence is orthologous to G2129
attgcaacagcatcgcaggcgtgtgcgagaggttctacaagcttagcagagagtgtgtctgcaatggctgaaagcaatcctatgaatcgcagcttttctgttgatgatctggtgggcggcatattcaggcttggccaggcgggggcagcttttggcagaaccgattctgaagcagcatttcaggagttcctcaagcgcatccccagcgcgaccaacctagcagccaaccagcagtatgagcccagccagctgcaacagcaggcccagcagctgctggccagcggcagtgcaggggcaaacaacgtgccagcaagcctgcctgaagcaggacaagccggagaaggcggcatgcccagagtgccctcgttggacgtattgcggcagctggtgatgcagaatccaggcttctcagcgccacccgtcagcgtgaaggcagaggggtctgcaggcatgctggcacccccgtctgcagctacaccgcctgctctatcggccccactgccggcgctgtcaatggcgcctgcggtagacccagcctcgctgtcagcggcagtggaccctagcacgttgtcagtgctgggcggagtgccgggcctagcagcagcagcagcagcagccaacccagcacttatggtgaacccagcagctgccgccgcagccgcactgcagctgcagcaattacaagcgccactgcgcatgggcacagtgtctgggcatgacaagtcggactatgataagtcagagacaaggcggcagcgcaggatgctgtccaaccgcgagagcgcacgccgctcccgcaaacgcaagcaggagcacatgcaccttctggagctgcagatagaggatcttgcggagcagaagcgtgagaaggaggccattgcagacatggctgagcgcaagtgccgcaccctggaggatgagaaccagcgcctcagggaggagaatgacaggctgagggacgagctgcgcttcctacgctctgagctgactgagcgcaaggagcgcaatggctactacaggcgtgaacacagttcagacggtgagcaggaggcggagaacggcaaggcgtaccatgcaggcagcaagcggcagcggccatcagaagcagcagctgcagacagcaagggcgctgaggtgctgtacaaccagcagaacggcaagcagcatggcgttggtgagggccaccccacagaccccgctgtggagggtgcacagcagccggtgggcgaggacgatctgcagtaacgtcgcgccagctagcactgctgctgcagctgctgagggctgctggcatgcgtggcttgcacgggtgtgttggatattgcgggcagtgtcagcaaaattgattgtcgcatctgcaacagcagcagctgatgcttgcatatggccatccgttggtgcgggtagtgggcgccctgccactgaagctgctgtgcaacatgcagcacgcaataaaagcgacatgtaggcaccataggccgagcagcctgctgagcagcagctgctgcgcttgcgttgtgagtggtgttgtggtttttcccctgcccaacagctcacttgcctgccttttattgttatttgtgaggacagttattgttttgtatgtgcatatgtggtagtgggcataaggggtgcagcctcagcagcatgtgtttacttagcgcgttgaccatatatctgtgagtgtgatgctgcttggctgtgtgcaaagtggggcgtgctggcaatgccttcgagtgttcctgccctgggcatctgctgttttttcttctttgttgtgactgtgattaacaagctgctagccaaccgcccagcagagtaattggcaattttgtgctccagctttttggggagttgtggggtggaacgcgtgtggcgggttccaagctggacagtgtttatgaccctggtgtgttgggacagtgaccagaacagctagggtggtggtaggcgggacgcagatcatgctgtgcatgcacagcataggaagctgctgatgctccatggatgcttcctggccccaacaacagagattgcgggggcgtggctgctatggttgtgcatgtgtcttttgtgacgttggcgcatcaattgtccgttgctggacgctgcttttgcagctgtgacactctcagcaacagcacagcaacacagcgagcgactcatgcacctactgctacatttactgcaagatgacacgaatggcagcggcacattggtgatcagtggcaggtcgcgtgatggctactgtagatgcagcactctgtgcggtttaccgaccgctgcgtgcgcgctgctgtgtttgatgcacactgaccaactggtcacgtccatggacttgactgatgctcactgcactacatgtgcgggagctcctcaacccacttgctaggttcttttgcgctgatgctacttgtggggtcagcgcggtggcaaagcgttgtcagtgtactgccatgctggcagcacagtttgtaagctggcaggactagcgcccttggcgcacgtgcgtgtgtgcggatgtgtgatgtgtgtgcacgtgcatgcgtgtgttattcctcagctgccttgcgtgcgtagtgggcttttgcacgtgggcgcctgcttgtagcagcatcaacagcagtgcatgctgtggcgcagcaggtgccagtcaccaaacgattgtcttgggggttacactgtgagcacatctcatctataactgtgtgtgcatgatgttaagcaagcaacatactgttagccatggcttggagtcctccgacttttcatacatgttggaggcttctttcccgctgctcaacgctgctgcaatgcagcttctcagtgcggccatgccatggttggtgtgcgactcgcgtgtcactatcgaccgtctgcattgcactgcaccggcggtgagccttcacactgggtgtgtttgtgaggcacgtatgtggtagaggcatacagggtgggtgcatcaacctaccactgcaggattcagagcaggctgacagagattttcccattgtgctgctgggctgcgtgtctagagcacaactctgttggccgtctaacgtacttctgtgtcttatacatactgtgcttcttttgcgtgcgatgcttgtgtcaaccttattggttgtggagcatgtgacagcagcagggatgttgctggctgaatgccggagggtgcaggggttttgagcgttgggcaaccgcttgcagctgtatgggcgattgggcccttgacacggcgactgatgctgacctgttgatgtaacatgggggtgagtaacatgctgatgtaaaaaaac

SEQ ID NO: 6276 - DNA, 1218 bp, Oryza sativa
  Predicted polypeptide sequence is orthologous to G2130
ggtcttcccgcttccattgcaaccccaccgcgccgcacgccgccgcatcgatcggaaccaaaccctaaccctaaaccctagcccccccacctcgccttccaccccccacgctcccatggcggggcgcggaggctacgcgtagccacatcgatcgaacaccctgtatggattgaggtgggtttcccgaggcatgggtacaaaccctagcctgcacgagctggcggcgggggcggcgccgcggggacgcgtggtgcgtatcctcgtgcgcgacgccgacgccaccgactcgtcctccagcgaggacgaggcggttgcggtggcgcagcctcggccgcggcggaggggtaaggtgggtggtggtggtggtggtggtgggggcgtgaagcgccgcgtgatggaggcgggggcgggggaggcgaggccgaccgcgcggttccgcggcgtgcggcagcggccgtgggggaggttcgcggcggagatccgcgaccctcacctccgccgccgcctgtggctcggcaccttcgacaccgccgaggaggccgccgccgcatacgacgccgccagcgtccgcctccgcggttccagcgccgccaccaacttcgcctccgtccgctgctgctcgctgccgccggagctacccaagccaactatttcaccgcctgaagcagctgtgaggccaatcaccttgccaattgggacagctaagccgacccttcttccacgggtgaaggaggaaggtgagagctgtggcggtcgggtcaaggaggaggccagtagctgtgaggtccaggtgcttgctccggagccaatgtggacgatgatttcaggcaagcgtaaggagcgatcgggctgtggaacccgtgtccgtgccttccatgctgtgtccgcctgtgtggaagaagttggcggggcctgagggtccaattatccgtaattactatcgttagcagctttattgttatgcatagcatcattggaaacttggtattgtgtaattttggttagtattgaacttatgatgtgaagatgactctgcatgtgacctgatttggtaaggttatgatgtgtatatacggtatggttgctgatatatgtgatgcagtatggtaggcttcgataaggtgttgtggaattagtatgttgcatctaaataagacctttgatgtgagatatagacatgttcttcgattagaataaaatatagtagaaaattattgc

SEQ ID NO: 6277 - DNA, 628 bp, Oryza sativa
  misc_feature (441)..(441): n is a, c, g, or t
  misc_feature (468)..(468): n is a, c, g, or t
  Predicted polypeptide sequence is orthologous to G2132
tggagatccgatcatccatgcatggctgcttctcccctgcgcctcctcgccatcggcgccgctgctgtacctttcatgcgtggtagccgccacccgccgaggacgaccgagcccgacgccgtgtctaggccgccgagatcatcgtccttcctctgccaagcagttcgccgagcgagccgccgggatccgccggccggtggcggcgccgacggcggccgccgaagaagaagaggaggaagaaggaataaaaaacccttggggggccccccgccatgttccaagaagggggtccggcgaaccggccaaaacgccggaaggccggttgccgggaaaaccctgacccccaaggcaaaaagggggaactggaaggaacctcaccgttcaagagaattttccttcgccggttaagtgtaacttttcttagaaaaaacggggggcaanaatggcggccgggaatcccctgggacnacccccaaacttagaaccgcgaaaatctcttccccgaagggggtaaaactcctcaaaattagaaaaaataatacgggaaattttctggaaggggaaaaaaaaaagagccgtggtgtggggggtgtaaaaaaaaaaaaaaaaaaaccccaagggggggccc

SEQ ID NO: 6278 - DNA, 255 bp, Oryza sativa
  Predicted polypeptide sequence is orthologous to G2138
atgcgcgcgctcgctcgtctcgcctggcagggcaggcggcgcgcgtgcacgacgtacgcgtcgaatgactactccatcccgctcgccggcgtgcaccggcgatcgggagagcaggtctccggaacctctgtcttcgacgttctgcaccgggagaaggcggcaataaggtttttgggaagcgcttcgcgcgactgctccctgttcgttcgcgacggctcgccttcctcttcgctcgcgtgtttcgtgccttcgtag

SEQ ID NO: 6279 - DNA, 382 bp, Oryza sativa
  misc_feature (133)..(133): n is a, c, g, or t
  misc_feature (280)..(280): n is a, c, g, or t
  misc_feature (312)..(312): n is a, c, g, or t
  Predicted polypeptide sequence is orthologous to G2140, G2765
acgacaaccacctcgcttgccattctggactgcgggtgagatcgatggtgacggacggggagtgctcggcggcggcggtgaggaagggtgggtcgccggcggtgcggagccacagcgaggcggagggaagcgncggcagcgcatcaacgcccacctcgccacgctccgcaccctcgtcccctccgcctcccggatggacaaggcggcgctgctgggggaggtggtgcggcacgtgcgggagctgcggtgcagggcggacgacgccacggagggcgccgangtcgtcgtccccggggaaggcgacgaggtcgncgtcgaggacgaggacgacgacgagggcgagcgcgacgaggggtgttattgtcgtcggcggcggcgacaa

SEQ ID NO: 6280 - DNA, 1054 bp, Oryza sativa
  Predicted polypeptide sequence is orthologous to G2140, G2765
atcatgaggtgagatatgatctgatcatcctggtctgacgagcatatccatctatcctacaattaacaaattaatgtgcattattgagttaatcgtcattaattcatatagttgaggattttggatagatggctgcatgccagcagcagatttggcaagaagggaagcagcagcagcatctgcaccacggtggctatgatgatctttcttcagtgtacagaggcacggttgtgctgccacggcggcagggcggcctggcgccggagccgccgccgccgcggccgtcatcgtcgtcggggaggagcgcggcggctcaggcgacggcgatgacgatccacagcgaggctgagaggcggcggcgggagaggattaatgctcacctggctacactgaggaggatactccctgatgctaagcagatggacaaggccaccttgctagccagcgtggtgaaccaagtgaagcacctcaagacgagagccaccgaggccaccacgccgtcgacggcggcgaccatcccaccggaggccaacgaggtgaccgtccaatgctacgccggcggcgagcacaccgcggccgcgcgcacctacgtccgcgccaccgtcagctgcgacgaccggccgggcctcctcgccgacatcgccgccacgttccgccgcctccggctgcggccgctgagcgccgacatgagctgcctcggcggccggacgcggcacgccttcgtgctctgcagggaggaggaggaggaggaggatgctgcggcggaggctaggcctctcaaggaggccgtgaggcaggcgctggccaaggtggcgttgccggagacggtgtacggcggcggcggcaggagcaagaggcagaggctgatgatggagtcgcgttactcgacggcggtcgtgcacacgcacgttgatcctcaatattgctggtacaatagtcgttagtgacaggtaatatacggcggatcgaaaaatggatgtatgaaattcacacctgttatcattttttactcgtagatttactcatgagtaaaaattttatggagatgtgaatc

SEQ ID NO: 6281 - DNA, 1469 bp, Oryza sativa
  Predicted polypeptide sequence is orthologous to G2140, G2765
gaaaagctagaacagctgctgctgcgagttgtagtagtagtagaagaagaaaaagcaagaaaaggttgttgcatagatcgatccatcgatgcgcacgatcgagtttattaattagctcaacgaaagaagaagcatcagcaagaagagccaagaactcgatcgatccaagaaggtaattgatcagctgattggttggtttggttgttgtggtggagatgtgggaagctgtaggcggcggcgacggcacggctctcctgccgtggcccggctcggccgcggccgcgccgctctacatgcccccggcagcagcggcagcggcgcccttcgccgccggcgagcagctgccggtggagcagcccttctacttcgacggaggcggaggcgtggcggggcataatcaccatcctcatcatcatcagtacgggatggaggcgccgccgccgatgacgatgatgcagatgggcggcgggggttcgtcgtcgtcgaggatggtggtgtccgggctgctcgggacgctgcaggcggagctcgggaggatgacggcgaaggagatcatggacgccaaggcgctggcggcgtcgcgcagccacagcgaggccgagcgccgccgccgccagcgcatcaacggccacctcgccaggctccgcagcctcctccccaacaccaccaagacggacaaggcgtcgctgctggcggaggtgatcgagcacgtcaaggagctgaagcggcagacgtcggcgatgatggaggacggcgccgcgggaggggaggcggcggcggcgccggtggtgctgctgccgacggaggacgacgagctggaggtggacgcggcggcggacgagggagggaggctcgtggcgagggcctcgctgtgctgcgaggaccgcgccgacctcatcccgggcatcgcccgcgcgctcgccgcgctccggctgcgcgcccgccgcgccgagatcgccacgctcggcggccgcgtccgcagcgtcctcctcatcgccgccgtcgaggaggaagatccagacgaggccgggaacgacgacgacggcgaacacggctacggcgttgccgcctcgcaccggaggcacgagctcgtcgcgtcgatccacgaggcgctgcgcggcgtcatgaaccgcaaagcggcgagcagcgacacctcctcttccggcgccggcggcggcggtgggagcatcaagaggcagcggatgatcagtgcacatgatcagcaaggttccttcaattctagtggctggtaaaaactcaagtcgatcatcgatccatccattaattcctgcagcctcatcagaagtagcatgaaatatccatgctcttgcttatgcaactcaacttatattagtatagttataaagctatatatagccgacttaaaaaaaacttagagtttggatcttctttttggtgttatggtgtgtgcatgagggaaatcaaaattaaaggaaggagaaaatttg

SEQ ID NO: 6282 - DNA, 1639 bp, Oryza sativa
  Predicted polypeptide sequence is orthologous to G2140, G2765
catccatctccctcccacacgcaagccccgggtactacgctgcccgtccagcgttcaatcgatcgatcgatccccgcggctcggtttgtgttgcgttcttccagatcgatttgatagatgggtgctcatggagaccaccgccaccaccaccaccatcaagaagccggggtgctcgtcgacgaggaggaggaggaggtgatcgagcaggcttgcggtggcccgacgagcggcgtggtggagcaagaggtggggggagacggtggtggagtgtgccaagatgctgccggcatggtgttcgaggcgaccagtagcgtcgggagcgtgagcgccaccatggggccgccgccgatcatgtgctggccaccgccggcgcagtctgtccacggtgcaatccaccaccaccacaacctaggcggcggcggcggccagcagagcccgttcttcccgctgctgccgcccctgccccctcagcccccgccgccacccccgttcttcgccgacttctacgcgcggcgggcgctccagtacgcgtacgaccactccggcggcgcgtcgtcgtcgtccgacccgctcggcctcggcgggctctacatgggtcaccacggctcccacgtcgccggcatgatgatgccgccgcccttcgctccgtcgccgttcggcgacctcggccggatgaccgcgcaggagatcatggacgccaaggcgctggccgcgtccaagagccacagcgaggccgagcgccgccgccgcgagcggatcaacgcgcacctcgcccgcctccgcagcctcctccccaacacaaccaagacggacaaggcgtcgctgctcgcggaggtgatccagcacgtcaaggagctgaagcggcagacgtcggagatcacggaggaggcgtgcccgctccccaccgagtcggacgagctcaccgtcgacgcgtcgagcgacgaggacgggcgcctcgtcgtgcgcgcgtcgctctgctgcgacgaccgcaccgacctcctgccggacctcatccgcgcgctcaaggcgctccggctgcgcgcgctcaaggccgagatcaccacactcggcggccgcgtcaagaacgtgctcgtcgtcaccggggacgacagcgccgccgccgccgcctgcgcggggacggacggggacggcgagcagcaggaggaggcgatgcaggcgcccatgtcgccgcagcacacggtcgcgtccatccaggacgcgctgcgcgccgtcatggagcggacggcatcggccaccgaggagtccggggggtcgggcgccggcggtgggctcaagcggcagcgcaccacgagcctctcggcgatcctagagaacaggtctatctaagcaagcatccacacatgatgagatgtgcaaaacgaaacgaaaaaaaaaaacagtaaaaacaacgtacaccacaccacagtccacactatctcaaagctgatcataataccatgcagctagctagctagattatggatcacatgttccccaagtacaaccgttttccatttctttaattttagttttctctcccattgattttatactagtactgctttgtgtgtgtgaatcttggtgctgtatatctgcatggcatctctcagcaatcaatacaaggccacactctttgttc

SEQ ID NO: 6283 - DNA, 2090 bp, Oryza sativa
  Predicted polypeptide sequence is orthologous to G2140, G2765
gctctcatagtcctcttcctcctcagttcatccttgcctgttgcctactccctcctcaatcctgcagaagtttctgaagagatcaattaccaagaaactgagaggaaacacacagattatctgcacacaaatcatcaccatacttgcatctgtcgttgagagaagatgatcccgttcacaaagcagagaagcaccaagatgaaacgtgccctgcactaagctatgctgttcggcaggagctcggtgaggccagtgatggaagcacgccgccgcacgccaagattctgcaaggcggactcggagtcggagcagaggaagctacggcgtgtcaggctccccttctggtcgtgcccgccgaatcggccgccgggcacctgacctgacctgacctctcttcctcttcctctgcatcttccacttcctcttcctcttttctcggtgtctgaatctctcctgagttgttgaacagcctgaggaagacacgggctacgatccttgtgccatcctgatttgtccctccctgtcgcctcactgtttcacgcgtcctggaagcaagcaggcaaacgacatggcggctctgcttttcttgtgatctgggttggaagcttctgctccttcgatcttcgccatttctgaggcgttcttgggagcagggcccttggtcttgctgctgtctgccaccactctgccctgcttgcccctgtgtgttcttcttgctggctttctcgtccttgtctgaatcttgcaggttcttgtctgtgacatcctggagacgcgtttcaggtgttcttgatcttggagcttatgcctgcgagttcttgggtgcaggaggagttgttagttgttacctttgtctccttcgttgatccattgaaagaggcagtggctgtttgctctttgatctgcatgtcctttggccttcaccgacgacgagatgggctctgctccgttcggtgacgccgtcgccggcggtgggctctatgagtaccaggggtatcacggtggcttcgccggcggccatggtctcggccaaccggccggccgagcgcccgcgttggacgacggtgaaactgaggggatggacgcatccgccgccgccgcagtcgccgccatggagatggcaaagaggaattgtggaggcggccgggaggagaaggcggcgatggcgctcaagagccacagcgaggcggagcggcggcggcgggagaggatcaacgcccacctcgccacgctccgcaccatggtgccctgcaccgacaagatggacaaggccgcgctgctggctgaggtggtgggccacgtcaagaagctgaagagcgccgcggcgcgcgtcggccggcgcgccaccgtcccgtccggcgccgacgaggtcgccgtcgacgaagcgtccgccaccggaggcggaggagaaggccccctcctcctcagggcgacgctgagctgcgacgaccgcgccgacctcttcgtggacgtcaggcgcgcgctgcagccgctcgggctggaggtggtcggctccgaggtcaccacgctgggcggccgcgtccgcctcgccttcctggtctcgtgcgggtctcgcggcggcgccgccgccgccgccatggcctcggtgcgccacgcgctccagtccgtgctcgacaaggccagctccggcttcgacttcgcgcccagggcggcgtcgctgctgggcagcaaacgccggaaggtctccacgttcgagtcatcgagctcctcgtcttgacaagtttcagagaaaattacgccaaagtcaaaaagatctgatcggttgcagtgatttttgcttctgataaattaatcgatcatggttgtaaaagaaagatacaaagctgaagtgagtttcttctttaatttctttctttctttctttttggcaagattaattactgaagtggcttctcaacattggttagcacttagcattttgctgctgcttatcttttcgaagagcgttgtgctccatgcatgattaattaccttgcatttgacatatatatatttgacattttcacatttcactgcaacttcagtttaactagtaactaggagctttgctccttcatgcatgatgcatg

SEQ ID NO: 6284 - DNA, 490 bp, Oryza sativa
  Predicted polypeptide sequence is orthologous to G2140
tcgagctggaggcgtcacgcgcgctgggacgcggccacagctgctacagcagcggcagcggcggcggcagctcggtggcgacgacgacgacgacgagcggcgccgccaatatcagcgcggcggcgtcggcggcgagtgtcagtgacgcccagatcggcgagctgaggcaggagagcgtgctcgagctgggaccaagatgatgatgatgatgatgagagtgatcgagttaggttcagataatcaactagttcttgattgaaaatgttccttttttttcatgggagatattaagctcatttgtattgtactagtaataaaatcagaaagatgtaatgtatataagttgcatgttttttcatgggagatatcaatttcatgtattgtactagtaatcaaaatgtaattaagtggccagaagaacataaggagtatattttgtgccctttgtttcatgtatcttaattactactactatctccacaaaaaaaat

SEQ ID NO: 6285 - DNA, 2323 bp, Oryza sativa
  Predicted polypeptide sequence is orthologous to G2141
gaaactgatcagatcacacacttcagactacagtcaaacagagcccttgcttgctttgcttgtgtcttcaacttcagagaccccctcctaccctcaaaaaatttcccctttcttttcctccgtttcttgcagcgacaagagaaatactaatactcctcctcctactactgctactgtgcaaggggaaggacacgacgacgaattggagagcggcgtcctctctgatccttttttttcctttattgcatctctctctctctctcgccatttttcttctaggttggtctctggatcaggccattgagggggaaagaaaaggtgcgggttttggggggaggttgttcttgcgggaggccgttgatttcgccgtgtgatcggagggagtgaaaaggagatgaatgagaaggacgccactgatttggaggagaggagtgaggccagtgagcacggccaagctctgagtttccatggtggtgccatgttcttgcaagaggctcagattgcttctcctgcagctgcaaataatgcattgacctccatggcgaatcctttccctatccctcctgggttgtggaatccaccttcacacaacatgggtttaggcgaaaccagtttttcatccttgttggggatgctgtcggccggcgcgccgccaccgtttgtggctactcccgggtttgtagattccacggcggggtttccttgctacaatggaggcaatcttggagccatgatcaatcaccctttccctggtatccaccagcctttgggtgatttccaaaacggcgtcgagccatgtagggagattgaggatattgagattgaaggatccaagaatgtgtcacaaactggtgagaagcagcaaggggatggtgagacaacgcatgccgtcgattcctcctccaaggagctaagcatgccagggcgcaatggtggcgctggccatgatgaggggactagggtgtcttgttccaagaagaggaaaagatcaggacaggatggtggggtgaagcatgcagaaggtggtgagcaattagcaactgtcggttcagcgcagaagaatgaggatgatgaaaagggtgaaccagagaggtcttctgtggcgtccgggaaatccagtgggaagcaaataaaggataatgcaggttcaccaaaggaagactatatacatgtaagagcacggcgcggtcaggctacaaacagccatagtcttgccgaaagggttaggagggagaagatcagtgaaaggatgaaatatcttcaggatcttgttcctggttgtagtaaagtaactggtaaggctgttatgctggatgagataattaactatgttcaatcattacagaggcaggttgagtttttgtcgatgaagctagcaagtgtcaatccaacactggacttcaacatagaacgcattttatctaaagatatttttcaatgtcgaggcactactgcatcatctgcctttggcttcttcccagacattgttcatccccgattacacccaccaaaatatacacaagttgggatgcccagcattgtgaaccccactgatgcatttggaagagtaatccatgctccattaggaactaacagtgcattcaaagaacctaaacatcagatgcccaacaatttgaatggagagttccaggacgtcattgagatgccttttactcatgaccatcatggatcaaatgatcaaccctgagattgattccacaactgaagcaagagatcaatatgtgccatgggctttcagcaaaactgtgatatatgagcatgttgatatcatggtactagctcacggctgatcactgaagtataagcatccaaaatgcttagttagtgctatttttctcatgttcatagcagcaattgacctcctgtggaagcctctctttggatgttccatttgctgttatagaaagttgggagataaaaaaaaaaggatgttcacatggagatctcaagcaatttgttctccactgaagtagtctacagtcttgaaatggcgagaagcttcattttgcaagaaggtgatttttctgtggtctcgtcaaccccaggattattacatacactagctagcattgtgaggctacagaaattgttctttgttgtacttgcttagcccatgttccatctgacaagcaacataggcagaaatgcagtcactgattttgtatttgttgaaaaaaaaaataaatgggcttggcctgatgtagcaagcatttgaattttgcaacgggtgcctattggcacagatgtttttattccagcaaagctgtgaattctgaaagagaagaaaagagaactgtgatcc

SEQ ID NO: 6286 - DNA, 2140 bp, Oryza sativa
  Predicted polypeptide sequence is orthologous to G2141
gaatatgaaattttcttgattcttgaaggatggtggggtgaagcatgcagaaggtggtgagcaattagcaactgtcggttcagcgcagaagaatgaggatgatgaaaagggtgaaccaaagaggtcttctgtggcgtccgggaaatccagtgggaagcaaataaaggataatgcaggttcaccaaaggaagactatatacatgtaagagcacggcgcggtcaggctacaaacagccatagtcttgccgaaagggttaggagggagaagatcagtgaaaggatgaaatatcttcaggatcttgttcctggttgtagtaaagtaactggtaaggctgttatgctggatgagataattaactatgttcaatcattacagaggcaggttgaggtatgatgtttgtaaaacttgtagggccattttcagttttacttgcatagtcctgctgcgatgtaatctggtatacccaatgtgtgcatgttgggcagtttttgtcgatgaagctagcaagtgtcaatccaacactggacttcaacatagaacgcattttatctaaagatatttttcaatgtcgaggcactactgcatcatctgcctttggcttcttcccagacattgttcatccccgattacacccaccaaaatatacacaagttgggatgcccagcattgtgaaccccactgatgcatttggaagagtaatccatgctccattaggaactaacagtgcattcaaagaacctaaacatcaggtttgtaccatcacttgcatttggctaaatggccattttcatttcatgctctttataccaaatactgtgttcatgaaaaataggacaagtttctgcaagatgttccaagacctaatttagtgttatatggcttggtgtttcgagaatactgctccacagatagtcgttgaaaagaatgtccacataatattttaaaccaagaaaagctagtcccctttatatccttttgctgggtcttgcttcactacccatctttccaaaaagttcgtgggtcttaaaagcaaagcaaactagataacataactaaactgagacattttagacaacaaacaaaattcctactatctgtttttcataactagccagattgtgcctgattcttttggccatgcaagctgtttgaacctagtccatcaatcagtctctttagcttctgactcattaaccctcttcaacctgattttagtgggaagagcattgttgatgttaaccgacattgtaacctcagtagcactaaccatttcactagtaaaccaactaaaaatgtacaaatgcagcttgttatatatctaattgtatcttcatcactacatatttgccttcacagttatctaaaacatatgctttcatattcataaacatttttttggaaagcggagtaccaaagcactgttttagtattttgcaatcctcttattacttgtgcattggacagatgcccaacaatttgaatggagagttccaggacgtcattgagatgccttttactcatgaccatcatggatcaaatgatcaaccctgagattgattccacaactgaagcaagagatcaatatgtgccatgggctttcagcaaaactgtgatatatgagcatgttgatatcatggtactagctcacagctgatcactgaagtataagcatccaaaatgcttagttagtgctatttttctcatgttcatagcagcaattgacctcctgtggaagcctctctttggatgttccatttgctgttatagaaagttgggagataaaaaaaaaaggatgttcacatggagatctcaagcaatttgttctccactgaagtagtctacagtcttgaaatggcgagaagcttcattttgcaagaaggtgatttttctgtggtctcgtcaaccccaggattattacatacactagctagcattgtgaggctacagaaattgttctttgttgtacttgcttagcccatgttccatctgacaagcaacataggcagaaatgcagtcactgattttgtatttgttgaaaaaaaaaataaatgggcttggcctgatgtagcaagcatttgaattttgcaacgggtgcatattggcacagatgtttttattccagcaaagctgtgaattctg

SEQ ID NO: 6287 - DNA, 2079 bp, Oryza sativa
  Predicted polypeptide sequence is orthologous to G2141
gagtggtagtctatgatcttctacctctcttctccctcttgctggaacatatagcatcagaatcctcactgggcatctttccttttcttgccatatctggccataggctacaataagagttcttgcttgcttctcctcctcctcctatcgcattgttcatacagctctgatcaagctctctaagcatcgatcacttggttcttgctcatcatctttcgcttgctcgtcagctaggaattcgtagtcttgagccgaggttgggtgattcgatggacatgagcgagagcagtgagaaaggaatggagagcaatgcgtcgtctggccctggcaatggcatcccggtggagtggcagagccaattcagcagcgccttcgcgtgccagccgtcggtggcggcgcagcaccagcagcacgccatgatggactccttcgcggcggcgtccgccggcctgtgggcgtcctccgacgtcgtcagcgccatgtcatcggccgcgccgccgcggggcgcggggttcttggcgccggtgcccgggttcctccagcaggggctcggccatttcccggtggactccggcttcatcgagcgcgcagcgcggtcgacgtgcttcggcggcgggatgatggccggcggcccatacggcgcagctgaccaggccatgggcgacgctttcggtggcaccgcggagggtctcatggatcatcacaggaacgttggcaacgacaaggccgaggagttcgccggcaacggccacgacgaggtgccgagctcggaggtagccggtggagactgctcctccaaaggttcagactccaagaagaggagaaggcctaacgaggtgatgggaaccgatcaagtccattcttccaacttgccatctgattctgcgaacgagagtgttcacagcaaagacaaaggcgaggagagcagcccggcgacgacgaacggcggcaagtcgaaagggaagggagcaaaggagacctctgagtcacagaaagaagagtacattcatgtccgggctcggcgtggccaggcaaccaacagccacagcttagcagaaaggttgagaagggagaagatcagtgagaggatgaaacttcttcaggacctagttcctggctgcagcaaggtcaccggaaaagcggtgatgcttgacgagatcatcaactatgttcagtccctgcaaagacaagttgagttcttatcgatgaagcttgcgacagtaaacccaaggcttgacctcaacatagaagggcttctttcaaaagaccttcttcgcttccctggagttccttcatcctctatcggattctccccagaaatgatgcatcctcaactacaattgtcacaaccaggactgattcatggtggtaccgctggcatggccaaccccgatgtgttcagacgaataatacaagcgcaattaggtgcaaaggatggatctcagatgccccactcattgaatggatcattcagtgacgtttcccaaatggcgtacccgtccctcggttctcaggacctaagcatcaggccatctcaggatgggtttcaaatgtgaagaagacgaagaagaagaagatgatgatgatgagggggccaattccatgtacgtgcaattgcttctggcatctggtgaacaagggcaggcacacgcacatgactgaagcttgctactactgctggagaagcagcgtttgcagtgctgctagctcatcgcgtaactgaagtctgaagggcttttaattccttccgtggctagctgtatatccatcgaggttttattgtgttcagaactgaaactgaaaggcttttgagccccacgtacagggacgctggaaacgaaaaatctgcgtccttgatggctggaaattctgtctggggagcgtgcatttacactgcagcacgaggagcagcaggcaggcagctgaatttgctgcagggctggcacaatgcaagatcactcatccggtggctttgttaagttacttccgattcattgttggttgcgaaaacgattaaacaactcatcataaacgtggcgctgaatggtgttaatgttaagatcaaacacatttgactcc

SEQ ID NO: 6288 - DNA, 1098 bp, Oryza sativa
  Predicted polypeptide sequence is orthologous to G2141
atggatgctaatggcggcaatgggtttggagtagagagcaacgcttcggctgtccatggtggcatggcgatggcttggcaatggcatggcggccagatgagcggcggcagctcgtgcgctgcggcgccgccgccggtgcaacagccggcgatggattctctcgcgtggtcgtcgacggtctcgccgagcaccggcgctgccacggcggcgagcggcgccggcttcttgctgccaccggcagccgtgcgcggcggcttcggcagtttcccggtcaactccggcggcatcgtcgagccggccggtgactgctcgtcggagtccaagaagaggagatcagacgagattgctggaacggatcacgcgaacgcatcgaacgcgcttgccgattctgggaacgagaccgagtgtagcaaagatgtcaacggcgaagtgatcggcccgccggcgacggcggcggccggcggcaagtcgaaagggaagggagccaaggacgccggcgaggcgcagaaggaagggtacagccatgtcagagctcggaaggggcaggcaaccaacaaccacagcttagcagagaggctgagaagggagaagatcagcgagaggatgaagctcctgcaagaccttgtccctggctgcagcaaagtcaccgggaaggcgttgatgctcgacgagatcatcaactatgttcagtccctgcaaagacaagtcgagtttctgtcgatgaagctctcggcagtcaacccaagaatcgatctcgacattgaatcacttgtcaacaattccaaggatgttcttcgttttcccgggcagccttcctctgctcccatgggattctccttctccacggagatgatgccggggctacaattatcacgaccgggcatccttcagggaggtgtccatggcatgatcaatccagatgtgttcaccagcctcatgcagaagcagcagcaaaatgacaagggagcattcagagagcctcagatgcatcagactttggatggatcattccgtaacaccgcacaaatgccgtatccacaggtcatgagttcagaagagctaagcatcaggcaagatcaagatgggtttcacatgtga

SEQ ID NO: 6289 - DNA, 1982 bp, Oryza sativa
  Predicted polypeptide sequence is orthologous to G2142
gggagagagaggaactgaggaagcgaagcgaagcgagagaggaggagaaagcccggagagcttgccctcgccgcgccgcggagatccgcttccccatccccccaacacgtcgccgccgccgccgccttccttgctgcgcggggtaatgcgcggccatgggactgcaagggaataaggcgacgcacgacttcctctcgctgtacgccgccgccgccaccgccacggactactcgccgctcccgcgccacccggactccaagccctcggcgccggcgccgccgcccgctcaagatttcttcctcaagacacacgacttcctgccgcaggtagagaagagagccgaccagacaccaccgccgccgccgccgccgccgccccacgccgcggtcaccgccgagaagcagctgctccaccagcacgcgttggccgccgccggcgcgttcaccatcaaccacgccgtggccgcggccgccaccgccgtcaagcaggagccgcccttcgcgccgtggtgccagcccgtcgccgccgtagatccccgaggtcaccagtggtcgctccccttcgccgcgcgcgccgtcgccgtcgcctcctccaggccgcagcagcagcagcagcagccaccgccgccggagaggaagggtggcggtggattcatggacgccggctccagatccagtggcggcgcgggcttcgacgacgacgacggccatgccgcgcgccgcgaggtctcctcctcgctgaaagagctcacggtcagggtggaagggaaaggtgggagctgcagcggcagcgctggcacggatcagatgccgaacacgccgcgctcgaagcactccgccaccgagcagcgcaggcgcagcaaaatcaacgacagatttcaacttcttagagacttattgcctcataatgatcaaaagagagacaaagcatcatttctcttagaggttattgaatacatacggtttttacaagagaaagtacaaaagtatgaggtttcatacccggagtggaaccaagaaaatgcaaaggttgtgccatggacaaacatctatttccgttcttcctggaaaaatgcgcagaacaaaggccaagttcctgcagatcattcacctgaccctccagaacttctgaaaaatggttccccctatatgttcccttttacagggaactctgataataacaatgcagttgaaactgcagctgcttcaggtgcacaggatcaggcagaaactgatccaatgagtcgtgtgtcttacagatcagtggacactcccagtcccaataatgttgcagacaaagttacatctcagccacacgctcaactggtgagaccatcacctgcagagaatcacacagtaaactgcgacaagttaaataattctgaccttgccatcgatgagggaacaatcagtctatcaagccaatattcccaagagttgcttaacaagttgaatcatgccctggaaaactcgggtatagatttgtcccaagccagcatctccgtgcaaataaatcttggcaagagggctatgaagagatctactcctgctgcaacctccacttctaaggagctcactgatccggcatctaatagtcaagcaatgggccgtcagcttaggttgggtgatggcgctgaagaacatcgacaagcctcaaagcgacacaaatcagataacagctgatggtttgctcctgaaaaccccagatattcaaccattttttgctcctaactgtgtacggggagccccaaggttttatgtatattaagtttacctgtgacgtctcgacaaaacaaggccttgatgtattctttcatttaatcacttcgccgttctagcccctagggaagaaaggaagcttccattgcagattgtgaagctgcttttgtccatatgcttccattcatatgagaagtttctcccaccctctgacagaatgtcttttgtaacataattcagaaatgagctatccaaagttccatc

SEQ ID NO: 6290 - DNA, 1003 bp, Oryza sativa
  Predicted polypeptide sequence is orthologous to G2144
ggcgagaagagggcaagccaccgacagccacagcctcgccgagcgggcgagacgcgagaagatcaatgcgaggatggagcttctcaaggagctggtccccggatgcagtaaggtatcaggaacagcactggtactggatgagatcatcaatcatgtccaatctcttcaaaggcaagttgagtacttgtcaatgaggctcgcagctgtaaatccgagggtcgactttggtgggctagacaacttcttgactacggagtgtggaaggataacaggcttgaactacaagaatggaatggatttggagcaggtcacctggccagacatgggcgtccatggagcaaggaatctcatgcaactacaacagcagttctggcatggtgatttagcacacccgctccagccgccttcacagtgggaaaagcggacggataccaatccccctgtctttagcaattcaagttcctccctcttcggctatgatctagcaagctctggagcgccggcccagacaggcaacaagctaaagacggagctgtgagcctgtgaccaacggtggtggtagtgatagcaagcaggtcagcagagcaagccaaacaaacatacgtgagctgtggacaatggcggctggatgtcaggagagctagctagctagctaggcgtgagctgtggactgacggctgctgctgctgctgctgctgctgtggatggttggcaacgtcttgtgcagtgcagcagtgcggtgcatgggactttcattgattttggaggccggattctgagacgatgtacatatggaatgcaagatatagagagatactgttgttgctgttgttggagactcttggagctggaggtgatggatatggaggttttactgctgctatctttttttgtagagatgagcgagagatactgtggattcttttcttgctgatgtattcttggtgtatgcctgactacgatggtttaatgtcaaggttatatgagcagcatttatttggtg

SEQ ID NO: 6291 - DNA, 753 bp, Oryza sativa
  Predicted polypeptide sequence is orthologous to G2146
atggcgaaggtgcgggggaaggcgggtgcgggtgcgggcgccgcggcggcggcggcgacgaggaccaagtggaggagcggcgcgcaggagaggatctacgggcggcgcctgctcgacgcgctgcgggccacgcgggacggggctgcaggcgggggcgggggcgcgccgccgcagccgcgggcggtgaaggccgcggcggactcggcgctggcgctcaccgcgcgggggcagtcgaggtggagccgcgccatcctgctggccggcgcggcgtcgtccaggcgccgcgtgctcgtcaaggccggcgggaagatccgccgcggcggcggtggcaacagctgccgccgcccgcaggcgcgcgccgcggcggcggcggcggctaaggcggccgcggccgcctcctccgccggcgagcccccgatgctgaaggagaggaaggtgaaggagcgcctccgcgtgctgggccgcctcgtccccggatgccggaagctccccgcgccggcgctgctcgaggagacggccgactacgtggccgcgctggagatgcaggtcaaggccatgcgcgccctcgccgacgcgctcgccgccgcgcagctctcctcgtcaactccgcagcaggcggaggccgccgccgacgagaccgagatggagagggtttgggatttgaggagggtaattgcgatgattgatgctgctgataatgctgctgctgctgctgctgctgatgatgatgatgatgacgatgatgatttgtaa

SEQ ID NO: 6292 - DNA, 644 bp, Oryza sativa
  misc_feature (2)..(52): n is a, c, g, or t
  misc_feature (589)..(644): n is a, c, g, or t
  Predicted polypeptide sequence is orthologous to G2146
tnnnnnnnnnnnnnnnnnnnnnnnnnnnnnnnnnnnnnnnnnnnnnnnnnnntttttttttcctagcaacaaaattcaataaaatctggtgccatgcattcacaactcctaagcaccagcagctagctaatctgcatttgttgctgctacttccatgttccgacgacaggggcaacagcaccaggaggtggaaaattcaagtggcagagcttacactagaattcctacttgcatctagcttgttgtcccactatacaaaataacatgcgtttgcctgccagcctagcaagaggtgaaagggaacaagtaatgcgtacgaagagtagaaacgaacgaaactcactacagaagattcaaacgcgcgcttacacgagacctcttacgagacacacgtaacctgtggcgcccacgcatcattctcatataggcttctccggcgtgacggatatttctttctccggcggcgagccgaggccggacaggaggcaggcgagcgcgcgcatgacgccgacctgcgcacgcaaagcggcaatgtagtcggccgtctcgtccagcagccgctccaccgccatcgcctcgccccccgggnnnnnnnnnnnnnnnnnnnnnnnnnnnnnnnnnnnnnnnnnnnnnnnnnnnnnnnn

SEQ ID NO: 6293 - DNA, 809 bp, Oryza sativa
  Predicted polypeptide sequence is orthologous to G2146
ctgcggtacggtctggaatccgggcttatctctctggattggatcggcgggcgagcggcgtcgggcgggcgctgcgacgacgatgtgcgggcgagggctgaagcggcggtggcctcggcccgcacgcccgggcctacaatgcctccaagcataccatcgtgatgccgcctgcgagctcggcgcccatagcatccgcggccgtctcctccgccggtgagccatcgatggtgaaggagcggctccgcgtgctgggccacctcgttcccggatgccggaagctccccgcgccgatgctgcttgggccaactatgtggccgcgctggagatgcagtcaaggccatgttctcatagacctcttggccgccaccgccggtgacgcgtgcgacaggggacgccgcgtcaacgggcagcgagcggcacatgacgtcggagatcgagcagtaccgccgcagcgacggcggtggggcgggcgcgaacatgcgcttgcgggtggcgatcgatcccctcgtcgattaggataatgagaaaggtaattacccaaagccattttgatttactatcaggcttggttacgggcagcaatcaattggttggtttgccttgttgatcaatcggagaaggaggtgcaggtggcggcgttaaaaacaaaaacaaagggcggcggacaaaaggaccaaggttagaacgcgttaattaaggcaaaaccttcatagttcaccaaaatcatcacggcggcgttaacagttgcagtgacaactgcttcccatatctgcttaaaaaccattagatggtaaagaaaacgacgaaca

SEQ ID NO: 6294 - DNA, 491 bp, Oryza sativa
  Predicted polypeptide sequence is orthologous to G2150
ctagtggatccccgggctgcaggttttttttaagggtagaaaaaatctgagtgatttttggttagaaatcatccgacaaagggatagacagttccagtcagaaaaataaaaagaaaatgaaagaaatgaaggcctcgaagcctcgtcgtcatcgctgcttgacggagaccgccgctcgccgttcttgattcttcccctggtgccccgccgttctcggctcttccccctggcgcctcgccgttcaccaccgtcgtcagagtttgaggccgctgaatccagatcctttggagccatggccaccggatctggcccgtcgcaccttgtgaaggacagaggtgcagtggtggctagcgaggaacacatcaccggcaatagcaagaccgaggggaagacaatggaggcggcagcaacatcttccatcaagtgccgagatccgggtattctcgtcaagcccttcttcgtcctgtcctcttcttcctcctggatctgtc

SEQ ID NO: 6295 - DNA, 538 bp, Oryza sativa
  Predicted polypeptide sequence is orthologous to G2156
ttcctcgagcactgttggcctactggatgcgatggtcgcggctagcgaacgccaagcggatcgaacgccgaggcggcgaggcgcagcagtattacgagtacgtgttgatcgagcgcgaacgccaccgcccgcggccaccgggcagccagatgatcgcagcggcgagaggcagcgaagaggggaacgccgagacggcgaacggccgagccctagtggctgggggctagccgtggctggctctccgcctctgcctcctcgttgtcatctcctcatcctcaactatgcaatcttcatcagctgcgatcatatctgctcaaagtctcgacctggcgattgaaaactagaccgtaacatcggtaatttcgagcaattagcaattaccatgattttaattttctgattaattattgcattttaaatgatcgattcgattgattatggaattaatcaattatcgaaagtaatgtgaatgtattttctttttgcttaaaacatgaagacatttatttccttaatccttgccacgccttctaaaaaa

SEQ ID NO: 6296 - DNA, 3334 bp, Oryza sativa
  Predicted polypeptide sequence is orthologous to G2192
gtccagccacatttgatccccctccactccattctctcctcctcctctcccaccataatggccaagctcccctcccgctccccactcctgctcccgcctctcctcctcctcctcctcctcagccgccgcgtcgcctcctcctccaccgccgccgccgccgccgcagcgcggtctgagtgaagtgaggttcttgggtggaagcgaaggagaagatagatagatagagagagagagagagagagagagaggattaaggatggaggttgacccatcgtcgtctttgccgggcgcgggggaaggaggaggaggaggaatcggcggcgggggtggggatttgtggccgttcgactcgctcaccacgtcgctgctgttctcgtcggtgtcggcctcaccgcagccgctgccggcctcgtcgtcgtggctcacgccgccctcgccgctgtggctgttcgacgagcgccagctgctcccgctcgacatgggcgcccccgctgcccccgccaccgctccgcccgccgaggccgccgccgtggtcgaggaagtccatcggacccgctccgggaattctgacacgactagtaagagggttgatcagattaatagcaaatggcagtttcacctatctattgatgataacacggacagctcatgcttgtttaaggagaggcttacacaggctcttagatacttcaaggagtccacagatcagcatctgctggttcaagtttgggcaccggttaagagtggagaccggtatgtgcttactacttcaggacagccctttgtacttgaccagcagagtattgggcttcttcagtacagggctgtatccatgatgtacatgttctcggtggatggagaaaatgctggagagctggggctacctgggcgtgtgtacaaacaaaaggttcctgagtggacaccgaatgtgcagtattatagcagtactgagtacccacgccttaaccatgcaatcagttacaatgttcatggtactgtagccttgcctgtttttgatccttctgttcaaaattgtattgcggttgttgaacttataatgacatcaaagaagatcaactatgctggtgaggttgataaagtctgcaaagctcttgaggcagtaaatctcaaaagcactgagatattggaccatccgaatgtccagatatgcaatgaaggccgccaatctgctttggtggagatactggagatcttgacggtcgtatgtgaagagcacaagcttcctttggctcaaacctgggttccttgcaagtatcgaagtgtactggcacatggcggtggtgttaagaagagttgtttgagctttgatggaagttgcatgggggaggtttgcatgtcaaccagtgatgtggcatttcatgttatcgatgctcatatgtggggatttagagatgcatgtgtagaacatcacctacagaagggacaaggagtttctgggaaggcttttatctatcgtcgaccttgcttttctaaagatatcagtcaattctgcaagttggagtatccccttgtacactatgctcgaatgtttggtctagctggctgctttgcaatatgtttgcaaagtatgtatactggagatgatgattatatattagagttcttcctgccaccaaattgcaggaacgaagatgatcaaaatgccttgttggagtccatattagctcgaatgaagaagtgccttcgtaccctaaaggtagttggcaacggagacaccaatgaagtttgtctgcaaataagtaatgtgctaataattgagactgaagatttgaagacaaatgtgcactttgagaattctgaaggttgctttcgtgaatcgcctgaaagtaatggaagccaaagagtccacgaggttgataatgatggcaacaaagtttcaatcatgtcagagagacatttgctagctgatgacaactctcaaaacaatggggcatctgttggcaggccaaatggtagtggtgcttctgattcgcttcacaaaagtaataaaccccctgaaaggagacgaggaaaagctggaaaaacaatcagcttagatgttcttcagcaatatttctcaggaagcctaaaaaatgcagcaaaaagccttggtgtatgtcccacaaccatgaaacgcatctgcaggcaacatgggatttctcgttggccatctcgaaaaattaacaaggtcaaccggtctctctcaaaactaaagcaggtaattgagtctgttcaaggctcagatgcggcatttaatctcacgtctatcacaggtcctctccctattcctgttggaccttcatcagattctcagaatctagagaaagcaagtccaaataaagttgcagaactttcaaatctggctgttgagggggacagagattcatccttgcaaaagccaatagaaaatgacaacttagctatattgatgtcacagcaagggtttataggtgcaaacaataacttgcaacttgaagcagacaaagcttctcactcgagaagctcatctggagaaggcagtataaactcacgtacctcagaggcctcatgccatggaagtcctgcaaaccagacatttgtttgcaagccaattgcatcgacgttcgctgaaccacaattaattccagaggcgtttactaaagagccctttcaagaaccagcactaccgctttccaggatgctcattgaggattctggaagttccaaagatttgaagaatctcttcacttcagcagttgatcaaccatttttagcacgttcaagcaatttggcgctgatgcaaaattcagggacggtgaccataaaggctagctttaaggaagacattgtcaggttccacttcccatgttccggtagcgttactgcattgaaagatgaagtagccaaaaggctaaggatggatgttggcatgtttgatatcaagtatctcgacgatgatcatgagtgggtgaagttagcatgcaacgcggacttggaagaatgcatggagatctctggtagccatgtcatcaggctgttggttagcgatgttgcggcacaccttggtagttcctgtggaagctcaggttgataattcaggtcagcattttcgttccatgggtgcatacatgttctgcgaggtcagtctcacctgttgttaatctagttctcttgctagatagcagtagctacttcattgtgtttgattattgtatcaatttttggttcgaatacatgtacttgtgcaaaacggcacttgtagtcaatactgtacatattaagcccttggtgctggaaaattctgatgttcaagttacaaaggttaattggtgtaatactaatatcttcgctgtcc

SEQ ID NO: 6297 - DNA, 1244 bp, Oryza sativa
  Predicted polypeptide sequence is orthologous to G2192
atccccatcccaaaccccgcgccgcctcttaccgcttcgcgtcagcttcgatttgattcggttcggttcgcgcgcgccccgatctatcccgcgcgaagtcgattcccacgccacccgcgctgttatgtgcgcggctcccatggcttccactgcccagccgcagcagcagccgcagcagcagcaggagcagcagccggtggcggcggcggcggtgccgactccggctcctccggcttccgaggcgcggccgcagaagccgacgagggtatcgttgtcgtacgaggagatctccaagctcttctcgctaccaatcgcagaggcagcctccatcctcggtgtttgcaccagcgttttgaagaggatttgccgcagccacggcatcgtcaggtggccgtatcgaaagcttgtatctgggaagtctggtgatgacacaaaaaacgctgaaagagagaaagccaagggacttcttgagatatctaaagttgcaaaacagaaggctctaagcgcatctggtctatcaacagtatcaccaggcgctttccaaggagtggcaaaatctcaacagggaagttcgaaggcaggacaagtctcacccccaggaaaacaaaatgtgttgggtggatcagcaatcttgtcctatggtacccaaaccaaaggcatcccaacctacatggacgacttcaagtacggatttccatcatctggcttgtctttgcaaactatgaaatggtgggggactgacagccacacggagaccacacctgcgaaagacgataacggtgaagcccctgaatcagcaaatgaggcttcgaagggtatgaccgacgatgagttggactggggagcagatgaagctgaagccgaagccgatgccgatagtgcgatcacaaccgaaccatctgcacagctgtgctccctgagaaggaaagctgtagacgatgggcgcaagctgctgactggcaagtcctgcgggggactggagctgtgcaggctgaataagaggcagaagatggccctcgcccaggtgttcggagcctcactgccggagcagttgaggagcaagctcgggtgatgattttgcctgccatttgtacctctgtgtaacactagttactagtagtagcgaccggcatggttaagctggttcctgatgtaacttgtcctgatccatttgtgttgtgagaactagataaattcgttgtgaagaggatggtaggagttttgcctgcctgctttcccatttc

SEQ ID NO: 6298 - DNA, 756 bp, Oryza sativa
  Predicted polypeptide sequence is orthologous to G2192
cgacaagatgaagcgcgtcatgaatccgtgaactgctcgccgtcgccgccggtggccatgcctgctcacccagctcttcttctccctccgccgccgccgccaccgcggccatgcctgtcaagtaccgtaggagagacctcctcccatggatcatgccaggcgccgccatctcacgccaaaactgcattgcgaaaacctccgaggtgcggcaatggcgacggcgtggtcaccatcaaggccagccacagaggtgacatcatcaggttcagggtgccgtgctcagccggcgtcgcggcggtgaaggcggtggtggccaagcggctgagcctggacgccggcgccttcgacgtcaagtacctggacgacgaccacgagtgggtgcttctgtcctgcgacgccgacttccaggagtgcctcgacgtcgtcccggcattgccgtcaatgtcggtgacggcgaggtcaggctccggagcggcggctccggtggtcgtcaggctgatggtccaggaggtagctgataacatcgggagttcctgcgctagctcagattagttgtaaaatgtagctgaaagtgtgaaaccagtagcaggaacatcaaacagatttctcaagtttttactactgatacacatacaagaaagttcagacctgtcaaaaatcactgtaaaaaggaacatgccttagagagtgtcaatataccatgaacattgtttcatcttgaataataaccggaaagagaaaggcacaaattgcttc

SEQ ID NO: 6299 - DNA, 591 bp, Oryza sativa
  Predicted polypeptide sequence is orthologous to G2207
ggagcgagcggtgcaagcacctcagttcgggaacggtttgaccaagctctagcttacatcggggagacacagagagacgccgatgtgcttgtgcagctctgggtgccagtcaagggcaacgatggtcagctggtgttgacgacgagcgggcagccattcactctcgatcagaggtccaatagcctcatacagttcagggaggtttcgaggaagtaccagttctctgcagatgttgcttcaggttcctcacctgggctaccagggagggtgttcatcggtaggcttcctgaatggtcaccagatgttcgatacttcaccagctatgagtaccctaggatcagccatgcacaatatttggatgtccacgggacgatggggctgccggtgtttgagagggggaactactcatgcttaggtgtcatcgagttgatcatgaccaagcagaagctcaacttcacctccgagctcaataccatttgcagtgctctccaggcagttaacctgacaagcacagaagtttcaagcattccgcgcacaaagcttaacagtgcttcctacaaagatgctttaccagagatactagaagtcctg

SEQ ID NO: 6300 - DNA, 1326 bp, Oryza sativa
  Predicted polypeptide sequence is orthologous to G2213
atggagatgcacgagtgctgctactacggcggcagcatcggcggcgactggctcaacccactcgccgccatcccgccgccgtgttcttcctcttcttcttcgtggtcgtcgcagcttctcctcctcagtgatcacgatgacgtactcttgcactccgccggcgatcatggcggcgcggtggccggaataggcggcgcctgcatgaccgccgatctcgttgtcagggacgaggagatggagatggccgccggctacctgccggtggccgcgtcggccgccgccgccgccgacgtcgaccactacatgtaccagcagtttcagctcgagcctgatcagttcgtctcgacgttgcccgcggtggcggtggcggtggcggcgacggcgggcggcggcagccacgacgacgagctcctgaggatgcccttcaccgacatcgacctcgacgcgttcgccgacgcgcgcgacgtcgtcgtcggcgtcggcgagcccaagcccagtccccagcacactctcgacgcggcgatcgcgctcccggcggtcggcggcggcggcgcccaccacttcggcacgcaggacgacgacgtcaagttcgacgtgaccaagcaacgcaacgacgccgccctcgccggcgacgactccctgtccatggtgatcgtcgagagctacgagatgggcatgcgacgtcacgccgccgagcaggagcaggagcagaagccaaagatcatcacatcagccgcaacgacattgacgcctcttcctcttcctccaccgccgccgccgccgccgcgcgtgacgaggagccgccgcgacggatcatcggcggcgacggcgggcgggaagactcggctggaccacatcggattcgaggacctgaggcggtacttctacatgccaatcaccaaggcggcgagggagatgaacgtggggctgaccgtgctcaagaagcgctgccgcgagctcggcgtcgcccggtggcctcaccggaagatgaagagcctcaagtccctcatcctcaacgagatggggagcaaggggatgtcggcggcggcgatgcggcgggagctggaggcgctggagaattgctgcgcgctgatggagaggaacccggcggtggagctgacggagaggaccaagaagctgaggcaggcgtgcttcaaggagaattacaagcggaggagggcggctgccgtcgacgtgctcgacctcgaccactgcttcagcttcgccgccggtcattgccaccgccaccaccaccagcagctggctctgccgccgccgccagctgccgccgccgaccaccgtaggagagatttcttcggctactga

SEQ ID NO: 6301 - DNA, 582 bp, Oryza sativa
  Predicted polypeptide sequence is orthologous to G2226
ccacctcgctcccccgtaaaacccgaaattacaatcaggtcctcggcggacgccacccccaaatctgaaaccctcgccgccgccgccgccgcgcgatcccccccggaattccatcggatcggcccccgcctctccggcgagatgggcatctcgagcatgccggcgcccaaggacagcgtggtggcgtacctgctgtacaacacggcggtgtcgatcgccatcctggcggacatggtgcgggcggcgctggtgttcctcggcctccccgtgccgccctcggcgtgggaggacggcgacgaccagctggcggcgatcgcggcggccgccgcggccgcggccgcggcggcggggggcccgagcctggcggacaggttccggagcaggttcaggccggcgaggttcgggcggcggcgaggcgggggcgcgggcgcggcctactgccgcgtctgcctcacgcggttcgagccggaatcggtggtgaaccgcatcccctgcggccacctcttccaccgcaactgcctcaagaagtggctcgactacgaccacgccacctgcccgctctgccgccaccgcatcctcccc

SEQ ID NO: 6302 - DNA, 609 bp, Oryza sativa
  Predicted polypeptide sequence is orthologous to G2226
gggggggaggacgcggccgtggccgtgtcggtctccgcggcggcggcggcggcggggcccagcctggcggacacgttcagggcgaggttccgaccggcgcggttcggccaccggcgctgcggcggcggcgcgacggcggactgccgcgtctgcctggtgcggttcgaggcggaggcggtggtgaaccgcctcccctgcggtcacatcttccaccgcgcctgcctcgagacatggcttgactacgaccacgccacctgcccgctctgccgctcccgcctcctcgccgcctcctcctcgccgccggccgccgccgccgccttggcccggacttagcgagtggattcgattcgactcgattcgattctccgacgagccgccccgcgctggctacgcgccaccgtctccgggtggcctccccgtgtgggcgtaggaaactagagagagagctctttgccttttttgcactttcacccctcactttgtcccttttttttccgtttcgggcggtttgtgcctgtaccgtgtaaatacctcgcagcaagagagtgctcctacgggtgtagcactttttgtgagctttgtgtataaaaccttctcggaatagcaacc

SEQ ID NO: 6303 - DNA, 992 bp, Oryza sativa
  Predicted polypeptide sequence is orthologous to G2226
gtaccatctcccgtgtcctcctcccacctcgctcccccgtaaaacccgaaattacaatcaggtcctcggcggacgccacccccaaatctgaaaccctcgccgccgccgccgccgcgcgatcccccccggaattccatcggatcggcccccgcctctccggcgagatgggcatctcgagcatgccggcgcccaaggacagcgtggtggcgtacctgctgtacaacacggcggtgtcgatcgccatcctggcggacatggtgcgggcggcgctggtgttcctcggcctccccgtgccgccctcggcgtgggaggacggcgacgaccagctggcggcgatcgcggcggccgccgcggccgcggccgcggcggcggggggcccgagcctggcggacaggttccggagcaggttcaggccggcgaggttcgggcggcggcgaggcgggggcgcgggcgcggccgactgccgcgtctgcctcgcgcggttcgagccggagtcggtggtgaaccgcctcccctgcggccacctcttccaccgcgcctgcctcgagaagtggctcgactacgaccacgccacctgcccgctctgccgccaccgcctcctccccgccaccaccgagtccccctcgccgtcgccggcgacggcgaccccccatttcgcccggatttagagagatctccccccttcaatccgccactgggccgtgtgcgcgtaggaaaattgagaggatcatttagctctagtgctagctccatttagtgctcctttttccccccactttcttaatttttttttcacctctttgcagtgtttttttttaccatcttcgagtggccttttcttttcttttctttctttttttacttctttgtgttgctgctgtaccattgtaaatatttgcagagtgctccgatcgatggagaggtgtagcacttgtgtacagggcttttggaaagcgaagagatgagaaggagagaaaaaaaaatcattgccc

SEQ ID NO: 6304 - DNA, 1475 bp, Oryza sativa
  Predicted polypeptide sequence is orthologous to G2227
gtattcccctcctccgcctcccctagtttcctctcctccccgaaacccccaattcgaatccggcggcgaattcgattggggatttcggcgtcctcgcctccgtgggattcctcggatcccgcctcggcttcccgtctcgatctgcgtctggagttttggagcagacgatttgagtttctggttcgatttggtttggtttggtttgggggcgatttggttcaaggcgcggatggcgtcttctccggtgtcgtactggtgctaccactgcagccgcttcgtgagggtgtcgccgtccacggtcgtctgcccggagtgcgacggcggcttcctggagcagttcccgcagccgccgccgcgcggcggcggcgggagcggccggcgcggggcgatgaacccggtgatcgtgctccggggagggtccctgtccgggttcgagctctactacgacgacggctccggcgacgggctgcggccgctgcccggcgacgtgtcgcacctcctcatggggtcgggcttccaccgcctgctcgaccagttctcccggctcgaggcggcggcgccgcggccgccggcgtcgaaggcggcggtggagtcgatgccgtcggtgacggttgccgggagcggggcgcactgcgcggtgtgccaggaggcgttcgagccgggcgcctccgcgcgggagatgccgtgcaagcacgtctaccaccaggactgcatcctgccctggctctccctccgcaactcatgccccgtctgccgccgcgagctaccggcggccgcggcccccgagtcggaggcagatgcgggactaaccatctggcgactcccacgcggtggattcgccgtcgggaggttcgccggtgggccaagggagcagcttccggttgtctacactgaactggatgggggcttcagtaacggcgtcgggccgaggcgggtaacgtggccggagggcgacggccatgtcgatggcggcgaaggtcggattcgccgtgtatttaggaatctgtttggttgttttggtcggagcagtcggccggagagttcatcatcgcagtcccgtagtggctgaacgcagttttctcggtaactcgatctcctattgatagtggtgaataagtaggatttagtataagaagggaacccagattataagttcttgggacttttgatgtaaatgaaaaccttgcgatttttttccactttgtcccgttttaagagtttatttagagatggccacgagcaaaatagcaaacaactggaagttagtttggaaagcaaattaggaggaagaagcacaggacttcatgaaaggaatgacagtgaatttattgggtaaatcaattgttgcaatgttgtagtcagagagaacaaagtgttgttcttacctctgtactgtttgtgtatatactggattgggccaagaagatttctgatttgcaatatcttgttctaataaaatttcagccttttttatt

SEQ ID NO: 6305 - DNA, 1327 bp, Oryza sativa
  Predicted polypeptide sequence is orthologous to G2227
gagatgagcgcgcccccgccgcgcgccgcctacctccgccgcccgcgcgcgcaccacgccaacgacctgcgcctgcgccgcacgcgccgcgccgcggcggcggcggcggccggcgaccgctcgccgttcaaccccgtcatcgtgcttcgccgctcccccgccgccgccggcgacgacgactccctcgccgccgccaccagcttcgagctcttctacgacgacggcgcgggctccggcctccgcccgctcccggagaccatgtcggacttcctcatgggctccggcttcgagcgcctcctcgaccagctcacccagatcgaggccggcggcctcgcccgcgccagggagaacccaccggcctccaaggcctccgtcgagtccatgcccaccgtcaccatcgccgcctcccacgtcggcgcagactcccactgcgccgtctgcaaggagcccttcgagctcggcgacgaggccagggagatgccctgcagccacatctaccaccaggactgcatcctcccatggctcgcgctccgcaactcctgcccggtctgccgccacgagatgcccaccgacgccgcccgcccgcggcccagcaatgccggcacagaggaggagacggtcggcctcaccatctggaggctgcccggaggcggcttcgccgtcggtaggttcgccggagggaggaggcccgaggagagggagcttccagttgtgtacaccgagatggatggagggttcaacaacggcggcgcgccgaggaggatctcctggggttcgaggcagagccgatcgacggagaggagtgccattaggcgcatcttccgcaatgtgttctcgtgctttggtcgcagccattcatcgaattctcaggcctcgtcttcgcattcgaggccggagttgaacgatgcgtctgaccggagcgccgtgttcagccatggctcaagaagccggagcacgagctggaggctcgaagatggccatgccgacgccatggtgcaaagataggcctcaactgaagtaaggaaggtcgtcgattgtttccatttcgcgcatatgtatttagaggaaaagaaatttgtagtagaacagaattgagaattggtgttgtacataggagcagcatcacatctactagtagatgataacttgcagggaagaagatgcccacgatggtgattctgaaatgagcatttgttgtttagagtgatgaatttgctcttgctggtagcaaatgtcgcttggaattctatgattcattcaaattcattgtggcgatgattctttgcatctgtgagaacggaatgaatgaaaccattttgatgtttgc

SEQ ID NO: 6306 - DNA, 654 bp, Oryza sativa
  Predicted polypeptide sequence is orthologous to G2227
atggcttcttccccttcctcttccttctcctcctccccttccgctgccggtgctgcgccggcgtcctcctcctactggtgctacaattgcgaccccttcgtgcgtgccgcccctcacaaagactccgctgtcgcctacccgaactacggcggcggcatcctcgaggagatgggtgcacccccaccgtgcaccgcctacctccgccacccgtgcgcgcaccacgccaaagacctgcgcctgcgacggacatgctgcgctgacgcagtggcggcagccgatgaccgctcgccgttcaaccccgtcatcgtgctttgccgctcccccgctgccgtagctgccggcgacgatgactccctcgccacggttactagcttcgagctcttctacgacgacggcgtgggctccggcctccgcccgctcccggagaccatgtcggacttcctcatgggctccgccttcgagcgtctcctcgaccagctcacccagatcgaagccggcggcctctcccgcgcaagggagaacccgccggcctccaaggcctccatctccatgccgcggggccgcccactcgcccagttcaatcgccggagaggagacagaaaaagtgacgggagtggcatggttttaattttagaaatttcgagtgacatgtag

SEQ ID NO: 6307 - DNA, 1312 bp, Oryza sativa
  Predicted polypeptide sequence is orthologous to G2239
atcactttgccgccgccgccgccgtttcctcctcctccctttccgagagagatggggcggcgcgcgcgctgcctctgcctcctcctcctcctcctcctcgtcgtaggtggcggtttccacgtggccaacgcgcaggcgtcgccggcgccgccacagacgggcacgagggcggtcaaccgcgccgtgtccaccgtcatcaccgtcgtcatcggcgtcttcttcgtcctcgtcttcgtatgcgtcatcgtcaaccagtgctgcgactgcgactcctccgctggcgctggggctgggcaagggcagtcgtcggctgctcggcgccgccgcgggctcgacccggcggcggtggcggcgatcccggtcgtgccgtacgcggaggtcaggaagcacaggagcggcggcggcggcgcgctggagtgcgccgtgtgcctcaccgtgttcgacgacggggacgacctccgcctcctcccgcagtgctcccacgcgttccaccccgactgcatcgacccctggctcgagggccacgtcacctgcccgctgtgccgcgccaacctcgagaagcagccagcgccgtcgccgcctgccgtggagttctcctcctcgcctgctgcggccgcggcggcggcggaggagtcgcgtacgcccgaggccgcggcggtgcgggttgaggaggtggcggaggcgagcgacgaagaggagacgaggaggagggaggaggaggccgtggagctggagagtctgcgcgccgtgcggcgggcggcgaggatgccgaggtcgaactcgacggggcactcgctgtgcgcgctgccggcgccgcgcgcgccggggccgggcgacggcggtgaccacgagaggttcacggtgcggctgccgccgcacgtccgggaggaggtgctcaagtcgaggcgcctccggcacgccacgagcctcgtcctcggcatcaggggatcgagccgcgagggcagctcgaggggcggcggcgggagctggcacggcgcgcggcggtggccgtccttcctggcaaggacggtgtcgtgggcgcgcggcggcgtgggagcggacaccagcgcgaaggagacgccatgccgtgatgcggtctgatccgtgcaaagccggcgagattttgtgaaaaaaaatttctctttttatgtagaggaattaatttaatttgttcgcgtgcgaaggctgaaaaaccttgtacatacaccaggttgtttgccatttgaaattattataattttgcttattagtagtaatcgcgtgcacgtaatgtacaaaccgtggcaaatatatttgaaatttcgtttgtttt

SEQ ID NO: 6308 - DNA, 1700 bp, Oryza sativa
  Predicted polypeptide sequence is orthologous to G2239
aaacgcaacgcaaacactcgctcgatcgccacatgccgacgcctcgtcctcgccaccgccaccatgcgctcccgctcgcgctcgcgctcgccgcgccgctgctgctgctagccgcggcggacgggcagccgaacgagtcgagggacaagaacaacggcggcggggaggtgggttcatggcgcccagcggcggaggcggcggcatgggctctcagtcgccgagcttcagtgcgcccatggtggtgctcctcgtggcgctcatcgcggccttcttcttcatcgggttcttctccatctatatccggcggtgcggcggcgaggcctccacggggccgaccatcccggccgcggcgctggcggcgctgtcgcggcaggagcagcggagccggcggcagcgcgggctcgaccccgccgtggtcgagtcgttccccaccatgaagtacgccgaggcgagggagctccgcgacggcggcaaggacgccgtgctcgagtgcgccgtctgcctcagcgagttcgacgacgacgaggagctccggttgctgcccaagtgcagccacgccttccacccggactgcatcggggagtggctcgccggccacgtcacctgccctgtctgtcgatgcaaccttgcgcccgacgcggcggcggcggaagcgaacgtcgtctccggcgaggtggatggggagcagcaggaggaggaggtggtggtggccatcgacgtggaccgcgagggcgaggaggaggacgaggagaggcggagggaggcgatggagctcgagaggatcggcagccagcgccgcgcggtgcggtcgaggtcggggcggccgctgccgctgccgcggtcgcactcgacgggccactccctcgccacgacgcggctcggcgacgccggcgacctcgagcggttcacgctgcgcctgccggagcacgtgcgcagggagatggtcgccgccgccggcgaggagagcctgcgccgcaccgccgtccgggaaggccgcgtcggcggcggcgcccggagcgcgcggatcgggcggtccgaccggtggccgtcgttcatcgcgaggaccttctcctcgaggatcccgttctggtctgcgtcgaggagggtactcgacgccgcggaggccggagctgacgccgccgccaccaccaccaccacgacgccaacgtcaacggcgaggaccaagcgtgacaagacggccgccgccgcagatggctccgtgagctcagccaagggcagcgtccgcttcgactgtctcggcggcggcggcggcggcggcggcccgagcaacagagtcgtcgccttcgccaacgacgacgaggaggatgacgacgagaagccaatcgcccggcaagtttgagctcgcgccatgcgcggtggcggcgccagtgcatgcatcatctgatcagaaaaccaatccgcggcggcttctcgcagcgatccgccatggctggaccttcgatgaatcagctcgtgcacggacacagatcactagaaaagatcatcaatttgagttgaaaataccactcctaaattagtactagattgttaattatacatttttctctccattgcttctttggatagagaagtggcgtggaaacgttcaaagatccaatttttcttcccctccgttgaaaaactggagcggggttgtacttgtaccggcactgtattcaaatattcatgtgattattcgt

SEQ ID NO: 6309 - DNA, 1735 bp, Oryza sativa
  Predicted polypeptide sequence is orthologous to G2239
gactagccaaggcgccctcgcctcccgccgccgaccacgcgcgctatctgcatgccaagttgccgagctaggatgcacgcgcaccagcaccagcacgcgctgctcgcggcgctcctcgcgtgcgcgctcgcggcgtcgtcgtcgacggccggagcgcagccggcggggcagcaggggtatgcctacggcgacgtgtccgggcagcaggtgcacgtcagcacgacgatgatcgtgctgctggccgccgtcgtcggggttttcctgttcatcgcgatctccaccatctacctccgccactgcaccggttacgaccccgcgacggagggcggcggcgtcggcgggagccgttccatgatcctccctgccaacagcttcgtctcgaggcggcagcggcggccgcgcgggctcgactcgtcggtggtccggatgttccccaccatgaagtacgccgaggcgaaggcgctgcgggtggggaaggtcgccggcgccgcgctggagtgcgcggtgtgcctcagcgagttcgaggacgacgagatgctcaggttcctgcccaagtgcagccacgccttccacccggactgcatcggccagtggctcgccagccacgtgacctgccccgtctgccgccgcaatctcgaccctaacaaggacaccaccgaagaggtgatcatcccggccgccgccgccgccgatccgaacagcacctccagtgaaatagttgtgatacggcaagaagacggggcgcacccagcagccgtggtgatcgacgtggtcaccgaggaggacgacgaggagcggaggaaggaggagctagagcttcaggcgataggcacccagctccgcgcgatgcggtcacggtcggggctgcggccaaagacgtcggcggcgaagcttccccggtcgcactccactggccactccctcgccgtccggctcgacggcgacctagagcggtacacgctgcggctgccggagcacgtacacagggagatggtcgcggcgggggagcagagcgtgcgccgcgggaggagactcggggaaggggtcggcatgggcgctcggtgcagcccccggttttcgcggtcgggcagatggtcatcttttctctcaaattctttgtcaggaaagctgtctttcctctccccgtcgtcgaggagaacgccggatagcacccaggtggaagtgtcatcatcctcgtcgtcgtcggtgacgaaggtgaaagggaagcgcgtggccgccgtcgatgttgccgacgacggttctgctcatgggactgcacagtaccctggttgcactgtggccagctcggcggcggcggcggctgtggacgtggagaaggcagctaccaggcaagttcgaacatagaaaacgaacagaagttttgagtgagaaacttgaacagttgaacttgacgtcatgcattttcccacatgaaagaaagaaatggtctttttttgtcggtgggactgtattctgtactctgtactaggtatattatcaacgccgatatgcccaaatattatgggagcacctattgatcaatcaggtgactgcagaatagcaaaggcgaaataatatacatactaggttgaagaaacttagatgcttttttttttttggaactagaaacttaggctgtgtttgagggagaggggattgagaagattggaaagatacgtaaaacgaggtgagtcattagtgcatgattaattgagtattaactattttaaattcc

SEQ ID NO: 6310 - DNA, 1249 bp, Oryza sativa
  Predicted polypeptide sequence is orthologous to G2239
actccattccttccaaaagaaaactcgaaacctccccctctccggccgccggcgagcggctcatccatccaccccaccttggccggagacggcggcaatggctcaccgccggatcgcgctcgccgtcctcgtgacgctgctcttgtcggcgttccgcccttgcctggcgcaacagagcaacgacgacacgagcaaacaccaccggagcgccacggccggcgggttcacgccgaccaccgtcgtcgtgctcgtggctctcatcaccgccttcgtcctcctcaccgtgttctccgtcctcatcaaccgctgcgcccaggcgcgcgctcccccgcgccgggcgttccgcagcacggcgtcccatcagcccgtcggcggcgccgccgccgcgtcccgcgcctcgcgtggcctcgacaaggaggtcgtggaggcgttccccacggcggtctacggcgacgtgaaggcgcgcatggcggcgaagtcggggccgctcgagtgcgccgtgtgcctcgccgagttcgcggacagcgacgagctacgggtgctcccggcgtgctgtcacgtgttccacccggactgcatcgacccctggctcgccgccgccgtcacgtgcccgctctgccgcgccaacctcacggcgccaccggtgtcgctcgccgccgccgagagctccgacctgacggcgccggaggaggcggtgcaggaggaagagtcggaggagctcgacgaggcgtccctgatggccaccttcacgccggaatccgtcatcgacttcggcgcgacgcacgaccatgaattcgacagagcagggtaccctcactaccggaggacgcagtcggccatggacgccgcgccggaccggcacacgctgaggctaccggagcacgtcatgaaggagctcgccgccgaccgcaggcaccggcgcgccgcgagcctcgccgggtacccggacagcgtggagaggacgccgaggtggctgacgtcgctctggcgatcggtgtcgtggcagaggcagagccgggcggactgggacgccggagaggagcacggcggcagcaaaagggttcacccggtcgccggagctcaggacgagacacccagcgggtccggctccgatgggagcaaggagaactccgattctgacgcgttaaaccgagtttgaattttgttttctcctcttctttttttttcttgtgcttcgttctaattgtgcagcggtgtagtaatacaaattaacgataaactaccttgc

SEQ ID NO: 6311 - DNA, 1242 bp, Oryza sativa
  Predicted polypeptide sequence is orthologous to G2239
atggggtcgccgcgaggacgccgccgcggcgacaatggccgcctcctcctcctcgccgccgccgccgtcgtcattgcctcgctggtcggcggcggcgcggcgcagccgacgacgtccgggcccggcccgaactacttcaaccccaagagcttcaacccgtccatggccgtcgtgatcgtggtcttggtcaccgccttcttcttcctcgggttcttctcgatctacatccggcgatgcgccggcgggccgttgggtgggcccggggggtatggcgtcggcggcggcggcggtggacgtgtgggtggtgggttcacgtttgcggcggcgcggtcgaggagggtgagggggcttgaccccgccgtgctgggcgcgttcccgaccatggcgtacgccgacgtgaaggcgcacaaggccggcaagggcgcgctcgagtgcgccgtgtgcctcagcgagttcgacgacgacgagacgctccggctgctgcccaggtgctcccacgcgttccacgccgactgcatcgacgcgtggctggcgtcccacgtcacgtgccccgtctgccgcgccaacctcgccttcgacgccggcgtcccgccgccgccgctggcgccgccgcatgcgttgaccaccgggcaagatgttgcggctgcgccgccgcagccggcggcgccagagcaggtgacggtggacgtcgtcgtcgcggatgccgaggagacggaggagaggatcaggagggaggaggcggccgagctgatgcggatcggaagcgtgaagcgcgcgctgcggagcaagtccggccgccggccgccgcagttcccgcggtcgcacaccacggggcactcgctcgccgccgccgccgccgtgcccgccaccgccgacgacgccgcggagcggtacacgctgaggctccccgatcacgtgctccgggaaatcgtcacctcggcgaggctacgccgcacgacgagcctccaatcgttccgcaccaccgccgccgccggcggcggcgcccgcgccgggaggagcgtccggctcggccagtccgggaggtggtccaacgtgtcgtcgctgatgcgcacgttctcggccaggctgccggcgtggggctccgctcgacgcggcgccgaagccgactctccggggaaggacggcgccaaggtcgccggcgactgcaccgcctccgtggagcaacactgcgacggcggcggcggcggcgcgtgcccacgtccacttggtgaccatgtatga

SEQ ID NO: 6312 - DNA, 1164 bp, Oryza sativa
  Predicted polypeptide sequence is orthologous to G2239
atggggacgcgcgagctcctcgtcgttcttgccgtcgtcgtcatggccgccgtcggcgccggcgcgcagtcttcttcggcgtcgccggcgccggcgacgtcgcaggcaccgacggtgcggcagcagacgccgttcgggcggaccatgtcgaccgtcatcacggtgtccatcagcgtgttcttcttcctgctcttcttctgcgcgtacatcaaccagtgtcgcctcgccgaggccggggacgccagggccgcggcggcggcggcggccggcgggggagccggaggagggccgtccaggagagggaagcgcgggctggacccggcggtggtggccacgttcccgatcgtgccgtacagggaggtggtgaagcacaagatcggcaagagcgtgctggagtgcgccgtgtgcctgacgtcgttcgacgacggcgacgacctccggctgctgccgcactgctcgcacgcgttccacccggagtgcatcgacccctggctggagtcccgggtcacgtgcccgctgtgccgcgccaacctcgagaagcctccgccgccgccaccgccgccgccggcggcggcggcggcgtccccttcgccggagcggtcgccgcggtgccagccttcgccgccgccgccgccgccgccgcacgccctggtgataccggtggaggacgaggaagacgacagcgacgaggacgacaggaaggaggaggccgtggagctcgagatgctgcgcagcgagcggcgcgccgcgaggctgccgaggtcgcactcgacggggcactcgctggtcgcgtcggcggccgccgccgccgagtccggcgaccacgagcggttcacgctgcggctgccgcagcacgtgcgggacgaggtgctccggtcgctccgcctccgccacgccgccagcctggtcaacctctcggacatgagctccgaggggagctcgaggggaggacggcgtgcattaggcctcgccttcggcaacggcggcgggagcagccacggcggccgccggtggcaggcgttcttggcgaggacggtgtcatgggcgcgaggcggaggcgacggctcggtgcgcaggggctgggacggctcgacgagaagaggaaaagatgacgccgagtcgagcagaaagggggcgacctcaccggcggccggccggccgtga

SEQ ID NO: 6313 - DNA, 1179 bp, Oryza sativa
  Predicted polypeptide sequence is orthologous to G2239
atggcgccagctcgagtccacagcaatggccgcctcctcatgcttctcctcctgctcgccgtcgccggctttgcggcggcgcagccgagccaggacaatcctccggcgggctactacgcgaccaacttcagcccgtccatggccatcgtcatcgtcgtcctcatcgccgccttcttcttcctcggcttcttctccatctacgtccgccactgctacggcggccgcggcgactactcgaccaccccgctgccccggtccggcgccgcgcggtcgcggcggcagcgcgggctcgaccagtccgtgctcgcgacgttcccgaccatggcgtacgccgacgtgaaggcgcacaagtccgtcaagggcgcgctcgagtgcgccgtctgcatcagcgagttcgacgacgacgagacgctgcggctgctgcccaagtgctcccacgtcttccaccaggactgcatcgacacgtggctcgcgtcgcacgccacctgcccggtctgccgcgccaacctcgtcgacggcgcgtccgagccggcgagcgatgtcgccgccgagctaccgacggcgcccgctccgcgcccggaaggcgcgacgccgtccgaggcagcagcgccagggggggaggcgccggcggcggcggcggcggcggcggtggtgatcgacgtggaggagaccgaggaagagaggatcataagagaggaggcggccgagctaacgcgcatcggcagcctgaagcgcgcgctgcgctcgaagtccggccgcgcgcccgccgcgcgtttcccgcgctcgcattcgacggggcactcgctctcctcctccgccgcggcgagcgccggcgccgagaggttcacgctgcggctgcccgagcacgtgctccgggaggtcatcgcggcggggcagctccagcgaacgacgagcctcgtggcgttccgcgccggccgccaggggagcacgcgccgtggcctcaggtcgggaggcggcggcggcggcggtgaaggcagcagccgcgccgggagaagcgtccggctcggccagtctggacggtggccgtcgttcctgccgcggacgttctcggcgaggctgccggcgtggggatcaaggtcgacgcggaggggcgacggcgacgggtccagcaagggcggcaggactgccggctccggcgccggcgccggcggcaagtaa

SEQ ID NO: 6314 - DNA, 638 bp, Oryza sativa
  Predicted polypeptide sequence is orthologous to G2239
tgcggagcaagtccggccgccggccgccgcagttcccgcggtcgcacaccacggggcactcgctctccgccgccgccgccgtgcccgccaccgccgacgacgccgcggagcggtacacgctgaggctccccgatcacgtgctccgggaaatcgtcacctcggcgaggctacgccgcacgacgagcctccaatcgttccgcaccaccgccgccgccggcggcggcgcccgcgccgggaggagcgtccggctcggccagtccgggaggtggtccaacgtgtcgtcgctgatgcgcacgttctcggccaggctgccggcgtggggctccgctcgacgcggcgccgaagccgactctccggggaaggacggcgccaaggtcgccggcgactgcaccgcctccgtggagcaacactgcgacggcggcggcggcggcgcgtgcccacgtccacttggtgaccatgtatgatgacgtgtcccgctgattgttagtcaaagtattagaagtactccactaatattaggaaggcgtccttgtcgtcaccgttaattctcttctcttttcggcggcaatttgtgtgtacataaagtcacaaactttattcttcttcgattacaaagtcgcaaaaaaattatgtggttg

SEQ ID NO: 6315 - DNA, 1223 bp, Oryza sativa
  Predicted polypeptide sequence is orthologous to G2251
ctctctctctctctctctctctctaaagattccatctttgatttcgtttctctctctagaaggaaggaaggaggtcgccggcggcgatggggttcccgtcggtgtgctactgcgtgatactgccgcagccgctggtgctggtgctgcagctgctcgacctgctgcgccacgccttcctgctctgcctctccgcgctcggcctcgccgcgccgccgctcccggacgaacaccccgcctacgcgccgcccccgccgccgccggcgtcgatggcggccctccccgccgacctcgtctgggcgttccagcccgcgccggagccggccgccatcaaggcgcgcctccccgccgtccgctacgccgacttcgtcaggtgccgccgcgccgccgcggcggccgcggcgtcgtgcgtcgtgtgcctcggcgcgctcgaggcgcgtcaccgggtgcgcgagctcggcaactgcgcgcacgcgttccacaaggcgtgcatcgacaagtgggtcgacaagggccaggccacctgcccgctctgccgcgccgccctcctcccctccgccgacgacgccgacgccgccgccatcgccgccaccaccaggcaccacctcccctccttctgatccatgtcgccaagaacccatcttgcttagcacccaacacccccttccaccccaagagcaacaagggttccctcctcctttctccaccaatggatcaaatccaatcaaaatggaagaacacacaacacaagagaagagagatagagagagaaatcaatggaggaagaagatgagaggagagagagggggtgtgtgtggtggaggagtattattggtaggtgaggcactaattatgaggaggacaaggatggctacctgcactgcattggatctggtgaatttcagccctagctagctatagatccaacatctcctctcttcccttctcttctcttctcttcacttcacttcacatcaactttttctttgcttttcttttttctactttactttcttcttttgttgccttcacctcctttttgaaattttgctttctttctctttaatttttctccctctttttccttcttttttttgagggtttcctctccccttgtcattaacttaatttgtaaggggggattaagagagagagatgtgtacatacctgcctccactttgacaaatatcggaataataatttataatgatgatgatgatgatgat

SEQ ID NO: 6316 - DNA, 1039 bp, Oryza sativa
  Predicted polypeptide sequence is orthologous to G2251
gtcactcgtcaccatcctccccctttgctttccacgactctctttcgccgcagtctctgcttccgtgcatccatcggcgttcggcgactcggtgtatagtagtattgccaactgtgcgtagcaagctcgatacagcggcgatcatggggttccctctggtgtgctactgcatggcgatccccaagccgctcatcgccttggccaagctcctcgccgccatcagggaggccctccagctgatgctcttcgtcgtcgggatctgccaccacccggagcgatcgggccgcccggctgccgtcgacgccccgctgcccgacgaggtgaaggaccgcctcccgcccctcgagttcgcccagctgctcgcggcctcggagcacggctgtcatggctgcgacgacgacgaggcggtggcggggtgcatcgtgtgcctggagaggctggaggcggatgacgtggtgcggcggctgggcaactgcgcgcacgcgttccaccgcggctgcatcgaccggtggatcgacctcggctggttgacgtgcccgctgtgccgctccaccctgctgccgcgcgcgcgccccgccgccggcccgcgcgggcgactgggccgcctcgccacccgcctcacgggcgtcgtttggtgaatcaatatttggcccgcgcgaccgcgacgcgacacgggatcggttgggtgggagggcagtcgcgccatttcacagcctaagctagcttactgctgctgttaatcaacggagacaaagctctctttccctttcgtttcctttttctttttctgccgaggattatccagctggaggagagtggtacgtgtcggaatgcggtggaatatatcgatgattagacggtaggaacaattaattagaagcaggcaagcagctggttggttggcccggcctggcacctggcatgatcattgggaggttcatgtaattactgcgatgattagatactgcatgtaagtaaatcatgtcatagagataatacacctgtgtacagtggtataatgataaacggttcatttggt

SEQ ID NO: 6317 - DNA, 1276 bp, Oryza sativa
  Predicted polypeptide sequence is orthologous to G2290
accgcagttcactgcactctcctctacaagcggatcaccggagaagagatcgatcggtagccgtagcacggcacggtggttgatcggcggcggccatggccggagcggagtggtcgccgttcgacggggacgccgccttcgcggagtactcgtcggcggtgctggccgagctcggcgggtgggcggcgccgggcgaggaaggcggcgcggggatgatggtaccggcggcgctggatctgccggtggatgtggtgggggcggcggcgcgggaggaggaggaggaggaggaggaggcgccggcgagatcgggcgacggcgccgccgccgccgcgtcgtcgagctctagcggggagcccgccgcccccgacaagcgaccggccgccgccgaggcagcgccggcggcggcggcgacggcgacggcgacggcgaagaaggggcagaagagggcgaggcagccgcggttcgcgttcatgaccaagagcgagattgaccacctcgaggatggctacaggtggaggaagtatgggcaaaaggcggtcaagaacagcccattcccaaggagctactacaggtgcaccaacagcaagtgcactgtgaagaagcgcgtggagcggtcttccgacgacccttccgtcgtgatcaccacctacgagggccagcactgccaccacaccgcctccttccagcgcggcgtcggcggcgccgccgtcgcggcgcacatccacggcgcggcggccgtcgccctcgccgagcaaatgtcggcgttcgtctcgccgccgccacagccgcatatgctgtacggtttaccccggttgcacccgccgtcctccgagaccgccgtcagctgctcgatgccgacgacgacgtctttgcaggagctgaacaatagcgaggggctacaacgccctggctataataatagcccccaggcggcggtgaccatcgcgcagcggccgccgtcgccgtcggtgcctccggctgtttcgtttgacaaggggctacttgatgatattgtgcctcctggagttagacttggatgacaatactcaaatatacatgcatggtaagttggtaagtagctacacaatggacctcattaattagaattattagcagatgttaaattgtatatgttcttatgatactgctaacgaaatctggaagttggaactcacgaaaatttagacactcctaaattaagttgattcttactcctatgtaagagactgcacactaatagaatcaaattttataattgttcttactcgcataaaaa

SEQ ID NO: 6318 - DNA, 1070 bp, Oryza sativa
  Predicted polypeptide sequence is orthologous to G2290
gcactactagctagctgctgctcctccggctggccggccggccggagtgtgccatggccatggcgggcgccggcgactggccgttcgccgccgacgaagcgtacgccgactcgtcggccatattcgccgagctcggctgggccaacgggctcgccgtcgtcgacgccgtgggggagctactgccgccgctggatccaccgggcgagctggccacgccgccgccgccgccgctggatctgccggagacgccggccgggtcctccgcggacggcgccgcgtcgtcgtgctccaccgacgacgccgacggcgggaagccggccgccgcgtccaccgaggcagcgagcaagtcgctgacgcctgggaagaagagggcgcggcaaccgcggttcgcgttcatgacgaagagcgagatcgatcacctggaggatggctatcgctggagaaagtatggccagaaagccgtcaagaacagtccttttccaaggagctactacaggtgcacgaacagcaagtgcacggtgaagaagcgggtggagcgctcctccgacgacccctccgtcgtcatcaccacctacgagggccaacactcccaccacaccgtcaccttcccccgcgccgccgccaccgccgccggcttctcgcacatccacgccatggccgccctggccgccgcacccttctccgcgcaccaacaactgtacagcaacctgcagccgccgccgccgacgatgccgcttgctgctactactccggcgtcgtcgtcgtcgctgctacagctgcctctgcactgcaaccatgagctgcaggttgttgccagctgcggcggctacccgtcgtcgtcgtcgtcgccgccggcgagtgttcttcccgtcgacaaggggctccttgatgacatggtgcctagggcaatgaggcatgatgggtagtacaagcatgcacaccatcgatttaatttggggttaatttgtagcctaattattaatcttaattagctgcttcgatggattaattagcacggtaagtagttacttattcgtgttgagatcactggaaagataataataattaat

SEQ ID NO: 6319 - DNA, 658 bp, Oryza sativa
  misc_feature (19)..(19): n is a, c, g, or t
  misc_feature (111)..(111): n is a, c, g, or t
  misc_feature (155)..(155): n is a, c, g, or t
  misc_feature (159)..(159): n is a, c, g, or t
  misc_feature (183)..(183): n is a, c, g, or t
  misc_feature (200)..(200): n is a, c, g, or t
  misc_feature (240)..(240): n is a, c, g, or t
  misc_feature (243)..(243): n is a, c, g, or t
  misc_feature (247)..(247): n is a, c, g, or t
  misc_feature (254)..(254): n is a, c, g, or t
  misc_feature (281)..(281): n is a, c, g, or t
  misc_feature (326)..(327): n is a, c, g, or t
  misc_feature (494)..(494): n is a, c, g, or t
  misc_feature (573)..(573): n is a, c, g, or t
  Predicted polypeptide sequence is orthologous to G2296
tgagaatcttgtttcggantcgtacaggaacatgggtatgttgctacactgcgcggagggatttacgaacgtgcacgtccattttatccatgtgtataggaactttgatgnttggacattgtaccttcttgagggtgctcaaagtgctaacgccnaacntatctttggtatacggatgttacntaccattttctggaacngctttgcttatttgtggtcagccggtacattggactccgnccnttgngctgagnccccaaaagtattcctccagtggccancctgaaaaattccgtagtgtcgacgttatggtattttgtttctanncccggtagtcccgtccattgtgcgaccggtgaggcgcgaaagcgtatgtgtgtcctacaaatttgtgagtcaccatcccagttggtagctccggccaacctgcaaggacaggtcaagtatccagaggcgactgatcgtaccgtgagttgtccgcatggtagccttgntcactgtacccggattgttattggtgagagtcatttgtgcaccattcttgggcaacctgtgtacatagtcatgcatatntgtatggatcatatggcgtcagaatcatcagataatataattgagacgttttccagttaaaaaaaaaaaaaaaaaaaaaaaaaaa

SEQ ID NO: 6320 - DNA, 729 bp, Oryza sativa
  Predicted polypeptide sequence is orthologous to G2296
atgtggatgcaggaagggcatccaacatgtgtcaaccttacgcctataccacatacagatggccatctctggaggaagtatggagagaagaaaatcaagaactcatcgttcccaagacgttggtgtaaaactgtcgcgatctacaggctatactaccgatgctcttaccgggacgacaggaattgcatggcgaccaaggtggtgcagcaggagaacgacgccgacccgccactctacagggtcacctacattcacccgcacacctgcaacccatcgccgccggccccgacgccggcccatgtcttcaccgagccaccgccggccaaagcggaagtacaccacgcggtgttgttcaggttcagctccactgccggcggccacacggccaataatgcagtgcatcgtcagcagtggcagcctgcggcggctacgatggcggcgggggcccaggcgcagctgtcaatgacgatgagcgacgacgagcgggagcagccgccggcggccatccgttctgcgccgccggcacggcggctgtcgatgttccgcgccgtcgttgatggactcaggcagatgcggtcgtcggcgccgccaacaccgtcgtcgtcgatggtggtggacgacggatgggacacgttctcgtcgtttgatttggatacgtgcgaattcagtgtcgatgacgagttgctctgtggtgaccatatgtatttcccggacagtatgcagcaatag

SEQ ID NO: 6321 - DNA, 1219 bp, Oryza sativa
  Predicted polypeptide sequence is orthologous to G2311
cagaccatagagaaacccaaactagggtttctggtcggatagttcagacgccggagagtgcaggaggcggggggggcttgtggggaggaggcgcgcggagatgggcgccccgaagcagaagtggacctcggaggaggaggaggcgctgcggcgcggcgtgctcaagcatggccccggcaagtggcgcaccatccagaaggatccggagttcagccccgtcctctcctcccgctcgaacatcgacctcaaggacaaatggaggaatttgagttttagtgcaagtggactgggttcaagggataaattaaaggttccaaggataaaagggccttcatcttccacatctccaagctctcagactccgcttctcgtcctacccccaaataaagttgctgaggcttcaccatccgcagatcctgagaaaagctctcaggatgtgaagattccaaattccatggtaatagaagctctttgtgaaattggggatccaaatggttcggatgttgatgcaatttgccactacatagagcaaaggcacgaggtgcaagcgaattttagaagattgcttactgcaaaattaaggaggcttatagcagcgaaaaagattgaaaagattgacaggtcctataggatcacagaatcttatgcagccaaagtttcgcaagcaaataagtctccaagtccaaagaaggatccagccaagccactgaaggcatcgcagaatttaggttcatttgctggtacgagtcctgccctagaagcagctgcagctgcagctatgaaagtggctgatgcggaggccaaatcacaccttgcgaatgagcacatgacggaggctgaaaggatcttcaagcttgctgaggagaccgagtctctcgttacactcgcaacagagatctatgaacgatgttcaagaggagagatattaacaataatgcaagtggcgcaaagcaattttgaattccaatctgttagcggcaacggcagcggcactggttctactgtacttgcataggttggtttgccctgtcatctttggcatgttgttcctccgatgtgtaacttaaaacatgttgttaacttgttatgtacttgggtcgagccggataagacgtttacctcaaaaacgtcaggtgttccgctcatccttaattataattatataaatgtgcatctctcttgcgattgcaagtgtgatcaaagacaaaaaaaaaaaaaa

SEQ ID NO: 6322 - DNA, 612 bp, Oryza sativa
  Predicted polypeptide sequence is orthologous to G2319
gcacgagggtagccatcttgtgtatcgaatagctatagctctccagcagattgatcagtgacgacgacgacgatggcggcaatggcggcggcggcggcggggacgaagaagaaggcgaggaagccgtacaagatcacgaggccgcgggagaggtggtccgccgaggagcacgagcgcttccttgacgccctgattctgttcggccgtgactggaagaggatcgaagcgttcgtcgccaccaagacggtcatccagattcgcagccatgcccagaagcattttctgaaggcccgcaagttcggcctcgccggtgggctcccgccgccgcttcaccctcgccgtgccacgctgctccgggccaacgccgcggcggcggacatgatgccgcccccgtggctgccatcggccggcggcggctccatcggttgctcggcgccaccgtccggcgtgcagcagagcatggccggcaggtcgccggcgtgctactcaactgatgaagcttctttccggccattgattcatagcaatgacaatgactgttcattcatcgagacaccaaactgcatcggatccggtggcgaatcatggatcggtgatgatgccttcttcatg

SEQ ID NO: 6323 - DNA, 468 bp, Oryza sativa
  Predicted polypeptide sequence is orthologous to G2334
tttttttttttttttttatcgtcgactcgacccaaccggatcgagcgccgccgccgccaagccgccaccaattcaattcatcgatgattcgagtcacggatacattgagtgttttataccgtatcccttctctctctctctctctctctcttacagccaaacagtattacagctggcgaattctttcccctattacaagaaagatgttacttggcccacattggcccactatagcgagggttaggaacacgagctcgaatgggcttctttgctgtagcgcttgaagtctcttctatctcctgctctgctgctatctccagttctactgcattgttctcctgttctccatcaggcaagatttgaaggtcgagggggcaacggcgatggggacgactgtggagacatcggtagccctcttaagtcggcggtagcgtcgagggggttggctcctcagtaccatcggatgga

SEQ ID NO: 6324 - DNA, 1729 bp, Oryza sativa
  Predicted polypeptide sequence is orthologous to G2343
gaagagaaggtagctcatgcatattaaaagggctaaacaccaaccaaaccctttgctcctccatgacaacaatgtcatgttgctagcagctagatcaagaatatattcaagatagttaattgctgcatataggttttgcaagttgcagaacttgcagctatattgttgttacactagctgttcatatcttggattccagtgatatctagagtgcatgcatggggcatcactcttgctgcaaccagcagaaggtgaagaggggcctctggtctcctgaggaagatgagaagctcatcagatacatcaccacccatggctatggctgctggagcgaggtcccggagaaagccggtttgcagcgatgtgggaagagctgccggctccggtggatcaactacctgagaccggacatccggcgagggcggttcacggcggaggaggagaagctcatcatcagcctgcacgccattgttggcaacaggtgggcccacattgccagccacctgcctggccggaccgacaacgagatcaagaactactggaattcatggatcaagaagaagattcgcaagccggcggcggccgccgccgcggcgaccacgacgagcccgaacaacccgccgccgtgcagcacggcgacgtcggaccaccaccacctgccgccgccggcgttcggcggcgctgatcaccacctgcagctcgacgccatcatcaaccagaacctgatatcatccctgccgccgaagctcgccaccggcgacgactcgccgccggcggtgcccgggctgccgcaccactgcccgctcttcatgttcgacaccaccaccaccggcgccggcggcgccatcagcccgccgccgccgtcatcactgatcccaacccacctccaccaccaccaccacccgttcatcgccagcttcacggcggcgatggccgccgacacgccgagctacctgcccccgctggtcgacggcatggcagccatgggagcggccatggattgcagcttagaagatggccaaacagccgccgccatggccgccaccaatggctactaccagcatcatcagaagcatcagcagctggagattgagctggaggaggaggagcagaggcagctagggcatcatcatcatcagcatcaccatgagcatgagcatgaaaatcatcagtgggatgaagaagaagcacagcatctgctgatgtgggatcaagaagtactaacatcatccaacttggaggccatgcaaagtggtgctcattccctcctttttatgggaccaaatgaccatgattaagttggtaataataacctatgtctaccccccccccaattttttttctttttgggaaaaaaaaacttgcatgtgcatattttgcatctcacaacatctgatcccatctctgatctgatcttgatctccctttgatcaatctagctctcactactaccccatctgatctgtctatacatgaaataatgaggttttgcaaattaaaggcgcgcgtaatttattgtgttttggattttttttctatctctctccaagagcttttattttggtttttttacttttttttttggattggagtgtgaagactgaatagtgtgtgtcaattgggttttttgtaaagagaccaccttgtatgagtgcatggcatggcactttggagtgtgtaatttgattgatgtatctaagtgaatttataataaacacaggaggatgac

SEQ ID NO: 6325 - DNA, 494 bp, Oryza sativa
  misc_feature (52)..(52): n is a, c, g, or t
  Predicted polypeptide sequence is orthologous to G2346
tttttttttttttgtacaatcctaatttcactcacctccaacaacaatgatncggttgtacatcacaatttacataagacaatttacataagattctttgttatacatcactcataactccaaagttcacttgtctactacttcctctgtttcacaatgtaagactttctagcattgcccatattcatatagatgttaatgaatctaggcatatatgtgtctagaatcattaatatctatatgaatatggatctagaaagtcttacaatatgaaacggagggagtatcagttagcagatcaatgaaccaactatgacacaattgtagaccagagaatattttagaaattgacaacattacagctacgattgaacaaatgctaagaaggataaagaacacataccagccttatgtcctcttcatttgagtagtaactcttaccttttggatcaacaacttctagggaccaccacacagtgctggcgtgtaaatct

SEQ ID NO: 6326 - DNA, 2917 bp, Oryza sativa
  Predicted polypeptide sequence is orthologous to G2348
ggtcctagtcatcggacgccgcccacctacccgactacccgaggcagcctctctctcctccctcgcccaccaccacacgacacgagacgagaagactgattcattcgctcgcgtacacgcctaggcgctccgagaattcgtgagggaatcccgcatcgccggagccgatcggcggcgccgcgggcgggtggggggggggggttagggttagggttttgggggtggcccaccggggatggacgcccccggcggcggcggcggcggcggcggcggcggaggtggggtggatgccggcgagcccgtctgggactgggggaacctcctcgacttcgccgtccatgacgacgactcgctggtcctcccgtggggggacgattcgattgggatcgaggccgatcccgccgaggcggcgctgctcccccctgccccgtcgccgcagccggcggaggcggaggcggaggccgcggggccggcgtcgctgccgtcgtctatgcaggcggagggaagcaagcggcgcgtgaggaagcgcgacccgcggctggtttgcccgaactacctcgccgggagggtgccgtgcgcgtgccccgagattgacgagatggcggccgccttggaggtcgaggacgtggccacagagttgctggcaggggcgcggaagaagccgaagggtgccggccgtggtagtggtgcggcagtcggcggaagtggtggaggggctagccgtgggacaccggccgagatgaagtgccaggtgcctggttgtgaggcggacatacgtgagctgaagggataccaccgccggcacagggtgtgtttgcgctgcgcgcacgccgccgctgtcatgcttgatggtgtccagaagcgctattgccagcagtgtggcaagtttcatatattactagatttcgatgaagataaaaggagttgtagaaggaaattggagcggcacaacaaaagaagacgaagaaaacctgattccaaaggcatattggagaaagatatagatgaccagttggatttttcagcagatggtagtggtgatggtgaactaagagaagagaacatagatgtcactaccagtgagacgcttgagactgttctgagcaataaggttttggacagggaaacacctgtgggttccgatgatgtgcttagttctccaacatgtgcacaacccagtttgcaaatcgaccaaagtaaaagcttagtgactttcgctgcttctgttgaagcctgccttggcactaaacaggaaaacaccaaacttaccaattctcctgtgcatgacacaaagagtacttactcatcctcgtgtcccacaggacgtgtatcattcaagttgtacgattggaatcctgctgaatttcctcgacgcttacgccaccaaatatttgagtggctttctagcatgcctgttgaactggagggctatattcgtcctggttgtacaattttaactgtatttgttgcaatgccacaacatatgtgggacaagttatccgaagacacaggaaatcttgtcaaaagcttggtaaatgctccaaatagtctcctgttgggtaaaggggccttctttatccatgtcaataatatgatatttcaagtattgaaagatggtgcaacattgaccagtaccagattagaggtacagtccccgaggattcactatgttcatccatcatggtttgaagcaggaaagcccatcgatcttattctttgtggaagttctcttgatcagcctaaattcaggtcacttgtgtcatttgatgggctgtacttgaagcatgattgtcgccgtatactgtcacatgagacctttgattgtattggaagtggggaacatatacttgattctcaacatgaaatattccggataaatattaccacatcaaagctggatactcatggacccgcatttgtggaagtggaaaacatgtttgggctatcaaattttgttcctatccttgttggtagcaagcatttatgttctgaactagagcagatacatgatgctctgtgtggttcttcggacataagttctgatccttgtgagcttcgaggacttcgacagactgcaatgttgggattcctcatcgacattggatggctaataaggaagccatccatagatgaatttcaaaacctactgagtttagcaaatatccagagatggatatgcatgatgaaattcctgatacagaacgattttatcaatgttctggaaataatagtgaactcgttggacaacatcatagggtcagagcttctttctaacttggaaaagggtagactggaaaatcatgtaacagaatttcttgggtatgcaagcgaagctcgaaacattgttgataatagacctaaatatgacaagcagagacaggttgatacaagatgggcaggtgattatgctccaaaccagccaaagttgggcatttctgtgccacttgctgaaagtactggaaccagtggagaacatgatttgcactcaaccaatgcagcttctggagaggaggaaaatatgcctctagtgactaaagctctcccacacaggcaatgctgtcaccctgagactagtgctagatggcttaacgctgcctccattggtgcttttccaggtggtgccatgagaatgcgtcttgccaccactgtggtaattggtgctgtggtatgttttgcagcttgtgttgtccttttccacccacacagagtaggggtgcttgccgcgccagtaaagaggtacttgtctaggaactactcatcatagttgaagctagattagattaaccttcctgttgcttttcccctgtatcatatgcatgtacctttctaatttgaggcttagcttgtgcatccgatgttcaaatatttgtaagaggacccacagacataaatgcaaatttttgcagctttttttggc

SEQ ID NO: 6327 - DNA, 1195 bp, Oryza sativa
  Predicted polypeptide sequence is orthologous to G2371
acacaacacaccatcatcatcttcatctcctacctcctctcctctcctctcctcttctccactacccaacttttgctcccaacacatctttgtttcgatcgaccgatcgatcagctctagctcagccgctactcctacgtcaaggagaagcgcctcgacgccggcgacgtcgtccacttcgagcgcgtccgcggcctcggcgccgccgaccgcctcttcatcggctgcaggcgccgcggcgagagcgcgcccgcgccgccgcccgccgttcgcgtcacgccgcagccgcctgccctcaacggcggcgagcagcagccgtggagcccaatgtgttacagcacgtcgggctcgtcctacgaccctaccagccctgccaattcatatgcctaccatcgctccgtagaccaagatcacagcgacatactacacgcaggagagtcgcagagagaagcagacgccaagagcagcagcgcggcgtcggcgccgccgccgtcgaggcggctcaggctgttcggcgttaacctcgactgcggcccggagccggaggcggatcaggcgacggcaatgtacggctacatgcaccaccagagcccctacgccgcagtgtctacagtgccaaattactggggcagctagttgatgagatgatgaggagatctgaggcctttgcttgcagaatcctaaccaccaacagtgaaactagttactactaccaccagcctactactactacactctgaaccaagtgacaggttcgattgaattgacctgttggaagggaaaaaagaagaaggaagtggggggagatcccttgtttcccgggcaatcttccttccatgaatcatcagagtgccccttttcctgggttttttttacattcttgtcttccagaaaccctacttacagtacgggggcccttgcagcaggtggggaggtttcaggaaacatcaggttgaaaaggagagggaggagagagatggtgacacaccatgagaaacaaacaggagagagagagagagaggaaaaattgacatgttttgcaagtatgtatgtgtcatctgtagtatgtgactgtgagtgggtccatgaacaaactgtgaagttgatgtatccttctcctgctgcctcccctgaacctgaagaaacaaagtaataccccaatggggattttgttctcttccccttttcttctacc

SEQ ID NO: 6328 - DNA, 1642 bp, Oryza sativa
  Predicted polypeptide sequence is orthologous to G2371
gtctctacaccgcacaccatccctgctatccctctccagcactagcagcaaaagcttttgccacaaaagagaagtaagctagcagaaatggccatgaaccaccctctcttctcccaggagcaaccccagtcctggccatggggtgtggccatgtacgccaacttccactaccaccaccactacgagaaggagcacatgtttgagaagcccctgacgcccagtgacgtggggaagctgaaccggctggtgatccccaagcagcacgccgagaggtacttccccctcggcgccggcgacgccgccgacaagggcctgatcctgtcgttcgaggacgaggccggcgcgccgtggcggttcaggtactcctactggacgagcagccagagctacgtgctcaccaagggctggagccgctacgtcaaggagaagcgcctcgacgccggcgacgtcgtgcacttcgagagggtgcgcggctccttcggcgtcggcgaccgtctcttcatcggctgcaggcgccgcggcgacgccgccgccgcgcaaacacccgcaccgccgcccgccgtgcgcgtcgccccggctgcacagaacgccggcgagcagcagccgtggagcccaatgtgttacagcacgtcgggcggcggctcataccctaccagcccagccaactcctacgcctaccgccgcgcagcagatcatgatcacggggacatgcaccatgcagacgagtctccgcgcgacacggacagcccaagcttcagtgcaggctcggcgccatcgaggcggctcaggctgttcggcgtcaacctcgactgcgggccagagccggaggcagacaccacggcagcggcaacaatgtacggctacatgcaccagcagagctcctatgctgccatgtctgcagtacccagttactggggcaattcataagaagattgactatgagatctgatctgaggccatgcctgcatgatcataattcataagtcctagcaagcaacagtggaagaactagttgctactgctctgcattcagtgacaggtttaaattgtgacttgtggaaggacaaggaaggaagtgggggggaactcccttgtttcccgggcaaatgcatattccttccatccccatagtgccttttttctaggttattttcttcttcatcttggcttccagaaaccctacttactgtatgggcccctggcagcagacatggatggggaggtttcaggaaacatcaagttgaaaaggagaggggaattgaagagacaggcagagagctgtatgtatgtcagtatgtgtcatctgtctgtatagtgggtccaagaacaaaccctgaagctgatgtattcactcctgcctcctcaggaaacataactttatccccatttcacctcttctactgtgcttgacctgatgcaatcaattgttgatggaccagatgcaattatgcaatgcttccatttgttgcaatccaataggttcaccgattacactgtgtaagaaattaaggagtgcatgtgcaatttattccaactttttagaaatgacttacatggtaatttgtctgaataaatcactatgatgttaatagtatgactaaagaaaactcccgcaaacgacaagcagtaaagaaattacgtt

SEQ ID NO: 6329 - DNA, 237 bp, Oryza sativa
  Predicted polypeptide sequence is orthologous to G2371
atggcacatcagattttggttaatgaatcacaagcaagcaatgtagcaggtggcgctagcactggtacggcagtgaccagcggagacaggaggccagatccatacatgagtgcatgtgaagccatgatgggtatattcctcattgttgtctacaccaatgagatcctagcatttaacagtcgtcaaaggctagacagttttaaagaatctcaaaaatgtgttggtcatgatctataa

SEQ ID NO: 6330 - DNA, 2037 bp, Oryza sativa
  Predicted polypeptide sequence is orthologous to G2372
aagcgatcgattcgagtccccttcccttcctccctaaaccctaaccaaacccccaccactctctttccgcgcgccgcgtgcgacgatggcgcgcccgccagccgccaccgctccgcctcctcctccgccgccgccgccaccgccaccgccaccgatcgaccgcctcgtctggctcgcctgcgccgccccgctgtcccgcatccccgtcgtcggcacccaggtctcctacttcccagagggccacgccgagcagtgtcccgcccctctcccggatccgctcccctccgcccaccgattcttcctctgcaccatcaccgccgtcgacctctccgccgacaccaccaccggcgagccctacgccaccatctccctcctccctcttcgccacgacgcccccgcccccgcccccgcccccgcccccgccgccgccgaattagcagaagcagaatcacaggagttccgctactacgccaagcagctgacgcagagcgacgccaacaacggcggcggcttctccgtgccaaggttgtgcgccgatcacatcttcccggcgctcaacctggatgatgacccgcccgtccagagcctcaccatgggggacctgcagggcgactcgtgggaattccgccacatctaccgcggcacgccgcgccggcacctgctgacgaccgggtggagcaagttcgtgaacgccaagcagctggtggccggggacacggtggtgttcatgtggtgcggggccccggcccccgagaggaagctgttggtcggggtgcgacgcgcggccaggtactcgggcgagtcggcgtgcaacgcgcgggggcgggtgcagccccaggaggtgatggaggcggtccgactggcggcggagcaggcggcgttcagggtgacctactacccgcggcatggggcgggggagttcgtggtgccgcgggtggaggtggataagggattgactactccgtggaggtgcgggatgcaggtgcgcgcccaggtgatggaggccgaggacacccgccgcctcgcttggctcaatggcaccctcactaacctccgccaccaacaaatctggcgcactctcgaggttgaatgggatgcctccgccgcgtcatcttccatgaaaaacagatttgttaatccttggcaggtccagcctgttgatttccctcctcttcccatggggctaaagatttctaacaacaatattagtgcacctgtgtgcaatggggattcactgctggtgccaccgatactaatgcacccgcaacctcaacctcccgctgacattcagggagccaggcataacaatggccatgcctatgcagatataccctcttcatcaacaccatcaatggtgaggactcagcagctgttcccaagggatcttcagattttagttccccacaccgacattgtcactcctcaaaatggatcaccgcccgacaaccccgtaaacacgcctctttctgcatctgacggaatgaagaccatacagctgtttggcgtcacaataacatcacctgtgcaaggagacaccaatggcgctttcgcttcagcacaagtgaatcaggttccagagggtgtagatgatgaaactgctaccgaagaagcttctgacacaagcctacctgactctcttaccaatggccacaatcaagatggtgctaggctttgaaggaatatcccattaaacgtttccaagatatggctggaccagatttgtttctaacattttggtctgttctgtttcaccctccggcagtttgacgggatgtggtgttcttatgcatgcatttaatctggagtttaggctggcaactatgccgcatggtccagttaagtttggagtaatctggagaaacgttcatttctttgttagaattgttatagagcagcactgctctgttttattttccttgaattttcacacctgcactttgtttgcttgttgtttgtttacctgtattgatctgataaacatctttaatttcctggggaaccgttgaactctgctttgctgttgcggctagcttttcc

SEQ ID NO: 6331 - DNA, 201 bp, Oryza sativa
  Predicted polypeptide sequence is orthologous to G2372
atggtgtggatgttggtggcgcactcccgcgtgtactacttcgcacagggccaagccgagcatgccaacggcggcgaggccgcggcggagctcgccacagcgacgggggccgcgcgcgcttccgacgtttgtgctctactgcatggaagggaccaggcgcagcaaattgagtggcgcattgatagtgcccttaggggctga

SEQ ID NO: 6332 - DNA, 1056 bp, Oryza sativa
  Predicted polypeptide sequence is orthologous to G2382
atgggggtgacctgcccgcaaactcgacggccgatccatctcgccgagccacccctatccccggaaccaaaccctagctccccgctcatggacgacggcgcggcgcccgccgccgccgccgccgccgaattaccctcgccgtcgccctcctcctccggcacctccccctccccgcgctccaagcgccgccgcaccgaccgctacgcgcaaggcttcgagttcgccccgcgccccgcccccgcgaccgcgaccgcgaccgctccggcgccgacgcccgcgcgcggcacgcccgagtggtcggagggctccaccttcgcgctcctcgacgcctggggcgaccgcttcgtgcgcgccggccgccgcagcctccgcgcggacgagtggctggaggtctcccgcctcgccgccgccgcggcctcccgcccccccgggtactactcggagcagcagtgccgcaaccgcatcgacaccctcaggaagaagtacaggaaggagaaggagaggatgcgcctcgccgcccgccgccccgaccgccccgaccgcccctcgccttccaagtggatctacttcgacaagatgcagtctctcatgtgcccaccgccgctcccgttgcagccacccgtagtgacgcgccgccgagacacgcagccggtgccgcgccaatcttggggtctggacgccgcggagtacgtgctgggcgggtgtgagaacgcgggaacaagggattctgggtctggtgcggaattgggtgaagagcagccaaacgaggctggtgcagggaaaggggaagactttgagttgctcgtggagtcgattcggaagcttggggatgtctatgagagggtggagagtagcaagaggcagcacatggctgaggttgagtggttgcggagggatctccaaagggatcttgaggtgaggaggagggagattttggagaaggcgcaagcagagattgcgcgtctcactgaggaagatggggaggagggtgacctcaaggagggtgagggtgatgataacaagaggtttggggatgatggtggtggcgaagagtag

SEQ ID NO: 6333 - DNA, 2777 bp, Oryza sativa
  Predicted polypeptide sequence is orthologous to G2404
gattagctaaaactgtgaaaactctccattttccttgcctctctctctccccacccaatcccaacccaccacctctcctctcgccgccgccgccgccgccgccgcgcgccgttctatggcctacacctcctcctccctccacctccacaagcacctcctcctccccaagaccaacccctcctcctcctactcgcggcctccgcctccgacgtgtggtgcgcgcctgggataccgttcgccgcggaggcgtcgtccgtggactgcgtggtggcgcggcaccagatggtggggagaggccgtggcggcgacgcggagaggccgcacagagagagaccgtgcctgtccaggagggtgaccgtgcaggagcagatatcgtcgtcgttcatggactcgccgccgccgccgcacctcgacgtcgcgcccttcttcggcgccgacctcctcccctccggccgcctccgccggatgcgcgggtaccgccactcccccgtcggcctcgaggaagaggtaaaaaacgtcacaggctcacggtagtagcagcagtactagtactggcacagtagcgcacactgcaacaaacgttcgttcgtttcctcgttgcccccacactgcattttgcttgcttgcacacttgtcctgagccaccgcattgcatgcatcggtagatacatttttccaacgtactcctaagtcggagatggacacggcccgcaacaagtgcgcatgctgacagcggttggtggtgcgacacgctgcctgcctgcataagattcccgtgcgtagggtagtttagcgcgtgatctgacatgcgtattaagcagctgtaacgcgtgatatagattaatagtagtagtattagaagtggagtagattgattgtctggtggtgcgcgagtgaacctggggggtggccggctggccgggtgggcgttggaagtggttgacttgcatctttcgtgcgctaaacgtgacgtgagatcgtggccttcttggaggttaactaatcggcagccttacacaggcgcgcacaataattgtataagcggttgcagttgcaagccatggcacctgcattatgcgcgctggttagcgtagtggccgtacactcgtttaggattaatgcggctgagaagggagggaacgagacagtgggatgtggccacagctttggaaagagacctctcaaccatggtcatacacttccatgaatgcttctcgttgtgtgtatacaccgtgccaactacaagtataaatgctggatactcttgctgagctgatcagaaatgttgccggtaatggtcaattgttgtctcaacggtgctagtatttcaggatgcgggcaaggagtgctggagcacacctgggaatgccaagcaatagtatggtttattctatctactgtcatgctgttctgtggtggatcgtacggttggtaggaatgggcatgctggtatggtgcgtgaatgattggttgcctccgatggcagatcgagagtcctagcagttcaccatttatgattagtgctcggctgtgctgcttgactgaactattcttttggtgcttaagggggaccaacgctccttatcatgttcctgttgcttcagtcataatcagatctagagttgtagtcattccttctggtccttctggatttcatgtgggcatgtgattggtgatgactccttaataatagctcaacatcaagatccacaaggattgtcggtcccgcactgccattgcctatcaagatatatatttgaggggatttgctttaatgtgctttggtgcctagttcagggaagtccatttccttacctataaacattttttctatctagttttacttctgtgctatacctctgttttctgacttaggttttccactgtcataagaattcatatttgattttggtgcacattccaaacagtcgtaaagaaagctactatatatttatctggtgcttcaatctaacctttctatgtaatcgtaaagaatataagagatacgtcagtgcagctgtagaagcatatttagctgcacactttgtactctacttggaagaataaccagcccgatggtcagtgattgagggttaacttgtgctaagcggtgcagttgttaatctgtgatcttcctggcagacatatacataattatgcatgttgctagctcaataagcagccttatcaaaggtagcgagttcaaatacttaatgaaactgtttttgatatggcagatcatgatgtttcagacaagagttctgttgggaggaatgagcatgtatgatcggtaccaggattggcgccttgatgttgataacatgacatacgaggagttgcttgagcttggagataaaataggttatgtcaacactggattgcgtgaggatgagatagttcgcaaccttaggaaggtcaaacacccagcctttgactcctcgttccggtattcaacagaaatggaaaagaaatgcagtatttgtcaagaagagtttgaagccaatgaagagatggggaggctggattgcggccacagctaccatgtttactgcattaagcaatggctttctcagaagaacgtttgcccagtttgcaagactgccgttaccaagacttgaagtccggactccgggcaacgacgattgtatacctgggtcaaactttcaaaacatgtttgtttgtgctctgtacagtcaattacatatgttattgtataaacacatcatccattcttttgcatttgcagatagaaatgccatattgaggcatcctttatc

SEQ ID NO: 6334 - DNA, 984 bp, Oryza sativa
  Predicted polypeptide sequence is orthologous to G2404
atggccggcgaccgccgcggcggcggcggcgtcgtctcggccgacggggagcgacggcgggggatccggcgcctgctgctgccccgcggcgaggggtcgtcgtcgtcctcgccgccgcagccgccgccgctgcaggcggaggaggggaggcggaaggggttcgcgtcggcggcgctgcgcgggctgggttgcacgtcggccgcggcctcgcaggcgtacgcgcccggggccggggcggccgcggcggcggccgtgcggtcgtcggcggactggcacgggcggaggcggaggagggggaaggagaagaggaaggagaggggaggaggaggagggggcggtggaggcggccacctcgtgggtggagggatcggcgccgacgtgtggtgcgcgcctgggataccgttcgccgcggaggcgtcgtccgtggactgcgtggtggcgcggcaccagatggtggggagaggccgtggcggcgacgcggagaggccgcacagagagagaccgtgcctgtccaggagggtgaccgtgcaggagcagatatcgtcgtcgttcatggactcgccgccgccgccgcacctcgacgtcgcgcccttcttcggcgccgacctcctcccctccggccgcctccgccggatgcgcgggtaccgccactcccccgtcggcctcgaggaagagatcatgatgtttcagacaagagttctgttgggaggaatgagcatgtatgatcggtaccaggattggcgccttgatgttgataacatgacatacgaggagttgcttgagcttggagataaaataggttatgtcaacactggattgcgtgaggatgagatagttcgcaaccttaggaaggaagagtttgaagccaatgaagagatggggaggctggattgcggccacagctaccatgtttactgcattaagcaatggctttctcagaagaacgtttgcccagtttgcaagactgccgttaccaagacttga

SEQ ID NO: 6335 - DNA, 1095 bp, Oryza sativa
  Predicted polypeptide sequence is orthologous to G2404
atggctcgccgcgacggcgtcggcggcgacggcggcgcgtcggcggcggagcagcagcggagagtagcgctgcgtgtgctgctgtcccgtgcggaggcttcctcgccgccgccggcgacggtggaggaggaggcgcagcgggggaggagcggtggtggtaacaaggggctcgcgtcggcggcgctgcgcgggctcgggtgcacgtcgacggcggcgctgcgtgcccacgcgccggcttcggcggtggaggtggcgagtagctcggagcggtggcacgggaggcggcggcggaggaaggtgcaggagaggcggagcgcgaggggcggcggcggaggaggaggaggaggcgtggcgccgcccggccccgcgccggcggcggccggggacgtgtggtgcacgtgcgctcccgggataccgttcgccgccgaggcgtcgtcggtggactgcgtcgtggtggcgcgccaccaccacgcccaccacacggcggcggcgatgggctccggccgccgcggggaggcggagcggcgccacagagagaggccggccgctcctcgagctcgaagggtgaccatgcgtgagcacatatcctcgtcgctcatggactcgccgccgttccccgacatgccgctcctcaacgccgacctgctaccaccaccaccctccggccgccaccgccatggataccgccacccccacgtcggcgccgccgaggaagagatcatgatgttaagaacacggctattatggggaagattcggtatgcatgatcagcaccaggattggcgactcgacgttgacaacatgacatatgaggagctgctggatcttgaagacagaattgggtatgtaagcacagggttgcatgacgatgaaatcgctcgcagccttaggatggtcaagtattcagcattcaaccccaagcattttgcaacagaagtagaaaggaattgcagtatttgtcaggaagaatttgaagcaaatgaggaaacagggaggctgatctgtggccacagctatcatgtgcaatgcataaagcagtggctttctaggaagaacacctgccctgtctgcaaaactgttgtatcgaagacatga

SEQ ID NO: 6336 - DNA, 1255 bp, Oryza sativa
  Predicted polypeptide sequence is orthologous to G2423
atatcagaaaataccaaaatacagcgtattagattttctacatggtatcagagccgtagacaaacgtcgatcgatcctcggttccagctaggttccatccgcgctgccccagggagatgagatcaatttctccctggggcaccgcaccgcattagctagctagcctctccaatcatttacagattagtttaccgcatatcattagatgcgttttctaataattagttttagatctattagctagccacagaaaaccatatgatcgtcaggagcaatgcggcaggtgttacaggagcagacaacgtcaacaagcatcataccatccggcctcatccatggatcgatctgcatcgccgctgccgactcgtctacatagatggacacctcgcgtcctctgacagattaatctgcaagacgcttcatcgacgacatcgaccgtgtcctctacgacggcaacgaccgcgtcaccgacaacggcatcgatcacgtcatgtacgactacaacgactgcatcaacccggcatcactattgtggtgaccgctatacggcgcagaaggaccaaccaaagtggtggcctcattgccaacgacgtcctctgacatatgcaagaggtccctaatggcatcctctgacatctacaaggtgcaagatgctaacaattacagtttttgtcttcacaccatggcgtaaatttttttttttttcgcctttggctatatgcggctacaccgacaaccacagttacttcatgatcggctacattgacgaacgtctacaacaaaaatcattgacgaaaactccagtccaagcgtccgtgtcatcgctatcgtccatgacactcccgctatgactgcgggagggaatagaggagagtcaagggacgacacagaaggggacgcaggcaccaggtggaggaccgtccatcagagatgcagtcgatgatggtgagtcaaagaaagatgaagaaatagaagatttcaaatccagtcgcaatcgttcgcttcgctcccgttacgactgagggggaatgttagaagtataatatggtagttagagataagagtcaaatacaaattatagagataagatatatcctagagatagaatcctagagataagatagagtcctagagatagaatcctaaagataaatctactcttatttgtattgtactccaagtctctatcccctatgtactcctatatataccccatgagagggtcgatccaatatatcagaaaataccaaaatac

SEQ ID NO: 6337 - DNA, 1105 bp, Oryza sativa
  Predicted polypeptide sequence is orthologous to G2453
gacgttgctcgtcgtcgtcgtcgttgtcggagtcgccatgtcgtcggcggcgcgccaccattgctccggtctccgggagcggctaggctgcgtgcagtgcagcttctgcgccaccgtgttgctggtgagcgtgccgtgcagcagcgtgctcagggtggtggccgtgcagtgcggccactgctccggcatcctctccgccgtcaacctgccgccgtcgccggtgtcggcgtccatcgagctgactccacaggtatgattcttttcagcttcagttgatgaaaatgattggatgatgtgcagaatctgtactaacctgacgagatgaaacaggagctggacgctggtccgccgccgggggagtactcggatgagagcagcggagacgatagggagggaagagatgcagaggacgatgcacctgcacctgctgctgctgctgttgcaaacaagcgtacttgtcctgctgttttctcttgatcagtttgtctgaagatgataatgacgatcatgatgggctaattaagcatgttcttgaaacatttctgcagcgccagggaggaagcagcggacgccgtctgcctacaactgtttcgtcaagtaatagcccagaaaaacaaaatgagtatatactgtgatcatagctagactgagggccaattgcagagcatcacctagagcatacatggctctgaatattcttatataaatgtcccccctcgatattcaggtgagacttgagaggtgatggaagtattaacattcctttttgttgtcagggaagagataaagaggatcgaaagcatggagcctaacatcacccacaaacaagcattcagcacagctgctaaaaactgggctcacttacccagaatccagcagaagcgaggcagggatagctgctgaactacacctgcaaaacaaggcaaacgaaattaatgggcacgagtaccaggcagcagtgagctactaggcaggttcaggaaaaatccaagttgtagctgtccagataatcttgttgcacatctcaagcacgtgcttcctgaattcttctctttcatgtgataaatacagcaagttttttttttcgactactcggttcttaacc

SEQ ID NO: 6338 - DNA, 4830 bp, Oryza sativa
  Predicted polypeptide sequence is orthologous to G2455
gtatatactacttccgtcccaaaataagtgcagtcgtggatatctgtgtctaatgtttgactgtctgtcttatttaaaaaaattatgaaaaaattaataaaattagtcacaaaaagtattattcatgttttatcatctaataacaataaaaatactaatcataaatttttttaataagacgaatggtcaaacgttggacatgaaagtgcaaaactgctgatcgcacccaaagctgctagctagtagtacctccacttaccagaaaccgggttagccctgacggctaaaaaccgtcaagaataaacgaatggaaggggatgcttgatcctgtagccccatctcaagtgacgtgcaatatactgtacataaatgtgtacatgaacttgaattgttgtattatagtctatataccactatatacattgataagacaagaacaaagggttttggaactttgttcttcatcgagggaattaatagcattaatacaaaaatcgtacattgttttgtttgacagattaacagtataatgcaatgttatatttaattcatgtttttcttgactccgtaaagatagtcaataaagttgtgcatgcatggctttcttgtcaataaatgtggttcttgcacattgtgcataccagtcacacattttccattttgttgatgttgttaggcccaatgttatttggtatgaaaatgatgccatactgccacacacaaacgaatgcgagatgacaaccaacgttaaacaaaaaaaaacagaacctatctgctgatcaaagacaaaccctgcaagccagtaacggtaatgcatgcagtagtactgcactaaacagcagaagtcctaaataattaattcaccatggaatattaagccccctggcaacgtagactcttctcctaccactcattctcccaaataagctacccactccgtccaacgatataagcatttctagattgttaagtactccctccattccaaattgatatacatatagtttttttgaggttattcctaaatgatctacatatttgtgttcattcattaggtctattcgttatttgtgcattggagtaaatggacattgatgcatgcatccatgcacacaagtatttataacccacatgcaatatcatgatttgttattggctaggagatagtggggatggtgcatgcatctagcttgttgctagagtaaatatagtatgagagagttattagcttttcttggtcttggtgtacatatgaaatatgtagatcaatttggaatggagggagtaaatgtgaaggttaaggagaaaagactttagtctctctcgtttaatgagagattgatggttggggatggaagggtgattgagagtaagaattggaggtgattggtgtaacaagtacacaagtgtatgaatgctattattaattcttggataaaattcaaatgcttatattgttggacggacggagtactagctatatagctagtcacaccagcatttgctaattggctgctcatctgctgtacccacatttcatttggccttgatctttccaacctctccttgcactcagcttgcagcttagctagctgcacacactgtcctcccacaagacaccccaccaaacaccttttcttcctccctttcttgtgtgtgcccccactcagatcagccagcagctggtagtaccctctctagcttattgcagggccatatcctctgctagcttagcttctctcacaaaccccttaattccatctcatagacagccaaaagggtcaagaggaaattgggtttgtgctctccccaaaatcctccatatatagtgcacaggaggcatcattctgttcatacatatctctcccttgcttgctttgctcctggatatatagctagcttctttctttcttcctctctccctgtgtggcacgcgcctccaatcgatctcttcggtgagtagacgcatcgagatcggggggaaatgtcggtccagtttacatcggagcatgtttgctatgtcaactgcaactattgcaacactatccttgtggtatcgtcttcctccctcatctctttctctctctagctctctctctctctctcatatcttgtgtatttctgttctaatttgaggtgtttgccggatctatatggggagttcaatttttttgtatatttttttgaaggggctaatgcgtgcatgctgtagtccatgcatagaggtagcctaagctaggggaaaataagcaccctaatcaagtatgctagctacttgtttactaaactaattgcactttgttttgtcctggataagtttgtaattttatatttctggagagttctccagtacatcgaaatccagcaatccggtctttttgcataaacttccatgtacatggtaacagaaatgcacagattttctttatggcaaacataaaatcatataaatagaaggatattgcaaacatactttgtactatttcttttcatcttctccaacttttcaagaaaaaaaaatccatatcttccacccaagggtgtcatttttgtatctccttgaaacaagactgtttctctctgacttgatccaccttgtacggttttaatttatttttacagaagggataaactcttcttggttttggatgagaaccaacatatttgtatatatcctatagcggtgcattatccagatccaacactatttgattatattctttcgctcatcaggcaaaatatcttgtacaaaatggtaattttccttggaaagaatgcttgatttgctcatagagaaaaaaaaaagtattgtccccgacatacatagtttttcgacgcatggggtcatacacatttttggaaggaacatgtacataagataatattatctgagagctttctcatgtatggatctactatactaccacaaaaagaaagaaataatttcaggtcaaattaaacttttagatgcgtgcaggtgattaaagctagcatctttaaccattaattattgcctctctagctttagctagctgctccatgcgataataccccagtgtctgtactgtgctgcacacttggagctattcctctgattattggctgtgccctgagtgtgcccacctctccaaaaccgaaattttttatgaataaacaaattttaattaacaaaaaaggctttaagctgctgcctgttgctaccacatcctgcagctttgtctctcattctgcacatgtgcagaaagaagtggatctgcctgtcatgtcattttcctctttgttgatgtttgcgcaggtgggtctcttctacatactctctctagctagctagtagtagtagctatattgtgtgtgtgtgagtatgcaatatatatgcatgcgtctcttagtatgtgttgtgctgaaagagaggagagtgtgacatgaacttttaactgtaaaagaagtgtgacatgaacttttaactgtaaagatgcctcctcttttttcatgctttttttttggaaaggatgattgtactgttcacacgaccaaatctaacttacctaagtatagatctcagtcatctgcacatagatttctctatctcaatctcaagatctgtctctctgctgtgtctctctcttcctgtttgtttgtgtgtgtgtgtctgactgatgagatgaatctagggagatattcttctttagacctgattgagatgtcatgtctctgcctcctggaggccttgagtgtgtgagatgcatcatgcattgcatggtagtaagagaaaacatgcatatatggctcaagcttctccaggcaaagagctagctaagctctcaaaagggagacacacttgggaaaaggtgttatttgtgcatgatggccaaataggactcaaaagacgatatggatatgagacatggtgcaacttttgacattcctagctactagctagctactttgtcatcacacatatatattgactacatacacatatatattgactacatacacacatacacatatatattgtgaaacggtacgtagcctagtggttgcagtgacctgagtaacaccccaaggttctgagttcaaatatccatagaagtgaattttagattgggttatattatggatggctaagttctctgtgtgataggctaagttcctaatttaaaacgggttatttgtgcttgataggctaagtttttatccaattggatatagaggccgggtaaaaaaatacacttctctaaaaacacacacacatgcattggcatttgacaattaatatatatggatatatacttcaattaatcttgtagctgcaaggctactattttttttccagcagcatggtcatctactcacctcttatttgcagtgcatgactgaacactgttgcagagaacacattgaattatttgaagagagaccagacggtagcatacgttgatacatgttcaggccaatgctgatacatatagctagcaagctagctagcatagcattttagcattatttgcttggattcttgtggatcgatctgcgataaataattttatgaacagttatatcttataccactatttaagaatccaatgaatttggacgaagggactagggagtcaattaattaggaccaggaggtaaacaataatactgtgtgcttgtgtggtaactctaccagactcattaattggagctacatattccatgtatatatatatgtcatgaaatcctatttttttctgttttacgtttctgatagaattacccctatatatttttattaataagtttgttatgcatataataaatcacagtgttctgagagaggaaacg

SEQ ID NO: 6339 - DNA, 957 bp, Oryza sativa
  Predicted polypeptide sequence is orthologous to G2455
catacatatctctcccttgcttgctttgctcctggatatatagctagcttctttctttcttcctctctccctgtgtggcacgcgcctccaatcgatctcttcggtgagtagacgcatcgagatcggggggaaatgtcggtccagtttacatcggagcatgtttgctatgtcaactgcaactattgcaacactatccttgtggtgaatgtgccaaacaattgttcctacaacattgtgactgttagatgtgggcattgcacaatggtgctctccatggatcttgctccttttcaccaagcacgcactgttcaagatcaccaggtacagaacagaggatttcaaggtaataactttggaagctatgacatagcttccagaaatcagaggacatcgacagccatgtacccaatgccaaccagtcagcagcaagtgtcacctatacgtccccctgagaaaagacagcgtgtcccatctgcatacaacagattcatcaaggaggagatacagaggattaaaaccagcaatcctgagattagccacagggaggcattcagtgctgctgcaaagaactgggctcatcttccccggctccattttggcctcagcgtcgccgacggcggcggcggcggcggcagcaactaatcgcggcggcgcggcctgccggccggccaccgatcgccggcgtgcacgccggcgcgcggcggcggccggtcgagaatgcgcgcgcaggagggacgacgacgatatattattatcgcgtgtgcccctctctcttcgccgcgtaattaattaatcagttaattaattacgtacgacctactgtgttatgctatcgatccgtgttaattaattacctacgtatcttgattaattagtctcgtattatacgtactattatacgtacgtgctgtgctatgtacgtagacaacaaaaaaaaatgtgcgtgatgagttctac

SEQ ID NO: 6340 - DNA, 1484 bp, Oryza sativa
  Predicted polypeptide sequence is orthologous to G2455
gatccatgtagctacagattatatgtaatcatcatgtaatggtacatagctcctggatatatagctagcttctttctttcttcctctctccctgtgtggcacgcgcctccaatcgatctcttcggtgagtagacgcatcgagatcggggggaaatgtcggtccagtttacatcggagcatgtttgctatgtcaactgcaactattgcaacactatccttgtggtgaatgtgccaaacaattgttcctacaacattgtgactgttagatgtgggcattgcacaatggtgctctccatggatcttgctccttttcaccaagcacgcactgttcaagatcaccaggtacagaacagaggatttcaaggtaataactttggaagctatgacatagcttccagaaatcagaggacatcgacagccatgtacccaatgccaaccagtcagcagcaagtgtcacctatacgtccccctgagaaaagacagcgtgtcccatctgcatacaacagattcatcaaggaggagatacagaggattaaaaccagcaatcctgagattagccacagggaggcattcagtgctgctgcaaagaactgggctcatcttccccggctccattttggcctcagcgtcgccgacggcggcggcggcggcggcagcaactaatcgcggcggcgcggcctgccggccggccaccgatcgccggcgtgcacgccggcgcgcggcggcggccggtcgagaatgcgcgcgcaggagggacgacgacgatatattattatcgcgtgtgcccctctctcttcgacgcgtaattaattaatcagttaattaattacgtacgacctactgtgttatgctatcgatccgtgttaataaattacctacgtatcttgattaattagtatcgtataatacgtactattatacgtacgtgctgtgcttatgtacgtagacaaccaaaaaaaatgtgcgtgatgagtaatacacgtaagtagtaagggtatagtgtttaaaaggatcaaccaggagagtataaaaacgaagtgaattgaatgaatgattagcagaaatatggtaagtgtgaatagacagacgaaatgaaaaaggaggagaataaaaaaaaaaaacaaatacagggcacatcaacacaagagcgcgaaaccgagcacggagacaaacagaagaaaaggcaatcaacagaaacgcagcaagcaaaaacactacgcacaacgcggccgagacgagacgcaacagagaaagcgagcaacgacggagcgagccgacgggggacggacggccgcaaaacgaggacggccagaagcgcacccaccaacggcgcacggagcgcacaagagaaccactgaccacgcagccgccgccgggcagcgcgcggccgggcggtgacgaagcgacgactggagcgcagtcaaagaggaggaggcggcaggaccgagaccagcgaggacaagacggcagcaaaagagcggcaa

SEQ ID NO: 6341 - DNA, 1598 bp, Oryza sativa
  Predicted polypeptide sequence is orthologous to G2456
atgctgcctcctcgccacctctgcctttccctctttgctcgcggcaaaatccacatgcagttgtagacttgtagtagtagttagttgtggttgtttgttgttttggctttcaaatcaggaacaacgacagatccgaggctttctcgaatcgggcaggtccatcaaatcggaagccagccagccatctaatcacctcatcacatcaaaggggaccaaaaggatatctctggtggctaccccctctcctccggccactcgtgtaaaatttcccttctgatcctgcgctgtgccagattataaggccattgcgtagctcgatcgaagaaagaagcaggccagccacagtactgcctctcttgtcgatcgatcgacagccacagcctgcaggtgtggggattcggctggccgtcgccttcgtcttcgtcttcgtcgtcgtcctcatcatgtcgtcctcgtcctcgtcgtcggctgtcttcccactggaccacctcgcggcgccgtcccccaccgagcagctctgctacgtgcactgcaactgctgcgacaccatcctcgccgtcggcgtgccgtgcagcagcctgttcaagacggtgacggtgcggtgcggccactgcgccaacctgctctccgtcaacctccgcggcctcctgctccctgcgccggcgccggcgccggccaaccagctccacttcggcccttccttgctctcccccacctccccccatggcctcttggacgaggtggcgttccagacgccgagcctactgatggagcaggccgcgagcgccagcctgagcagcatcacgggccgcagcagcagcagctgcgccagcaacgcgccggcaatgcaaatgcctccggcgaagcctgtgcagcaagagcctgagctgccaaagaacgccccggcgtccgcgaacaggcctccggagaagcgtcagagagtcccatctgcgtacaaccggttcatcaaggatgagatccagcggatcaaggccggcaacccggacatcagccaccgggaggcgttcagtgcagccgcaaagaattgggcccatttccctcacatccattttggcctcatgccggatcaggggttcaagaagaccttcaagcctcaggatggttctgaagacattcttctcaaggatagcctgtatgctgcggcagccgccgccgccgctgcagccgcaaacatgggcgtcactccgttctagcgagctttggcaaagcggccgcaagcaccgaattcttggtggtggccctagctcgctctcatgtgtggcgccattctagctatatagcaagggtttaattagcatcagatcatcatctcttaatatcatgtgtgttgcttaattagagtacttctgagtgtgtagaagagagatggggaatcctgttgagtgcctaggtttatgcttataaccatattcctcgtagagacttttttccctgtttttctcttttcttttccttctttatttttttatcctttctttctttcaggactatcttcgtactccctattcacctgtagagtgtagagaagttgctgttccgttgcctgattgtgtcccaaaagacgtgtcttaattacg

SEQ ID NO: 6342 - DNA, 1809 bp, Oryza sativa
  Predicted polypeptide sequence is orthologous to G2456
gttacatatctctcccttgcttgctttgctcctggatatatagctagcttctttctttcttcctctctccctgtgtggcacgcgcctccaatcgatctcttcggtgagtagacgcatcgagatcggggggaaatgtcggtccagtttacatcggagcatgtttgctatgtcaactgcaactattgcaacactatccttgtggtgaatgtgccaaacaattgttcctacaacattgtgactgttagatgtgggcattgcacaatggtgctctccatggatcttgctccttttcaccaagcacgcactgttcaagatcaccaggtttaaaaactgaaataatggtttgaaatttcagttcaaaactgtagccgaagaatctcttgcatatatatcagctatatcttattttttatgaaacaaaacaaatgaaatattaatttctgtacgtatgtaaaaaaaagaattaatattaattatttactacgtacagtggaatggtcacatctaaatttgtttatttaggtacagaacagaggatttcaaggtaataactttggaagctatgacatagcttccagaaatcagaggacatcgacagccatgtacccaatgccaaccagtcagcagcaagtgtcacctatacgtcgtatgcacaattaattttctcatgattttatttcattgatctactaaattatggggtttattttttatttctctatataagcatgcatgcaaaatgggtatatataatatagttaaaggttatatttactgttctaggcttctaatgtataatcaaaatatattatagtaatcaagttcatgcatgagctatatatgaacctgatcacactgaattccagtaaacattagttttttccccgtatacgcatggagctgtgttagatttcccaaatgatcaatctataggtattaacacacacacacacacacacacacacatacatacacacacacacaatacatatattatcagcttgcataatttattaaattgccttgttcttctgtattcacattatagctagttttatgtattatatatatgcttgtataatagatttaaaatattggtccttttttcttctttacagcccctgagaaaagacagcgtgtcccatctgcatacaacagattcatcaaggaggagatacagaggattaaaaccagcaatcctgagattagccacagggaggcattcagtgctgctgcaaagaactgggctcatcttccccggctccatttggcctcagcgtcgccgacggcggcggcggcggcggcagcaactaatcgcggcggcgcggcctgccggccggccaccgatcgccggcgtgcacgccggcgcgcggcggcggccggtcgagaatgcgcgcgcaggagggacgacgacgatatattattatcgcgtgtgcccctctctcttcgccgcgtaattaattaatcagttaattaattacgtacgacctactgtgttatgctatcgatccgtgttaattaattacctacgtatcttgattaattagtctcgtattatacgtactattatacgtacgtgctgtgctatgtacgtagacaacaaaaaaaaatgtgcgtgatgagttctactacgtacgtacgtactgtgttctagtgttttaatttgtatccgaaccaaggagttgtttaattaactgcatgcacatgcactggacttgaatctggagtattatgtaagtgtgcatgcatgctggattatgcaaaataaacgaattaatgaatagaactgtttttgttaattaattaatt

SEQ ID NO: 6343 - DNA, 1301 bp, Oryza sativa
  Predicted polypeptide sequence is orthologous to G2456
gatccgctagcttcatctccactagtctcatccctccttctccctctcctcgttgaacaccgcactatcaaatcacccagctgaaagccaagaccgcgcgcgccggccggccgggcagggatcacctagctaggatacgcgccatgatgtcgtcggcgccggagacgttctcgctggaccacctctcgcagcatcagcagcagcagccgccgccgctcgccgagcaggagcagctctgctacgtgcactgcaacttctgcgacaccatcctcgcggtgggcgtgccgtgtagcagcctgttcaagacggtcaccgtgcggtgcggccactgcgccaacctgctctccgtcaacctccgcggcctcctgctcccggccgccgcctccaccgccaaccagctccccttcggccaggctctcctctcccccacctcaccgcacggcctccttgatgaggtgccgtcattccaagcgccggcgagcctaatgaccgaacaggcgagtcccaacgtgagcagcatcacgagcagcaacagcagctgtgctaacaacgcgccggcgacgtcgatggcgtcggcggccaacaaggctacccagcgagagccgcagcagccgaagaacgcgccgtcagccaacaggacttcagagaagcggcagagggttccctcggcatacaaccgattcatcaaagatgagatacaacgcatcaaggcaagcaatccggacatcacccacagggaggctttcagcgctgctgccaagaactgggcccatttcccacacatccattttggcctgatgccggaccagggcctgaagaagaccggcatacaaagccaggacggagctggggaatgcatgctcttcaaggacggtctctacgctgcagccgccgccgctgcagcagccacagcagcatctagcatgggtgtcactccattctaacgcctcagatcaatgcacgatctggcttaaaaaaaactttgtgtcccaccctgtagttagggtcctgcatgtctcgatctccagatatgatctccggttgcttgttaactgaaatgttcctctatatatggacgatcatggcaccatatgcatggcatcttggcatgcatcgatcgtatctaagtccttatctatgtgtaattctagttttctcagtttcttcatgtattttccccttaatttttcctattcctattcgcatgtacagaggctgctagctgtgcgtgctgcctcttatatatcttatggacataactagatcgatttggtttaattaccaggtgatcatttgaaatc

SEQ ID NO: 6344 - DNA, 733 bp, Oryza sativa
  Predicted polypeptide sequence is orthologous to G2456
aactcgcaccttcgtctccgcctcttcctctccctcaactgcgcaagcgcttctccctccttgcgcggtagccggcgccaatccctaccctcgtggcggctggctctgctccctctccctgcgcagcagccgacgcctctccagccctctcccctatgcagcgagtcctctcctctctcatgaggtggaggaggaggcgtggggtggcgggggcaagatccaacgacccccaagcttgggaccagcacagcgttaagggagatggcgaggacggtgcgacgacggcaaggacagtggctccacgaaggaggaggtgcagggcggcggcggccagatccaagtgaattttttgctgcctcccgctttcactcacccttgcttctgttactccatctgtaagcgatgtctttgccttagcagccagatttgatgtcgtcctttggaaatttgtggccttctttatggggatctttggtgcttgcccgatttgctctccatgggtgttttggagatgcttgggctgattctgtcaccactggatttgccgcatcgtgactcgtgagctgctgcatcttaaggcgaaagattggtttctttagggagttgagatttgtttgtgtgtatctgcttccacctttataatttttgtagcgtcaatcttcatcgtattcaattatgtgtccttgtgaagcaaaacattgaatgaaaaactgattttctggggttggttttg

SEQ ID NO: 6345 - DNA, 942 bp, Oryza sativa
  Predicted polypeptide sequence is orthologous to G2456
atgtcgtcgtcgtcctcgtcgtcggcgtcgtcggcggcggcggccgcgtttcggccggctgttgtgcagcgggagcagcaggtggtggaggagaaattccccgcggcggcggcggcgatgcgggagatggtcctcccgccggtggcggcggcggcggcggactccgagcaggagcagctctgctacgtgcactgccactactgcgacaccgtgctcgtcgtgagcgtgccgagcagcagcctgttcgagacggtgacggtgaggtgcggccactgcagcagcctcctcaccgtcaacatgaggggcctcctcctcccgaccaccgccgccgccgcgccaccaccacctcctcccccgccgccgccgccgccgccgccggccgcgcacttcccccactcgctcaacctcgcgccggccaaccctccccaccaccactccctcctggatgagatatcgacggcgaactccccgacgcagctgctgctggagcagcacggcctcggcggcctcatggcgagcgcggcaagctgcaggaacaacaactccccggcggcggcggcggctccgccgccgccaacgtcgcaggggaaagcggcggcgaaagagccgtcgccccggacgaacaccgccgtcatcaacagacctccggagaagaggcagcgtgtgccatcggcgtacaaccgcttcatcaaggacgaaatccaacgcatcaaggctggcaatcccgacatctcgcacagggaggccttcagcgcggctgccaagaactgggcacactttccgcacatccactttggactgatgccggatcaccaggggctcaagaagaccagcctgcttcctcaggatcatcagagaaaggatgggctactaaaggaagggctttatgcagcggcagctgctgctgcggcggcggccaacatgggtgttgcaccgtactaa

SEQ ID NO: 6346 - DNA, 1496 bp, Oryza sativa
  Predicted polypeptide sequence is orthologous to G2457, G2459
gacatgagccacaagaaataaaagcacttgctagctatgcactgtagcagcattgccgctttgctttgcttgcttgcccccacacgctctctctctctctcactagctaattagctgctactacatcttccatctctctcctctctctctctctctagaaataaggaaggagagaaagagaaagagagagaaaaccagaaaagaggaaagtgagatagctcaatttctccttccttcctctctccatctaatctacacatgcacaaatgttgcagctgatatatggcttagctagcatatgcaaagcaagccttcctgcagtctagtcacctctcaagctacatactcccagtactgcttcatctagctctctctagtagctagctctatcatcatcgatcatcctcctctcaccggccggccaacccaagaagagattattcctcttcatcttcttcttcctctctgttcatcactggcttcggcggcggcggccgcggcggcgatcgatcagctgtgagaagaagaagaagaagaagaagaagaaatgtctgcccagatcgctccggcagagcaagtgtgctatgtgcactgcaacttctgcaacacgattctcgcggtgagtgtcccaggaaacagcatgctgaacatcgtgaccgtccggtgtgggcactgcacgaatctgctgtcagtgaacttgagaggactgatgcactcagccccagcactacaagatcatcatcatcatcatctccaggagagtggtctgagcggatgcttccgtgatcaaagtggctatccggagtttggtttttctgcagcttcgtcgtcttccaagctcaggctgcctcctgctgctgctgccatggtttcctactcgcagcaaaaccagcagctcgagcaagctctccatgctcgccctccagagaagaggcaaagggtaccttcagcctataacagatttattaaggaagagatacgaaggatcaaagcaaacagccccgacattagccacagggaagccttcagcacagcagccaagaattgggcacattatccaaacatccattttggcctaagccctggccatgagggtggcaagaagctcgtcgacgtcgaccccatcccaactgctccatcttccaagaagatccaaggtttctactcatagattgaggggatcaatctgccgataccgataccgcaaataggaggaagagcatcaagagcacaaaacatatatatactgtgagtaaagaagcaaaggaaaaaagaaaagaaatgctgccaccttacctttgttcatgaccaaaaaacttgtgaagacgtatgtcataagtacatagaagaaatcaactcatatagagtgaaaaaaaacatacaaaaaatcaagctactatagctcatcgatcgactgaaaggctgaataaaccattcgaccataatgttgttacatgtataagtatgtttgaagctagctagctggctagttcttt

SEQ ID NO: 6347 - DNA, 1257 bp, Oryza sativa
  Predicted polypeptide sequence is orthologous to G2457, G2459
tcccgtttgcaccaccaccaatctctctctctctctaagatctctatctatctaaagatctgagctacaattaattaaaacctgataagaagaagaccctgagctcaatcccttcttattatactatatatatacttctgtatttgtgcacagtgttggtacaggtatctgcagacagccatatctatctttctagctaattggcaatatgcctgaagtccactgctcgtcctaagatttacttctccacccccccccctctcctttgcttcttcttcttcatcatcatcttcttcctcctcctgttaattaagttcttgatttctaagctagcaattgagcacacatcgatcgcgagagacgcagcggcgcccgtctaccgcggggctagaggaatgtcggcacagatcgtgccggcgccggagcatgtgtgctacgtgcactgcaacttctgcaacacaattttcgcggtcagtgttccaagcaatagcatgctaaacatcgtgaccgtccgttgtggccattgcactagcctgttgtcagtgaacttgcgaggattggtccaagcactcccagcagaagatcatttacaggacaatttgaagatgcacaatatgagcttccgcgaaaactactctgaatatggctcatcttccagatatggccgagtgccaatgatgttctcaaaaaatgacacagagcatatgctgcacgtgcgacctccagagaagaggcagcgggttccttcagcttataacagatttatcaaggaagagatccgggggataaaagcaaacaatcctgacataagccacagagaagccttcagtactgcagcaaagaattgggcgcatttcccgaacatccatttcgggttaggctcccatgagagcagcaagaagctcgatgaggccattggagctcctagtccccaaaaggttcaaaggctgtattgatcgagtacacatgatgatcgatggatcctacgtgcttgttgatctcatgttgtaagtaacttaattaagaaaaaaagtctacgcttatttatttcttaagtatcatcagttaaatttgtgagcgagtatatagatgagttgtcatgatcagtgagtgatcgtatgcatgcagtgctgagaattaaaggtgtatatgcatgagtaacgttacatgcagctagtgtcgacgcacgtatgacagactgaataaactcttcaccatgttgtttttttatgtttgaaatgaattaattaattgtcc

SEQ ID NO: 6348 - DNA, 1037 bp, Oryza sativa
  Predicted polypeptide sequence is orthologous to G2457, G2459
ccccgcaccaccgctcacacttgctcctcctcctcctcctcctccgcctcagtgctagggctagcttgcttgtcgccgtcgccgccgtcgtcgccgccgcaatggatctcgtgtcgccgtccgagcacctgtgctacgtgcgctgcacctactgcaacaccgtgctcgcggttggagtcccatgcaagaggctgatggacaccgtgaccgtgaaatgtggccactgcaacaacctctccttcctcagcccgcggccgccgatggtgcagccgctctccccaactgatcaccccttgggcccgtttcagggaccttgcactgactgcaggaggaaccagccgctgccgctggtctcgccgacatcaaatgagggtagcccaagagcacccttcgttgtgaagcccccagagaagaaacaccgcctcccatctgcttacaaccgcttcatgagggaggaaatacagcgtatcaaagctgccaagccagatatccctcacagggaggccttcagcatggctgccaagaactgggcgaagtgcgacccccgctgctcatcgacggtttccacctccaacagcaaccccgagcccagagtagtagctgctcccattcctcatcaggagagggccaacgagcaggtggtcgagagcttcgacatcttcaagcagatggagcgcagcggctagggcggcggcggcggccggagccggcggcgatctatatcggcggtgaagctcgtatgaagctagctagcctgcaggccggccactggggagagtaccaaatttcagatcccccttattatcaccgtcgtcagctcagctcatgcatgcatgctcatcgttcccctttagcatatatctgtgctcgttttgtgtttattagttaattatgtttgatcttgttaatttgttgttgcatggagtatgtaccccctataagacccagctgctgctaccgtacgatatacgtacgtatgctatatatatatatatatatatatatatatttgtcatctaaaaaaaaaaaaaaaaaaa

SEQ ID NO: 6349 - DNA, 1694 bp, Oryza sativa
  Predicted polypeptide sequence is orthologous to G2465
ggtccgtccgttcgattcgacgacaccttcatttttattttcttccttgtgtaataagaagacgactagtggtaacaaaaagattcgctccctacgcgacgccccgaccccgattcccttcgcttcctactccttcctcttccttgttccttccttccttcctcaccccacgaacgcgcacaccaacctttcccatccctagctgctgcccttccatcggatccacggatcgagacctggcacggcggcggaggacgggccggcggagatggaggtggaccacgcggaccgcgacggcgcgcggcgccggtgccgcgagtacctgctcgcgctcgaggaggagcgccgcaagatccaggtgttccagcgggagctccctctctgcttcgacctcgtcacccagactatcgaggggatgaggagccagatggacgccgccggcagcgaggagacggtcagcgaccagggcccgccgccggtgctcgaggagttcatcccgctcaagcccagcctctcgctgtcctcctccgaggaggagagcacccacgccgacgccgccaagtcaggcaagaaggaggaggccgagacgtcggagaggcattcgtcgccgccgccgccgccgccggaggccaagaaggtgacgccggattggctccagtccgtgcagctctggagccaagaagaaccccagcagccatcgtctcctagcccaactcctaccaaggatttaccgtgcaagccggtggcgctgaacgccaggaaggccggcggagcgttccagccgttcgagaaggagaagcgcgccgagctgccggcgtcgtcgaccacggccgcggcgagctcgaccgtggtcggagacagcggcgacaagcccaccgatgatgacacggagaaacacatggagacggacaaggacaacgacaaggacgccaaggacaaggacaaggaaggccagtcgcagcctcaccggaagcctcgccggtgctgggcgccggagctccaccgccgcttcctgcaagcgctgcagcagctgggcgggtcccatgtagcgacgcccaagcagatccgggagctgatgaaggtggatggcctcaccaacgacgaggtcaagagccatttgcagaagtatcgtctacacacgaggaggccgagctcgacggggcagagcagcgccgcagccggcgtccccgccccgcctgcgccgcagttcgtcgtcgtcgggagcatctgggtacccccgccggaatacgctgccgcggccgccgcacagcagcacgtgcagcttgccgccgccggcaataatgcgtccgggagcgccaaccccgtgtacgctccggtggcgatgctgccggcaggcttgcagccgcattcgcatcggaagcagcaccagcagcagcagcaaggacagagacattccgggtcggaaggccggcggagcggggacgccggcgatggcagctcgtcctccccggccgtctcgtcgtcgtcgcagaccacctccgcttgattagtgtagattcgtcgattacatcattatatgtacgtagtacgagagtgcatcacatcaaagtgcagcttgattttggagctagctagcttaaattaagggttaattactgattgcttcgtgatcgcacacaccacatttgctgttttgtttgtaaaaaagataataaaatacataaatattaagg

SEQ ID NO: 6350 - DNA, 2862 bp, Oryza sativa
  Predicted polypeptide sequence is orthologous to G2492
atggaaagtcgggaatggatgtatcattggccgaggcttttgtctccatatagcaacgaagtgtctaaatttattggtattgccaaggcacacgctgagaagaacaatatgaggaagataatttgtccatgtgctgactgtaagaatgaaatagtctgggacttcgacgatgcttttaaagtgaaggagcacttagtaactcgtggatttatggacgagtacgaaatatggacacgttatggcgaagaacaagtggacaggcctgaaaatgtagttccgacacaagttgaagacatggtgcatgacgatggttctgttgaggacaaaatcgacctagaggaaatgttacgtcatgcagaacccgaggtgctgatggggtcggccagagagttaaataactttgaagctttacagaaggcagcaaaggaagttttgtacgatgaatcgaagggctgtgacagtgagttcacaacactatggaaagagtacgtttttttagatgaatgtccaacatgcggtactagccggtacaaatcgaatagcaatactggcctagaaccgtctgacacaactgagggacgacagagaaaaatcccgcagcttgtgatgtggtaccttcctgtcaaagaccgcattaaactgatatactcaaacccacgagatgcggaactaatgcactggcatgaagaagggcgcaagaaggatgggatgattcgacacccggcagatgctcgtcagtggataaactttgatgctcagtacagagagtttgctaaagacccacggaacattacatttgccctgagtactgatggagttaatccttttggagacatgagcagctcacatagtacttggccagtgcttctcaccatgtataatcttcctatctggctttgtcaaaagcaaaaatacgtactactctgtatcctcatacagggaccccgtcagcctggtattgatattgacgtatttcttgaaccattgttggaagatatggctgatttatggaaagagggattgaaagtgtatctcccgggttccaacaagcttgtgtacatgcggcaccggcggttcctacgcacaaatcacaagtaccgcaagatgaaggcggagttcgatggcactgaagagactgatcctgcaccaaaaccaacatcgggagaaaaggggacaaagcgcaagaaacccgagaagaatacgaaacaaggggatagtaagaagcaagatgatagttcgaagccagatgataaactccctcccctattcaagaagcattccatattttttaagtacctcccatactggaaagatctggaggttcggcatgccatagatgtcatgcatctagagaagaatgtgtttgacaacatagttggaacattgttggacatgccgaacaagactaaagatggtctgcaatcaatgatggatctagtcgagatgggaatcagagaagagttacaccctcaagaaggagaaaaaaatggtaaagtatatcttccaccagcctgttttacactgacacctgaggagaagaagtcattttgcaactcattccgtgatgtcagagtgcccataggtttctcatcaaacatcagtcgactagtttcaatgaaagatttgtcggtatctggttataattcacacgactgtcatgtcttgctcaccgtgttttttgcaattgcaataagggccataaaaccggagcatttaaaggttgctattacaaggttgtgctactttttcaacgcagtgtcacagaaggtcattagtctcgaagagttaggaaatctccgtacattcgcacatgagacacagtgccaacttgagatgtgtttccctccgtcagtttttgatatgatggagcacctcattgttcacgtagtgtcgcagatggttgcgcttcgcccattgtacctccatcaaatgtggtcatacgagcgttacatggcggttttgaagggttacgtccgaaatcgtgcacatccagagggatcaatggttgagggttatagtactgaagaggttgtcgagtgctgtatcgattatctcaaagatggatatgcaattggagtacctgtgcctcgacacgagggcggattgagtggcaggggaacgataggaaagaagagatttgtcacccatgatcacaaatcattccaagaagctcacttcagcgtgcttcatcagtttgttatcgttgagccgtacatcgatcaacatatcgaactaatacgagctaacaataagggtcgcaccaccgagtggataatgaaagaacacgagcatctcttcacagattggttgcgagacctagacttacctgagggacaaactaccgatgaaatgactatgaagcggttggcttgtggtccatcaactatagtaaattcttggcagggatatgacattaatagatacttgtttagtacaagagcccaagataataagacttgtatgcaaaacagcggtgtccgtgtggaggcaattgatgaagccggggaaaaacaatcatacttcgggtttatggaagaaatatgtgaaatcgactatgggcacacaatgcaattctccatatttaagtgccagtgggatgacccttgggtactcgccaatcgtgtggcacaagtgttttacgtgaaagacccatcaaatttgaagaaagatatagtgctacccggaaaacaaaagatattgggagtggatggggttgaagatgtcgaagattacaatcaatacgatagtatgccactttatagtcagtttgtacagaagattaagaacgtcgagacatctactcagaagatcgtgaagccttacatgcgcacggatggtgtgggaaaaaatgttaaagggtaa

SEQ ID NO: 6351 - DNA, 1052 bp, Oryza sativa
  misc_feature (14)..(14): n is a, c, g, or t
  Predicted polypeptide sequence is orthologous to G2515
cgatcccctcctcnctcctcccccacttctccccaccaccacaccaccacacacacgcacgcacgcacgcacgcctccgttttcccccaccgacgagaggcggagagggaggggagctagggtttttcggggcggggatggcgcggagggggagagtgcagctgaggcggatcgaggacaaggcgagccggcaggtgcggttctccaagaggagggcggggctgttcaagaaggcgttcgagctcgccctgctctgcgacgtggaggtggcgctcctcgtcttctcccccgtcggcaagctctacgagtactcctcctccagcattgaaggtacctatgatcgctatcagcaattcgctggagccaggagagacctgaacgaaggaagtacaagcatcaacagtgatgaaaatgcaagtatacactccaggcttagggacataacggcctggtctctccaaaacaatgctgacgagtcggatgctaatcagctagagaaactggagaaactgctgacaaatgctttgagggatacgaaatcaaagaagatgttggcaaaacaaaatggtgaagggagtaggagcagagcaaactccagtggctctagggggcaggaggaaggaagtgcatgagcaggaagcacaggtgtcctgtgcataagtttggcagtgcatgcacctcccaaattaaaaagctaataaaaaaaagagaaaatggtgcatgctctgtttgctgccagtttctcccactgattgatcccaggtagagaaaagagttgccatggcctctggctctgcttgttagatcaagggggggagatggaataaaaggatggggaagtattcaggttcttgtaatgaagacctatgctgtggtgttttagcaatgtttgatatgtgtgctacctgtgtttgactggttgtgttgcttgatgtgtcatctgaccatgatactgaaagcctgataattgcactgacttgtgtatggagtttgtttcaacctattggtatgaatctgtttgattctgtaggaactgtggtttgctgtttgcc

SEQ ID NO: 6352 - DNA, 1079 bp, Oryza sativa
  Predicted polypeptide sequence is orthologous to G2515
gaggaggtcgggatggggaggcgggggcgggtggtgctgcggcggatcgaggaccgggtgcggcgcgggatctgcttccggaagaggctcgccgggctggagaagaaggcggaggagctcgccgtgctctgcgacgcccacgtcggcttcgtcgtcctctcctgctccgacgacgaccgcctccaccatttcgccgcgcccgccactatagaaaacattgtggaacgttatgagaattctctaacagcacaaaagggagtacatggcaggcgcactccggaaaagagagacactcattggtgaaaattttcctgccggtgctgatgataattattttaccataccaagggcaaggattttcatgttcccaaggaaacaacagataaagggtcgaacgatgatgacatgcgatctattgatgaaacagacatatccacattgaacatggaccagcttagccaaattgaaagattactggaagatgaactaaggtggacaagggcaagaaaggtggtggtggatagaagtgccagattacaaaaaaaggtgcaggggaaagcggcgattgttgaggttgagaggggctccatggagattcccatagaatctgggcaggagaaggaacagataggaggggaggctgtggaggagcaacggagccggactacgccgttggacctcaacatgccttgctgggacgcaggtcctctgcagtaaacgtagataacattatctttgcacagcaatctgagtctgtctaacgttagtcgctactactgtccccggtactaacagtgtcgtaagttactgttgctgggaaactactactacgctttgctaatctttttttactgtagccgttcatatccaggatactgtgccgtaactggagcacaccagattcaaatcaaatgtactgtgacaccattgtattttaaaatgtgtttttctcctacttcctactagttctagttcatgttcggtggaaaattgtaaaccaaataaaccggcatcggtattggtcgatgtgtacccgtgggctctgtaataagactgtccgtgcctgcaaattagtaccg

SEQ ID NO: 6353 - DNA, 582 bp, Oryza sativa
  Predicted polypeptide sequence is orthologous to G2515
cactatagaacaagtttgtacaaaaaagcaggctgtaccagtccggcattcctcgagcactgttgtcctactggaaaaagaaaaagaatcttcttctccgacccgccccgccggtggggagtcggcggggccgcgggaatccggcaaagcgacggcgatgtccgccgcccgtggttgcctcgtctctccgcctacataagggggcgcctctccgggctccggcgcgtcggattgggaggtcgggatggggaggcgggggcgggtggtgctgcggcggatcgaggaccgggtgcggcgcgggatctgcttccggaagaggctcgccgggctggagaagaaggcggaggagctcgccgtgctctgcgacgcccacgtcggcttcgtcgtcctctcctgctccgacgacgaccgcctccaccatttcgccgcgcccgccacgtacgctctttccccttgaagttgaatctgctcaactcttgctgaagtgtatagtagtactggctaccttagctcgattttgtcattttgactggtatattcaaatatcgttgggtattatattactcggttcgattttgacta

SEQ ID NO: 6354 - DNA, 1269 bp, Oryza sativa
  Predicted polypeptide sequence is orthologous to G2520
agcgctctctccctctcgtcaccgctactactagtgtacagtgccactgcgagctctcctctccgcccccgatctggtcgcctcgctcgcctcaaaccctagagctccatccaccggcgagccctcttgggcggaggtgcttcattgctgctgctgctgccatggaccccgcccccacgctcgccgccgagctctggcgaacgccgtacctcggtggcggtggtggtggaggaggaggagggcgtgggttggaggcggcggcgtccggggtcacggagcagagcaatgggagccgcgggggtggcggaggaggaggcgcagggcggaggaggcagcgggaggcccccgcgctcgaggacgactcgtccaggatcgtctccacttccggaggaggaggcggcggtcaggatttgactgattcagaagcaaagcgtttcaaggcaagtaaatcaagtggagataatagcagtttaagaacagaggctgaaactgattcaagaaatgctagcaagtctggtgatcaaaatccgccaccaccagaaccaccaaagcaagactacatccatgtgagggcaagaaggggtcaagctactgacagccatagccttgccgaaagggcacgtcgtgagaaaataagtgagcggatgaaaattctccaggatcttgtccctggatgcaacaaggttattgggaaagcatcagtacttgatgagataattaattatatccaggctttgcaacggcaagttgagtttttgtccatgaagcttgaggctgttaatgctcatgtgaataatggaatcgaagcatttccacccaaagattttggtgctcaggtatacaacacggctcctggattgacgtttgatccacaaacaccaagagaatacgcccagggatcaacaccatcggaatggctccacatgcagattggtggcacctatgaaagagtgacatgaacagaacaaagtcaggatggtggcccaaaataaagcataccatgagttcagtcagaaaccacggctttagattatttttcgaaactctcgtgctccaaattcgatttcattcatagcatggagctcatgtatttagagactgcgagcacagtatttttacatctgtaccgggatacaattctcatcagattcatgtattccacggaatttcggcaggtcacgctcattcgtagcatgaaagaaaagtaataaccatcaataattctcttgctataaatcctaaagcccttcatttaaaaaaaaaaaaaaa

SEQ ID NO: 6355 - DNA, 422 bp, Oryza sativa
  Predicted polypeptide sequence is orthologous to G2520
attgttgcttttccatctaaagattttggtgctcagccatataacacagctgctggtttgacatttgatccacaaacaacaagggaatttgcccagggttcaacatcagagtggcttcacatgcagattggaaatgcatatgaaagagtgacatgaataaagcaagcaaaaccataaaacataattccttgtagtggcaataaagtgtactgggatcgatcaagcctgtggtcctaggattatttttttttctcaacaatttcttctcattatcatgtcaccaagttatttttttgttcctaatttggtccatgatgccatagatacattcatcttgacctgttgatactcaacggtctatctgctttgcttgtatcccatggtctttgtagctcggatttgaatagggaaagaagaggatg

SEQ ID NO: 6356 - DNA, 2890 bp, Oryza sativa
  Predicted polypeptide sequence is orthologous to G2522
atttgatgacgaatcaagtcacaataaaataaataataattacataaatgtttggaataagacgaatggttaaacgttggataaaaaatcaacggtgtcatacattaaaatatgaaatatgaaggtagtatgtgaaagcctgatatgtcaattggttagatttcttgtggtgaaacatgcatcttcaaattcattatattttaattgtaaaaaaaaatctttagagatggttactcttaaaattatcagattttttttgtcacggctaaatgtaatgaatcttaatatgaattttcgcatatatgtgtagtactattagaaataactgtttatttttttctaattttttatgacatttgctagttggtgtgtgtgagaaacctatatgcatatttttcacttagacacaggagcggagctaggtaggatagggggtgcccaggaacccggttaagaaatttttttaagctatagttcatctattttcaccatatatgcacctccctcaatccaaatttaggcacttatatcagtctaaagtagagtaaaataagtgagtggcagctctcttcatttcgttctagctccgctcctgcttagacatactatctcgatataacaattcaaccaagtcttacgtgaactatgaaccgcccaacacaaaggttcatgagatatccgccgttggtggtcaggtgaggtgaggtgaggtgaagctttgggaagcatcaaccttgaaaaccaagaaaaggtcgtgggcgacagggcgagcgccataaatatctgaaaacatcttgtggagagctgacaggtgggacccgaggggaggtcccgatcggactgtagcgtgggggcggggatcgagtgggcgggtagcgacaggccaccgcccacccagcccatccgcgcgcgtggacgcaaaatggagtggcgcgcgccgaacgaaacggaagccgcagccagcaaattgcaaaggaaggcaaatcacaagcaaatccacccccgcgccgcgccgctcgcgctcggctccgccttttttccctttcgacgtcgttgggccaaggaaacggaaccaaatcttatcgcctccttgtgtgggcgccatccgtccctccgtccgctgcccatctctctctcacgctcgccgtcctcttgtgccttcttggcttgggtttgcctgcgcctgcgcgcgcttggcctagttgcatcgtctgcgttgcggctgctgcgatagcatgtaggccaaccgcgtcatcttatctctctctctctctctctccccccatcatttcatctgatctagtatctcatctcctcctcccctccttttccttctcccccaaccaactcactcttcatcttcaacaccttgctgttcgtcctcgtctcgtcgtgctgattgttcaagaacaggagaaagaaaggaagaagcagtttgattgatctgtttctgttggggggagctcggtgatccatgcatggatggcaaagaactcctctcaccgtccgaactgtcatactatgcgcaccagcagcatcagcatcagcatcagcagcatcagcagcaacaccggatgctcgggggcggaggaggcggcggcgggcatagcgcgtcgccgctcgccgggatgcacggcggcccgtcggtcatccgacccatgcccaacatggggatgagccccaccgcgatcctccagtccatcggcccgggcccgctcgccggcatgcagttccagatggacgccgcgccgccgccgccgccattgatgcacaacagcatggcctccgtctccgcctccgccggcgccggctcacccaccgtgccgccgtccgcgacgcccatggagccggtcaagaggaagcgaggccgcccgcgcaagtacggcccggacgggaccatgaaggtgtccaccgccgccgccgcgcagcaccagcagcagatgctgagcgcgccgccgaggatggggtccgtgtccggcgccgacatggttggcggcggctcagggatggacgactcggcgcagaagaagcggcgcgggcggccgccggggacagggaagaagcagcagctctcatcaccggttaagctttcagggggcaatgcgttcagtggctcagctggaacgagcttcacccctcacatcatcacggcatctccttcagaggacgttgcagggaagatcgtggcgttcgccaaccattcgtccagggcggtgtgcgtgctctcggccaccggctccgtctcccgggtggtcctccgccacccggccgacggcgccatgtcaagggttcacgcctcctcccactacaagaaccctgccatctacgaggggctgtacgagatcttgagcatgtcggggtgttacaacctgatgaacgaggggcagagcgacgggctgagcgtgacgctgtgcagccccgagaggcatatcattggaggcgttctcggcggagcattggtagctgccagcaccgttcaggtggtacttgggagtttcgtgcagggagggtcgaagcccaagtcgaagaaggccgggaaacagcagcagcaacaggcggcggcggcggccttcagctcggactcgctgaccggaggagggcaggacgcgtcgccgagctccggccataaccaaaatctaacgccgccgccccctgtaacaacgacgggagggtggcctagctccgggatatttgacacgagaagttccaacattgatatcaactcatctagaggctagcttcatctctcaatttgtcgactcttccatatgtgctccagaaatttgtttttctgattcccaaagaattacccccaaaattgtactcctctctgtaatagcctgttcagtttttgagccgttaattcttatagattattattattcactag

SEQ ID NO: 6357 - DNA, 614 bp, Oryza sativa
  Predicted polypeptide sequence is orthologous to G2525
accgctcgccgccgacgacgagagcgactgctccgatgagcgaatccggcagggtcaccgccggcggaggaaggggcgagctgcggccgccggagctgccgcgggacccggcgctggagttcctgtcccggtcgtggagcgcgtcgggcgccgccgacgtctcccgccgcgcgctcgccgccgccgccttcccggcggcggcggcgtcggccgcggtcatcgccgaggacgtctccggtgagctcgacgtcgacggctccgcctccgggagctccttctccttcgcgtcggcggccacctcgcagctcatcatggacaggatcatgtcgcaatcggaggtgtcgccgctgacctccggccgcctctcacacagcagcggccctctcaacggcggcggctcgctctccgacagcccaccggtctcgccggacgtcgacgacagcaagttttgcagagcggtgagcacgccgaagccgcagccgtaccgcggcgtcgtcggcggcggcgggaagacggtggggcggtggctgaaggagaggaaggagaagaagaaggaggaggcgcgggcgcacaacgcgcaggtccacgccgcggtgtctgtggcggaagttgtt

SEQ ID NO: 6358 - DNA, 1278 bp, Oryza sativa
  Predicted polypeptide sequence is orthologous to G2536
atttcacgcgaactcgagccccacacatatatatacacatcccaagatcacaaatcgagtgtaattaaatttgtgatttgtgaaccttcttcaattctacctagctagcaatctattgagaggtgaattgaagtgcatgcatacaagaatatatagatggtgatgagcggcggcggcggcggcgcgaggattgccagtgatccggcggcgacgccggggttccgattctacccgacggaggaggagctgatcggcttctacctccgccaccgcctcgccggcacgagggccgacgacgtcgcccgcgtcatccccgtcgtcgacgtctacggctaccatccttcccagctcgccgccatggccggggtggcgaccgcgggggacagggagcagtggttcttcttctgcccgagggcggagcgggagctccacggcggcaggccggcgcggaccacgccgtcgggctactggaaggccacgggctcgccgtccttcgtcttctcctcctccgccgccgccgccgccagggtcatcggcgtcaagcgcaccatggtcttctaccagggccgcgccccctccggcacctagaccaggtggaagatgaacgagtacaaggccgtcgccgccgccgccgccgacgacgaccacaacgccgctggcgtggccgtgcagctgccaccaatggcgccgccgccgtcgtcctccgcgtgcgtgcggctgaggaacgagctgagcgtgtgccgggtgtacgtcagcaccggcacgctccgatccttcgaccgccgccccctcgacgcgcccccggtgatcagccaccatcaacctcagctccagcaacaacaacgtcagctgccatcgtcggcagcggcggcggcgacgaacggcaacctcatcgccctcgccggcgggtacgagtgctcacacgacagctccggtggctcgtcggaagatgccgccatcgactggagctcgctgattaccgccgccaccgattccgctaccgccgccgttgatttcagcttcaacgacgacatcgatttcagccctgccgctgttggcccatgggcgccacagctttgattgattgattatttgtgcacactgcataataactgaattactagtaattagtagtagtaagtttgatcagtgcttgctaattgccatagtgttctatgttcaggtcaactcgattgatttattacctcccaaactctcaattctgcttgtctttaatttttcttgaataaattctgaactatggcctgttcttttctt

SEQ ID NO: 6359 - DNA, 2330 bp, Oryza sativa
  Predicted polypeptide sequence is orthologous to G2536
aaccatggatacaagctagctttgcttcttcttcttcgtcttcttgtaccaaatcattcaaagttttctttcttcaagccttcaatcttctatatatatctccctccatgatcaaccagctatagctacctcactccaacaatcgccgaccacgatggccaccacgaggagcggcgtcggcggcgccatcagcgacccatttgcgacgccggggttccgcttctacccgacggaggaggagcttctcggcttctacctccgccaccgcctcgccggcacgaggcccgacgtcgagcgcgtcatccccgtcgtcgacgtctacggctaccacccgtcccagctcgccgccctggccggggaggcgagcgcgcgcgacacggagcagtggttcttcttctgcccgcgcgccgagcgggagctccacggcggccggccggcgcgcaccacgccgtcggggtactggaaggccacgggatccccgtcctgcgtcatctcctccgccacaaacagggtcatcggcgtcaagcgcaccatggtgttctaccagggccgcgcccccaccggcaccaagacccgctggaagatgaacgagtacaaggccgtcgccgacgacgccgacgccgccgccgccgccatgctccacccaatggcgcctcccaggctgaggaacgagctgggagtgtgccgggtgtacatcagcacgggcacgctgagatcgttcgaccgccggccgctcgataatcaagcggcggcgcccaccaagcaacaggtgatgccatctttgacggcggcggcggcggtgaacacgaacctctgcggcggcggcggcggcgtcgtgttcgccggtgcacaaggagacagctcccgcgactgcagctcgtcgtcggggtcgcgagaactcgccggcggcgccgatgggtctgaagacgacgccatcgactggaactcgctcatcagtagcgccactgctgatgatctcggcttcaacaccgtcgttggttttgatcctagcatcgtcggatcatggccacaagtctagtgcttgattacgcgtaatataaaattaatcgagtttagtgatcagttagttttttgttttttttgcaagaagttcaaaaattattgctgtgtgttttgcactgagtagcaaagatgggaggattagaagatgaatcgattagtttgcaaatcaggtgaattaattagagtaattaacatctgtagtaatagtaagtagaaaatcaaaatgagaagttgtagcagaaagtgtatactaccacaaatccgttcttagtccgactccgaattaatcccagacggaagatcgatcgagaccgattcggagatggagccgattttgcttggaaatcaatggagaggtgaaatgggatcggattcatgggcggctacataagcaggagtcgagaggccgcaccagctcatcatcatcatcatcatcatctcattccccgcggttcgatcctcctcgcgctctcgtcgtcgtcgtcgtcatctccggttgatcgatcacttcacttcaagtcgatgtcggccatggcggctctccctgtgctgctcccgaccccgccgaggagcaagatgctgccgctgctcccgacgccgtgcctcgtcatcctccccgccaacttcgccacgtcggtggcctccaacgcgcccaagcccggccgcgccgacgccgccgacaggtgggacacgcacaagaaacccaccagctcgtcgtcgtcgtcaagctccagcaccgggagcgccagccgcgccgccgcctgcgagcgcaaagaacccggcagcccagcgtcgtcgtcgtcaagcagcggcgggaagcccggccgagccgactcctgcgagcgctgggacacgaacaaggccaagaaccagatcatcagcagcggccgcctcacgccggcgtcgtcgtcgtcgacgaacgcgcgctgggacatgaacaaggtcaagaacacggcgccgccgtcgaacagcaacaagcggccggtgagccgcgggtccgcctcggccgagcgctgggacatcagcaagaagcatcgctcgcaggacgccgccgccgccgctctcggctcggcgagtgatcggaagttgacgacggtggcaaagccgcagcagccgctgttctctgggccggcgttcctgacctcgccggagccaagcatgcttcccatgcccaccttcttgatggcccgatagcttctgcttgtgcatttcaacttcagatgaatcggactgtagttaggatgggatttgatgaagcatgttattctttgtgggtctgtttgtgatcaattgaattgaattgaact

SEQ ID NO: 6360 - DNA, 1248 bp, Oryza sativa
  Predicted polypeptide sequence is orthologous to G2536
gaatagcaatagcgccaagacatacagagaagccacagacgtcgaggcagctagcgcgcgggggaggacaggacactgcagcaagttggccggtgataagcgcgcgaactcgctggcaatatggccgacggcggcggccgccgggctcccgggttccgcttctacccgacggaggaggagctgatatgcttctacctccgcaacaagctcgacggcctccgcgacgacatcgagcgcgtcatccccgtcttcgacgtctactccgtcgacccgttgcagctctcagagattcaccacgagatgctgggcggcggcggcgaggagggggagccgtggttctacttctgcccgcggcaggagcgggaggcgcggggcggccggccgagccggaccacgccgtccgggtactggaaggcggcgggcaccccgggggtcgtctactccgccgaccgccggcccatcgggatgaagaagaccatggtgttctaccgcggccgcgcgccgtcgggaaccaagaccgcgtggaagatgaacgagtacagagcattccactaccccgacgcctcctccgcctccgcctccagcgccggcgccgccgcgccaccaaaccatcttcctccgcagctgaggagcgagttcagcctgtgtcgactgtacaccagatcgggaggcatccggcaattcgatcggcggccgctagcgggtggtggtgatgagaacccggggccatccatggctgccgcggcggcgtcacccgaggaaaacgacggatcaggaagttccatgcagcaactggagctgatggatcaaggtggcgccgttgatccggattgggaccagtgggacgacttggccaccttgaccgcacttctgtactggcctagagattagggatgccaattgtttacatgatcttgctcgtagtgctaactgtgaagtgcatgttacacgtatcaacgaccaagtgtagtacatgcttttttttcttttgccgcgcaaactctccagtattaacataagaaaaaaaaaatcagaacacacacaattttttttggtttctccaaatataattaattaattattgttttcttcagttaatcatatttttctagttggatcttcgcccttggccctgtgggatctcctccaacttttctgataataggatttgtttatactagttcatccgtcacaaaatgtaaggtatacatgtattttagatggtttcattaatacaatacttcttcg

SEQ ID NO: 6361 - DNA, 1150 bp, Oryza sativa
  Predicted polypeptide sequence is orthologous to G2536
atacgagcctttgctacccaccacgagagagacgcccaccgtacatcgatccatcgccggccggccgcacacggggtggattgagatcgatcgatcgatcgggcagcggcggacatgggagagctgcctccggggtaccggttctaccccactgaggaggagctggtgtgcttctacctccggcacaagctcgacggcggccgacgcgtccccgacatcgagcgcgtcatccccgtcgccgacgtctgctccctcgatccatggcagctcccagaggcgcaccagggcgcgtggaccggcgacggcgagccgtggttctacttctgcccgcggcaggagcgggaggcgcggggcgggcggccgagccgcacgacgccgtcggggtactggaaggccgcgggcacgccggggtgggtctactcctccgacggccgccccatcggcaccaagaagaccatggtgttctaccgcggccgcgcgccggcgggggccaagaccaagtggaagatgaacgagtacagggccttcgaggaagacgacgacaacgcagccgccgctgctccggcacagaaccattatctccagacgaggagtgacttcagcttgtgccggctgtacaccaggtcagggtgcccccggcagttcgatcgccggccgccgagctcctcggtggcaggcggcggcggcgagaaccgggcggcgccgtcatccaccgcggctgcgtttgccaacgaggatgctgctgaatcctccgggaagagtcagaagaggaaaaggagcgcgccagatgacagccttgacagcacctcatccagcgacgacaatggcggctgcgatggctctatgctgcagcaacagcagcagaggcagagaggaaccgatgaggagcttgtagagtgcagcatgacggactgggcagatcttttggactggttttgatgtaggaattcgattttacggtcggtcgtaaattcaagaaaacggcggtcgatctctaatttttgttgctaattttcattatttttttcgtgttgccaaaaaatattttagcagtcaaatggtaaattttgagaaagatctcagacagttggcagctcaaagacacaattttttaatgataacggaaactaataaaagcctgctgaaaatc

SEQ ID NO: 6362 - DNA, 387 bp, Oryza sativa
  Predicted polypeptide sequence is orthologous to G2543
cgccgcaagcgctaccaccgccacacgcctcgccagattcagcagctcgaggcgatgttcaaggagtgcccccacccggacgagaaccagcgggcgcagcttagccgggagctcgggttggagccgaggcagatcaagttctggttccagaatcgccggacccagatgaaggcgcagcacgagcgggcggacaactgcttcctccgcgccgagaacgacaagatccggtgcgagaacatcgccatccgcgaggccctcaagaacgtcatctgccccacctgcggcggccctcccgtcggcgaggactacttcgacgagcagaagcttcgcatggagaacgcccgcctcaaggaagagctggaccgcgtgtcgaacctgacgtcgaag

SEQ ID NO: 6363 - DNA, 228 bp, Oryza sativa
  Predicted polypeptide sequence is orthologous to G2543
atgacgcttgatgacggcaagtttgtcgtcgtcatgttcgggcccaacaaaaaagggccacagtccccttatgaagccatggagacacgcatcacgccgtcgctcatgtgccgtcgatcgatgcacgtcaatgatcggagcgggcgtcgccgatcggccgacatgggacgcatgaggcaccgcaagatggatcgatctacgtactgtactttgcatgccaccgcatga

SEQ ID NO: 6364 - DNA, 2096 bp, Oryza sativa
  Predicted polypeptide sequence is orthologous to G2557
gatgaacatgaggaccatcatatccctcatcccagatacatgatctgtactgtctcctcctctctagcttctctcctctccctgctgtgccccttgctttgttgcttggtcaattagagctaagcagcaagctagcttcctggaagcaaggccggcgcctggctgggacaagaaccacaggaaccacagctgactgattgatcaatcaatcaatcttctgctgccctgctgcctcacagcctcagcaagacaatcaattttggccctcttgaggctccggccggtcgccgactcgccgtcgtcgaaggtgctctccggccggcggagttaacattgagcttgatttcaagccgcgctccgatccgaccggcaaagcgccgaagctgccttccgtttgtttcactctggtctctgggggctcgccatcagccatccgtaccgagctgtagtgtgcgcggttttgtcgcgtcgtcgtacgtcgagaatccgtgagccagacagacaagccagtggtttggtgattcttgcggcggcgcggcgatggagaccttcggctgggccggcggcgggcagctgatgcaccacgacgacatctacttgccgcgctcggtggggtgcgggcggccgttcgagctggacgacgcgttcctgggcgcgtgcttcggcgcccagctccagtgcgacggtggcgtcggcggcggcgacggcggcgggtgtctgcagggtacctcgggatttggcgccgtggctggagacccgttggggttgctgtgctcgggggacgtgtttgcgtctgtcgccgagggcgccggcggcgcgcacgacgacggcctcctcgacgcggcgctcgccttctcccggaatcagctcgggggcgccgcctgcgacgggagcgacggcggggccgtgtcgaacggcgccatgctgtccagctacagcggcaccaccggcggcaacatctcctccggcgagtcgaataactacagcggcggcggcggtggctacgacgccgatgtggtgtcgccgacgtccaccatgtccgcagccacacagtcgctccaccccaagcgaaagctatacgacgaccaccaccaccccgccggcatagcagccgcagccgcagcgccaccgctggcgccgtgcccacgccccaccaccggcgccgtcgccgcgaagcggagggcttccacgtcagcaacaagcatcaccttcggccaccagccgcaccaccaccacgcgggcgccaccaccgccgggtacgagcctgacatggaagccatggcgcaggtgaaggagatgatctaccgggcggcggccatgcgccccgtccacctcggcacggaggccgccgccgacaagccccgccgcaagaacgtgcgcatctcgagcgacccgcagacggtggcggcgcgtctccggcgggagcgcgtcagcgaccgcctccgcgtcctgcagaagctggtccccggcggcaacaagatggacacggcgtccatgctcgacgaggcggccagctacctcaagttcctcaagtcccaggtccaaaagctggaaaccctaggcaccaccaccaccacgtccaagttaccgcagcagtattacagcggcaacatcaacagcagcaataatcaccatggattcctcggattcgcagcaaataacaacaccatttcagctggctacgcaaattctaatgctggaaatgcaacgaaactgttgtagcactgtggctagcacaagtacttgatacgcacaacgtacgcgtggtctcgtcgtctatatacatgtagtaacatgctgctgttttctactgtttctaggcttggtggtgatcagtgtacgtacacacggcacataattggagtcttaattagtggtggagtgcatgctgatttagttcgtggtcatgttcttgtgcaagatttagatttataatcttccgctggcggatcagctgcatggagtgagaagttacatcaaattaaaggggccatctgatggttcgttcaaaaaaaaaaaacgggtgccatctgatagaggaaaacatgtggttcaataatggaaaagagtggcctggacgagcaatttgcgagtgg

SEQ ID NO: 6365 - DNA, 1473 bp, Oryza sativa
  Predicted polypeptide sequence is orthologous to G2557
atgtttagatcagctgttgcagtgagccaatcagctgcctcatggaggttagctacgacgacgacggtgtggatggatcgtggcttcaacgagatgatcttgagcgagagcgtgtggaatggcggcggcggcggcggagatggagatggtggggcggtggtgctgccgccggaggtgggtggtgtcaatgcggtggacgggagcggcatgacgatgctggagaggctggtgctcgacgaggccctggcggcggcgatactcgagctgcagggcatccaggcgccggggtgcggcgggggcggcggcaaggtggcggtggtgccgccgccgacggccggtgacggcggcgtcgaggcggcggtcgccttcgcggcgatggcgacggggacgcctgcctacgctgacgttgacgcggatgtcctgcagcgacagcggcagcatcaccatcgccaccagggcgcgatggggatggctgccgagtacgacgtcgcaccagcaacaccggctgtcacgttgagcgctgtaccaccaccaccaccaccacctgcgttcgcgaccgcagccgcctccgttgacggcggcggcgccatggacgcgacggtcttctccggcatcggcaacgacgacgtcgtcgacgcggtgagcgccacggtggcgatgactactgccactgcaacgaccagccagtgcgaacgagtcagaggaggcggcggcggcggcggatgtggacgtaagcaacgccggccgggaagaaagcggaaggccgccgagccaaccgccgccgccgccgcggcggacatgtcgtcgcaggacaaccctctctgcagcctcctggcgtcgaacaccgccggcgccgacggcggcatccagatcgcgttcagcacgagcgccccggcgtcgaagcgggcgaagccgtcgctgagcagcagctcgtcgagcatcagcttcgacggcaggggccccggcggcaactgcggcggcggcggcggcgacgacccactgtacgagcccgacacggaggcgctggcgcaggtgaaggagatgatctaccgcgcggcggcgatgcgccccgtgaccctcggcgccgaggacgccggcgagcgcccccgccgccgcaacgtgcgcatctcctccgacccgcagacggtggcggcgcggcagcggcgggagcgcatcagcgagcgcctgcgcgtcctgcagaagctcgtccccggcggcgccaagatggacacggcctccatgctcgacgaggccgccaactacctccgcttcctcaagtcccagatcagggagctgcaaaccctagaccgccggaactacccgaacgccgccatgtccatcaacaccgccgccgccaccaccatggcgacatccagttcaccaacctacaacaacagcaacgccgccatgccagccttcgccttcccggaaaccctaggatgcggaggaggaggagtcgagcagctgatctaa

SEQ ID NO: 6366 - DNA, 1245 bp, Oryza sativa
  Predicted polypeptide sequence is orthologous to G2557
atggacgccttcgggtggagcgcgccagccgcgccgtgccagccgagctgcggccccggcggcgacgacgacgacgacgtcctcctcgccgccgtcttgggcgcgagcttcgagctccactccctcgtcgacggcggcggcaacggcgccgccggcgccgttcgctctgacgatgcctacggcctcgacgtcgacctgccgtcccaccagatgagcctcctgcgttgccaagatggtctgagtgctcttcacggcgacgcgtccccgacggcggcggcggcggcgttccttgactcggtggatgtgttgccagtgccggccatcgccggcgcgacgcacgacgacggcgggctcctcgataggttcgcgttcccgaacgttgccgagacgacgaccgtgcaagccgccgcgtcgaacaccgccttctccggatacagcagcaacaccaccggcggcggcaacatctcctccggcgagtcgaacacctacacggaggtggcgtcgacgccgtgcgccgtgtcgacgacgacgacgacgacggctctgcccccgtcgaagcggaagctaccagagaagtaccccgtcgtaggcacatcaccaacgacgaagaccacgacgacgtcggagacagccgcagagcgccggagcaccaagagaggggccgggggcagcagcagcatcacgttcggcggcggctgccacggcgccggtgcggcggcggcgctgctcggctacggccgcgggtacgagccggacacggaggcgatagcgcaggtgaaggagatggtctaccgcgcggcgccgatgcgcccggtcaccctcggcggccccgcctccgcctccgacccgtcatcccggccgccgccgccgccccagcggccgcggcgcaagaacgtgcgcatctccagcgacccgcagacggtggcggcgcggctgcggcgggagcgggtgagcgagcgcctgcgcgtgctgcagcggctggtccccggcggcagcaagatggacacggccaccatgctcgacgaggccgccagctacctcaagttcctcaagtcgcagctcgaggcgctggaaaccctagggaatggcaatggcaacggcaacctgttgcaccatggctactacactggatcaagaaatgctactgctactgctgctactggttctagcaatagcactgtacttgcatttgggcgagatggacttgctggctttgtgaaatccaataggaatttgcaattgtag

SEQ ID NO: 6367 - DNA, 702 bp, Oryza sativa
  Predicted polypeptide sequence is orthologous to G2557
gcgagtcgaacacctacacggaggtggcgtcgacgccgtgcgccgtgtcgacgacgacgacgacgacggctctgcccccgtcgaagcggaagctaccagagaagtaccccgtcgtaggcacatcaccaacgacgaagaccacgacgacgtcggagacagccgcagagcgccggagcaccaagagaggggccgggggcagcagcagcatcacgttcggcggcggctgccacggcgccgccccagcggccgcggcgcaagaacgtgcgcatctccagcgacccgcagacggtggcggcgcggctgcggcgggagcgggtgagcgagcgcctgcgcgtgctgcagcggctggtccccggcggcagcaagatggacacggccaccatgctcgacgaggccgccagctacctcaagttcctcaagtcgcagctcgaggcgctggaaaccctagggaatggcaatggcaacggcaacctgttgcaccatggctactacactggatccaagaaatgctactgctactgctgctactggttctagcaatagcactgtacttgcatttgggcgagatggacttgctggctttgtgaaatccaataggaatttgcaattgtagtactgtgtaccatgcatgattcatgcatgcatgcaaggtgtgtattcgtgtgagtgacatatatatattttatacagtgcagtgagaca

SEQ ID NO: 6368 - DNA, 695 bp, Oryza sativa
  misc_feature (676)..(676): n is a, c, g, or t
  Predicted polypeptide sequence is orthologous to G2559
gctgagaaagctgcagcaacaggtggctcacacgaaagagacgctctcctgacgacggtcgccacggagaagaggatatcgctgatcaaggcgtgggaggagaacgaaaaggccaaggccgacaacaagtcagtaatactaatagtagctcttctctcacttcttgccaaggctgagttattttcttcaactttgaaccgtgctcgcttttcattagcacgttttttaaactattaaataatgtgctttataaaaacattttatatagaaaataaattcaaactaggtcgaaagatataaaattcctgcattccaaatgagccctcggttaactgaaactttcgcgcacagggcggccaagaagttggccgacatcgcctcatgggagaactccaaggtggccgagatcgaggccgagattaagaagtaccaagagtacctggagaggaagaaggcggacaggtggagaagttgatgaacggcgtggcgaaggtgcacagggcggcggaggagaagcgagcggcgacggaggcgcggcgaggggaggaggtggtgaaggccgaggaggccgcagcaaagtaccgcgccaagggagagccgcccaagaagttgctctttcggttgaatctcttctcggtcatctccattgatcgtcgtcgtcgtcgtcgttgttgtnaatgtgtgtgcgacagtgt

SEQ ID NO: 6369 - DNA, 975 bp, Oryza sativa
  Predicted polypeptide sequence is orthologous to G2559
aaatacactcttctctgagcttcctcaagcttctgaaaacagcaagagattaaattatcgtaattttaagcatccaaggtgtttggtgccagtgctcgaggactggagatggagacccaggaggcgaagagagcagatgtggcggcggcgccggcgacggcgaccggcggtgaggccgtcaaaccggccgccggcgatgctggcgcagtaaccaagacgaatggaccttcagcaccagcaggcaaagctgcaactccaacgggttcggttgacagagacgccatactcgcaaacgtggagctggagaggaaactgtcaatgatcaaggcgtgggaggagagcgagaagagcaaagcggagaacaaggctcagaagaagatgtcatccatactctcatgggagaacacgaggaaggcagctatagaagcaaaactgcgaacacaagaggagaagctggagaggaagaaggcggagtacgcggagaagatgaggaaccaggtagcggcgatccacaaggcggcggaggagaagagggcgacggtggaggcgacgcggcacgaggagataatcaagtatgaggagatggccgccaagcacaggtccaaggggactacacccaccaaattcctctcttgtttcggctcctagaaccacaaaaaacgctcctgcagtgcagtctcctgtcctgtgtgctgatgcttctgtgtgttgatatggtgatcagtttgcagttttgggcttgtttctcttctttaatcttctgtgttgaagttccggatttcatggctctgtcatgctgctgctgtgttttccttttcgctgaagatgtgatcatcatgtttggtgagtgtaagcatactcaaaacacttgtaaacagtcagtcacatgtaaacataccaccttttttgtgaattttgcgcttccagagattaagaaaaaaagcgtgccaatttgttttgttggtgctttgtatc

SEQ ID NO: 6370 - DNA, 1037 bp, Oryza sativa
  Predicted polypeptide sequence is orthologous to G2559
acagtgcgttgtccatcacaattgctaattaactaagacacccttccttgattgtgacactagcacgacgcactttcctctatatacatatacatatatcctccttccgtccagctaacggtttatatgcttagctagctgtttgttttggcgataccatttgcattgcttgcccagcatcgtcgtcgtcgtcgtcgggagcaaggaggaggagagaccatcgatcttgattgatttgaagctagatggcggaggaggcgaagaaggtggaggtgaccaaggacatcgccgaagagaaggcagtggtgccgctgccgacgccgccggccaccgagcacgacgactccaaggccatcgtcctcgtcaaggaagctgaggctacaggaggttcagctgaaagagatgcttatctcgcaaaaattgtgtcggagaagagattggtactgatcaatgcctgggaggaaagcgagaaagctagagcagagaacagggcggccaagaagctgtcatacatcacttcatgggagaatgcaaagaaagcagagatggaggctgagctgaaaaggatcgagcaagaactggagaagaagaaggcggcgtacgaagagaagctgaagaacaagctggcattgctgcacaagacggcggaggagaagagggcgctcaccacggcgaagcgtggcgaggagctgatcatggcggaggagatggccgccaagtaccgtgcaaagggcgaggctccgacgaagctgttcgggctcttgaaagcctgagagaaatcatgaggagttcatcatacatatatgctgggatttggtgttgttgattagtctgtgaacttacagaaatttgtatatgtgcaatgcatggcatccgtgtttgcgtcgtgtgtatgtcgtctaattgaagggccatttggtttgtattttgtcagttgggtggtttgatttctggtgcgttttgtaaaggaattgtgtatatgcataggggagtgcaggcaggggatgatggattatgaatacgcttattctttcatg

SEQ ID NO: 6371 - DNA, 950 bp, Oryza sativa
  Predicted polypeptide sequence is orthologous to G2559
caagcttctgaaaacagcaagagattaaattatcgtaattttaagcatccaaggtgtttggtgccagtgctcgaggactggagatggagacccaggaggcgaagagagcagatgtggcggcggcgccggcgacggcgaccggcggtgaggccgtcaaaccggccgccggcgatgctggcgcagtaaccaagacgaatggaccttcagcaccagcaggcaaagctgcaactccaacgggttcggttgacagagacgccatactcgcaaacgtggagctggagaggaaactgtcaatgatcaaggcgtgggaggagagcgagaagagcaaagcggagaacaaggctcagaagaagatgtcatccatactctcatgggagaacacgaggaaggcagctatagaagcaaaactgcgaacacaagaggagaagctggagaggaagaaggcggagtacgcggagaagatgaggaaccaggtagcggcgatccacaaggcggcggaggagaagagggcgacggtggaggcgacgcggcacgaggagataatcaagtatgaggagatggccgccaagcacaggtccaaggggactacacccaccaaattcctctcttgtttcggctcctagaaccacaaaaaacgctcctgcagtgcagtctcctgtcctgtgtgctgatgcttctgtgtgttgatatggtgatcagtttgcagttttgggcttgtttctcttctttaatcttctgtgttgaagttccggatttcatggctctgtcatgctgctgctgtgttttccttttcgctgaagatgtgatcatcatgtttggtgagtgtaagcatactcaaaacacttgtaaacagtcagtcacatgtaaacataccaccttttttgtgaattttgcgcttccagagattaagaaaaaaagcgtgccaatttgttttgttggtgctttgtatc

SEQ ID NO: 6372 - DNA, 2575 bp, Oryza sativa
  Predicted polypeptide sequence is orthologous to G2565
gatcgactcaaaccgaatccgctcggctcgcatgggcgaccgccaccgctgtcttctgtcggcgccgccctcgccgtcgacagccacagtcgctgccgccaccgggagccaaaatcggcgccgccgccatcgaaatcgattcgatttctctcctttcctcctctcgtgtattttccggccaccgaaaaccctatctcttccaaaaaaatccccaaatcggcgccggctgctgggtctacgggaggtcgccggctgctgggtctacgggagggcgaggcctgctggggaccttgactgccgcatcggcaggggcagccggccggcggtaggtggcagcggcagggcagcatgccgcagcagcagcaggccatggctgtcgcgaggcagaccctcttgttgcatgctatggctctggctctagctatgtcacagcgtgaacaggccctataccgaagctgccgatggaagaaagcaatgtcatagctgcagcacaacagaggtacattttttttgagaatttcagaacattccaaatagaaaggtttaaatttattattgaacttgcagttgtgtaattgtttgtggagttttgattagtctaaaataacaccgctgatactagagtatgttgcacaaaatggtacacgctcaattgctctggacagactattgaaaatactaactccttatattaaaggaattagaacaaagtcattgatttcgactagtatcttggaaggtgtaacatccattagtttatctttttatccttcttctgagcaccccccaaaattgcagctaacttccttctaaaatattttatatcttcctgcaaaattcataaaggtatttgttagatagaaacaatcaattgaggacttgtaaagaagatgcaaaaatatttagtgcatcttacatgcgtgtattccttcgacaacctattgccttgccagtgctccatgttttttagtacaaagagcccacatgagacgctggaagaattgaattatattagagaagtgataacatacatttaggtagtgaaaaaaactattattgtagtggctgcataacatacagatctccttgtaatggcaaattctgtatgaccgtgacttcccaggaagtaatatgatggtcaggccattgtgttgctatgtgcttttcttctggttccaacagctgaaaatattgttgtaatccttctagctgttttgtgagaaaacgtcattactgcggtatgttcatgtcctttttggtttatttctaagtagaatacttacaacttttcttagttccttgcgttgtgtggatgaattcgccatggagtcaagcacttggatgatgcggcgtttggcgtgtatgactgccaggtaccgatgtttttcttttatgttcatggggaggaaaatctgtacaaagaaatcatttgtaggatatattagtagtataaacttgctgaaaatttgatagtattgtggcataaatattaccatatcatgctttagatatctatttgccgttgctttagccattgcccgatcgatgatgtctttggaaacatagtgttcgccatctctttgtagcaaccttgttattaacggtttctctaggaacaccgtaccttctgccctagtccctgtaccttccttcatatctttctcacgtagacaagtaacgtatgcatcgattatttaaaagtagaggaaaatggcaggttatgattgtgctagtagttgcatgagagaatagtttcacgggttagtaaacttacgtgatcatccaaatagctcgtacttgattcagtcactggattagtcagaatttgcattgttttttgggaaattgagacatcatcgatatgcaccactagttgtgattctggtgcactcattatacttttaatggtttcctcatcttctgcggtgcacttgaactctgccattgaagttaaatctgtaagtgaactgcaacacaaaaattaagcagagtaggatgtgatgataattataggacttttaccattggatattaaattctttgcttgcgcattctttggtttcttctttgtagcccctaaattgtagatgaaatcagaatttgatttaattgttgatttacgcaatcttcatgttgatcctgaaagtgacttggcaatgacgggcgtttgagttggtgggtttggtttctgctattcaattggcattttaaaaataattagtattaaatttgacagacactgaagaagtaagatgttgtcttaccttttttttaattatatgtgtttctttgtcgaaacttttgcaaacatttggcttagagttcttggaagttggtattgtcttttcctctttgaatgcagctattatgttggtgagtgattgaatttggttatgcatggactgttgattctgcttcatctccttcatctcctttccttgctcttctatcagcatgattagttttcgggtcagtgactcagtttctggcctatcctgcataatatgtgtttgttaagttttgagacatatgctgttgtaattcaaataaatagtaacaaaagtataattttttg

SEQ ID NO: 6373 - DNA, 773 bp, Oryza sativa
  Predicted polypeptide sequence is orthologous to G2571
gaattaccttttattccccttcaaagaatttacaacacaatgacaatcacaagttacagtcttgctagctctagcacaaatgtcacttcaccagcaagacaaccttcctctgttactcactgaaaatttcagacatagcacacgatgaataaaacacactggaaatttcagatatatcgactccaatcactgctatcctacagacatcattttcagatatgtcgactccaatccctgctatcgtacagacatcttctagcttaattggaatcacggctgtggcaaccctccagcgggtcctatccattctgagacatgctacaattgttgcgctgcctgacgaggccatgctgctgcagcagaagctgtaccgcggcgtgcggggcagccgcagtggggcaagtgggtggcgtagatccggctgccgcagaaccgggtgcgcgtctggctcggcacctacgactcggcgacggagtagcgctcggcgaggacggcgacggagcagcgctcggcgggatggcgcggcgctgctctcggcgaggacggcgccgctctaggtgacgacggcgacgggacggtcctccatcctcgactgcaagtccggatgacgtggtggcagtgaaccctttccttcctcgtgccgaattcctgcagcccgggggatccactagttctagagcggccgccaccgcggtggagctccaattcgccctatagtgagtcgtattacgcgcgctcactggccgtcgttttacaacgtcgtgactgggaaa

SEQ ID NO: 6374 - DNA, 535 bp, Oryza sativa
  Predicted polypeptide sequence is orthologous to G2571
gcacgaggcagaatgcccttcccgccttgcccgtaacatccgctggtaattacgaaattaccctcgcggctccgggattcccatggacgccagcctccgcacactgcctccggcgagcttccccggcgaggtccgctccgccgtctcctccctcctcctctctcccggcggcagcgccctcgacaccgtgttctcccacctcccgccgcccgtcaccgtcccgcctctcggctccagcgtctactaccgccagagcgagctcctgcgccacttcgccgcgtcgcaggcggcgcaggcgcagagcgccaccgccgccgccagctcgtcgtcggccgccgcggcgggtctcgacgatggcgcgccgcggaagctgtaccgcggcgtgcggcagcggcagtgggggaagtgggtggccgagatcaggctgccgcagaaccgggtgcgcgtgtggctcggcacctacgactcgccggagaccgccgcgcacgcctacgaccgcgccgcgttcaagctccgcggcgagtacgcgcgcctc

SEQ ID NO: 6375 - DNA, 495 bp, Oryza sativa
  Predicted polypeptide sequence is orthologous to G2571
caggccatccgcgtccgcatggcgcgcaagcgcgcgcgcgcgcgccgccagcgcgaggagagcaagaagagccaacgcgccgaggacgcgaagtcggcgacgccgtctcgccccgtggcctccgagcgctccgcgtccgagacgacgacgacgacaaccacgacgtcgtcgtcgtacgggtcaccggacggcgtgctctccatgagcgcggcgtccgtcgacggcgactgcccgctcgagcggatgccgtcgttcgatcccgagttgatctgggagatgcttaacttctagctgcgtagatggagtacgaaccatggacacgaaccaaccgacaccaaggtccatggatggccatgattggttgcagagtttgagctcttagaaattcttcgctgttaggtgatgatggattattggttatttgtgaaggttataacctagaaatattagaaggatatcagcaataaatcgtcccgagaaaattgggcttgttag

SEQ ID NO: 6376 - DNA, 600 bp, Oryza sativa
  Predicted polypeptide sequence is orthologous to G2574
atgaaacttttgaagagaatggattacccggccaggcggtcaagcgaagaaagaaaaagttctgctgtcgaggttggcggcgaaagaggtgcgccgccgcccagcagcggcggctctgtcgtctcgcggaggggacgttgtggccccatgcacggcagcgacgcgcgcggctgcagccggcgtccggcggcaacgccgggcatgcacgagagacatcagccatcaagttgggccaaagctcgtgcggtggcgcatcccagatgcgagcgaagacagaggaaggtcgtgggcgtatcgctggcgtatcttgatttatttatttttttgcaaatcacaaatatgtgggatacgtacgggatacgtattggagcgtatccgatacgtatccgtatccgttgccgtatccgacacggatacgtgactatacaagcatatcaggatgggacaggcggcatcgcacccacgtcctaccctgtgtcaggcggcgtggggcaaggcgaaggacgacgctggggcccacctgaggacgagcggccaccttactttcggcctaaggcatgggcggtagctcgacccaggttgatgtgggcccctctctag

SEQ ID NO: 6377 - DNA, 483 bp, Oryza sativa
  misc_feature (297)..(297): n is a, c, g, or t
  Predicted polypeptide sequence is orthologous to G2574
ttttttttttttttttttgtcctttgaatcttatcgatctttaccgaagtggacatcccaggaccacaaaacccacagcatcttcagaacattcgacgaattcatgacatgttacactgagtatgaatcacacaaaactcttgactaacttataccggtaccttcccactcttataaccataacgagaaccagcacttaaggcggaactcccgacttcggtagtaagaattcttaatttggccaaaaggccaagtcccccactaatggaccaaaggggaatcaccaaatatacttgngctggaattctctcgatttattccaatcttcccgaggcggtccttaggtccgacgccctttggtaccctgctgtgctctgccctatagcgctccgaaacccgttagctttacgctaccctcctacgcacggtcaatctcgtcgcgccttgttggtccacactggttctcgccccccaccgttactc

SEQ ID NO: 6378 - DNA, 673 bp, Oryza sativa
  misc_feature (11)..(75): n is a, c, g, or t
  Predicted polypeptide sequence is orthologous to G2574
tgcgcgatgtnnnnnnnnnnnnnnnnnnnnnnnnnnnnnnnnnnnnnnnnnnnnnnnnnnnnnnnnnnnnnnnnnttttttttttcagtagatcatcaacttaatttacaggtggaaaattaaggcgagctatgtagttaaatgcccctatgtgatgtggtggcaaatcttgaccaacaaaaagaagaattcaaagaagaagaagacatattactggcttgatccatacatatagcacagccctagagcacagcctactacccgccggatcttgaatgtgcagcgccgtgcgagcgacccgacactgaacgaacagaacgagcacgtgacgcgaccccattgtgacccattctgtgcgaacatctggcacctcgaaatctaccttgacacagcatctactaccagactcacaccaacaccgaatatctagacaatccgtatacataggacaaagcggttataccaggaccatctgcacgcccatgcataccattactacgctcccatggacgtccaaggtccacagctccgaggcagcggctagcacgactgacgatcgatccttcgctacgagctgtctcgccgcacagcgcgatccaaggggccccttagacccccgcaccccggacccagcggttgacccccctctcggcacagaagaacagagcgagcg

SEQ ID NO: 6379 - DNA, 1947 bp, Oryza sativa
  Predicted polypeptide sequence is orthologous to G2575
gagaggttgtggttagctagctcgaggcgcggacgcggtgttatgggcgttgccgtgcactggcggagggcgggcgattcgcttcacatggggggcgagccgcgcgcgcgcgcggaggcggcctgggcggctgcgttgcctgccgcgttggttgcgctggtgcgcgacacggctacatacacacgaatgatgcaccgtctccgaatggaaacgccacggggccccacctgccagcttgacccctgctgctgctgctgcactgcacatgttattccccctccgcctccggtgtcacgcacgcacgcgacgcgacgcgatgccgaggcgtccgtaccaccaccgccagcatcagcggccgtcagctcgagatcggacggcacgggacagatggcagcaggcgtcacgctggcgtgtgccgcccccccgccgctaagggccccacgtgccagcgatggaggcaggcgccgtggggtggtcaaagggggcgcggggacggacacgtgtcggtcgccgcaacgtctgaatgttcgaccgcgcgagagagagagggtgcgtgcgtgcgtgcgtgctagagccaagaaccacgagcacggccagcgtcggcgagaggcggcggtggatccggctatgtcgggcgagtaccagttccaggacgagctggcgccgctgttcgcgcggccggggggcggcgcgggggagatgcagatgctgccgtcgtcgtggttcgccgactacctgcaggcggggacgccgatgcagatggactacgacctgatgtgccgcgcgctggagctgccggtcggggaggacgtcaagagggaggtcggggtggtggacgtcgtcgcggccggcggcggcggggcgccgccgctgacgccgaacacgacgtcgtcgatgtcgacgtcgtcgagcgagggggttggtggaggaggtggaggcggcgccggcgccggcgccggggaggaggagtcgccggcaaggtgcaagaaggaggaggatgagaacaaagaggaaggcaagggagaagaagatgaaggacacaagaacaagaaagggtcggcggcgaagggagggaaggcggggaagggggagaagcgggcgaggcagccgcggttcgcgttcatgaccaagagcgaggtcgaccacctcgaggacggctaccggtggcgcaagtacggccagaaggccgtcaagaacagcccataccccaggagctactacaggtgcacgacgcagaagtgcccggtgaagaagcgggtggagcggtcgtaccaggacccggcggtggtgatcaccacgtacgagggcaagcacacgcaccccatcccggccacgctccgcggcagcacgcacctgctcgccgcgcacgcgcaggcggccgcggcggcggcggccgcgcaccagctgcaccaccaccacggccaccacggacaccacggcatggcgccgccgttgccgctgggctccggcgccgccgcgcagttcggccggtcgtccggcatcgacgtgctgagcagcttcctgccgcgcgccgccgccgcccaccacggcatgactacgatgggcggcgccgcggcgacgacgacgacgagccatggccttaacagtgcaatcagcggcggaggcggcgtctcgagcgagacgacgagcgcggtcaccgtcgccgcctcggctcagccgtcgtcaccggcggcgctccagatgcagcacttcatggcgcaagacttgggcctcctgcaggacatgctgctgccgtccttcatccacggcaccaaccagccttgacgcgacgaccaccatcaatctgaagctgaattaatcatcagactagctagacaagaggtcatttggctctcgatcgatcatgctgtttaattaattaacatctcgttacatctttttccccccaaatgatcacctctgtttcgtttcttgatttgttttttt

SEQ ID NO: 6380 - DNA, 1525 bp, Oryza sativa
  Predicted polypeptide sequence is orthologous to G2579
acacacaagctaagcttagctcgagctcattcatataccttagcttagctaaagcctagctcactctcactctcactcttgcattgcattgcaatattgcaatattgcattggtcatgaacactcgaggcagcggcagtagcagcagcagcagcagcagccaggccagcctgatggcgttctcggagccgccgaagccggcgagccagccgtcgccgccgtcgtcgccgatgagcgagcggccgccgtcggggcgcagcaggcggcgcgcgcaggagccagggaggttcctcggcgtgcggcggcggccgtgggggaggtacgctgccgagatacgcgacccgaccaccaaggagcggcactggctgggcacgttcgacacggcgcaggaggcggcgctggcgtacgaccgcgccgcgctgtccatgaagggcgcccaggcgcgcaccaacttcgtctacacccacgccgcctacaactacccgccgttcctcgcgccgttccacgcgccgcagtacgccgctgccgccgccgcgccgtcctcggtgcagtacggcggcggcgtgggcgcggcgccgcacattggctcgtacggtcaccaccaccaccaccaccaccaccacggacatggcgcggcgtcgggcgcgtcgtcggtgggcgagtgctcgacgatgccggtgatggtcccggttgatccccaccgctccagcatgtcgtcgtcgctgctggacatggacaggaacggccacgacttcctcttctccggcgccgacgacaactccgggtacctgagcagcgtggtgccggagagctgcctccggccgaggggcggcggcgccgcggccgatcatcaggacatgcggcgctactccgacgccgacgcctacggcatgatggggctccgggaggacgtcgacgacctcgcgcagatggtcgccggcttctggggcggcggcgacgcggcggaccagctcggcgcctgcgggttcccggcgagcggcggcgccgccgacatggtcgcctcgtcgcagggctccgactcctactctccattcagcttcctctcccattgatcgagttgcaccgggcattgcatggctaatcacgcactttgcctctgagcgatcatgcatatatcatttcctgtctaccatgatcagatcgagttgatcttgatcaatctgcgtttgatcgatcgagcaagagatcgagtagtatagcagcagcagcagcagcagctagcagtagatcgaacaagaagagtggcttggcgccatttctagttaattaagtagagcttcttcaaatatgtacttaggcagatgatctctctctctctctctctctctctctctctctctctctctcttctatattagcattagtacctacttagccatcatattcatgcatgcatgcatgatatattgcatggcacagcttgttaatttcttctagcatcttaatcaattaatccatgacctggttcaaaatgtccaattcgattttacattttacaactaacc

SEQ ID NO: 6381 - DNA, 1128 bp, Oryza sativa
  Predicted polypeptide sequence is orthologous to G2585
atggcatttggtcaagataccatagagcagctgtaccgggagctcgccggcggccgccgcctcagcgccaagctccaggcgctgctcgaaggccccctcgatagccgcggccagaaggaggccgtcgatgttagcagagagctcgggcgagtgttcatggtgtctctctacatgctgaagccttgcagcaacagcagcagacgaccggaaggagtgaccaggacggcgccggagacgaggactgacgatagcatttgcttgcacactccggcgagggttaaacgcgttaggagtgaagaggttcttgtcagaaatggcagagaagaggtggttacgaggacggagattattacaccttccccgtacaaggatggctaccagtggagaaaatacgggcaaaagaacattcaggacagcaattatctaaggttgtacttcaagtgcacgttcagccgcgagcggagttgcgcggcgaagaagcaagtgcagcagcgggacgccggcgagccgcccatgttccttgtcacctacctcaacgagcacacgtgccagcagccgcaagctgttcccggcacgcccaacactgcaggtagctcgccgacgacgacgagccggcaacgacagtcgtcctcctccccgccggcggaaatgttggacctgacgatgaacggcgccggcctctttagccgtcttcttttaccccacgccgtcggcggcggcggcagcgccgccgaagaggaggccgccatcgtcacgtgcctcgcggcggtcatcagcggaggaggcgccgcagccgctccgccgccgttgatctggccgacatcggccccagaggcggcgttcgtggcgtccgcggcgggacactcgccgagcgccgcggacgagagcgtggcggacgaggcggcggcggcgcagatggccgacatggactactgtttcggccagtacgatcagtcaacgttcggggcggcagcagcagcggatcaccgtgtgttgatcggtgacgacggcgacgtgcagcgcatcgtcgcggcgcggatcgcggacacggtgtggccgcggtacacgcgcgacacgagtgcatgggagactgctgggacgtcgtcgatgagaggatcgatcgattga

SEQ ID NO: 6382 - DNA, 255 bp, Oryza sativa
  Predicted polypeptide sequence is orthologous to G2590
atggcgcggcaggcaacgacactagatccacttgtcccgaggtcgtcgccggcggatctgcccttcccttggccattggcagtggatctagccctcccgcaatggtcgccggcggatccgcccctccccgcctccgctatccgcgggcgttgctgcgccgctgtatgccgcagcgtcttcactgtctacgggcattatgctgtgcaaccgtatgtcgcagtgcctccgccgtccgccggtagcgccgccgtctga

SEQ ID NO: 6383 - DNA, 680 bp, Oryza sativa
  misc_feature (638)..(638): n is a, c, g, or t
  Predicted polypeptide sequence is orthologous to G2592, G2713
ctccttccagccaccaatccattgcagaattttcgtgctcaatttcggataaatgttgggtgttctgtttggtgggttgagagcttgaattcgagccgttttcttgcttcttcgagctggtggtggttttcttggcccttggattgattctgggattcagcggcggagacacctacctccgcgtgaggatttctgccatttcttgcttgctgcgtcgagggatttggtccccgccctgcttgcttccagctcagttcggtgccttgttggtgttcatcgatggattccggcatgggcggcgacgccatggagacattacggtgaaattagctcggcccgtctctcgcctgcagatttgagagattggaggagaggtgtggattaggagggggaatcgagcgaggaggaagatgtcgttcaggagcctgatccaggagatgagggacgagttcgggagcatctcgcggcacagcctgcggtcgcggtcccaccgcggcggcggcggcgcgccgcgggtggcggcggtggggccggcggaggcggcggcgatgcagcagagctgctgggcgcagctgccgcccgagctgctccgggaggtgctggtgaggatcgaggagtcggaggtgtggtggccgtcncggagggacgtggtggcgtgcgccagcgtctgccggagctgg

SEQ ID NO: 6384 - DNA, 2027 bp, Oryza sativa
  Predicted polypeptide sequence is orthologous to G2592, G2713
gagtatcttccccgttccttcccttggcgtaagagaacgagaaatctcccatctctcagtcgtctcccccgcttccttgcgccaagacgagtcgcggctgagcaggagaggggcgccgatctccatccggcgagcagagcaggggaggggatcctggtatagattgttgattgcttgtgcgtgaacacaactaaagcagtaattcttaccgtgtcagcgtgatctgggactgtggccaattgtaccataagtggaaacacagctgcgaagattgtcggtggtcttcgctgataatatattgggcaggctaagtttcaagttcagtttgctgaattcagcgagcctagatgtcgtttcgcagcattgttcgtgatgttagggatagttttggtagcctgtcgaggcgaagctttgaggtcaccctggctggtctatcggggcttaccggccaccatagaggcaagtctcagagtacggttcacgagctctgtgatgcagatctcataatccaggagagtcgttgggctagcctccctcctgagctcctccgcgatgtgatccggaggctggaggctagtgagagcacctggccgtcacgcaaggatgtcgtgtcctgtgctgccgtctgtaaggcatggagggagatgtgtaaagagattgtgctgagcccggagttttgcgggaagcttaccttcccgctctctctaaagcagcctggccctcgagatggaatgattcaatgtttcataaagcgggataaatctaaatcaacttatcatctctacttgtgcctgagtactgctgtacttgcggatagtggcaagttcctcttgtccgctaaaaggcaccgcaaaacaacctgcacagaatatgttatctcaatggatgcagacaacatttcaagatcaagcagcacctatattggaaaactaaggtcaaacttccttggcacaaaatttataatctatgacacacagccctcttataatggggctgtaatccctcctgttggacggagcagccgaagattcaactccaagaaagtgtctcctaagatgccgtctggtagttataacatagctcaggtgacatatgagcttaatgttcttggcaccaggggccctaggcggatgcactgtgtcatgcactccatacctgcctcctcagtcgagcctggtggcattgtccctggccagcccgagcagattgttccccgagctttcgaggagtcatttcgcagcaccacctccttttctaagtcatccatcatggatcggtccatggatttcagtagttcccgtgatttcagcagtgctcgcttttcagacattgctggaggcaccataaatggtgatgaagaggggcaaaataaggagaggccactagtgcttcgcaacaaggcccctaggtggcatgagcagctccaatgctggtgccttaatttccgtgggcgtgtaaccattgcgtcggtaaagaatttccagttgattgctgcaccagcacagcctcccgcaggggctccaactccgtcacaacctgctccaccagagcaggacaagattattctacagtttggtaaggtagcaaaagatatgttcacaatggattaccgctatccgctctcagctttccaggcatttgcaatatgtttaagtagcttcgacacaaaactggcctgcgaatgagggaaacagtgagctctaatggaggcagaactggaaatgcaacagagagcaacttgagaaatgtaatgcccaagggctctagatcatgtttgcattttgttgtgtcgtcttggctgtatttctgcttgtagcctggaactggatttctcagcctgtatgtttcacctggtagcaccatgataggtttcctttgggacagcggttcatgcattgcatttttccatttgtgtggtgtacatgcggttccggatttaagctgaaaggatccgttcatgtctttgttaagctttgcatggatgccgtgttctggtaaagaaaagggaaagattcagtgcttcactt

SEQ ID NO: 6385 - DNA, 2102 bp, Oryza sativa
  Predicted polypeptide sequence is orthologous to G2592, G2713
ttttactcaagtctacgtgatgtgcagcctggcccaagagacggcactcttaaatgtttcataagaagaaaccggactactcagacatattatctgtatattgggctcacagaagcacttgccgatgatgggaagttcctacttgctgcacgcaaatgcaggaagcccacatgcacagactacctgatttcccttgacatgagtgatatgtcaaaggggagcaacacctatattggcaagctaaggtcaaactttctcggaacaaagtttaccgtctatgatgcccatccaccatatgatggagctgttgtctcaaaaagtcggtctgcacgtgtggttggtctgaaccaagtctccccgagagttcctgccgggaattacccagtttcacatatttcctacgaattgaatgttttgggtgcaagaggtccaagaaggatgaactgcattatggattccatccccacatcagctgttcaagagggtgggaaagctccgacacagactgaatttcctctcagtggcctcgactctttcccatcaatttcattcttcagatcaaaatcagctcgaatagatagtgcaacttcacaattatccactcagaaggaagaaaagctggttctgaagaataaatctcctaggtggcatgagcaactgcaatgttggtgcctcaacttccgtggacgggttactgttgcctcagtgaaaaactttcagctggtggcgtctgatgaaaatgggccaactaaccaggagcaggacaaggtgattctccagtttggaaagattgggaaggacttgttcaccatggactaccgttatccgatatcagcatttcaatcatttgcaatctgtctgagcagttttgataccaaaatagcctgtgaatgagataaggtgatcatttctctctattcagctttactactatcgacatttacacatggttacttaccctgcttgatataatgacacttaatacttgcttttatctagatggtcttcagtttacctaattgtttcttcaacagtattatgaaagctgactcacattttcagaaccttccaaacttcagacactagatagtcagattaggagtactagtagagcagtagttgatccaaaatctgagctggctgttaggcatatctgaattcatcggtctgcccatatgcaaatcgagcttttctgttgggatgtcacatcagaagagaatagatggcaacacatgtatgcaatttgcaccagatgatagctgccctctgtgttttacccttagctccgtaatcactactgattcagcctgttctgtaaactacagttgcatacttgcttgggtacggtttatgtgccatgaaacgtgacacgaagcaaagaaaaataattttagagtagggattttatgtttctactcttagcggtttaaatagaaaacaataagaaaaccacgtagaccaatctgaaattaagtttcaaaaattcaaatttagccttggtttataggctgacgagttgccaatggaactcgcaaaaatacctcttaagctgcagttgcgcagttgttttccatcactgtccaggcatagctgcattcatgcagctaaatcacaatcagatgaaccgcatcctaatcaagatttttggccgcgaatgcaatgtacctgcaggtgctggatgaaggacgaaccgtggaagcatgataagctggatcggcaggcgtagcgtgcacgagtcacgcttgacattgaagcacaaggatttgtttggatttgggcagaaaaaaaaacaccaagtccatctcctgaagttgctgccccggatgctgctgctgcagtgtacataatagccacctgtgatctttctggcctcctggcttgtaattctgttctagtttgttttttttttctaattgttacacattcttgggcggtgccggctgttgaaacctagagagtttcttcttctttttaatctcccccaatttacattgtaaacggcaggcttgtgtagccaaaaatgccaagttgtgtgttgcaagttgcaacttgatgtgttctttaaattagtgtaatacatggagtaataggctgcagtgctg

SEQ ID NO: 6386 - DNA, 1941 bp, Oryza sativa
  Predicted polypeptide sequence is orthologous to G2592, G2713
gaccaccacttgttctttccttcccctcctcttcctcctcctcctccgatccccatgcctcctccgcctccgcctccctcccccgccggccaccgctagctgccgccggcgccacccccgagcggttgcgcctagggttcttgattttgagcttcggagcgaggcgaggcggagatgtcgttccgcagcattgtccgcgacgtgcgcgacgggttcgggagcctgtccaggcgagggttcgaggtgaggctggtggggcaccggagggggaggtctcacagcgcggtgcacgagctgcgtgacggccacgcggccgccgccgccgccaacgtggtccagagcagctgctgggctaacctgccgccggagttgctccgggacgtgatcgagcggctggaggccagcgaggcggcgtggccgtccaggaagaacgtcgtcgcgtgcgccgccgtatgccggacatggagggacatgtgtagagagatcgtcaagaaccccgagttttgcgggaagatcacttttcctgtttccctcaagcagcctgggccccggaatggagccatccagtgcttcattaaaagggataaatctacccaaacttacaacctatatctatgtcttagctcagctgtgctcgttgaaagtggcaagttccttttatcggcgaaaagatactcccgtgcaacctgtacagaatatacaatatttatgagtgctgacaatacatctaggtcaagcaacatgtacattggaaaattgaggtcaaatcttctcggaacaaagtttgtaatatatgatacccaacctccatgcaacacagccaatgtttcacagtcagggaaaacaagccgtaggttctactccaggaaggtgtcgccaaagaacccttccagcacctacagcatagctcaagtttcatatgaactgaatgtcttggggactcggggtcctaggcggatgaactgtgtgatgcactcaatccctgcctcatcgcttgaggctggtggcactgtcccatgccagccagacagtgtgcttgcacgctctcttgatgagtcatttggcagcatctccttttccaagtcatccattatggaccgctctatccgtttcagcagtagcagatattctgacatctcagtaggtggccccatggtcggaggccaggcattgggtgacagtgatgagtccaaggagaggccattgattctccgtaacaaggccccaagatggcacgagcagttgcagtgctggtgcctcaacttcaagggcagggtaaccgtcgcgtctgtgaagaacttccagcttgttgctgcaacacagcctgctgctggagccccgacgccatcgcaacctgccccgccgcctccacctgatcatgacaaggtcatactacaatttggtaaggttgcgaaggatatgttcacaatggactatcgttaccccctttcggccttccaggcctttgcaatctgcttgagtagtttcgacaccaagctggcctgcgaatgaaatcatcggtgcgaaagcatggttatcgattattgtaacaaattgggccccctccaaatttagctgggggctctatcctgttgtttgctatttatgccctattaacttgtagtcattagaaaaccaatgttttttttctagacatgttccctgatttgtagatgctgttgtgttgtatctgtatccctacattctccttttcttttgttttttttaacaggttgctctgtagaagcatatttgctctgcctgtaactgtaataattagctgactgaattgttatgttcatgcttggcttgtgcctagagtttcaaatcttgagttgtatcaaaatttcgtaatggctgcctgttgtgggagatgtgcaatgtatttttgatgaactttgttgagttgcaataaagcaacaatcagttccatgtgcttcc

SEQ ID NO: 6387 - DNA, 1994 bp, Oryza sativa
  Predicted polypeptide sequence is orthologous to G2592, G2713
gccacccgccttccctttcctctcttctcctctactcctcgccttcttcttcttcttcttcttcttcttcttcctcttgctgttcttcgctcgcgcccgcccaccactgcaactcctcgtctccccctccgccgcgttgccgggtggagttgccttgcccgagaggagcgggcacttcgggtttgtgagagtgagagctctgtgcagcggacaggtttgaggcggcggcggcggggctcccactcggccgaatggactgctagtagcggttgcttctatgtgtacagtatctaaccttctaaccattttcaaaggaggtcatattttgtagggcatcgtatgccttattatctggcattggctggtttagatgtcgtttcgtagcatagttcgcgatgtccgggatggttttggaagcttgtcaagaaggagctttgaggtgacccttgcaagtctttatggacttactgggcatcacaaagggaagactcagagctcattggatgagctcgatgactcacctgctataatcccagagagccgctgggcaagtcttccgcccgaactcctccgtgaggtcatacggagactggaggctgatgagagtacatggccatcccgaaggaatgtcgtctgctttgcagctgtttgtaggacatggagggaaatgtgtaaagagactgtgttgagcccagagttttgtgggaaacttacctttccggtctctataaagcagcctggtcctcgagatggtatgattcaatgttatataaagaggaatagatcaaaatccacctaccatctctatctgtgccttagcaacgttgttactgcggaaggtgggaaattcgtcttagccgctaaaagacaccgtaaaacaacttgcacagagtacactatttcaatggtttctggcaacatctcaaggtcgagcagaactaatattggaaaattgaggtcaaatttccttggcacaaaatttataatttatgacacacagcccccttacaatggggctgtagtccctcacgtcggaaggaccagcaagagatttaactcaacgaaagtttctccgaaggttccttctgttacttataacatagctcaggtgagctatgaactaaatgtccttggcacaagaggtcctagacggatgcgttgcatgatgcactccatacctgcctcctcggtggagcctggtggcatagtccctggccagcctgagcaaattgtacctcgagctctggaggactcatttcgcagcaccacctccttctctcaatcattccggagcaccacctccttctctaagtccatcatggacccatccatggatttcagtagtgctcgcttctctgacatcagtggttctataatgggtggtgatgacaatggtgaaatcaaggagaggcccttagtgctccgtaacaagcccacgagatggcatgagcagctacagtgctggtgcctgaacttccgtggccgtgtcaccattgcctcagtgaagaatttccagctggttgctgcaccaagccctcctcctgctggtgctccaactccttcgcaacctggtccagccgaccccgaaaaggttattctgcagtttggaaaagttgcaagggatatgttcacaatggactaccgctatcctctctctgccttccaggctttcgctatttgtttgagcagtttcgacacgaaattggcatgtgaataattgttggaagaaggaaaaactgaagaagggcaagaaaagagttcagatgtctggggataggttactagttgatgtttgcatttttttttcttgttttctcggttgtaattgtgcttgttgtagccttgaactagacgtatatgcaggaaagcatgcttttatgtgccctcatgcatgatagaggtaaggagccacatatcatccactgatccatactccatactgtgatgatgtatctgctgtgccattgccaacacaactgtgaaaggttccctcc

SEQ ID NO: 6388 - DNA, 3316 bp, Oryza sativa
  Predicted polypeptide sequence is orthologous to G2592, G2713
gaaatctttagcctgagagagagggagagtgagagaagaagaagggagggtgattgctctgatctggagctggttggggggaaaggagttgggagaatctcatgggagctgtgatgaaatgggggaggagaagctccttgatccgttcttgagccgggaaatttgatctttttaagctgcggggttggggggaaatttggatcttgaggctacccgagcgcgaagcctggtttcttccggtgctccgttgctgcattgccttgttgcccccagatccgagctgccgtgcgagggaaactcggatctttgcttgcgctctccccaaatctgcccaaaatttgggctctggagcaagctgtgttcgtggtagccccccgtgcttcaaatccttttcagaaagttcatttgtttagttgggggttagatatggcagtgatgcggactactttatgaggtgtctcctgccatttttttttagagtagattcgtcagtaatggcggatcttgccatggagtagtagtagtagtagtagtagtagtagtagcagggggttccttcggtgatagcgaagggtgcttagccattaagcggcggcgatgtctctgaagagcattgtgcgggagctgagggagatgagggacggcatcggcagcatgtcgaggcgagccgctgacgggcgcgccggcggcgggcgcggcggctcgcggcattcttggccggtcctgtggtcggagcagcagcagccgccgcagcagcagcagctgcagcgtcaggagcatcagcagcagcaggggcggtgggcgaacctgccgccggagctgctgctggacgtgatccagagggtggaggccagcgaggcgacgtggccggcgcggcggcaggtggtggcgtgcgccgccgtctgccgctcgtggcgcgaggtcaccaaggaggtggtgaagacgctcgaggagtgcggcaggatcaccttccccatctccctcaagcagccggggcctcgtgagcatccagtgcagtgctttgtgaggagggacagggcgacttccacctatctcctctacctggggctcagcccatgtaagttaaatttacatctctgtttttggttgttgacaaaatatatggcttacaaatcttgttctactaccaatttataagagtatcatgtaccatcagtccatcagtattcagtactagtccagttcatctgcatcaagatgtgttgtttctgccatttgcaacagtgaaaaaccagaataagctgtttgaatgagttactaccattgttaattcggtttaccgaaatctgtgtcaggtaatgaattgtgttccttaaggctaaggttaggggaatgcaatctgctatgggtgtttcatatgcatagcaaattttcattatttacacgagcagatgttttctagtgcctgcatgtatatgaagattttgtttgtcctgcctgtctttgagcgctacattatgcaaaaattcaaccgcggaggagtactcagtgacaagaaaagataatgttcgccttttccgatcacatcagctgaactggttgctcctccagatcgagaaggaaaccaactgtgactaataaacatagagcctgtaaaggttgtttcaacgcacttggctacctcattaacacaagtctttgtagcgtagcaaatgtacaagatcctaagctgaacctaaccgttgaacgtgcggtgctttactattttccggaataggttagacaatatgtgcaggcaatccatgatatgcatgccattctgcagattcctattcactctagatgcataaatatctacttctaacccccctatctaccaggctgtgggtgcagtccacaacaaacttggtacgtatgctgtttagtacttcctctgtcccaaaatataagaacctaggatcgtgtccagattcgtagtactaggaaatgtctcatccgattcgaagttcttatattttgggacggagggagtaggatgtattataagggctaaatagctcatctcctgttttgaaaatttgaatagagctaatatggaactcagaatacggacaattaatgttgactacatcactaactattattctatttatgaatgcagctctacatggagaaaacgacaagcttttgcttgcagcacgcaagattaggcgtgcgaccaggacttcttttgtgatctcactggtctccaatgacttctctctatccagtagcacctatgttggtaaactgaagtaagcactttataatgttgactttaagtaatttggttattctcttacttctagaaagctcactcaaatttattcccctgtatcagaccaaacttccttggcacaaagtttacaatctttgacagccagcctccttgcgatgctgtagtgttgccaaacaaccgaccaagcaaacgacatttcaagcaagtatcaccgcgattgccactaggcaattacaatgttgctacggtctcatatgagctcactgtcctacgtaatcgaggaccaaggagaatgcaatgcaccatgcactctataccggcattgtgtattcaggaaggtgggaaggccccaacccctgccggcatcatccactcacttgacgaacaagttcccgccttatcaactagcaaaggaaaggaaccagccatagaattttcatcgacaagcctcagcgctgatttgtctggaccggtctgtacaaatgaagtgcctcttgttctgaagaacaaagctccccgctggcatgagcagctgcagtgctggtgcctcaacttccgagggcgtgttacagtagcatcagtcaagaacttccagctcgttgcctcagttgatccttcccttggtatccctgcggcagagcaggagaaggtcatcctccaatttgggaaaatcggaaaggatatattcacaatggattataggtacccgctctcggcgttccaggcatttgcgatctgcctgactagctttgacaccaaaccggcgtgcgaataactgaagaaaggtatcaaacctgtgtcttctctctatttagctcaggcagcgtctgattccgttggatgctgtaaaattctcggtcttgctatgccaaaatgagcctactcctgggggagacagtagctttgtcagatcaagatgaacaatggcatctatatcttggcaactggcaaaaccccaggaaagatttgagtgacaatgctgtaaccaacaaactgctattgtactattgttcttggaatgtttagcggtgaaatatcactgcgctatggataatatggacgctgttcatcgtgccc

SEQ ID NO: 6389 - DNA, 1826 bp, Oryza sativa
  Predicted polypeptide sequence is orthologous to G2592, G2713
cttgcataaaagaaaatcccccgtctcgtctcctccgctccttgtgcctgcgcccatcgactccatctggcgactcgcgagagcagagcaggggagggggaggggaagggcgccgtcgtcctgttgttcactcctgacctgcatcacatctggagatgtctttccgcagcatagttcgtgatttcagggacagtttcgggactctatccaagcggagtttcgaggtgaaaatttcaggcttttcgggccgtcacagagggaaatccattggaccatcaagcgagctggatgacacgcccgtggtagctcagcaaagcaagtgggctggtcttcctcctgaattacttcgcgacgtgatgaaaaggctggaggaagatgatagcaattggccctcccgcaaggatgatgttgcctgcgcttcagtttgtacgacttggagagacatgtgcaaagatattgtcaggaaccctgaattttgtggaaagcttacatttccagtgtctcttaagcagcctggacctcgagatggagtaatccaatgtttcataaaaagggacaaatcaaaactaacttatcatctctacctgtgccttagctctgctgtgcttgatgagactggaaagttcctactatcagctaaaaggagccggcgaacgacacacactgactacatcatttctatggactccaaaaatatctcccgatcaagtagtggctatattgggaagttgaggtcaaatttcctcggcaccaaattcatcatctatgacacgcagcctccatacaatgctcggacactttgctcacaagaacggacgagccgtcggttctcctctaggaaagtttccccaaaagttccaacgggttgttatcccatcgtgcaggtgaattatgagctaaatgtgcttggaacccggggaccaagacggatgcaatgcgctatgcattccatcccagcatcagcagtagagcctggtggcattgtgcctggccaacctaaagagctcctcccaaggttatttgaggagtccttccgcagtatggcaacttccttctccaagtactccatcacagatcattcgacagacttcagtagttctcgcttctctgagtttgggggaggggctctgcaagggcaagagcaagagcaagatggcgatgatgtgaacaaggagaggcctttggttctccggaacaaagcaccaaggtggcatgaacagctgcaatgctggtgcctcaacttccgtggccgtgtgacggtggcttcagtgaagaacttccagctgatagctgctgcacctcagccatcttctggagccgcctctgaaccttcacaggcagggcaggctgcacaacagcaaacccaaccttctcagccatcgagttcgtcgtcgtcgtcatcatccaaccatgatacggtgatcctgcaattcggcaaagttgcaaaggacatgttcaccatggattaccggtacccattgtcggccttccaggcttttgctatctgtttgaccagctttgacaccaagctggcatgtgaataaatgagtagaatagcgatcagaaagcactccagtgtacctgaggacctaagccactccaggcgtatggtattttaggataggagaattctgtgtctagtcacttgtgtgtattcatgtgcagttctttggttgaatccttgtgttcctccggcgtgcgtgtttgttagaagtgtaaaaaggggattgaagtgtagatgtctgtaagatagaacaagatcttgtttcttgtatgttgggcttaaaaagttttgagcaagagaatgaatgaatggttgagggagc

SEQ ID NO: 6390 - DNA, 2073 bp, Oryza sativa
  Predicted polypeptide sequence is orthologous to G2592, G2713
ggtctcctctcacaccacacgcctcgcatcgcatccccacctccgccgatcccgccgtctccggccatctccgccgccggcagccaccaccacctcctcctcttcccctctcccccttccgcccaattggttgccccgaccaaaccctacacgcggaagggctcgctcgctcgatccggtgcgggcagcgcgcgcgcggggctcgacgcgggcggcgacggggggcgggctcgatccggcggagcagtgggcgctctcttccacgatgcgtctaccctcttcgcgcgagcacgacaaggttctttttgcggggtcaacaataatgaggagaatttgagttggtctggaattactctgggatgttatcattggcgaaaagtatagatcccttttggtagctgaggagagatctcaattttttcagagagtagatgtcgtttcgcagcatcgtgcgcgatgtgagggatggatttgggagcctatcgaggaggggatttgaggtcaggattctggggcatcgcagggggaagtctcatggtgctgtccatgagttgcatgacccggtgcctgtaatccagagcagctgctgggctagcttgcctccggaattgcttcgtgatatcattgagaggttggaagaaagtgaggctacatggccttctaggaagcatgtggttgcttgtgcgggtgtctgcagaacatggagggagatgtgtaaagagatcgtcaagaatccagagttgtgtgggaagatcaccttccctatttctctgagcctgggccacgagatggaactatgcagtgtttcattaggagggataagtctacgcagacctactatttgtacctctctcttggctctgctgtgcttgttgacaatggcaaattccttctatcagcaaaaagaaactggcatgcaacatgtacagaatatgtgatatctatgaatgctaacaatttatctaggtctaccaacacaaacattggaaaattgaggtcaaacttccttggcacaaagtttgtaatatatgatacccacactccgtacaatgcaactagtgattcacagtcagggaaaacaagccgaagattctccaacaagggaacagcaaagcatccctgcagcacatatagcatagcaaacatctcatatgagctaaacgtctttggaactcggggtcctaggcggatgtgctgtttaatgcactccatccctgcctcatctcttgaggctggtgggactgttcctagccagccggatagcatccttgcccattccctcaatgaatcctcctttaggagtgtctccttttcgaaatcgtccgttatggaccattccatgcatttcagcagtgctcagttctctgacatctcaattggagatggcccaaggattgggggccgggtattgagcgatgatgaggagtgcaaggagacacctttgattctccaaaacaaggctccaagatggcatgagcagctacagtgctggtgcttaaacttccggggccgggtaactgttgcttctgtcaagaacttccagctcatcgcagccacgcagcctgctgcgggagccccaactccatcacagcctgttccaccacccccaccagagcatgataaggtcatactgcaattcgggaaggttgccaaggacatgttcaccatggattaccactacccgctctcagccttccaggcatttgctatctccctgagtagtttcgacaccaagctggcctgcgaatagaacttccaggcaggccagaaacatcatggatgcttcttatttgacgccctgagggcatgcccctggatggagctgaccatccccaagtttagcctgggacgccgttctgttgtatgttactgatgatgtgttaactcagaaacacccaagcaacaaaaggcaaattgttattttagcatttagcttatttattctgattttgctttgtaattgaatgttatctttatttctttttgacccatagctctctctataacaggtattctgtatgtgcatcggataattttcgcagaattcatttgactgttctccagtgatttatt

SEQ ID NO: 6391 - DNA, 3119 bp, Oryza sativa
  Predicted polypeptide sequence is orthologous to G2592, G2713
ggctgtttctctttcaactgcttcacactgttgctctcttccctctctgcacctgcaaccaccaccacaaccatataccagtaccatcgaggaggttgccttctcttccggtcggaagcttgctttccttttcttcttcttcttttcagatccaaggttaatttcagccgacacacacaggaattgaacctgtgctcttcccaggtttctgtctgtctgcaaagttggccgctttctgcagattcatttcctttgccacgttttctgctgcaaaagttggatctttgcaagggggactggctgatttcatttgaggtttctgaataagttggggagcttgatttggagagggttacttttttgggggtgatgtttcgatttgcaaatcagaacaagattacttaagtgctgctaagctcaattggaagtggaagatcttggtcacgcggcatcaggtgaaagtttggtcgctgtgcatttttcacaagggatgtctttccgcagcatagtccgtgatgttagggacagcttcgggagcttatcaagacggagtttcgaggtgagaatttcaggcctccctggtctttctggccatcacagagggaagtcccttggatctttgagcgagctgcgtgacagacctgtagtagtagatcaaagcagatgggttggtcttcctcctgaattactccgtgatgtgatgaaaagactggaggaaggagagagcaattggccgtcccgcaaagatgttgttgcctgtgcagcagtctgccgaacatggagagagatatgtaaggatatagtgcaaagcccggaaatctgtggaaagctcacttttcctgtgtctctaaaacagcctgggcctcgagatggtttaatccagtgttttatcaaaagggacaaatcaaaattaacttattatctctacctgtgtcttagccctgctgtgctcagcgagaatggaaaattccttcttgcagctaagaggaatcgtcgggcaacttctacggaatacataatttctgtggattctaaaaacatctcacggtcaagtaatggttatgttggaaaaatgaggtcaaattttcttggcaccaaattcgttgtctacgatacacagcccccgtacaatgctgggagcctcatgtcatgtcagcatggcagccggcgaatctcttctaggagggtttccccaaagttacccaccggtagctacccaattgctcatgtgaaatatgagttgaacgttcttggcactagggggccgaggcgtatgcaatgcaccatgcattcgatcccagcctcagcagttgatcctgaaggtgtggtgcctggtcagccagagcagcttctcccaggtccattcgaggagtcgtttcgcagcacaaacacctcctccaggttctctttcatggacagatctctggacttcagcagctcccgcttctcggaaatcagtggatcagcgaaccaacagggcgaggatgatatacctgaggctaaggagaggcctttggttctacgaaacaaagtgccaagatggcatgagcagctgcaatgttggtgcctcaacttccgtggccgggtaactgtggcttctgtcaagaatttccagctgatagctgctgcgtcctctgaatcttcacagttggagcagcagcagcagcagcagcagcaaaaccatgcttcgagttcttcttcggcatccgatcatggcaagatgatcctgcagtttggtaaggttggcaaggacatgttcaccatggactaccggtaccctctctcagcattccaggctttcgccatctgtttgaccagcttcgacaccaagctggcttgtgaataacatacatcagtactataagtgtgtttgtatagcgtgtcagtgtgtgtggatagtataaacatcagtcagtctcgttgtgtgcagatgcaggtgcagtttgttgttgctgttgatttagttgtctgttcttcttgtgtggcagatgtgaacaaagaatggcaacacatctcaagtgcagttgtttgctgctactacatttatatcatgtaagtatttggaggttggaagtggaacaaccccaggctcctctagtttctcgagagggtatgcatcttacttgcgaatgtgatttatctactcggtctatatatcttggtatcctttaggatcatagctgctatatgagagaagctacactgctacagcctgcatatgtgcttgaaggagccacttggaaaggaggcaatatcagttgatcgattcataggcatgcagattatgtacaattaacacttaacagtaatgaagcaccattcctgcaatcttggaaacaaatcctagatgaaaaaaaaaagaaaccttcataaactgcttaacgggagatcgttacaggaagaaccctatgatatgactgactaatcaacagcccactcaaaatcccaggaagagatggcaacactcaacatacgtcaaatgacatccggattccatttgtacacctgatgaataacaagttgttggttgtcagcaatccatgaaaacaacttcacttttcacagccacattcatgtatttgtcaacaaagtacatcaggatgttgtttcttctcaggagatgaagggagtgcagcattgccagttggcaagatctccagatctctaacctcactagaactctcaatcttagttcttgtaattgggatctcattgtctaaaccaggtgagcagtcagctctgcgatatttcacgccattgctttcaactcccaactcttcgtcacccagttcatctgaccgacgttgtgaggtcttaaggatgtcgaggcccatctcaagatcatcctcgactttggctcgtggacggtggggtgtctcctcttctgctacattggaacggctgattcgtggtggtgctaccccatggtcctcttgaacaattgctctcaggttgatccttgaaggcgctcttttggtgcagaagaattcagaacagttgttcatgcaaccacggtcaaacacgttggattggttgttgtatttgtacttgaggttctcatatgttgccttcaaaaaaggaagtggaaattcaattcagatcacagttttcaatttttc

SEQ ID NO: 6392 - DNA, 1949 bp, Oryza sativa
  Predicted polypeptide sequence is orthologous to G2592, G2713
gacgacgaaaaggccacagctttcaatataaacaaacaccaaacgaatcccttcttagcggtagtgcatccccatccatccattctcgcacaagattccatcttttcatccaccaatctcgcgaaatctccgtctaattcaagaaaagatgagctgaggaatgagaggaaatattggtgttgcgaattgtggattgggaatttggagtttggattaggaggaggaggaggaggagaagattaggcgatgtctttcaggagcgtgatccaggaggtgaagggcgagatcggcgccatctcgcggcgggggttcaggtcgcggccggggcgagtccggcgagtggcggcggcggcggaggagccgccggacgagtcgtcggcggcggcgctggtgatgcgggagagctgctggacgcagctgccgccggagctcctgcgggaggtgctggcgagggtggaggagtcggaggggtggtggccgcgccgccgcgacgtggtggcgtgcgccggcgtctgccggagctggagggggatcgtcagggagatcgtgcgcaccccggaggcgtccgggaacctcaccttcccaatctctctcaagcagcctggcccgagggatgctcctatgaaatgtttcattgtaaggaaccggaccactcagacatattacctgtacattggactgactgatgcattaactgatgatgggaagttcctacttgctgcacgcaaatgtcgtaggaccacatgcactgagtacctgatttcgcttgatatgaacgatatatcaaagaggactgatagttatgttggcaaactaagatctaacttcttgggaaccaaatttactatctatgatgcccatccaccttatgctggagatgtgatttcaaagggtcagtctgcacgtgtgattggttcaaaccatttatcccccaggatacctgctgggaattatccagtctcacatatttcatatgaattgaacgttttgggttctaggggcccgagaaggatgcactgcgctatggattctatccctgtatcagcaattgaacaaggaggaacagctccgacgcagactgaatttcctttgagttaccatgaatctttcacatcaattccctttttcaaatcaaaatcagttcgagcgaataattcaactgcttcattactcactcaaaatggaagcaaactggtgttgaagaacaagtccccgaggtggcacgaacatctgcagtgctggtgccttaacttccatggacgggtaacggttgcatcggtaaagaacttccagctggtggcttcagatgagagtaacccaaccaaccaggaacacgatgatgtgatcctccagtttggtaaagttgggaaggacatgttcaccatggattaccgctatcctatctcggcatttcaggcgtttgcgatatgtctgagcagctttgacaccaaaatagcgtgcgaatgagtgaaggtgtgattctttcttccatgatcgaatgaaccgtttcctgatgacccacattgcaagctggccatgcactctgcttagttgcttccaccttttggaagcatgcagaatagagacataaataaaagttgctttaaatctaacattttagttgggtagggatatgtaacctgcaatttagctttcttgaagtatgttcaacctgcaacatttgagtgacttgtaagtcttgagtttaactacaggtgttggataaccacaattgacagctcaggattatgtgtatacttgtccctttggaaatccatagatgtatctgtttgcatagatatgcttatgttacattcttctattaccagaatgaagcagagctattggatcttgtttcaaaaaaaaacatgaaatgtacatgagacccttttttttcacatcgaataatgttctggctcaattgttcatggaaaaaaatgttaccatgt

SEQ ID NO: 6393 - DNA, 401 bp, Oryza sativa
  Predicted polypeptide sequence is orthologous to G2592, G2713
gaaaccaacgaaaccatccgaatcgatgatcgaacgattcaaagcaggagatacgactggtctccattgttgtgtaaataaggctcctacttggaacgaagctaccaattctttcgttctaaactttaataatcgagtgaaacaagcttctgtaaagaacttccaaatcgtcgaagagaatcatcctgaagacgtatggatgcaattcggaagaatcagtgaaggacaattcgcattagattacagatatcctctttcactcttgcaagcatttgctatcgcaatgactggattcgataataaattagcttgtgattaaaacatgatctccaaagaaaaacaaacgaaattgtaaagaagaaaaaagggttttcatcaaaataaaaagccgtttaattctc

SEQ ID NO: 6394 - DNA, 581 bp, Oryza sativa
  misc_feature (27)..(27): n is a, c, g, or t
  misc_feature (43)..(43): n is a, c, g, or t
  misc_feature (53)..(53): n is a, c, g, or t
  misc_feature (59)..(59): n is a, c, g, or t
  misc_feature (62)..(62): n is a, c, g, or t
  misc_feature (68)..(70): n is a, c, g, or t
  misc_feature (77)..(77): n is a, c, g, or t
  misc_feature (84)..(84): n is a, c, g, or t
  misc_feature (86)..(86): n is a, c, g, or t
  misc_feature (92)..(92): n is a, c, g, or t
  misc_feature (99)..(99): n is a, c, g, or t
  misc_feature (102)..(102): n is a, c, g, or t
  misc_feature (115)..(115): n is a, c, g, or t
  misc_feature (122)..(123): n is a, c, g, or t
  misc_feature (221)..(221): n is a, c, g, or t
  misc_feature (311)..(311): n is a, c, g, or t
  misc_feature (340)..(340): n is a, c, g, or t
  misc_feature (365)..(365): n is a, c, g, or t
  misc_feature (373)..(373): n is a, c, g, or t
  misc_feature (421)..(421): n is a, c, g, or t
  misc_feature (436)..(436): n is a, c, g, or t
  misc_feature (438)..(438): n is a, c, g, or t
  misc_feature (440)..(440): n is a, c, g, or t
  misc_feature (443)..(443): n is a, c, g, or t
  misc_feature (460)..(460): n is a, c, g, or t
  misc_feature (471)..(471): n is a, c, g, or t
  misc_feature (497)..(497): n is a, c, g, or t
  misc_feature (513)..(513): n is a, c, g, or t
  misc_feature (515)..(515): n is a, c, g, or t
  misc_feature (522)..(522): n is a, c, g, or t
  misc_feature (528)..(528): n is a, c, g, or t
  misc_feature (530)..(530): n is a, c, g, or t
  misc_feature (532)..(532): n is a, c, g, or t
  misc_feature (534)..(534): n is a, c, g, or t
  misc_feature (539)..(539): n is a, c, g, or t
  misc_feature (548)..(548): n is a, c, g, or t
  Predicted polypeptide sequence is orthologous to G2604
tttaaggtttttggcggggaaaggganagaccaacaacctccncccccggaanagtttnttnttaacnnncccgggngggcggnanaaaaanttggttngtntacaatggttctngctgtcnnctggctatggaagcaaatcaagttgcgcatgttaaactgcgggaactgccgtatgctgctcatgttccaatatggcgcaaggtctgtcaaatgcgcantctgcaattttgtgacatcagttgggggctcacctggtatagaccagaaagcccagcagctgaaactgctgaagtgccataaatattcanaaaagaacttctcaaaccgatgctttganttgcacatgtttagaattcttcccngaaacatnttttttctcccttttttatctccctttccccccaatttccaccttccntccttggatatgganananccngcgggaataaatgaaanttttgctaaanacctatgctcaaaattcgtccaatcntctgtttgaccgaacnanattgacnattatntncntnaaccnatgataatntttatgcattaaaaaaaaaaaaaaaaaaaaaaa

SEQ ID NO: 6395 - DNA, 832 bp, Oryza sativa
  Predicted polypeptide sequence is orthologous to G2604
gtgatttcagttgcctgactgttgctggaatctgtgaagcatctacaagcgatgccatcggttcaggcagctggcacagcaatgccggttccccttgccccatatccaactcctgtgccatttacacctcccaatggtatggattccaacttggcactgcaagaacacagctacattttgagttttttttccctgatgttggttggtcacctagaaatgttggtacatgccatagtgttcgccctgatgcattcttttggactagaaatcttatgaactgaatttcaatagacagctttttcttgaatcagatgttactgttcctggttcagaggttgcagtttattctgctcatagaaatcctgaaagtttagagagaactccttgttgagaaaatggaagtttttttactgctgagtttcgttgtctgaaatgaaaatgatgcatggaagatgcttttgttgtctgaaaatgaaaatgttagctgctgaaatgcgacattcagtcagtctctgaatttcaggggcccaaagccagctcgtttgctctgggtgccgtaatctgctcatgtatccagccggagcaacgtcgatttgctgcgcagtctgcagtaccgtgaccgtggtgcctgcccccgaaatctagctgcaatgttcacgaaaataaagagagattaaaggggaatacaaatggcttcagggctccgcaacagtgcgcgtgtcgcgttgatggtgtgcctgcactcaggtcgctcgagaagaagtacacactgaagttgctctggtcatatttacattattgtgtgtaactcttccttgtttgcttttcagtc

SEQ ID NO: 6396 - DNA, 1713 bp, Oryza sativa
  Predicted polypeptide sequence is orthologous to G2604
ggaacagatggcggtgctgtacgtcaccttcttgaggttgattgactaaaaaccttgaaaatactccctccgtttcacaatataagtcattctagcatttcccatattcatattgatgttaatgaatctatacatatatatatatctagattcattaacatcaatatgaatatgaaaaatgctagaatgacttacattatgaaacggaggaagtagttggcaagggaggtggatgtggggaggggttgagttgctctatgtgctcactggttgaagctgattgttgcgctcctatctacctcacttatttaccaggaggtgttaagctcattcggtgagaattttacctactcctttcactgcattttccttgaccacacttagattaaaattatagcttccttcctggtagtagcaaattgtggcaccaatgtggcacatatttattggttatctaaattattttcttatattgtgtcttgactctatttggtgttgtaaggcaggttagtggctgattaattagctgcattatgctaccccgttattactagcttaaataagttgatctgttcttgatgcaatttatacatctatgagctggtcacttcatcagctttactcaggtaggggtctttcctacatgagtggctattctctccaaactaataaaaattcatgtgagttttgttggtattttagcacaaaaaaaagtactcaaatagctgtttgcctggatgctatacccaccaatgaattttcaattatgggatggttcttattttttttgtacatgtaaacagaacctgaacatcagatttgatgagagattcaaccaagaagctaaaattttttgcgactgatgtgcattgctgaaccagttttctgttgcataaagagtcctgaaacttcttgttgcaaactgaagtggtgttctaaccagttttcttcttgctttctcattagcttctcttgaatctttctgtaggtttctttcctgtagggaaaggaaaggtgatttcagttgcctgactgttgctggaatctgtgaagcatctacaagcgatgccatcggttcaggcagctggcacagcaatgccggttccccttgccccatatccaactcctgtgccatttacacctcccaatggggcccaaagccagctcgtttgctctgggtgccgtaatctgctcatgtatccagccggagcaacgtcgatttgctgcgcagtctgcagtaccgtgaccgtggtgcctgcccccgaaatctagctgcaatgttcacgaaaataaagagagattaaaggggaatacaaatggcttcagggctccgcaacagtgcgcgtcgcgttgatggtgtgcctgcactcaggtcgctcgagaagaagtacacactgaagttgctctggtcatatttacattattgtgtgtaactcttccttgtttgcttttcagtctaggatagagatttacatgtcaaagagtcaagtgcacttttgaaagtgtaatgcgatgcaagtaaaaacaattttggacaagatcaaaaggatccatgtcatttgctgtcagaatagtaatgtttgttacttaatgaggtttgttacaaaccttaattacaggaatatcattgtagtagttcttaactttttacactcctatttgtagatgtacatatatttatgtacaattatcagatggactattttatacact

SEQ ID NO: 6397 - DNA, 1555 bp, Oryza sativa
  Predicted polypeptide sequence is orthologous to G2604
ttgcgccgtcccggttgccgaccgccgccgctgccgcctccgcctccccctcgcgccgccaccgccgccgccgctgagcgccatcgccgtcccccatcgcgctgccacctccgcctcccgccgtccccattgccgaccgcctccgcctccgcctccgccaaccctagccgccgctgccagtcccctcctcccttcggtgaggcgagcagccatctccgccttggccaccgccgtcgctgagcgctgccgcttccgcctccgcctcacgccgccgctaccaacagccgcctccggccgccggcgtccggatctgggctccatgtggccgcaggcgtacagatccgccctccgttgccgctgccatcaaagaaacgacggtggtgacgaagccggcatcaatgaaggcggtggctgcggcgagaagaggtgaaccgtacatcgccaggctgatctgccgacgagctcggcggcaacatggtcggtcaactggcgctacggtcgatctggatggctcactcacaaggcaagcctgtcatcacaatgtcctagagccgggtcgccccattgagggtctggtgctgcgtccctcctcatcctctccctcacgcagctacaagattggaatcactccggttaacgagaaacgcgtccagccaaccacttctcctcggtgactatttttctcttccctccagccctggcagcaatagagcaagctcatgtcaccgtagtcgcatgctcttgggggaggagatactagcagccggcctaaggaaatcttcaattcttcatcgccgtcgcttcctcaagttcaagaactggtgtaatagttgatagagctatacttgcagaagataaaaaacatggtggcttcaagagctccaaggagtgaatctccatggctaaagaagcccatgcatggagtttcaggctcaactgccatggctagcaccccatggagctcgatgccaccaagcagccattccctgggggcccaaagccagctcgtctgctctgggtgccgtaacctgctcatgtatccagccggagcaacgtcgatttgctgcgcagtctgcggtaccgtgaccgcggtgcctgcccccgagcagaaatctagctgcaatgttcacgaaaataaagagagattaaaggggaatacaaatggcttcagggctccgcaacggtgcgcgcgtcgcgttgatggtgcctgcactcaggtcgctcgagaagtacacactgaagttgctctggtcatatttacattgttgtgtgtaactcttcctggtttgcttttcagtctaggatagagatttacatgtcaaagagtcagtgcacttttgaaagtgtaatgcgatgcaagtaaaaacagttttggacaagatcgaaaggatccatgtcatttgctgtcagaatagtaatgtttgttacttaatgaggtttgttacaaaccttaattacaggaatagcattgtagtagttcttaactttttacactcctatttgtagatgtacaattatcagatggactattttatacactactttctccctctct

SEQ ID NO: 6398 - DNA, 1462 bp, Oryza sativa
  Predicted polypeptide sequence is orthologous to G2604
aagtaatgtggcatctgaaaattgagtttctttgcatctaaattttatagtagtttagaagtttatattgtaccctctgttttatttacaaaagtgagtagtttttggtttttagagcagaaatatagctgcaatgttcacaaaaatgtaaagagagattaaaggggatagcctgtcttcccttgaaatcgatgcatgagttttgcatttgctgaaattttgttctgaaatgcagttttgccaatgattttcctacctggaatttctgtgcaggaaccgagatggcgcagttagtttgcggaggatgccacactctcctgatgtatacacgcggtgcgacgagtgtgcaatgttcttgctgtcacactgtcaacctggctatggaaggtactaccaaaatttatcatcctcctcctctgttgcaattggtatattctgtggctttgattccagtatgcaaaatcctcctcctgaacagaatattttcctgtggctgaaagcaacagcaatcagtcggtagcaataaacatcgtcgagttggcttgtattccagtcatattcatgagagttggctatggttcagaaaacaaaaaagtttgacaaggatacactagatttaccagagtatgatgaaatatctcctacaattacaagatgtgctacagtagtatcctatacttactgaaggtctcacaaggacacctaatttagcatcaagttctgaagttccatataatttgttcagagttcagagttttctttaaggcagacttctgaaagatgagtgtttgttcatataatcttaaacacactgaataacaaatgattcccatgttcttgatggcagcaaatcaagttgcgcatgtaaactgcgggaactgccgtatgctgctcatgtaccagtatggcgcaaggtctgtcaaatgcgcagtctgcaattttgtgacatcagttggggtaagtgttcatcaacaggacacttcaatttcatatttagttcctttatctgaaaacattcaattttacagtagcatcatctaatggctaatattgcactgcaacctgatttttttcatgatgtgaccttagttgaagagtgtgttttttttctgaatcttttcaggcctcacctggtacagaccagaagcccagcagctgaactgctgaagtgccataaatattcagaaaagagcttctcaaaccgatgctttgagtgcacatgtatagagttcttccctgaagcattttttttcttccttttttatctccctttccccccaatttccaccttccttccttggatatggagagagcctgcggaataaatgagagttttgctaaatacctagtgctcaaaattcgtcgaatcgtctgtatgaccgaacaagattgacatattatatacataaacctatgataatatttatgcattgctcattgtttctgaatagttgaaacatgt

SEQ ID NO: 6399 - DNA, 1221 bp, Oryza sativa
  Predicted polypeptide sequence is orthologous to G2604
gtggtaagagagaggagatagagagagctgtactaactgatgaactgctctcatgcaagccagattaccataaagattgggtcataagcactgttgttaggttatcaatgggaaatagttttcatggacgttattggccgtgaatcccaagtggtgtggctaatctctccaaactaataaaagttcataatctgaacacaagatttgatgagagattcaaccaagaagctgaaattttttgcacctgatgtgcattgctgaaccaattttctgttgcataaagagtcctgaaacttcatgttgcaaactgaagcgtgatgttctaacatttttccattggagctttcactggtttcttcagaactgaaatctttcttgctttctcatcagcttctcatgcatctttctgcagggtttctttcatgtagggaaaggaaaggtgatttcagttgcctgactgctgccagaatctgcgaagcatctacaagcgacgccgtcgttcaggcagccggcacggcaatgccggttccccttgctccatacccaaccccgcctgtgccatttacacctcccaatggggctcaaagccagctcgtgtgctctgggtgccgtaatctgctcatgtatccagccggagcaacgtcggtttgctgcgcagtttgcagtaccgtgactgctgtgcctgctcctggaaccgagatggcgcagttagtttgcggaggatgccacactctcctgatgtatatacgcggtgcgacgagtgtgcaatgttcttgctgtcacactgtcaacctggctatggaagcaaatcaagttgcgcatgtaaactgcgggaactgccgtatgctgctcatgtaccagtatggcgcaaggtctgtcaaatgcgcagtctgcaattttgtgacatcagttggggcctcacctggtacagaccagaagcccagcagctgaactgctgaagtgccataaatattcagaaaagagcttctcaaaccgatgctttgagtgcacatgtatagagttcttccctgaagcattttttttcttccttttttatctccctttccccccaatttccaccttccttccttggatatggagagagcctgcggaataaatgagagttttgctaaatacctagtgctcaaaattcgtcgaatcgtctgtatgaccgaacaagattgacatattatttacataaacctatgataatatttatgc

SEQ ID NO: 6400 - DNA, 936 bp, Oryza sativa
  Predicted polypeptide sequence is orthologous to G2628
atggcgaatgattcctcctccttccctcgcagcctccttatcccgctcgccgccggcggctgctccgacgatgacgacggctacgacgagggcccgtcggacaccgtctccttcccctccttctggccgccgttcccggccatcttgtctgattccgactccgacgtcgccttgttccctcctcctcctccccacgtggaccactgccctgcgccgcagggcgccgcgtcggcgttcttcgggctcggtttccgtgaggaggatgaccacgatggcggcgagtgggcgccgccgggcgaggtggagttgcctctctgttgggattgcctgcagctggaggagcccgaccaccagaggtgggacatcggcgtgaacggcggcggcggcgacgagtgggagcaggtcggcatcagggtggaggaggaggaggaggaggccgcggcggcggtgaggagcctggagtgggaggtgctcctggccacgaacagcctcgggagcctcgtggttgacggcgccgactacgacggtggaatcgacacgttcttcctcgacgacgccgacgacgtgctgttcgggcagctcgccgcggagcacgagccccccgccgccaagggcgcgcgcgcggcggcgaaggccgccgtggagagcctcccgaccgtggtcgtcgacgcggcccgcggcgacacgcagtgcgcggtgtgcaaggacggcatggaggccggcgagcgggccaggaggctgccctgcgcgcacctctaccacgacggctgcatcctgccgtggctcgccatccgcaacacgtgcccgctgtgccgccatgagctgcccaccgatgaccccgagtacgagaactggaaggcgaggcgagcagccgccggcggcaatggcgatggcgacaggtacggcatcattaggcaactttcaatgattgattga

SEQ ID NO: 6401 - DNA, 426 bp, Oryza sativa
  misc_feature (13)..(13): n is a, c, g, or t
  Predicted polypeptide sequence is orthologous to G2633
agaattgagttantggggcacagagaatccgcaggtcagcgaacgcgtcgaaacggagcagaggttaaaactgatgtcttcgggccagggagcaagggtgcacctcgaggcaagggccaggctcaagctgaagaaagcggtggcggccgcaggatgagtatgcggggtcgcagctgaaaagaacgagtgcagattttacggccgaatcatgattcaacgagtcatttaattcaatagtaacggtcgcgatctcaagtggcatactcgagcatcgttagcgccccactggtactgaagcaaggacacctcagtacaaaatatccatgagcacgatgttcgacggcatagtatagttcagatatgtaaaatgtattacaggagctacacaatggacgcgttcatggatcgtaaaaaaaaaaaaaaaag

SEQ ID NO: 6402 - DNA, 405 bp, Oryza sativa
  Predicted polypeptide sequence is orthologous to G2636
cgtctatttatgcttccatcatcaacattttcttcgcattctcgaacatccagtcaaggtgatgaacaacatctgcaaaaatcaaatacagatacgatcactcgacgacaaataagtttagatacgaatacaatcagttcaactgatacatttgcttttgagaattctctttgcggatccaacgatgatcttcaaccgacaatcaatgcacaacaacaacaacaaccaaaaccaccacctatacctcctcgtgcaccacgtactttgaacggaagtaataaaaattcgtctccttaacaatgaactattctttgtcagattttgtttgtattaagtgtgtctttcataaattatttctcttatgtttaataaatatctttaaaatatagtcaggaagagaaaact

SEQ ID NO: 6403 - DNA, 975 bp, Oryza sativa
  Predicted polypeptide sequence is orthologous to G2639, G2640
atgctgatgctgcggggcggcggcggcggcggaggcggaggcggaagcggcatggagggaacgagaatggcgggattcccgttaggaggcggcggagggaggcacggccgcgacgaccaccaccgacctcccgttaaccccaccgactccgccgccgcgttcctgtacccgagcaccgcgtcccgtggcgggttccagctatggcagcagcagccgccgccggccgcgcacccgttctacgcgcagaacatcatccgcttcgccgatgaccccgccgcgccgccctcctcgcgtggcgggaggggcggcggccccggtggctccggcggcggcggcaccatcagctgccaggactgcggcaaccaggcgaagaaggattgcacccacctccgctgccgcacctgctgcaagagccgcggcttcgactgcgccacccacgtcaagtccacctgggtccctgccgccaagcgccgcgagcgtcagaacctcctcgcctccgccgccgagtcctccaagcgcccccgcgactccgccgccgccgccacctccaccacgcccaccacctcctcaggggagcagcagcagatgatggtgggcgagaggttcccgcgggaggtgagctcggaggcggtgttccgctgcgtgcggctggggccggtcgaagaggccgacgccgaggtggcgtaccagaccaccgtcagcatcggcggccacgtcttcaagggcatcctccacgacgtcggcccggaacactcgtccggcggtggcggcggcatgggcggccgccacgcagccgcgggcgaggcgggctcctccccgagcacggccgcggcgccgcacggtggcggcgaaggcggcagcagcggcgtcgcggcggcggcggcggccgtgtcgtcatcggctgtggtgatggacccgtacccgacgcccggcccgttcggcggcgcgcacttcttccacggccacccgaggtga

SEQ ID NO: 6404 - DNA, 1754 bp, Oryza sativa
  Predicted polypeptide sequence is orthologous to G2649
aagttgagtacaagccgggaacaacaaacgtggtggcagacgccctctccagaagggacgaacacctggctgaagctctcgccttgtcagcccctcagttctctctgtttgatgagctgcggcacgaggtgctcacgtcgcccgagctgactgccattcgggatgacattgccaaggggtcaaaaccgccggcctgggcgttcacggacggcctcatcacgttcaaaggccgtatctttgtgtctgcatcatcaccatccttgccggccatcctcgaactggcacacggcctggggcacgagggcacgcagaatacgctctctcgcctccgagctgacttccacctcgcacgggacagggcggtggtacaagagcatgcccgagcctgtttcacgtgtcagcaaaacaagacggagcacctacaaccggccggcctcttgcaatccttgccggtgccatcggcggtgtgggctgacatcgccatggattttgtggagggtctgccacgcgtccatggcaagacggtcatcttaacggtggtggaccgtttctccaagtttgcccactttataccaatggctcatccctacacggcaacctcggtggcagcggccttcttctcggaaattgttcgtctgcatggtgttccagcttctattgtcagtgatcgtgatccggtcttcaccagcactttctggcgggagttgttcagattggccggagtacgactgaacttgtcgtcggcatttcatcctcagtctgacggtcagtccgaggtgacgaacaagatcattgcgatgtatctccgttgtcttaccggcgatcggccgcggcactggctacggtggcttccatgggcagagtactgctacaacacgtcctaccagtcatctcttcgcacgtcgccgttccgtgtggtttatggccgtgagccgcctacgctgcgcgcctatgaaccgggatccactcgtctgctggcagtccaacaggcgatgcaagatcgagatgaatttttgcgtgagattcgtgatcgcctggagcaagcgcagcagacacacaagtcggcgtatgatggcaagcatcgggcattggaattcagtgtgggcgactggttgtggcttcgtttgctccatcgcccgattgcttcgctcggggtcaccggccgtggtaagttggggcctaaattttacgggctgtacagggttgccgagcggattggttctgtggcatatcgtcttcagcttcctccgggtgctcgcttgcatgatgtgtttcacgtgaggttgttgaagccattttgtggaactccgccggattctgttccaccgttaccgcccattcaacacggccaagtgtgtttgcagcctgctgcagttacgcagagtcgattggctcgtggagttcgtcaagttcttgttcagtggaaggataagccttctgccgaagcttcatggatgcctttggatgaatttcgcactcttcatccggattttcagctcgaggacgagctgcttctccaggggggagagatgtcatgtggggattgcaatacaagcgtcgcagcaacaggcgggcgacggcaaggcgtgacgaggaatagttttttacttctgttttgattcggttcagagtttgttagatagtttgttagtttcttattccgtaagttgttaggagtctatcctttagaattgctatataatctgtaagacagtttggttttggaatcaatcaattacgtgagattaatctgc

SEQ ID NO: 6405 - DNA, 1781 bp, Oryza sativa
  Predicted polypeptide sequence is orthologous to G2649
gaccttcacttgattgctggtggtagtagtagtagtagtactataggctcttcttggagatagcggacgagctggagtcgtagcagccgcagctagctgcagcgagcagctatcgtagacggagatagagacaggccagtctagtgcacttacgggagatcgaggagacttctcagcctttacttgaggaggcctcagctgcctgcgaaatccgcggatataagtgtggcttcgggacggcgcttcccatccgacaccggcgccttcgcggactgggtcgcctcctccgcggcggcggcggccgccggccgaggcgacgacctctccctcggcttcaatgccaccgccgcggccgcggccccctccggcgcctcgctggccgccggcctatggggcccggcctcctcctcgcgccaggccgcgctgaactacggcatggccgacgtcgggatggtcgtcgtcacccccgccgcctccttccaccacacacatcaccaccaccaccaccacgaggccgccgccgctgccgccgccgcggcggcggcggccgccgatcctatcttcccgctgctctccgccggcccctgcgtgcttgatccggataagtcggcggcgtcgggcagcgcgatccaattttggcagccgccgccgcagctgccgtcatcggcggcgggtggtaaccctaaccctagctccagcgccttcccctacctcaagaagcccctcccgatgctcgacaccggcggcggatcgtccggctccggcggcgcggcgacgtgccaggactgcggcaaccaagcgaagaaggactgcggccaccagcgctgccgcacgtgctgcaagagccgcggcttcgattgctccacccacgtcaagagcacctgggtgcccgccgctcgccgccgcgagcgccagcagctcaccggctccgcctcgtcttccccggcaaccgcctccgccgcggccgcctccaagaagccccgccttctcacctcccaaaccacgacgtcgcacacctccacctccaacgccaccacgccccgcagcttcgacaccacctccagccatcaagacgcgtcgtttagggagagcttgccaaggcaggtgcgcgcgccggcggtgttcaggtgcgtgcgcgtgacgtccatcgacgacggcgaggacgagtacgcgtaccaggcgacggtgaccatcaacgggcacgtgttcaaggggttcctgtacgaccagggagtcgacgacggccgcggcctcgccgccacgagcaatgacgactcgacggccggcggcgtgcccaacatctccgagctccacctcggcggggcctccatttccggcaatgccatgagagaaggcggctcctccatggtgcactcggacttgtacggcggcggcggcggcagcggcggaggcccgcacattctcggcggatcgagctatggtaacaccatgaactgagcttcttatagaagagtaaggttattacaccaattactgccattctttttctctcgtcgttcttgccccgtaccaccacgaaggggcatcaacgcatgctgtttgttctactactcatatcttcggtggtgttagtgttatcgttgttgtagtataataacatcggagaattgttgttagcttgtactactaccttagcagtagctgttcttttttcattttttctctttccattggagtagagattaataattgttaggaagaattccaaagaagataatgcaagattaaatcagtaagcataagaaagtattataattgcc

SEQ ID NO: 6406 - DNA, 769 bp, Oryza sativa
  misc_feature (550)..(550): n is a, c, g, or t
  Predicted polypeptide sequence is orthologous to G2649
tttttaacctgtaaatgcttgaaccttttttaatttcccagcttctaataacaagactacatagcttgctccattgcagcaacagcaacattaacaagaaacgagaattctgccactatcagtagcaatgacagtactactccataaactaagctactcaatgaaaagaaaagcaggagattttatagtaatcaatgggtacctcatgcttactcgatcttgttgcacgattagtttttcagttcatggtgttgccgtagcccaacccgccgaggatcagcggcccgccgctgccgccgctgtacaggtgcggtggcaccgccgccgaggcgctgccgaggtgcaggtcggagatgctgggcacggcggcgccggcgccgtggctggactcgtcgttgctggtggatgccatgccgccgcggccgtcgtcggcgccctggtcgtacaggaaccccctgaacatgtggccgttgatggtcaccgccgcctggtacgcgaactcgtcgtcgccgtcgtccacggacgtcacccgcacgcaccggaacaccgncggcgcgcgcacgtggcgcggcagggcgtccctgaacgacgcgacttggtggctggaggaggtgcgaaagtgcgaagagtggtggcgtgcacgtggaggtgcggaggtggtgggggggtctgggaaccaaggagcggggtattggccaaggggggcccgcgggaagcggaaatgagggaagggcggcgcgaaattggaccgggaggccggggacaggcc

SEQ ID NO: 6407 - DNA, 1611 bp, Oryza sativa
  Predicted polypeptide sequence is orthologous to G2650
gttccacatccttctctccgacgacgctacctagctaagctgctgctctgtagctggcaggctagggtttacgctagctgatcggagctaccaccaacgccggtggttggtagctcggcggcggcgggatcttcttcttgctcgggttaattggcgagctatatatatatctagctcatcggcgggaaggggaaatctcggctgacttgaagggatcggaggaggccatatatatgcatggctgagttcttgtagctagctagctaggtggatcgaggactgacgatgggaggatgagctcgaggaggcgttgataaggatgatactaggaagcaaccaagcggccgccgccgcggctgcggcagctgcggcggaggaggaggcggcggagctagcgaggaagcacacggcggcggtggcgacgtcgcggcaatggtcggcgcagacggagtcgcggatcgtgcgcgtgtcgcgggtgttcggcggcaaggaccggcacagcaaggtgaagacggtgaaggggctgcgcgaccggcgggtgcggctgtcggtgccgacggcgatccagctgtacgacctgcaggaccggctggggctcaaccagcccagcaaggtggtggactggctgctcaacgcggcgcgccacgagatcgacaagctgccgccgctgcagttcccgccgcaggaccacctctgcatgggacaccaccaccacctgccgtcggccatgccgctgatgcaccaccacggccaccaccaccacgccgacgacgataagtaccacgtcgcggcggcggcggccgcgctggccgcggagaaggaggcggcggcggccggcggcggaggaggaggagggggagacgacgtcgacggcgggggcggcggcggagcggcgcacatagtggggaggttccccgccggtggctaccaccggttcatggggctgaacaacccgctggggatggtcaacagcgccgccggcgccgccatgccgttccactacgccggtgagtcatggaataatggcagcgtgcaagacagcggcgccggctcgccgcaggtggccgccgccgcggctcaccacacctcgccgttcccttcactgctttccttggctccagggccgcatcatcagctggtgttctactcctccgaggccaagcagttcacagtagacaaccttggctcgcagggcttgtccctgagctcggcgagagctttccatgatcagacaggaagctaagcaagctcgatctacacagtacacacactggaacaacactcttcgatcgtcgacaaggtaaggatcgatgagctctaccaaaagaacaaatctaagctagctagtgcaagtgtgtgcattgctttgatctatgtattaatttctttcaagggaacaattaagcttgtgggttaagatttaagaaggaagatactgccagctagctggctgctaatttcttttgctctgaaactagggcaagaaatatgcagggctttgctgcatatgcctgtgtgcaatacggatttgttacttctttttatatgcaaagaagtaattgatgtattggcttgtgtaataattaataagttctgaattttgaacctttc

SEQ ID NO: 6408 - DNA, 1539 bp, Oryza sativa
  Predicted polypeptide sequence is orthologous to G2650
gagtacacacactctgagctccactagctctctctcctctccctttccttccttattattcctcaccatcagctagctgagagctagggttcaattccctcttgctgctccctctctcccggccggcgacggcgacggcgacggcgaggctgttgggctcatcatcacctagctgaaaatcggccggcttgattaattccaagcttgcaggaggctaattgaggtgatctatatctccggggagagagaggagggagaagcgccctcttgctcatgcttgtctaatcatgagcagctcaagatgacaagcaataacagcacgaatgaggagctcggcggcggcggcaggaaggcggccgacaagccgagcggcggcggcggcgccgccgccgccgtggcgagctcgcggcactggtcggcgtcgacggagtcgcggatcgtgcgcgtgtcgagggtgttcggcggcaaggaccgtcacagcaaggtgaggacggtgaaggggctccgcgaccggcgggtgcggctgtcggtgccgacggcgatccagctctacgacctgcaggaccggctggggctcagccagccgagcaaggtggtcgactggctgatcaacgccgcccaggccgagatcgacaagcttccgccgctccagttcccgccgcacgaccacgacctcgtcgccgccgccgcctcgtccatggcgccgccgccgttcgcgaacggaggcgacggccaccacggcgcctccgcgtcgtcgatgctggaggacggcgacaaggccgccggcggcggcggcatgaaggcgttcatgagcctgagcaactccctcggcctgctcaacgccgccaccatgccggcgacgttggccgctcaccaccaccaccatcatcacgccgcggcgtactacgccgccgccgaatcttggggcaacggcggcaatggtggccaccaccatgatgtcagccatggcgtctcgccttcggctcacaactcgccgttcccgtcgctgctgtccttggcaccgggctctcatcatcagttcgtcttctactcgccggaaggcggcggattcgccgtgaaagaggctgcagccgagcagtttcctgtagatagcctcgaccactcgcaagggcagctcacactgagctcagcaagaagcttccttcactctggaagccagggatgatttgatcaattacaagagacaataatccctactccaataaggctggtacgttagaacaaattaaaaaaaattctaataacttcgtttgttgttccattttcaggtgtgtgtttaaggttgtgatcaatttggtattttatttaagcgcattatttggtacggccagatgattaagagttctagaactacttaattacagcatgcaaaagttaaaattcaaggttttgcagggtgtgcgatatgcaattcgttgcttcttcttttcttttcttttatatatatatatggaggtaattaattgttggtgtattattttgtcttgtgtaataacgatttgaggaattttggagcct

SEQ ID NO: 6409 - DNA, 1413 bp, Oryza sativa
  Predicted polypeptide sequence is orthologous to G2655
atcatcggagctcggtctgcccatggagatgacctagctagctagctagctagctatagcctctctctagacatctctctcttgtgtgtgggtggtttggtttcttgattggagcatggcgttggaggcggtggtgttctcggaaggatactacttcggatgcggcggtgccatggcggcggaagcagctgcaggaggagcttggagctggagccacgggtatggcggtggcgttgatcaggggaagggggcgatggagttagtggtggacgacggggtggtgaacgccttctgggacggcggcggaggcggcgcaagctcttccccggtgatggccgccgtctcggggtttattgaggagccggacggcggtaattcctccgtcgcagacgcagcgccgccgccggagcacggaggtgcgtctgtcgtcggacgggatggctccgcggcggcgccggcggcggccgcagggaggaggaagcggcggagggcgaggaccgtcaagaacagggaggaggtggagagccagcgcatgacccacatcgccgtcgagcgcaaccgccggaagcagatgaacgagtacctcgccgtgctccgctccctcatgccggcctcctacgtgcaaaggggcgaccaggcgtccataattggcggagcaatcaactacgtcaaggagatggagcagcttctccaatccctggaggcgcacagacacgcccgccgcgcacgcaccgacgccgccgccgcgttgccattcgcgggcttcttcacgttcccgcagtactccatgagcgccgtgcccacgacaaccaccaccactgtagcagcagcagcaacggaaaacggcaatgccgtcgccggcgccggcgcgggcgacgacgcggacgcggacgtgtcggggtcgaagccgtcctcggtggcggacatcgaggtgacgatggtggagagccacgccaacctgaaggtgctgtcgcggcggcggccgaggcagctgctgaggatggtggcagggctgcaacaccaccgcctcgccgtgctccacctcaacgtcgccagcgccggccacatggctctctactcccttagccttaaggtggaagaagactgccagctcacgtcggtggacgacatcgcggcggcggtacacgggatcgtcgagacgatcgagcaagagcagcagcagcagcagaagcagagctgtagctagatcagctagagtattttcttagaacatttagcaatggcaaaaatggtcaatattaatatgcgccaaccgtgtgtaatgtgtgcactttcgattcttctagaactctgtacgctggatgcacatgtaccgcagttactacacccacgtacatttctgtagttcatcttcacttcaattaatgcatcatggtctaccactctgtactt

SEQ ID NO: 6410 - DNA, 1312 bp, Oryza sativa
  Predicted polypeptide sequence is orthologous to G2655
aactcactctttaattcgcctccccctgaatcgtgtgcgtatcgtatcgtggcgtcgtcagttcgcgaaaaaaaacgcccgttcgttttgccgggtgcgtgcaggatggcgttagaggccgtggtgtttccgcagggccatttcggctacgggtgcggaagggactcgccggcgtacgggatgccgtggtgcgacgtcctggctgctgccggcggcggcggcggcttcggtgagttttacggagtggacgagtgggatgaccagctgcaggtcgcctccgtggatgagtgggaggtggcatccaaggataactcggatgcttccacggagggcaaggcggcggcggcggagcgggcggagccggtggccgccgggaggaggaaacggaggcggacgaaggtcgtcaagaacaaggaggagatcgagtgccagcggatgacccacattgccgtcgagcgcaaccgccgccgccagatgaacgagtacctcgccgtgctccgctccctcatgccggcgtcctactcgcagaggggtgatcaagcatcgatcgtcggaggagcaatcaactacgtgaaggagctggagcagctactgcagtcgctggaagtccaaaagagcctcaagaaccgcagcggcgccatggacgccgccggcgattcccctttcgccggcttcttcagcttcccacagtactccacgtcgcctcgcactggctgcagcgccgccgccagcgccgggagctccggcagtgcgagcagcgtcgtcatggacgacacggcgggctccgcggagagcggccggcagtcggcggccatcgccgacatcgaggtgaccatggtggaagggcacgcgagcctcaaggtgctcgcgcggcggcgaccgaagcagctgctgaagctggtcgtcgggctgcagcagctgcgcatcccgccgctgcatctcaacgtgaccaccgtcgacgccatggtcctctactccttcagcctcaaggtggaggatgattccaagctgggctctgtggaagacattgccaccgctgtgcatcagatcctgggcagcattcagcagcaggaggccgtcctctccatcagctgacgccgcgatcgatggagacgacaaccgagacggccgccatgtgaagcctctgcctcgtccgtcctggaaatggaaccatggcgcctcgatcgatagcttgttagcttgtaatgtgtgaatgtgattgtaccctagccaacagagtgctgcatgcatgcagtatctccggcgaccttaatgagaaatctataccaacattttgagctcttgtaaacgt

SEQ ID NO: 6411 - DNA, 1566 bp, Oryza sativa
  Predicted polypeptide sequence is orthologous to G2655
aaaaccacccaaaagcgtagcgacacacgagaagccaccagccaacgtagtacgcgccgagagctgaggccatccacgacacacgaacatgagcacactagtagacgcgctgtgcgctccctgcagcgacaccgcgctcatctacgacaccttcaacgcctccgccgccgcgagcttcctcttcgacaatgccgccgccttctgcgacgctgacatcctcggcgccacggcgacaggggagaaggaggcgacgtcgtcggccgcggccgcggccgcggaagccgccccgccgaggaagaagcggcggcggcgcgcgaagagctgcaagtcgcgggaggagacggagacccagcggatgacgcacatcgccgtggagcgcaaccgccggcgccagatgaacgagtacctcgccatcctccggtcgctcatgccggagccctacgtccagaggggcgaccaggcgtccattgtgggaggcgcaatcgagttcgtgaaggagctcgagcagcagctgcagtcgcttgaggcgcagaagcgaacgctgctccctcaccacaaggcgagatgcgacgacgcaacgccgatgcataacgccagcggcagcaacgtcggggccggcggctgcatggagcccacgacgataacgagcaactgcagcagcagcgtcaccgaggacgcgccgtccgccgacgcgcccccgttcgcgcagttcttcgcgtacccgcagtacgtgtggtgccactcgccgcgcgactccaccaccaccaccaccgcggcgtctgcgtcggcgtcggcttcggcgtcgtcgtcgtcgccggccacggtggcggcggcgctccagtcggagcaccgctccgggttggccgacatcgaggtgagcctggtcgagacgcacgccagcgtccgtgtcatgtcaccgcggcggccagggcagctgctcaagatgatcgccggcctgcaggccctccggctcaccgtgctgcacctcaacgtcaccacgctggactcccttgtgctctacaccctcagcgtcaaggtggaggaaggatgcagcctgacgacggtggacgacatcgcggcggcggtgcaccacgtgctctgcatcgtcgacgcggaggcggccgcctcggagcatctcctcgcggcggggcaactggccacgacggcgacggcggtggcgaagagagaactcgcgacgtacatgtactgagccgctccaagtgccttacatgtcgtcgtttgtgtggtcgcgtgtactgtatgccgcgctcccgtttttctcccctttttaggctcgtcacgtttttgctgtgtagtggcccggcaggttagatctagttctagttgtactagtagatgcaaaatgctatgtgtccagtagtcccagcctctcgacgagggcgtacttgtctgtttctcgttctgaaaacagaatgttgtattgctgtacctgtacagtatcctgcctcgcctttctgtaataagagcgactagcgagtagcgacattggaaggaacagttcgagattcgtattatccgaacagggccttatgagggtactagctt

SEQ ID NO: 6412 - DNA, 1343 bp, Oryza sativa
  Predicted polypeptide sequence is orthologous to G2655
atctccattggccacccaccaccattgtcttctcctcccatattcttcacctcgctcgtcgtcgtcttcctcccccgccgccggccggtgcgggctggtgttcgttcacacttaccggccagccaccgcacgccattgctggcattggaaggtgatggcgctggaggcggtggtttactcccacggcggccatttcggcgggtacggcggcgggctgatgggcggcgccccggcggcgccgtgggatgtcttcgcagccgccggtggcggcgggagctgggacgatcccggcctgttcgcggcagaggcgtctcttgatgtgatccagggcgtggatgagtgggaggtggatcaggatcagcatgcttcttcttcttctaaggtggcggcgcggccgcctgtgaaggcggcggcggcggcggggaagagaaagaggcggcgggcgaaggcggcgaagaaccgggaggagatcgagagccagcggatgacccacattgccgtcgagcgaaaccgccgccgccagatgaacgagtacctcgccgtgctccgctccctcatgccaccttcctacgcccaaaggggtgaccaagcatccatagttgggggagcaatcaactacgtgagggaactagagcagctgctccaaacactggaggcgagaaggaccatcaaggaccacatcgacggcggcgccggcgagtctccctcccccttcgccggcttcttcgccttcccacagtactccaccgccacctccggccatggcggcggcggcgatgcacacagcaggatcgtcgtcaagcctgcagagacgacgactacggccgccggtggcggcgccggcgcggcgatcgccgacatcgaggcgagcatggtggagagccacgccagcgtcaaggtgcaggcgcggcggcggccgaggcagctgctcaagctcgtcgccgggctccaccagctagggctcaccaccttgcatctcaacgtcaccaccgtcgccgccatggccatgtactccttcagcctcaaggtggaggatggatgtaagcttgggtctgtggaggagattgcaactgcagtgcatgagattctggagaggatgcaggaggagcaggcttttgctgatgccaaaactagcttgtgaattgtactgcctgcagctgcctactttcccagatgtgctccagctggggattctcttgtatgtaatggcacttggcagtgcaggcatcaaatgtttattgcgaactagtattagctagctagaaaatataatatttgagatatggtggttttggcatatattaagaagcagggagaggtttaattaactatatgtttggatc

SEQ ID NO: 6413 - DNA, 1056 bp, Oryza sativa
  Predicted polypeptide sequence is orthologous to G2655
atggcactggaggccgtgctgctctcgcgtggtgatctgtttggtcgtcgtcgttgcgccatggaaggaggaggaggtggttggagcagcccgttcagtggcttcgagggagtgatggatttggacggcggcaactgggacgccgccgcgtgctcatcgatgcttctgcatggcttccaggagctagagatccctgcggccgccgctgctgctgctgccatggcgccgccgccgccgccggtagagcctgctaattgcgcggagaatgcaggaggggttggtggtcatcaggaggatcaggctgcggtggcggcagcggcgacggcggtgcagtcggggaggaggaagcggcggcgggcgagggcggcgaagaacaaggaggaggtggagagccagcggatgacccacattgccgtcgagcgcaaccgccggaagcagatgaacgagtacctcgccgtgctccgctccctcatgccgccgtcctacgcgcaaaggggtgatcaggcgtccatcgtcggcggcgcaatcaacttcgtcaaggagctggagcagctgctccagtcgctggaggcgcggaagagttcccggcaatgcgcggcccacgacgcggcggcagcggcggcgccgttcgccagcttcttcaccttcccgcagtactcgatgagcgccgccgccgccgcggcgccggtggctcccgttgtgaacgagttgcacggccgtgacgacggcggagcaggcaccgccgaggccgaggcgtcagggtcgaagccgtcggcggtggccgacgtcgaggtgaccatggtggagagccacgccaacctgcgggtgctgtcacggcggcggccgaggcagctgctccggctggtggtggcgctgcagggccaccggctcaccgtgctccacctcaacatgaccagcgccggccacatggttctctactcgttcagcctcaaggtggaggatgattgccagcttacgtctgtggatgagattgcaaccgccgctcatcagatcattgagaagattcaagaagagcagggctgtagtttagattag

SEQ ID NO: 6414 - DNA, 719 bp, Oryza sativa
  Predicted polypeptide sequence is orthologous to G2655
gcgtcgatcgtcgccggcgccatcaacttcgtcaaggagctggagcagctgctccagtcgctagaggcccagaagcgtcgcgccgagcacgcgccgccggcgccgccgttcgccgggttcttcacgttccctcagtactctaccacagttggtgacaacaatgcggccggctctggcgccgccgacggcgagggcggctgcggcgcgcggcccggcgcggccgacatcgaggtggccatggcggagagccacgcgaacgtgagggtgctcgcgccgcggcggccgaggcagctgctgaggatggtggtggcgctgcaatgcctcggcatcaccgtgctccacctcaacgtcaccaccaccgccgaccatttggcgctctactccttcagcctcaagatggaggatgaatgccggctttcgtcagtcgacgagatcgccggcgccgtcaatcagatggtcacgaagatcgctggcgagtgcattagttagttaattagcttgaaaaaaaaagaggtgtttttgtgcgtgtatgtgtttgtagcaattaatcccgtcctagtacatggataattcaggcgatttgagccattgtcagggtagtacaatactagctgcccgccatgtttgcgtgcaagtaattaaacatgtatcaatcagcggatcagatctgcttaactgaattttcaaagtacatatgtaagcatccagctcgtcgagtc

SEQ ID NO: 6415 - DNA, 1080 bp, Oryza sativa
  Predicted polypeptide sequence is orthologous to G2661
tcaggggctgaaacaaacccagcacatttgtgtttgtacgcgcagctagctagccacgagcgcggatccatctcctagctagcgcaccatctatggatccataccacgactaaaacatgcatgacccacgcggcttccccatccacccgcagccgtaccacctccaccccacggccggcggcctcggcgagggcaggatgcggggcggcgggcggcggcgccccggcgccaagctctccaccgacccgcagagcgtggcggcgcgggagcggcggcaccggatcagcgaccgcttccgcgtgctccgcagcctcgtgccgggcggcagcaagatggacacggtgtccatgctggagcaggccatccactacgtcaagttcctcaaggcgcaggtcaccctgcaccaggccgcgctcgtgcagcacgaggagggctgccagcacgccgacgtcgccgcggcgttctccgccgccgacgccgatctggcccttgagctgaaccatcgccacggcggcgccggcgatgatgacgccgggatgacgacgctggagatggcgccgatgcaagaggcggtgggctacggcgacggcccggctcatcagatgatgcagcaagcgctcgatccagcggggcagctgatgatgggcggcgctcatcagctgcctcctttgccttgctgtgtcttcgtccaggagactgacccctcgtgctactcggtgtgcaatgtccacggtgaggagtctggtgcgcaaggatcttattagctagctagtgagacagtggcttgcttaggtagttaatttccttaagtatgctcgaatattggctctacccactagctgtctagctctacttagcttacctaggtcgtcaaccaatatattaccggttggtcatggtcccttaaattagctagactcttgatttctgtaagaatgcatatatgcatgcatggggttctgttggagcaatgcataacagagctttgttttacatgcatgcgtgcatgcttcctagatatcattctgaaatctgaacttgtttgctcgatcgcttaattgctatctcaccatttcggta

SEQ ID NO: 6416 - DNA, 416 bp, Oryza sativa
  Predicted polypeptide sequence is orthologous to G2679
tcgcctcgaaggctgccctcactgtggtttggcgttatgcccgcccattgaatatggctctcaacaccagacctgttgttttcctccattacggtatccctgccattcctttcaccatctttgccttgtgttatgaagaaaccagaaagtatctactcagaaacatgaagtcttcagacaagagaaagccaaactggtggatcagaaacacctattggtaagcacacacagacagaacaatatccaccacaagccacaatcatcctggtgtatgattatgagcttatttatcaaagttggagtgataaaataatttatgttacttgttaaataataagttgaaaataaatgaacgttagtatgttatacactccttttgttaaataaatttttatttgagaaaactttttctacag

SEQ ID NO: 6417 - DNA, 292 bp, Oryza sativa
  Predicted polypeptide sequence is orthologous to G2682
aagctttttttttttaagaaacaaaagaaggatggtttattctgtaaatgtcacaaattatgttcatcggaaaaggtatgtgcttgtattaaagctaacagagcatgtactgaatattgttcttgccatgaagaaatgttccaatgtgagatcttcatcaacacccaaattacctagtactacgaatacatgttgtgtttccaagtgttgcaaagtagactcccctccagactttaaatgtcaacgatgtggaaatatgtgccatagctccacctgtactatgcccaagctt

SEQ ID NO: 6418 - DNA, 522 bp, Oryza sativa
  Predicted polypeptide sequence is orthologous to G2699
cggcgaggtgaaggcgatgctgaacgaccacgcggccgggtgggggatgaagcgggaggacgacgacctcgtgctcacgtggaaggggcacaacgtcgtgttcgcctcggcatgggcgccgtcctgatcagctcgggacgccgcgcgcgtggacggcatgccgcatgtgtacggccggcgacaagttgtgctattagatatcttctatgagctttatcgggaggcacagaaagaaaaaaaaaacttctcgtacgggtatttgatcagtacgtacgtctcacttccaagagtgcatcaagaaacagatacatataagtgtttctctttcaagatttacaaagtttcctgtaaactaaacgattttttttttcggtttgctactgtgtaattgatactctatgaacaaccagccggacaaagggtgtatgttatagttgatgtatggtgtgtgttgaactaccaaaattaatccaagatacgataatgtggaaaaaaaaaaaaaaaaaaaaaaaaaaaaaaaaa

SEQ ID NO: 6419 - DNA, 500 bp, Oryza sativa
  Predicted polypeptide sequence is orthologous to G2699
gtagaggctggagcggcaggaggacaggacgaggtggggccagcggatgcgcgccgccgggttccgcgcggcggcgttcggcgaggaggccgccggcgaggtgaaggcgatgctgaacgaccacgcggccgggtgggggatgaagcgggaggacgacgacctcgtgctcacgtggaaggggcacaacgtcgtgttcgcctcggcatgggcgccgtcctgatcagctcgggacgccgcgcgcgtggacggcatgccgcatgtgtacggccggcgacaaggtgagtggccgtgtaggcgtgtgtgcgtgcctacttttgcatggatatttggatttagggtttgtttttgtgtatgctcattgtggaaagatggtcttgttaagttggcttttacctgttgattttgcttagacgattcgtcgttttgatcatgtaatgagaatctctctctagttcttactgctagaatgaatgaatgaagaaaaaaaacttgcaatcaaa

SEQ ID NO: 6420 - DNA, 398 bp, Oryza sativa
  Predicted polypeptide sequence is orthologous to G2699
gggttttgcccattaatttgttttttaatcaccggaacaactaaccagaaaatattattttaatttgtggaatcaattttttccaaaatttaaaaaaccaagattttgttgcaaaacacccttcaaaaggttaaattatttcctgttgttttttttcaccaattttttccagtccaattgccattatttcaaccctttattcactgaagaagcaaccccctttgctaaaatttgttattttgacaaaatctgaccattttttttttttttttttcattttacctttttttaacctgttttactttttatttcattcggtttttccattactattttttttttttcaagaaaaaaaaaaaaaaaataataatttaaaattaaaaaaaaaaaaaaaaaag

SEQ ID NO: 6421 - DNA, 1773 bp, Oryza sativa
  Predicted polypeptide sequence is orthologous to G2717
aacgccgccgtcgacccgtcgtcgtactcccgcccacccagcgccgccgccgccgccgccgtcctcccaggccgcccgcccagcaccgccgtccatcgtcgccttccccgtcctccccatccccccgctcgagttgcgggtgaagaggggctcgaagcggctgctccgccaagcccctcctctcgccctcctcccctctcgccgagcttgccgtcgccgccgtcatcctgctgcatcctgatctgtggaagtaacaaacagttcgtttgtctgtttccccgtaaaattccccaagctggacccgcccctggaagaagaagaagtagcttagtgttgatttgagcataatatgggtgccccgaagcagaaatggaccgcggaggaggagtccgccctcaaggccgggatcgcaaagcacggggctgggaaatggcgcaccatactcaaagacccagacttcagcaacgtcctgcgctaccgctccaatgttgacctcaaggacaaatggcggaacatgaacgtaaccgtgaacgcgtccggtgcccgcgacagggtgaaagcgcccgtcgttaagaagccaagatccgctcctaagcatgaaggccactctacctctacagctattgccgcggtaacttcagatggtgatgatgatgttgcggagcctgtgcctcttgcaacgtctacttcatccaagagatccctctcgaggctagacaatatcatagtagaggcagtaaggagcttgaatgagcctacagggtcatacaagacagccatagctaattacatagaggagcaatactggcctcctgctgattttgatcatgtcctgtcttcaaaactgaatgatctgacagcatctgggaaattgataaaggtgaatcgaaagtacaggatagcccctagttcatctttgtcagaagggcgaagctccaaagtagtgctgctcgaagatataaaaaaagaaccaacaaagttagatagggaagatgttgcagtcctcactaaatctcaaatcgatgctgaattagctcggatgagaaccatgactgcagaagaggctgctgctgctgctgctcgtgcagttgcagaggcagaagctatcatggctgaagccgaagctgcagtaagagaagcagaggctgcagaagctgatgccgtagctgcacaagctttcgcggaggcagcaatggcaacatttaacaacagaagttcagcaaaattgatcattcgagcttgaagctacctgtgggagctggtgcagcatcagtttcctccgaccttgttgtatgtacacttgtcccgcgttccaatgcaatgcaattgctactccagttgggctagggacgaccctattccatccttaacttatgcaagcttattacagaaccaaattgcccaaagccccaaactggaattgcaccgcatctgctgaatttgccaacaattttgttacgcctggatctgcacaggcattgcggctacggcatcttttgactcgctcatggtagtaacccacatatgctgggataatcagggagtgaccagtagaagtacatcatggttatccccattcctccttgggtgattgtaattcaccttgtaatcggttttggcatcaaataatcagagtattgcgttgttgttgcatgtacagatgtaacagtgtgtgtctggttgactggttcacttcattgtgtatatcaactggcttttttttttaagctctttctcatggataatatggtaatgctgcagcgtgatgtattc

SEQ ID NO: 6422 - DNA, 1718 bp, Oryza sativa
  Predicted polypeptide sequence is orthologous to G2717
ggcctcccatggcctcctcttcctcctcctcctccgcctcatctcatgcctcactcgcctagaacccctcctcctcctcccgatctccgaggcaatcctcctcgaattccccgcgccccgatctccccctgacgccaccctcctcctccgccccggatcgccccgcccgatctcgccgcggggtcgaatttccccttctcttgtctccgatcagggccgcctcgatcgaaggcggcgccgcgccgaccatcccaccttgtttggttgtaatttcttcttgtcgcgtgaggaggggggcgtggcggcgggggagagcgcgtgagcgggcgggagatgggggcgccgaagcagaggtggacggcggaggaggaggccgcgctcaaggccggcgtggcgaagcacgggacggggaagtggaggaccatcctccgcgacccggaattcaccgcgctcctgcggctgagatccaatgttgacctcaaggataagtggcgcaacttgagtgtcactgctggaggatatgggtcaagagagagggcaagggtagctttgaagggaggcaagcgagggcctaaggcccttgctgaaccgatggatgccgacgaaaagaaccctgacattgatgataatgcaatcattgatgcacaaccgttggcagtggttgttgagcccatgcaacttgagagtactccagagaaagagaaatcagttgctaggcttgatgaccttattttagaagctataaagaagcttaaggaaccgtctgggtctaatagaacaacgatttcttcatacattgaggagcaatactggccacctgaagattttcaacgattactttctacaaaattgaaagcattggttgctactggaaaattaatcaaggtgaatcaaaagtacaggattgcaccaagttcgaactcttcaggtggaaagagcatcaaggtgtattccactggagaaatgaacatagaaaataataatgttagacagctgagtaagccgcaagtggatgctgaacttgataagatgagaagcatgagtaaggaagaggcagcatcatttgctgctagggcagttgccgaggcagaagcagccattgctgaagctgaagaagcagcaagggctgcagaggccgcagaagccgaggctgacgctgcaaaggcttttcttgatgctgttgtgaccacgatgcaaaacagaaatcatgcttctgcgatgcttcgagcttgctgatcttctctacggattcagattgggtttcagccagtgaaacttgtcaagacaacgctggtgttctgctacaaagcttttgttgatagatgagattcttgtatagccttatagatcaagatgctttagtgaggggggttttcaacattttgctctgatcctgaaccctaactactcatatttgagttgatgtcatccagtggtatccaattagatacatatatcacgtgactggtgtttgtgctatgttaagacaatcaacaactccaataacaagggcgaatgagaatttagtctgaatttccccccgttttgtattgcttttgtaattagccttttccctttggtcaagcgaagtcatgaaatagtagaattgtagttggaaagacatgtcgtatgagctgtgctaatttatggacatggctttaatatgacaagttggtggtggtgttttagcattacattacaactaattagcacatgct

SEQ ID NO: 6423 - DNA, 1394 bp, Oryza sativa
  Predicted polypeptide sequence is orthologous to G2719
aacgaacgaactagcaccaaccccacagcaccagccaccaccatgtcgtccgaaaccgccgcttcgccgccgccgccgccgccgaatccaccggccgccgactccacccattccagccccgcctccatgaccgacgagacgcacggcgcaggagcccatcccgacgagtcccaaccgcatcgctcctcatcgtcgtcctcctcccctcccgtggccgtcgacggcgagacgcgcgtcccactcccagtccggtccctgccccaacctagccacccatcgccgcctccttcgggggaggacgaggatgacgtcgtcatcaccggccaaatcgcagtgggtgacgccgcgggggcggcgatggaggagcgggtgaaggggccctggtcctcggatgaggacacgctgctgagcaatctggtggagaaactcgggccgaggaactggacgctgatagcgcgcgggatacccgggcgctccggcaagtcctgccgcctccgctggtgtaaccaactcgacccccaagtcaagcgcaagcccttcactgaggaggaagaccgcattataatggctgctcatgcaatccatggaaacaagtgggcggctattgcaaagcttttggttgggagaaccgataatgcaatcaagaatcattggaactctaccctgaggcgtcggcactgcactggtggccgatgcacacaaggtggtgttatgaagagagctattccggagaggcctaggtcggtttcagaagaaccttggccattgggcaatcttagttccttaaatgttagggaagcaatggaagctcccgcacaaacagtatctgaaagttatgttggggcatggcaaatcggggatcagagttgcaaaactgaagttgttgatccaccttatcttgcccgaccagttgcaaaggttggtgcattcaaaccatacaatgtaggacctgctcaatcatcacaaaaggaaatgctgagctttgccaccaagtttgactcaaaccttcatcctttcaagcctgaaaatggggtctgcaagtttgttgatcctacaagttttgctgctgaggtgccaaataaatgtgggcatggctgctgcagttctcatgggcaacttcgtaagaactcattgctgggtcccgagtttaatgagtttgaagatcatccaccaatttcagatagtagttttgcttcgttggtgtcagaaattagcagcattgcctggatgaaaagtggtttgcaaagcagtgacaccttagcgcggtctgttccaccagcttaacagattaggataatgtaaattagtgagatgaaacttttggagtcaatttttatatattaaggtgtaatcaagtcaaatcatggttattgttgtatttttggtagatggac

SEQ ID NO: 6424 - DNA, 3341 bp, Oryza sativa
  Predicted polypeptide sequence is orthologous to G2723
gaatcaggcatcattctttagctcctatgccacagatcaattatcaggtaccttttccagtttcctgctgggttccctacttttcatcaagtgcacatctatgttgggaatccaatctttgatgtgctatattagtatatggtgtggatcctgttcttatgatgtcaccgtcacataattacatgcttacttgcagaggtaaatacatgattaatcagaaaaatatcagaagtttttctttgggagtgctaggagtttggttcatttgatcataaattttcttagcttgtttcatctttcatattatttttctcaatgcaccacatatcatgacaggctgatattgttagtcaacgtgatcaggaaatccaatacccttggctggtaagtttgagttataaatattcaaataaatatttgagtccttttgttttcaagtaccaaatccatagaatagattattgccaagagagcaccctggtacttgactgtagagatttgtatcccatgtaatacaagaatcttggccacttgcatggtgggggttcttccccatcgtccacaccttaggatgttgacgatttgaattatcacgtgggagattcgcatatgtgcaggtgacttttgtttttgctgatgcgactgatgtaaaggagccagtaagtattttgtaatccacactttcaggcataacctatttctaaactctcatcatcataactggatgacctgttcctctctcttattaaaaacttgcagtttgtggcctagtcaactatttgatgttggccaaaatgtagacgtggcaggactttcattttaattggaagtcctgaggactaagatgaaagaacaaaaatctgaagtaaatgctaagaatttacaatgttaaaaaaaaaactgaactaccaaatcgcattttggcaggaacaaaccatttagaaatgttcagcgaattcattttgtatagcttttgaagttctcttgaacaattagtcctttgagaaaagaaagttatggaatgatgccattggaatgttcaccaagaaagagaaataaaacatgattttctacatggaatggaccattgttataataagtggtaatttcaccatcctacagggttaccagaaaagaaattccttagactgtttggatcatgcttggatcagatctgtcattttctttttatagaaaatctggaggttcatagtaccctgaactatctaccaatcactgtgctacggaaatcaaacatgtaagtatgtatcctctcgcataacatgcagttatcccatgaatctagttatggcacttcattgtacactagatcctatttacatattttttactagaataaacctatattgctcccaccagcaaggttagtgacattttgggatgactgcaattacattgaaaaaaaaggtttatgtaagtttttcttgaaaaatgtgttcatgatatatttatattccgtaaacatgttacagtagaaattaatggccaaacccaaacttacatgtcaatttccaaaatgtcaattatctgtgactggacatcaaagtgacttaatgtttgaatgaaatagctattttcaatatagtttctgtctatgaacattttgactgaatatctccagtatgtcgtcattatgcgcaaaggggttgaattctaggtgttgatatggattgtttttatctgttttgtttgactacatatcacagttgaataatatatctggtttgcatgtcattcttttctagcaccatgacagattagtttagttgaaatatgaaggggtagataagtacttctatcctttctggcgcaataaaagcttattttcctcaattagaggaagtccaaataggcatatatttaatgtgtgtccgttcctactcattttattggcatttcctttaaataggttcagtgaagctgcagagtgaaggttatagtgaagactggcctgctatatgtgcattgcacaagacaatctgcagtctttttgtcctcttgatttgaatataaaggttctaattctactaaaaatgaatataatacaagcattcaataaactgtttaggacttgcacatgtctcatcatttagattgtgataaaataaaaaaaaatatttgaacatttctgtttgagaggggaggatgttaatacaaatttctagtcttctgtttttacctggaaggcttcatagccacagcttctattccaaaaactatttgcttgtcgtaatcactgaattgatacacatttcatggtttctacagccattcagttgacttgaatcagtaccagaaatcacctttacttgaaacattctacaagttgttagtgccaataccttcacatagtgataacatattacctagcatatgttaaccatcaaatgcacccttaacacattgtcccaaacagggatcaaaggataaatgatctctctaaatagttctttttttcttcatatgtgtgttagggttggggtgtggcagagggggtattagaaggccaaacctctgtggtacacgtctatagattccaaataaatgatacagtacctctttggtactcccatcaacatggttcacaccacaccactacaccagtgacaccaccaccaccattacagggtatttttcttggcccctctgtataaatagcagcaccatgttcactctttgttccattgaaatacaagcaaccataaacagtagccatttctaggaccttggcctttcttgaaggaggatgagttcatcctggacaacaaagcagaataaggtgtttgagagggcgctggcaatatatgacagggatacgccagatcgctggcagaatgtggcacgggcagttggtggtggaaagtcagttgatgatgtgaagaggcactatgaaaagctgatcaaggacgtggatcgcattgactctacaggaggccatcaaggatcccattacaacagctccaatgctagcagcagcagcagcagcagcagcagcaactctcggggcagtgccaatgaggaccagaggaggaggtaccacaactttcagtgaatgtgacattgacatctcgaaagccgaaagcagcctgagttccagcaagaccgacacatatgatcgactgtccctgcagatgctaccttcactatttcgtttatgttttctattatgcgcgtgtgtgaatcagaactggccctaatagaccagtagttagtaacttagtttcaattgagctatgactggtttgctgaattatactgttgtattccatctgacgatgctgtatatgtaatatctgatggaaagtttataatcttctccg

SEQ ID NO: 6425 - DNA, 689 bp, Oryza sativa
  misc_feature (396)..(396): n is a, c, g, or t
  Predicted polypeptide sequence is orthologous to G2743
atttttttttttttttttttttttttttgaactgaactacatgtccaaacaagcattatttccctgtccttgactcgatacattccggcgacatctcccgaatctattcaatcaaccatgtattagagcatggccaacagtttcccaatactcttcccaataccagttttgagtgagttttgcatgaaaaaatcgctccaacagtatacctaaatcacccctaaaagcttggtgtttccaaacccgtatatttctgttctcgacttgtatggaagagactcggtgcccaatccttcgatctgcatgcacttcgcgcgtgctgggtaaaaattttcctaccaggtttttcttttgtgagttcgtcctgcctgtgagtcaatccatcatgccagcagnctcatcttccccgcagatgtcttggaaagcatgcatgtggtcccccaagctttcacagtgtcgaaattttttctcagtggcggtgccggaaccatcttcaccccaattgtgcagacctcgtcggacacccaccagaaccacaacgaatgattcgccgctgcccgatcactcaaagtgctctaacaacggatcccaaaaaattcccccgtaaatgtgccaacaaaaacccgccaatgacaaccctgcacaaagggccccaaaaaataacctcacgtaataacacaccaacatag

SEQ ID NO: 6426 - DNA, 654 bp, Oryza sativa
  misc_feature (36)..(36): n is a, c, g, or t
  misc_feature (490)..(615): n is a, c, g, or t
  Predicted polypeptide sequence is orthologous to G2743
cgcgcatgtgtggtaccggaatcggcattatggcgnggaggatcaatactctatgcgttctctctctttgcggcagggcgtgtgtgtggtttgaggagaaggaatctgatggagcgggaaatttgcagagggaaggtgaactatatgtggaaaacctctctgcaaaagagagataaggaggtagggatgcagggaggtgctccagtgacccgtatgccgccgggtcaccggatctgcacctcgccgtcttccgtctccgccttccgtttctgcaccgtaatgatgctgcttgccgatttgactgcgaataggagtagatttgactgcccgattgattgatagatccattgtttacccacagaaacaataataatactctactactactcctacatagtaggagtaccttgcctattgtatgatactagaagtagtaaattgatggtacaggataatacagacttataaatttcttattaaaaaaaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaataccgggggggggcgttaacaaggcctgagacgg

SEQ ID NO: 6427 - DNA, 1780 bp, Oryza sativa
  Predicted polypeptide sequence is orthologous to G2747
gctctagcccctctcttgttcaaacaccttcatctgaatctcttgagcctgaattttcccaacacaagcaagcactacaattgagctaagctatagcacacacacacacacacaaaccctgaattcccacttcctaagttcctatagctaagcatatagtagccacaaggagctagctaattcttattagctatagctccagatccctcacaattctaaatttccaatcccaaaagacccaattaaacaagagatagttgcctcctaatccatataataagccctcaaattaactggtagccatatactatcaatagtaacaaggcagcacaagcagcataccataagcatacatcgggtcaaagccgaggtcaagtccaccggcaggaggacaagccggcggccggggcccagaggaggagctgaggcatcatcgatcgatcgatcggcatagtgcacgtacatggagtccatcacgccaatcgtgaggccggcatcggcggcggcgggcggcggcgaggtgcaggagagtggtgggaggagcttggcggcggtggagaaggagcacatgttcgacaaggtggtgacgccgagcgacgtggggaagctgaaccggctggtgatcccgaagcagcacgcggagaagcacttcccgctggacgcggcgtccaacgagaaggggctcctgctcagcttcgaggaccgcacggggaagccatggcggttccgctactcctactggaacagcagccagagctacgtgatgaccaaggggtggagccgcttcgtcaaggagaagcgactcgacgccggggacaccgtctccttcggccgcggcgtcggcgaggccgcgcgcgggaggctcttcatcgactggcgccgccgccccgacgtcgtcgccgcgctccagccgcccacgcaccgcttcgcccaccacctcccttcctccatccccttcgctccctgggcgcaccaccacggacacggagccgccgccgccgccgccgccgccgccggcgccaggtttctcctgcctccctcctcgactcccatctacgaccaccaccgccgacacgcccacgccgtcgggtacgacgcgtacgccgcggccaccagcaggcaggtgctgttctaccggccgttgccgccgcagcagcagcatcatcccgcggtggtgctggagtcggtgccggtgcgcatgacggcggggcacgcggagccgccgtcggctccgtcgaagcgagttcggctgttcggggtgaacctcgactgcgcgaattccgaacaagaccacgccggcgtggtcgggaagacggcgccgccgccgctgccatcgccgccgtcatcatcgtcatcttcctccgggaaagcgaggtgctccttgaaccttgacttgtgaagagggtacggccgtacacgtacacgatctctgctactttatgcttcaattctgctactacgtactgacacaaatggaaatcgtcgacgaagagtgtgaccggagaagtaaacaaaggcggcgatggcggcgcgcagcggcggcggtggcggcggaggtggaggcgcttggagcatctagcgccttcgtatttcgtatatagctcatcatctctcttaaattagtcagtgcagtgtgagggggaacagtttaagaaaaaagaacgaagcagcaacgtacccaaaaaaaatattctttctaggttgatggttttttcttgcttcgatttgctttgcctttttctcttgtgcttaattataattaagttttcttagctgctcg

SEQ ID NO: 6428 - DNA, 939 bp, Oryza sativa
  Predicted polypeptide sequence is orthologous to G2747
atggagttcaccccaatttcgccgccgacgagggtcgccggcggtgaggaggattccgagaggggggcggcggcgtgggcggtggtggagaaggagcacatgtttgagaaggtcgtgacgccgagcgacgtggggaagctgaaccgattggtcatccccaagcagcacgccgagaggtacttcccgctcgacgccgcggcgggcgccggcggcggcggtggtggcggcggtggcggcggcggggggaaggggctggtgctgagcttcgaggacaggacggggaaggcgtggaggttccggtactcgtactggaacagcagccagagctacgtgatgaccaaagggtggagccgcttcgtcaaggagaagcgcctcggcgccggcgacaccgtgtcgttcggccgcggcctcggcgacgccgcccgcggccgcctcttcatcgacttccgccgccgccgccaggacgccggcagcttcatgttcccgccgacggcggcgccgccgtcgcactcgcaccaccatcatcagcgacaccacccgccgctcccgtccgtgcccctttgcccgtggcgagactacaccaccgcctatggcggcggctacggctacggctacggcggcggctccaccccggcgtccagccgccacgtgctgttcctccggccgcaggtgccggccgctgtggtgctcaagtcggtgccggtgcacgtcgcggccacctcggcggtgcaggaggcggcgacgacgacaaggccgaagcgtgtccggctgttcggggtgaacctcgactgcccggcggccatggacgacgacgacgacatcgccggagcggcgagccggacggcagcgtcgtctctcctgcagctcccctcgccgtcgtcctcgacgtcgtcgtcgacggcggggaagaagatgtgctccttggatcttgggttgtga

SEQ ID NO: 6429 - DNA, 1462 bp, Oryza sativa
  Predicted polypeptide sequence is orthologous to G2754
ctcttccccaatccacgccgccgccgcctccgctcctcccctcgagagtcgcaacctgccctttcccaatctcgccgccaaattctccggcgagacggccatggaggtcccaccttttgctcgccccaatcgagcctcgccgttggcttgggaagcggatttcctcgagaggacaaatctcaccatgtcgacggtggagtacgcgcttcctaccgcaatcatgacgtcgccatccttcgtcgcggaaggcgctggaggaagccagatttgcgccatgtattcctttcaagccttcagtgaaatgataaacgagaggaacgctgagcccgggatgatcgacgtcttcctactcccccatcttcccctcaatgacgtctccgatgtgtacgaccagatcggcagcggcgacgccccctaccgcatctcaaatggccccatgcttctcaacaaggtcaatgcttatcgcgagctgattcgcgtgggtaaagagctggcgcctctggagggtctcatgaaaagccttgaggacgagctgcttgtccgtcttaatagcattgtctctatactcaaatcagatggtgaagacatcccgttgccacttgacatgtctgcagcaactcagcttctattcaagtgggaatctgattttgtcgaggcctgtgagatggcaacgaaggccagacgccgcctcatgctggcaactcttctggcaatgttctggtcctccagtgacgactttgtggagaatgaattctcagtcagggagggtgatgcaatctccatgagtcatgtacaagagactctccaaaggttggctccagatctttaccagaatgtgtttggcgccctcaatgaggtacactatacagaggatggaaggccaccgaagagtgtagttgtttcgctcaagaggctaattacagagatcacatccgagatgacacctactgagttcgtagcattctcactggagacgagtcgcagggacttgattcaccagctaagtgatgtgtcccaccaggaatttcgcttgaaggtcttgaggtctcttcagtctgtggcatctgctttaatccacctccacatgctggataaagagatgttggagccccacctctcacggccaacactcttggggtgcaaagattattcaccgctaaaccaggatccatattggccccattttcaagttttatcagatgaggaattaagtgttgaagtccgtcgaggctccctgccaatgttctgaggtttgatttttgtgcaaaaggaggtgaagaactagaggaaagtgaagaggagagaaaagtcgatgttgtttgaaagcttcatgccatattgcgccccttccttctaaggcggatgaaggtggatgtagagcaaatgcttccatgaaagaaagagataatcatttatgctaacatgactgacaatcagaaacaaatccaaaatcacttggttg

SEQ ID NO: 6430 - DNA, 912 bp, Oryza sativa
  misc_feature (559)..(559): n is a, c, g, or t
  misc_feature (591)..(591): n is a, c, g, or t
  Predicted polypeptide sequence is orthologous to G2754
aaccgcatgcgttggtaccggggaatcggccattatggccgggggaattatcgagtactacttggaaacaaaaggccttcaggtttgccgaattgatggcagtgttaagttggaagagaggaggaggcagatagcggaatttaatgacttgaacagcagcatgaatatctttattctaagcacacgggctggtgggctgggtatcaatcttacttcggctgatacctgtatcctatatgatagtgactggaatcctcagatggatttgcaggccatggatcgatgccaccggattggtcaaacacgcccagttcacgtctaccggttggcaacatcacattctgttgagggccggatcatcaagaaagcatttggaaagttgaggctggaacatgtggtgatcgggaagggtcagtttgaacaagacagagccaaacctaatgcactagacgaggcggagttgctggcgctgctcagggacgagcaggacgaggaggaccggatgatccagacggacatcaccgacgaggatctcctgaaggtgatggaccggagcgancttacaggccctcctggcaacgccgacgccgnccctctcgcgcccctgaagggaaccggctgggacgtggtggtgcgacgaaaaacggggggggatgtcacgtcgtcacaggaagtgattcttaacgtcgtggcactaagcaaagctcatgatgagcggcatgggtcgagtggagtgccggaaagaaattgtgaccccattatacatggggtagagacgatcggagaagagaggcttcgcgagtaagggagaggaaaacagtatcaggagagagatagtaacacggctccaatcacggacgataccctgcgcacacgactcagacacagcacacaatcaagagagaaagaagc

SEQ ID NO: 6431 - DNA, 737 bp, Oryza sativa
  Predicted polypeptide sequence is orthologous to G2754
tggatcgatgtcaccggattggtcaaacacgcccagttcacgtctatcggttagcaacatcacattctcttgagggccggatcatcaagaaagcatttggcaagttgaggttggagcatgtggtgatcgggaagggtcagtttgaacaagacagagccaagcctaatgccctagatgaagcggagttgctggcgctgctcagggacgagcagggcgacgaggaccggatgatccagacggacatcagcgatgaggacctcctgaaggtgatggaccggagcgaccttacaggccctcctgccaatgccgacgccgcccctctcgtccccctgaagggacccggctgggaggtggtggtgccgacgaagagcggcggcggaatgctgacgtcgctcaccagttagcttcttcattcgctcgctgttgccgtctatgcatgccgaccgggtggggtgcctacttcacctgtgctgatgagacgatgcttttgtgatatacaatatcccccaagtaattgactgactgggcgttgcacttgcacctactgactaggagtaggaggtgatgtagtagtgtgcactgttataggctcagctgctggaattcattttgcaaggccagaagccttttccagcaagccgtgcaaggaagtggtttttgtcatgatacaattgtctacccagcttatgtgtaagcaagctatgcaatgcaatgctataaatagtttcttcaaggta

SEQ ID NO: 6432 - DNA, 438 bp, Oryza sativa
  Predicted polypeptide sequence is orthologous to G2754
gatgtttgacttttgttttcctcttttggactagggttttagcctcttttgtttcgaggggtttttacagattttgcaggagtggtggtggatgtggaatgttggctaggttttagatcgctgaggctgatttgtgggtgctgttccgtcagggcttgaattcggaggcggctcatggtggaaggaatggtggtcgctgtggcaaatgggacgaaggtggaagcagcaccggccgccggcgccggcgccgctgccaacgcggattcccctacatccgttctggaggatgagatttctgaatgtaagaatggggatgcctcggataccgtggaggcaattaagcaagaggatgatcatctcaaggtgcttgctgaggagagagctgatgattttgtggatgcaagttcatccctgactgtggaacttgcggccaacaac

SEQ ID NO: 6433 - DNA, 1241 bp, Oryza sativa
  Predicted polypeptide sequence is orthologous to G2766
tgggcccgcacggcggcggcggcggcggcggcggagggggcggagggcatgggcatcagctgcaggacgggagcgtggacttgctggcgcggcacagcagctcgccggccggattcttctccaacctcatggccagcaacggctttccaggctcaaaaggcgggggaggcagcggagccgaagcccaccaccacccttccatggccggcagcggcagcggcagcagcagcggcgggaggaagatgaagtcccagctgagcttcacggccgggccgccgcacctctcgcacatcgcggaggacggcgccttccccgaccgcgccggcgccgaggcctccgtgccccgcaccttctccgccggcggcagcagcggcggcggcgggttctccatcgtcgggccgtgggaggagtccagggacatcatctccaccctcggcgggtacgagtcccagttcggcggcatggcgagcacgtcggcgctggagatggccggcatggacaggtacctgcagctgcagcatgaccaggtgccgttcaaagtgcgggccaagcgcggctgcgcgacgcaccccaggagcatcgcggagagggtacgtacgcaatatcatgatcaaaacgcctctatatttgcttttgctttctcttcagatcttgacacatgagcatgtacgtcggtgtgatcgatgcgcgtccgtaggaacggaggacgagaattagcgagaagctcaggaagctgcaggagctggtgcccaacatggacaagcaaacaagcacagcggacatgttggaccttgcagttgagcacatcaagggtctgcagagccagctgcaggctctgaagcatgagcaggagaagtgcacttgctgcagcaggccttgattgatgaagcagtgagacggcgaaactgaaaggtatctatccttagtttggaaccctgattacggatgatactttcatatttccttgagagtaacgcatgcgtggatgcatgaaccaattaatgtcagtgacacaatccaaatcgaccgtgagcattttgtcgaaatgtgtaaattgttagataggacatggcaagggacatgtatatgcatgcctgcatgcatgagtgagtgcatggagctagctactccgaaatagcggggtgcagccattgtgatcccttaattaattctcgatccactgatgattaattagcttgtaattctgtctttaaaccttttttttaatgacgaggggagag

SEQ ID NO: 6434 - DNA, 1671 bp, Oryza sativa
  Predicted polypeptide sequence is orthologous to G2766
gagccgaagccgcaacctgcaaaaccaagtccacctccgcctccgcctccgcctccgcctccacccaccaccaccaccgccgccgccgcgccgccggagatgaacaggatgacggcgccgcacggggggatgccgccgccgccgatgccggcggcgggggggctggcgaggtacggctcggcgccggggtcgctgctggcgtcgatcgccgactcggtgatccggggccgcggggttggggttgtcgatcagctgcatcatcatcagcatcagcatcagcttccgccgccgccgccgccgcagcagcagcagatggtggggaggtacttctccgcggagtcgtcggggctcacctcctgcgagtccagctgccggacgacgacgacgacgtccacagcggcggcggccgatgtcgggcggcacccgctcgagcgcgcgtacggcggctccggcgagatccacgtcgacgcctcctccgccgccgtcccgctcttccgccacagcagctcccccgccggcctcctctcccgcctcatggctgacccgcacggcaatggcatggccgcgacgagagggatgggcggctactccggcggcggcggcgacgccggcgcgatggcgcacaggaggctgagctcgcagtggagcttctcgcggcaggacctgccgcagatatcggagatgggcggcctcatccccgacatcggggagagcatcgtcaccggcggcggcggcaacagctccagcgatggcgccggccacggcgcgcagtcctcctccttcctctcctccaggaacttctccatgagctcctgggacgacaccaactccatcatgttctcgcccccgagcagcagcaagaaggcccgcgtcgccgccgccgccgccggcgaccacggcgacgacatggtctccagcttcagcaacatcgactcccagtttggcttgtcgaagcagtcgtcgctggagatggccggcatggatgacttcttgcagctccagccagactccgtcgcctgcagggcccgggcaaagcgcggctgcgcgacgcacccgcggagcatcgctgagagggagaggagaacgaggattagcaagaggctgaagaagctgcaggatctcgtgccgaacatggacaagcaaacgaatacatcagacatgttggatattgctgtaacctacatcaaggagcttcagggccaagttgagaagctaaaacatgaccaagcaaactgcacttgctcaggcaagcacgattgctgaggctggagaaccagatctccgagctaatgttgtaatgatgtgattggtgaacccaaagttttgcttcagaagattagggtgtaaaagcacttcacatgtcaagtggcctccatgcctcgccctcccctttatcggttgtgttatggacagcgtcaatgacttgaagagtaggcggtgacaaagtagattaattgttgtattttaattgatgtaaggcagtggcttgtatgtaaaatcatccatttcaacgccaatgggattgcttcttattatcattgctcttattaaaagtatcctcctctttggcaccatttttgtgaattaccgactcattactgttgtttttgctgtaaatcaccttgtatgtctccttttcgtttttccaacaaacttattagttgttgtgtc

SEQ ID NO: 6435 - DNA, 1757 bp, Oryza sativa
  Predicted polypeptide sequence is orthologous to G2766
gagtcgctcgctcgctcgctggctgactgcgcccgcgcccgctttgctgcgctcccccggcacgcgacgacgaaaagaccggcctcaaaagcgacaccacgcagcagacgcagcgcccccgcgcggagaagctagctaggtactcctgtctggttagctagctagctatagctagaagcctagcacatgaacccggcgccgtcgagggcgccgcagcggcagcagcgcggaggggagatgtcggcgcgctacggcggcgggctgcagttcttcgctgacgccccgccggcgggggtggaggggggcgccgcgaccgcgcggacgttcttcccggtgccgggcgggggaggggagcagcagccgccggagcgcgcgatgaggcagcagcactacggcggcggcgggagtggtgcggccgagatctcgctggggcacggccacggccacggcggcaagcaccatttccatcagttcggcgtcgaggcgaaggacggtggcggcggcggcgaccagtcggggtttctgacgcggcacaacagctcgcctcccgggttcttctcgagccccgtcatggacaacggtttctcatcgagtgctagaccagcaggatcatcactcggtgaggttcgccatggcgccatgagcagcagcagcaacaacaacaagaagatgaaggccccactgagcttcgctagcagcaggcagggctccggcggcctctcccagatatccgaggacggcatcccggacctcactgacagcatccatggcgccgctcatcatcatgggcgctccgaggagaacgtctccacccacgaccacgtcgtccgctccttctcctccggtgggttctcgatcgggtcatgggaggactccaactccatcgtgttctccacgtcgacgggcaaatcaggagcgcacggcaacgacgacatcatcgccacccttagcaactacgaatctcagcttgttgcgcccagggagatggctggcgtagagaaatacctgcagatgcagcacgaccaggtgccattcagagtacgggccaagcgtggatgcgcgacgcacccacggagcatcgcagagagggagagaagaacgaggatcagcgagaagctcaggaagttgcaggccctggtgcccaacatggacaagcaaacgagtacttcagacatgctggacttagcagttgatcacatcaagggactgcagagccagctgcagactctgaaggaagacaaggagaaatgcacctgcagctgcaagcaagcatcaaggaacagaccagccgactaaaatgggatgtgaagcaaattgcagtgctggctagtttgatgacatttctccttggtcctcaaaacatgtttgcctggcgacaggaaattaaaggtatagcaggcagcatatagcgtgacaagagcaaagtaatggaggtcatcagtctcttccaaacgaaaggtcgaagtcgtctgatcaaacctttaccagtgaatcgatcagtccagtcttttttcttttgtcagtgtgaccaaccccttttgttgagctgtaaaattaattgaaactagactagaattgttccttcctttaacaaggagctctgctgctctggatgttaggcttctagctgtcctgttgctgtggtaaatagtgattggttcacccagcggttagcaaataatctggttgctggtttcagggtattctccggccaacattagacaagattcagtgatgtgttatgattcatacagatc

SEQ ID NO: 6436 - DNA, 3486 bp, Oryza sativa
  Predicted polypeptide sequence is orthologous to G2766
gtgtcccccactggcacatactccaggggcatatgtgctgttattactgtacacaagtaagcttaattaacttcaataatggtgctcgtgacagtgcaataatgcatctctggcaagaagtagaacaaaagaaatggaaaagaatcccatcctcgcacactgtatctagtgtactactcctatataagtgcatcaggtttatagttattagttcgaccgttatatttccaattgtagagcttgagtactgcctagcaagtttagtatgacttcctccgtttttccaaatacatgtaactgttaattagtattattatagcttcaatcactaataatttttaaatattttgactataaaaagtcatattgtttatatttaggatgttgatccaaaacacaacaacgacacagatttatagtaaaaaatgtccgttactaatgtaacttagggctaaatataggtagtctccagtaattacagctgaaggaatagtactaagcagcgtgacactgtcctatacattatgtgctgcaacatacttagtacaatgtacagtattatcaagttgatatgattaggctggtgcattgtatgttgccgacatgactgcgaccgtttattggcgcacttgctggcggccatctgcttgcagcgaacctggacacatgtcagtgtccgcagaattcatttcctaacaatgaagcacgtaccactcggttcactgcacctgctactaaacctctctctatcgcaccagaaaaataattttgttgtcgatcaaaacgggccccatggatttaatttttgatttattttcgaaggtgcaagataagtcccccaaaaatgccgttttcttatatttattcggaaggttaagataagtgattcttgttggtgcaggtaggagtatgatttaagataagtgtatcggttagtttaacctgctggctctgtcagctatgctccaatcatgcataatgcaaatgtcaccaacaaaaatatattgtttgtttttctatggtcatggttaattcagaagggataaaacgttatagtaatatcaggttctcgttgagtttgaaaagtcaatccatttttgttgattaatgtcaccatgcataaggtgagtgacagcaacggcagacatatcttgtcgtatgagtcatgctggggccaatagtatattcgagcaatactgcatcactgccttttttcagcatgataaaatagtttgaatataaaccaaggagtataaaggagttttttttttctgtaaagcaaaggttaaaaaaaatattaccagggacggcattaataattgctactgcatcgatcatggtaaattcattactgttgcaacttgcaacttttcatcatgggctgatatatcggatcagatgcattcacggataagatgtaaaggcgatgacaaatatccagcttgagtaatggccaggtgctatgctagatctagtttagattaagccttggctttagcttagcttttgtttatgccttcatggggtaggcttttagataatggatgccccatactgattgtctttactctttagccgatttacacagacatttgctgtttgatggggccaaaaatagtttcttcaccatctgtgtcgtttcttgcagtactgtttggtgtccttgctttctgaaaagaaaattgttcatttctagttttgtatcaatggttagaaccaaaagttgcaacaaaaggttcttgccaaaatcagtcacaaaagttaacttaactaactctgtttagtttcagataatgatgataattaagataagatttttatttttttagaatttttactaacataatgaaagaaactttcaaataaaatttaaaattttctattaaaaattaataacatacctaaaatttaaaattttcaaataaaaatttgaaactctaaactcagatttgaaaactttcaactcaaatttgaaactttcaacttaaattggaaaactttcaacttaaattttaaaaccttcaagtcaaatatttgaaaacacgtgtgctgcagattgaaaaaaaaatcgaaaagaacacgacaaaaattaaaccgcgcggaggagagacaacgcgaaaataggagaaaaatcacaaaaaaaaaaaatcagcaacgttatagttcggcacccttggtcccaaaacaaatttatttttcacctacttatacttattaataaaaaaaattagaataccttcacttatcaaatttaatgcaattatttgtctttttatctactccaaatgtatttatccactacttttataaattccgatgcaacaattattaaaaaataaagttaacttattttgggatgaaatagaggaaacaaatgaacttattctggaacggagggagtaactaatcttcgaggtactacctctatcccaaaatataagacataaccttatattttgggatggagggagtaccatactactgtagtactgtatcaccttgaaagatttttttttttggtaatataagagatttatcgtttatacagtagtttgttttaaagattggccaaaacttacaaaaactgacgtgattgttatgagttattagttatgaccactcactgacagaagaatctgttgcaaaaactgacgtgctgcctgtgatgaattgcaggcaatggcatggccgcgacgagagggatgggcggctactccggcggcggcggcgacgccggcgcgatggcgcacaggaggctgagctcgcagtggagcttctcgcggcaggacctgccgcagatatcggagatgggcggcctcatccccgacatcggggagagcatcgtcaccggcggcggcggcaacagctccagcgatggcgccggccacggcgcgcagtcctcctccttcctctcctccaggaacttctccatgagctcctgggacgacaccaactccatcatgttctcgcccccgagcagctccagccagactccgtcgcctgcagggcccgggcaaagcgcggctgcgcgacgcacccgcggagcatcgctgagagggttagtcataatttggcaattttcccttcacccatctttgcatatgatatgattatgatacgatcgatgttggatgctggtatggagatctcatgttttctctgtgctgttttaggagaggagaacgaggattagcaagaggctgaagaagctgcaggatctcgtgccgaacatggacaaggtaactcaatgaactgtttgggtcatttctaccaattgaacctgacaattctgaacctgattggagctgtgcttgtccctcggttataaatcgaaattagttcaaaatgtttgatgtgatatttactggattcttctcaaatatacagcaaacgaatacatcagacatgttggatattgctgtaacctacatcaaggagcttcagggccaagttgaggtatgctagctccacttcagaaatctcttc

SEQ ID NO: 6437 - DNA, 1313 bp, Oryza sativa
  Predicted polypeptide sequence is orthologous to G2777
tcatggagatccgcagatcactgaggccactggacctggccaagcagcgcggccgcagcagcggcaatggcacggcggcggggagtgccgtcgacggcgcgtcgccggcaggttcggactcggaggagcacgtgctaccgggcggcgtcgggacgttcagcatcaggcacgcgtcaggtactccgtcgagagaagaggccggtagccatggcggcgtcaggaggagtgcgttcgcatttgcacctgcgcttcatggcgccaggatggagaatgcacatgaaacaggaggaagatctgggagtagggctcaccgtgcgccgtcgacgatgtggcaagattctgccattgatcaaagatccataggccagacaccatatgaagcaacaagagcagagggaagaagtagcgccagcagcgccgatcagggacccagcactccgagatcaaagcattcagcaactgatcagagaaggaggaccaagataaatgacaggcttgaaatacttcgtgaactcctgccacacactgatcagaagagagacaaagcttctttcctttcggaggttattgaatacataaggtttttgcaagagaaagtccaaaagtatgaggaagccgatccagaaaggaatcacgaggattccaaatccatgccatgggcaaaagtctactatagatcatgctggagaaacacaaagaacaccagtcaagtccagggggaagatttgtcaccatccacacaggacatgaacaacgaacagtacggtcccaagcacatatcggcagcacaacctgctctcttcaacacacagagtgtaaccagtacaaccaccagttcctcccacatggcaacaggcacaccacaaaatttggaaaagaacagcacacccagcaatcagccaccatggctgagcatgtcaacaatgcgccaagagtctgaaccaggcaacaaaatgccgaacaagcatgagaaacagacccttcacgatgaaaaccatagtatttctagcgcttactctcaagggtctgttccttaaccatttgttacttcaagactaaagttagcacaatatgtaactaacaggatactacttcaatttgcaacagattattcaacagattgacagaagctcttaaaaagtcaggactagatccatctcaagctaatatagctgtagagatcaacctggccaaacgagcaagagataatactagtgacaactcaaaggtatagagctttacaaagttgatttattcatgatgtttgaacatatagatcgtctgcttaataattattttgtacctttgtcctg

SEQ ID NO: 6438 - DNA, 1620 bp, Oryza sativa
  Predicted polypeptide sequence is orthologous to G2777
attcaataacctgcaaacaaaatgcttcacaagggagaaattgcaatatagcctgctgactacagtgccaaaattgatattctgtttacctccgaaaggaaagaagctttgtctctcttctgatcagtgtgtggcaggagttcacgaagtatttcaagcctgaaggagagcatgaagaattgcattttagaacacatttcttgcaccatatacttatatgaaattgtcttggaattaaatgctgctaatatgatatcttgttgagctatctagctacgtcttcatggttggtttgttcctgctctgcagaaaataattcaaaatggtgtttgacctctactagcttgcctgtcatttatcttggtcctccttctctgctcagttgctgaatgctttgatctcggagtgctgggtccctgatcggcgctgctggcgctacttcttccctctgctcttgttgctgagtgcacatgtatatatcaaatccatcagtgcctgaattgaagtgacagactagagaatcaacaatacaactgcggtactaaccttcatatggtgtctggcctatggatctttgatcaatggcagaatcttgccacatcgtcgacggcgcacggtgagccctactcccagatcttcctcctgtttcatgtgcattctccatcctggcgccatgaagcgcaggtgcaaatgcgaacgcactcctcctgacgccgccatggctaccggcctcttctctcgacggagtaccggacgcgtgcctgatgctgaacgtcccgacgccgcccggtagcacgtgctcctccgagtccgaacctgccggcgacgcgccgtcgacggcactccccgccgccgtgccattgccgctgctgcggccgcgctgcttggccaggtccagtggcctcagtgatctgcggatctccataccgtatcctgcacttgacatgggtaacatgggttagcaagttggtgcattgctgtctaacttgcacaccatggcacttgcagttgagaaggcaaaggagagggcggtgcagacagctcacctcgcgatgaatggctggaatgctgctcctcccggtgctggaacggcggcgacgacgagccgccgccggcgcggagcgagaggaagtcatgagccggctcctctcctgcgaatcaccgacaagcacaacacaacacacggcaatgtaccatgagctgatgagcatcatgcggtgaagagagaagacgctgtggaattggaggaaggaaggaaaggacactagggtgaagtgtaattctctttgataccttggaaaagctgcattggcgcccgggacacaggacactggagatctgtcgacgctgctgccaagccgagcggcctgccgttgcagcagaaagatggcgcctggatcttgccgctgggcagtacactgatggaatgtagcgaattcggttgtccactcggaccttattatagtcggctaagagagagtcgagaaggataggagactgataatgatataacaaataagctagggaggtaagccctgctgcctgccgcctccctgcctgtctggctggtagtattatactttgtacctttgatataacaaacgtttcatggttaaaaag

SEQ ID NO: 6439 - DNA, 422 bp, Oryza sativa
  Predicted polypeptide sequence is orthologous to G2779
gaggtgtcattctcttctcaacggtcgacaaagtttcgaaatctacaccgatctatgagcattgctgttggctttgttgcgtgtccaaactcaaattttatttttccagactggccgactttaaaaggcagctgggcgtccgtgtcgaatctttgcctgttgcggtcttcctcccgttattgaaggcgatcgacgagagtatcctcaacgagtcaggctcaccctaccttagtttaagcgcctagcctgtgacgtcgaagtccaccagacatcaacaacctctactgcactctccttctcaacaaccaccgtcgcgaaacaacttccaacgcccaattatctccacaaacacctgaaccactttatcgacgactgcttctcaccagatgacctaggaactggtgagcgcgcaatgggtgggc

SEQ ID NO: 6440 - DNA, 1693 bp, Oryza sativa
  Predicted polypeptide sequence is orthologous to G2783
gagctagagagaagcatgcagcgagaattaaggtaggaggagtagttgcttgcctccgtcctgatctccactgattcattgtgttatatatgcataagcataacgcaattaattaggaggccggtcagctcgatcatatcgcagggagtacgtagcaaattaatggcggccgtcgggctgttggtactagttggcctgcaggtggtggtcgggtcgatggcggcgcaagaagcaggtgatgccccggcgagcatcacggggccatgctcgcgtacaggagacaagaaggcgtgcgtggagttgttgtcgggcatcccggaggcccggaaggcgacgacggtgggccccctcgcggagctgtacctgcaggcaatcgccaaccacacgacggaggccaaggcgatggctaccaagctgctagccaccatgaaggggaagggctctggatcggggatctccagtactggatggatgagaactacatctccgcctgctttgcgcccaccggcgagctacaatctgtgaagctaattcgtgacaagcagactggacaacttcagggttatggctttattgaattcacatcccatgctggtgctgaaagagttcttcaaacatacaatggggcaatgatgccaaatgttgagcagacataccggttgaattgggcctctgctggtgaaaaacgtgatgatacccctgattacacaatttttgttggtgatttggctgctgatgttacagactacatattgcaagagacgttcagggtacattacccatctgtgaagggtgcaaaggttgtgacagataaaatgacaatgcgttcaaagggctatggcttcgtcaaatttggtgatccttccgagcaagcccgtgcaatgacagaaatgaatgggatggtttgttcttcaagacctatgcgtatcggcccagctgcaaataagaaagcaactggagttcaagagaaagtaccgagtgctcaaggagttcagtctgacagtgatcctagcaataccactatatttgttggtggccttgatcccagtgtcactgacgatatgttgaaacaagttttcactccctatggagatgtggtccatgttaagatcccagttggaaaaagatgtggttttgttcaatttgctaacagagcttctgcagatgaagctttggtacttctacaaggtaccttgattggaggacagaatgtgaggctttcatggggccgcagcccttcaaatagacaagctcagcctcaacaggattccaaccagtggggtggtgctaatgctggatactacggttatgggcaaggatatgagggttatgggtatgctcaacctcaggaccctaatatgtacgggtatggagcttatgctggttatcccaactaccaacaacccctagctcagcagccgcagcagcaacagtgagatccaatggaagatttggttttcgagactgatcaaagccgtcgaacgaggtgatgcttctgcattccggagcatgtctgggttatgtcaatagagattgtgatttgtagttctccagattttgactgcttatgaggtgttttgattaagcgacatgttctgtacttctgtgagcctgggctggtgcacattgtgattctgtcgtacatgtgaactgcatgtagtaaaaaaatctttcgtggtttgttttctgcccc

SEQ ID NO: 6441 - DNA, 1693 bp, Oryza sativa
  Predicted polypeptide sequence is orthologous to G2783
tgaatttggttctgaagtaaggagcaaatatgctaccttcctgttctccctttctgccactacattgagataactacattctgcgaagttctctatcatattccagtacttccaattttagctttaattatctatttaggtttctctatctagccttcccacagtcttaatgtacctttctgcttcaacctatcattccttttatttgcaccaacctataagcaatatcacattgtcttctccaaattattttatattgcagattccttttgctcctctattttccatttccccattcatatgttatctgtaatactaaaaactttctaggttttattcaaataatgcagggcagcaagtgatatgtgataactatcttcttgaacatatttatatacatgggcaagatttaggtgtggtcacaaataagagaaatatttgtgctttataaaagcaattctcagtttactactgatgaatgattggcatactgcatttggaacttatgaatgccattaagtttctatttttgtatatatatgccgtataggttaattgcagttcataggtattattgcacatttactgcaaagtacatggggtggtcttgagctccatccatcaactcaaattcataactgacctgccatactaacatccatgctcctgtatccagtttattcttctattgcagctaagctgatgcaatcagtgagtaaatcacgtctgtgaagcaaaggactgcttgtgttccttcccgaccctcccctaacagtgtttgctcttttttgtttgctgattgattcatcgtagttagacagcaatattcacatgcactttaccctctaggttattaaggaatagtctgtctacagttttgtttgctttggtctgactagcaaacatgatcactaacattggtttggggttttgaatattatttagtatgatctttcggaacttatggtgcttttgttttgtcattgcaggttaccagagctcccaaggaaacagtttggagaatgatcccaataatacaacaatctttgtgggcgggttagattccaatgtaaatgaggaccatctaaagcaagtatttactccatatggggaaattggttatgtgaagattcctctaggcaagcgttgtggatttgtccaatttactagcaggtcatctgctgaagaagccatccgtgtgctgaatgggtctcagattggtgggcagcaagttcggctttcatggggccgtactcctcagaacaagcaggctccccagcaggatgccaaccagtggaatggcaactactatggataccaacagggctatgattcttcttactatggtgcacccaatgcacaggatcctagtgcgcaaaactactatggatattctggctatggcaattacgaacagcagcaggagcccccacagcagcagcagcaacccccacaacagcccccacagcagtgaccatggcgacgtgcaactttcagatctcgcagttggattatcagggtgtacattttgcgtgaactcgagctggcgcttccttaagttatttgtagatgtctttgtgtggatgaggtcgtgttctagctccgctaccacctgtcgttagacgactgatcgaacccttttgacagtagccagtgtttcgttttttgggcctccctgggtgtgatgatcacc

SEQ ID NO: 6442 - DNA, 1599 bp, Oryza sativa
  Predicted polypeptide sequence is orthologous to G2783
gagtctctctctctctctctctcccgttcgtgcgtgctagctagggcatctcgtcgcattgatgcagcagccgccgtcgcagccgcagcccggcatgggcggcccgcctccgccgccacagggcgcggcggggcagccgccgcagtggggcgcgatcccgccgccgatgccgccgcaccagtacggcgcgccgccgccccagcagccgccggcgatgtggggccagcccccgccgcaggcgcactacgggcaggtgcccccgccccagccgtactacgccgcgccaccgccgcaggcgatgcccgcccccgcggccgcggacgaggtgaagacgctctggatcggcgacctgcagccctggatggacgagagctacatctacaactgcttcgcggccaccggggaggttcaatctgtgaagcttatccgggacaaacaaagtggacagcttcagggttatggctttgttgagtttacaagtcgtgcagctgctgatcgaattcttcagacttataatggacagatgatgccgaatgttgagatggtcttccgattgaattgggccagtgctggcgagaagcgtgatgatacccctgactacaccatttttgtcggggatttggctgcagatgttacagactacctactacaagagacattcagggtccattacccttcggttaagggtgcaaaagttgtaactgacaaaatgacaatgcgttcaaagggttatgggtttgtgaaatttggtgatcctacagagcaagctcgtgcaatgactgaaatgaatggaatgctttgctcttccagaccgatgcgtattggtccagcggcaaataagaaaacaacaggggttcaggagagagtaccaaatgctcaaggagctcagtctgagaatgatcctaacaataccaccatattcgttggtggtcttgaccccaacgtcactgaagatgtcttgaaacaagttttcgctccttatggagaagttgtccatgttaagattcctgttgggaaaagatgtggttttgttcaatatgttaacaggccttctgctgagcaagcactggcagtgctacaagggaccttgattggtgggcagaatgttagactttcgtggggtcgaagcctttcaaacaaacagcctcagcacgactcgaatcagtggggtgctggtgctggtgctggtggttactatggtggctatggacaaggttatgaggcttatggtgggtatgcacaacctcaggatcctaacatgtatggttatggagcctatgctggttatcccaattaccaacagcaacaagtagcacagcagcagccgccgcagcagtgagccctgtttgatcgatcgcgtctttgggctgtgaggcacacaacccatttcaagctacagctttagctatgttattgctattctcaatagagagacggtttctgaagactccagatttcgattgaggttttaatgtatgaactgtattatgattatgaacaacggatgctgccatatcgtggttcctatattgagtcatgtattttgaaaacatatcctctgtttccatctcacccttatcatcgattattattattgcc

SEQ ID NO: 6443 - DNA, 2076 bp, Oryza sativa
  Predicted polypeptide sequence is orthologous to G2784
atgccgatcattcctgagcaggcaatggagttcctctctcgaacatggagcccctcatcatcagatttcttccaagcattcgtgtcggtgtgcgaactgaggccggacaacctgaagtatgtcgaggctgctgacagcaagaagatgggcacagtgcttgcttccgctgctgcgctggtggccaccgtctgcgcagaggctgcagagctcgctgggaccaacaggtccggcgtgacttccgccgtgaaaactggagtcgagagctgctcctctgctgaactgctcaccctcacggccactgctgctacatgtctgagaggagctgcagcactgaaactgagggcagacgtcaggggaatcggtagcaacaacaactcagttggcaccagcactactagcatccacaaagacacaactctcagggttaggctgccttgtgggagcgtgcgactgaggaaggtggctgtctttccacagtgcgacagagtagtactgaggctggggaagaaacatctgcacggggcattctcaacctacaaaaattatgaggtgcttgacgtctccagcaacggcggcgatgtggtggtggacggcatggtgttgttcccgctggtgctcagaacggccgctggtgtggtacagctgctgttggacagtcagatgcactgcaaggtctggaagaatgccatcgagggcattctgtccgaccaaaacggttggcaacttggcccatcagaaggccaccggccgactccgactccaagtctccaactcccaccggcggcggcggcggcggcgagccgagttccccatcgccatcggtggcggcatctccgtgaccccctgctcaagtggcggcggcggagcgtgcggggaaggaggaggtggaggatggactggtcgaaccttggcggggaggggccggccggcctcatcgccgagcgcgtcctcgccaacgacgtcgccgactacatccgcttccgcgccgtgtgccggctgtggcggctgcgctcggtggatcccctctcccgcgccctggactgccgcttcctcccccggcggtggatcatgctcgacaaggcggcgcccccccgctgccgccgcttcctctacctctccaccggcgagtgcatccgtacggatctcccggagctcgagagccacaccctggtcgcgctcgccccggagggcctcctgctgctgctccaccagcgcaccctcctcctccgcctgctcaaccccctcacccgccacctcaccgacctcccgccggtcaccgcgctgctcacgccggagcaactgcgatcttggcattcggatggggggttagaagacgatccgctattggcgcgtggcgtcggtcttgcatccgcaaccacagtggctctcttcctctgccgccccaagttgatcgccgtcgctaaacccggcgatgagtgctgggccgtcgtcgtcgccgacaagaaccgcccctacattgactcggctttgcccttcgcagggcgcttctactgcgccatcggcggcagtgtcatggtgctggacagctctccttcttcagatcagatcatagagggcggccgcggctggtcaccaccgctcagccgagcaagcccttgcatttctcccggatgtcaggaactattcaccttgtggacaatggtggggagtttgatgctggtgtaccgtaagatccgccagagcaatgttgatgatgaatcgcggcaaggtgctgcgaaatacgagatgaagtatgatgtttacagggtggatttcgacgccggggacttgatcccgaggctcgcagctgacactctctacctgggattcgattgtcgtgaaaagactcagatgaacgaaatcgacggttacaatgttgcagatgggagtagcgagccatgccacctcgactccatcttccgtgagatgtcgcagcaggacggttacagtgttgcagatggaagcagcgagccatgccacctcgactgcatctttcttcagatgttgcagcagccatacagcttcgtcaactgcctctcccactgcatccagggaataggcgatcatcttgcctaa

SEQ ID NO: 6444 - DNA, 1200 bp, Oryza sativa
  Predicted polypeptide sequence is orthologous to G2784
atggagcttgacaggagcctgattgcctgcgaggagccgccttcagagccgatggactttctctcgagcgcgtggtgcagctcggctatccaagttcttcagacgggatcgatggattgctcgatggcgctggtggagaacccggtcatggcgcctgacaatgataggagagacttgttgccaaagaatgaccgtagcttggttgtcgacagtagcggattcagcacgacgcaatggaaatacgatgatctgaagtcatggatatggcttcagaaggcaattcacccagagctggattatgatctcaagaagaaatggctcccgcgcaagatggcgccatggagcggcatctcgctcaagaagtgggtcaaggagcggaagcagaagcgcaaggaggaggcgcgcctgcacaaggccgaggtccacgccgcggtgtccgtcgccggcgtcgcggccgcgctcgccgccatcgccgcggagagctccacgccggcggcgacgatgaaggagaccgcggtggcgtccgcggccgcgctcgtcgcggcgcagtgcgcgaaggtggccgaggctgcgggcgccacgcgcgaccaggtcgcggcggccgtcaacgccgccgtggccgccacggacgccagcaacgtcatcacgctcaccgcggccgccgccacatcactgcgtggcgcggcggcgctgcgaggacggcgtagcagcggcggcggcggcggcggcggcagccagaacgagcggatggaccacgcgagctccgccttgtcccaggacgacctcgacttcgacttcaactacgcgaggtccaaggcggcgctcgccaagggggacgagatgttcgtcgccatgcccgacgggaagtggaagctgcacacggtgtccgcggcgacgagcaagggcggcaaggtggtcatgcggatcaagaagatgaacctggtcatggcgttctccaacgccaaagagagtgtgatccacgacgtgcagccgtgcgcgccggagaagccgagccgcgacgaggacgcgacgtacccgatcgaggtcacgacgagcaagggcaaggtggagctccgcgccgacgactacggcgtgtacaagaggtgggtcacggcgctgacccacatgctcgcggcgcccaccgccatctgcaaggcgcacgagctgccgccgccgccgccgcctcaccgtcggaactga

SEQ ID NO: 6445 - DNA, 313 bp, Oryza sativa
  misc_feature (73)..(73): n is a, c, g, or t
  misc_feature (97)..(97): n is a, c, g, or t
  misc_feature (235)..(235): n is a, c, g, or t
  Predicted polypeptide sequence is orthologous to G2789
acaatttggaattggaatttatgcccacattcccgggaggttcgatttgttccgactcagatgaccgatacgnaccagctggctggtggtgacgatnttgagcgatggagacgaggatttgtgaggtgtttgagcgagagatgtgacctgagagttgggattcgatccggtgtgtggtgttgtgacgagagtggccgatgacgagtgagcgcgagagtggtggtgggcgacttcnactcctgtttgttttgtgtaaccatacgagcatacagatgataaaactcttgttcacattttaaaaaaaaaaaaaaaa

SEQ ID NO: 6446 - DNA, 1476 bp, Oryza sativa
  Predicted polypeptide sequence is orthologous to G2790
gacccggtctatacatgcaaaacgagccagcaagcgtccctggtccccttccatctgaactccccactggcctgtctccaatcttgagcagttctctcttgcaaaactttaaaagttggaagaagcctttgagagttctgcactctgcacgcacagacaaacgccacagagcggctgcagctaatactagcgcgaaacttctttgacccgaagaaacatccccaactgctaggtatcatggtgaaggaggaggagatcatcacagaggcagcaggagcaagaggctacatggagatgcttgggcttggagaggaggccgccgactacctgatgtgcctgtctccttcttcctacctgtcttctcctgctgcttccaccaccacagctgtggcttctcctacctgtgcctcgtacttggctcctcacccttaccaccacctgctaagcttcagtggtcaggatcagtaccacggtgatgacgtctttgggttacagtattacggcggcgatcaagtaattccggcggtggttccgcagaagtccagcccgaccaccgagtgctcctcctccgtctcctccatgtcgtcctcgccgacggccaccgccatttccagctctaagtcaccggccttcaagaagaagggatcgagaggttgtgatcagaggaaggctactgctcctgctgctgccacaaccacaaacaagagacccagggtgaggagggagaggctcggagagaggatcatagcgctgcagcagctggtttctccgttcgggaagtctgatacggcctccgttcttcacgaggcgttgggatacatacgcttcctgcacgaccaggttcaggtcctgagctcgccgtacctgcagcgcctgcctccctctgctcgcgtcccggagcaggagagaggcacgccggcggcggaggagcaaccgccggcgctgcggccgagcgacctgaggagccgtgggctgtgcctggtgccgatctcgtgcaccgagcatgtcgccggcgccggcgccggcaccggccacggcaacggcgccgacctatggtcggtggcggcgggcatggcgaaggcgacggcgaccgtgacggccgccgtggagaggagcaaggaggcagccgccgccgccgccgccactgccgcattgctgcgtgctgatcgtccagggcagcagctggcctaatctgatgactgccatatactctactctactccactttcttcacagctgcagggttttagaactaagccagatcttttggggggctaatctgttttagaaatcgactagtactaccttttgctgttcttttggagaggctgctgctgagttcatgggaaattggaaagtggcgcagggatgcacattccatcgccagcaaagaactgaagtgtgtaaatggagggtggggttttagctgattaaagtacaagtactaatgctcctgcttaagctttttttaaggtt

SEQ ID NO: 6447 - DNA, 2200 bp, Oryza sativa
  Predicted polypeptide sequence is orthologous to G2791
gagaaggggtgtactagtaaacaaaacaaaaagaataggttgagactttcctgctatcgtcagcattttcagcccccctcccctgggctggctctgcatcatcattcatcatcagcagcagtcagtccatccaacgcgtcttcagtcctcacccgcagcaagaaagccacacttttcctcctcctcctcctcctcctcctccgcctcttcctcttcctcccccttcgttctccacacccactctcgggctgcggattctccggcttccgcgcctcttcctctgtcgggttaacaaagttactttcagcgtcagagggtatttcgtacaaaaaggaactgctgttggtacaggattatcagctgtgaacactttctgtttctagaggccattctctgtaacactttggagcatcaattttgtagcgtgctatcatggactactctgctggttcctacatgtggcctggcaattcaggttctgagaactataattttgttgacggttcgtcggaatcatatgcagaagaaggaagcctaccaccttcaggctatttcatgggagctggatcagatcgcagtttaaagatcacggagaatgaaaggaaccccactatgcttgcaaatggatgcttgccatacaacacccaggctcatccattatctggccagattctacctaagggtgagctccctaacaatcttctggatcttcaacagctacagaacagcagcaatctgcgaagcaattcaattcccccaggggttcttcagtgcaattcaacatctggaacatttgatgcgaaattggatacacctggtcttgcagaactgcctcatgctttgtccagttcaattgatagcaatggtagtgacatttctgcttttcttgctgatgtgcatgccgtttcttcagccccgacgttgtgttcagcattccaaaacgtttcctccttcatggaaccagtaaatctagatgctttcggtttccaaggggcacaaaatgttgctatgttgaacaaaacaagtcttccaaatgggaatccctcgctgtttgataatgctgccatagcatcactacatgatagcaaagagtttctcaatggtggttccatcccttcgtttggtactgtcctgcaggcactaggagcgggtggtttgaaggctgctcaacaggagcaaaatatccggaatatacctctccctacattcacatctggtagtcatttggcagttactgatgcacaagggccaccacttccttcaaagataccaccattgatccatgaccataatagtgagtaccctattaaccattcttctgatgtggaaccccaagcaaattcagctcctggaaatagtgccaatgcgaagccacgtacaagggctcgccgtggacaggcaactgatcctcacagtattgctgaacggcttcgccgagagaaaatttcagaaaggatgaaaaatctccaagtccttgtcccaaactccaataaggcagataaggcatcaatgcttgatgaaataattgattatgtgaaatttcttcagcttcaggtcaaggtattgagcatgagcaggctaggagctcctggagcagttcttccccttcttagggaatctcaaaccgagtgccatagtaatccatctctatcagcttcaaccatttcacaagggccaccagacatgccagactcagaagacagctctgcctttgagcaagaggtagtgaagctgatggaaacgagcatcatcagcgcgatgcagtatcttcagaacaagggtctctgcctgatgcccattgctctcgcttcggccatatccaaccagaaaggcatggctgctgctgctgcaatccctcctgaaaaatgaaaaaaaaaatgaaatcggaaaaatatggggggaacaactgcagaagacataataactcaacggctgcagaaatgtgctggacactgcaggttttgtgaatgaagtgaaatccaatccagggggtcataaaacataggaagttatctgactaattcaggcttatgacacaatctactctatagtctatagctattgtgtgcctgttgcacatcagttgatgtgtattcttttgttttttttgtattgcatccggatgctaattaggtagtagtgtttcctttgatgtacatgagtattatctatgcggttttatctaatgtgcatataaagc

SEQ ID NO: 6448 - DNA, 573 bp, Oryza sativa
  Predicted polypeptide sequence is orthologous to G2791
aaaggcatcggagaccaggagaatatggcgttaattaattaacccggtaggttagtatagcactctgcagttttccccgatcgacgacgtcgtcttctccgtcttcgtcgccgcgacaccggcgagatcatggagatgggcaaatacagcagcagcgagaggaagaagggccccgagaaggacacgtccatcaggtcggccaccgtgtccttctcgtcctcctcgtcgtcagccggtacacgcccttcttgctggcgtagcgtcgtgacgaccgcgaccgcgagacggcgctgctgcggcggcgacgagcacgacacggcggcgcgcgcctccgtcctccacggtgaccaccacctcggcggcatcggcaagaaggtggacgcgagcgcgggcgcgggtgtcaggacgctcgtcgagcgcaacgatttctactgccaggaatgcaacacgcacggcaaataggtgaaaggccaaacatcttgggtttctctcctgttttttttttccagctgctcttacatttctgcttgaacaatactccctccgtttaatattataaaactttttagtatt

SEQ ID NO: 6449 - DNA, 1575 bp, Oryza sativa
  Predicted polypeptide sequence is orthologous to G2791
atgggcggcttcgcctaccccttcacgccgtcgccggcgtggtcgcgggacgccgtgttcgctggctcgccgtgggccgcaggcggcgtctcctccctcgccgacgctttggtgagctacggtgccgtcgacgacgaggaggccgcgttcctcggcaagaccgccgcgtcgtctcccagtacggcgaggctgcacgagcagcagcagctgctgctggaggctgagctgctgcgccacggcgacggcctcggcttcgccgcgatggacgacgacggcggcgccgcgatgctcggcgcgctggagccgtgcgccatgccgctcaccgacagcggcggccccccggtcatctgcagcagcagctccaacgacagcagcgggagcgagcactccgccgccatgcctgcaggaggcggcttcctcgtcggagagcagcagcagcacgtgccgccggcggcctacgccgcgggaggtgtactcccgtccatggccgcgggagaagaaacgccgcagagcttcggctttggcagcctcttcaatggcgatctcctgcaggaggcgaccgtgagcaagtatcatcatcatcagcagcagcagcagctgggcgttgtgccttcgtcgcagccgcatcatctgaatgatgacatcgatttcaacactggaaaattgatgtcttttgcttctggacagcagcacgttacccccagcattgacagcctgcagatcgaccagaaggaattcagcagtggcctgcaccacctcaatctctcctcgctgatttctggaccactcgcatcattcaatgcaacacagagccatagacagcctgctgaagcttgcggtggcaaaaatggcggcgccgctccatttgtgaacctatctgaggtgctaccaaagggcaatgggagtggtagtgctgggaatggagcacccaagcctcgtgtcagggctcgccgaggccaggccaccgatccccacagcatcgcagagaggctccggagggagaagatctctgacaggatgaaggatttacaggagcttgtcccaaactcaaacaagactaacaaggcatccatgctcgatgagatcatcgactatgtgaaatttctccaattacaagtcaaggtccttagcatgagcaggcttggagcggccgaagccgttgtccctcttctgacagaaacacaaaccgagagccccgggtttctcctgtccccaagatcatcatcaggagaaaggcaggcaggagcaggagcagtaacaggagggctccccggcgatcagccggagctcctggacggcggcgccatgttcgagcaggaggtggtgaagctgatggaggacaacatgacgacggcgatgcagtacctgcagagcaaggggctctgcctcatgccggtggcgctggcgtcggcgatatcggcacagaaggggacgtcctcggccgccgtccgaccggagaagaagaagaacggtgatggcgatggcggcggcgacgaggaggacgtgaagggagagtttgacgcaccgaggaggcctcctgtcggccggccgaaggagatgaggtccagagtctaa

SEQ ID NO: 6450 - DNA, 769 bp, Oryza sativa
  Predicted polypeptide sequence is orthologous to G2802
gcaccaatccattccacctccgttaaccccgttcgttttatttgcgtttacttcgtttcttgggaaggcacttccttcctcttcctaggaaggtaataaagaagagcctcctccttcctccatggatagatagatcaatgggagctctgcatttccttttctcgtctctgttctgttgttgggtgtgtgtgttcagtgttcttgctcacctagaactgtcggtggtgctgctgcataccgaaatgccggtaatggcgatgataatatgagcgctcatgctcatccatgctgccggaaggaacacgatgacggaatttttcttggactcgcgagtgattcgatcatggggggaggtcatgccaaaatttttctccgggttcatcggattcagagggggaggtgctgcctctgaatgcaattgagtgcacctgaaacagaaaaaagaaaaagaaactctgcttcctttttttctctctcttcatgctcgttcttgcgttaggggataataataagccgagatctagtgaatatttggggggtttagcgaacatgatcatcgataacgacatggtgagatctagtggtgatgatcttgcttctggatctgggggtttagttcagcaagcctgaaattctcacctgggtttaaggtttcttttatttttcttttttcatcagattgaagtggatagaatgctagatctagtaatgtcctatgattgtttctctttcacctgaatttttaaaagcatttttgatgatttctctc

SEQ ID NO: 6451 - DNA, 1968 bp, Oryza sativa
  Predicted polypeptide sequence is orthologous to G2832
gaagcggcgcggcgagcagcagccggcgaggcaggatgaacctggcgcagtgtcgcgtccagattcataggccgcgccgacctataagtacactcgcggggcacgctctctctctctccgaggattgcggttgcaagcaggataaacggccaccggtaggcgtcggcggagaggagaggagcaagagagggtgggaaggagaggcacctccggattaattcctccgcgggagctggatattgtgagggaatcgagcgatcgagtcgtcgtcgtcttcccctgagcaatccggacgcacgcgccccccgcctgttctgcttccatcttctccacgcggatcggcgagacaagaatcaggaagcacccagcgattgagtcgtcatctttccctgagcaacccggagtgccccacctattctgcttcctcttctccacacggatcgtcgagacaagaagcaagaagcatccagatatggcaccaagaggaaagccttggaagcattgttgcaacaagtgcgacaagagcttccgttcagggaatgctcttggaggccacatgtcctgccacaggagtgttggtaatcagccaaagagcacgtcaagcccacccactgttgttgatctgcacatgccactgctgagttcctgtgatgataatcttttgcttttgcccccagaaacacaatgccagatgtgctcaaaggtgttctccacccccggatcgctgagggagcacatgatgatgcacggtggggagaaggtggtggtcaaggctgaggaagaagctgccgggctgattgaagcactgggcattgctgatagcatgcaagatgtaatggtgttttcttcagtgaagcgtaagcgatcattccgatcaaagaggcagacaccagcactcagtttggaggagatagaggctgcagatgctctcctactgctttcagggtgctttgacaagacttcagcttatgaggattgctatctgggagatatagaagacagtagcttgagatccattgtgctgacagaggttaacatgaatgccgtggatcgttgttcggttcgatctgttggctccaaggagccaataaatgataataactcaggttacaaggattgctatggacaaagtgacaaggaaaactgtttgatcgttcccaaggaggagatggatccaaatgattttgatcatgagctggttagagatgctgctctcaggaaaccaagaaccgacaattcagatgaggagatgaagtttggtgatcttccagctgctgctatgaaggacaacagccaccgttgcaatacctgcggaaagtcatttggatcagggcaggcactgggaggccacatgcgacgtcattatgttcggaagtgcaatcgtcaacggggggttgctgaccacgctggttctgttcttatgaaagtgcaaaagctgaagcttagattggaccccatcttgtttgatgtcacacttccagctctcactgatggagactgctgcatttctgtgggtgtgaagcctgaacctcagctgtggtgtgtcacgagcaatcttcagtgaaccaatccggtgctcgatgtggtctgaaactctctgttcttttggtgaaatctggggtgttgtctgaaactggtacagttccttgagctgtctgtagactgtaggtagttcatcagccaggaagcaaaaaaaacccatgttgtcttccgatagatagtcacaagctcacaatactgataggagtagttctcttgactgacaaacttccatggatagcaaaggccaggatcttgagtgatagcttggttactgaacagtgaagctgatttccatgttgcatgcaatgcaatggacgagcttgtcattttttttttgtaccaacaatctgtaaaatcagttttgctttgctttctgtaaatgtctgtaccttgattcttgaaaggaatgctggtcagaatgaggtg

SEQ ID NO: 6452 - DNA, 3820 bp, Oryza sativa
  Predicted polypeptide sequence is orthologous to G2834
ggctgccctgtggagcctcaaattctactcgcgtaagtccatcttttttttttactgagtatattacacgcttcacacgaatttctcttttttttaaactaaacgaatttctcaatcttgttaatttcatccgtgctatactggaacaactgtaacaattttgggggcagagaattttggggggagggaatcaatcttgcaccagttggtctcctttagaatctggatatggttctttagattctttctgatgtttttgttagaggatggtgtgatggtgcctttctttttagtgtttgtttgatctggaggggcattagaggtggtgtttttgggttagatggggatcttgaagtgtgtgacgataatcatttgggggtagttttagatctgccggttttgtgtttgtgttcttggggttgattgtttccagattgttggtgtgcttatagggcctaggggtgagaattgagataagaagggaaggtgatatgctgaaattatgtttgatttatctctgatttgtactagaccatcaactttgctacagtactttatttgattaatagttaggctgtgaatccatgaaaatatgcatcatttggatttgtcaatattttttttgcatgtatgcttcaggttcttttgcatcttcagctccacatcaggagtgatccctgttacttggtgccaccactttctctgctaagtgattctttatttgtgataatttaaaattaaaatacaaaacactatttttttactacaagaaatatgtagatgcatgcacagaaaaacaatcacagttgcctagccatatgaactaaaattttagcatatcactacttataacaaaagtacgttggcacatatatatatatgaggaggcgtttccagtagaaattttgattgggtcatagatttgttgttagactcttttctttgagcgtcgtgaattggagtaggaatttacatatgttgtgattttctttggaattaaagtggattacttttaaagtttgattttaaagaataattttagatagacttttatatgtgttctaagaaattattaaaatagaactagacaaacaaagtggtaaagaaaacccttgaaataaatttagaattaagtcaacttcgattatatatattcgtagttcaaccagcattcatcatgcaataaagtaatgattttatttataccctgagtaagttttttttaaaataatttatcacccatataaaggaggcaattctcgctctcactaacatattgaactatttttgtcactaaatgtggactgggatagcaaattgtatccaacttaagaatgtcatattaccaaatgtcccagttataaaataataattatatttacacaccatgactttgtaaaataaaatactgtaccttttttttaagatgacttgtcattttcttttcatgcagccttattagattatgttgtactatcaaccaaaactaatgtcttgccttgtactgtttccacgttcatggctgatggcctcatgggccaatgaccttgggggttgctaaaagtcagaggagcctgatcccaatatctcatattcccagggacccctccgtaaatttgtgtttttgcccacgaagaaataggaaatcgtctcgccgttcgccaccacggtgactcgactagtatttcccctcgctcgccgtcgactcctccgctcgccgccgccgccgccctcgccgtcgccgtggcctccgccgatccgatcccaatccatcccggcgaccgcgagcagggcgcggggcttcgtcgttcgtcctgctgattccgccgcatcgcgtcgcggttttcatgactgccctatagatcagctcctgattggaaggactgtagttccatgagatagaagggcatattgaagtagaatttggcctttggtgaatctaaatggacagtggcttgggaagaagttcagagacatccttgaaagccttgccatcaatggcaagtaatgcaacaaggaatactgatcctgaccaacagggtgttcgattcagttccatggaccagcctccatgttttgcaagacctggtcaatcgttccctgcttttcctccactctttggggttcagtcttccagcttgtatttacctgatgacattgaagctaaaatcggtaaccagttcgaatcaaatccttccccgaataatcctacaatggattgggaccctcaggcaatgctgagcaacttatccttccttgagcagaagatcaagcaggtaaaagacatcgtgcagtctatgagtaatcgtgagagccaagttgctggtggttccagcgaggcacaagcaaagcagcagcttgtcactgctgatctcacttgtattataattcagcttatttcaacagctggttccttgcttccttcgatgaagaacccaatcagcagcaacccggcactcagacatctcagtaacacactttgtgctcctatgatcctgggcaccaattgtaacctgcgaccaagcgcaaacgacgaagccacaattcctgacattagcaagacccatgactatgaggagctgatgaatagccttaatactactcaggcagaaagcgatgagatgatgaactgccaaaatccttgtggtggggaagggtcagaaccgattccaatggaagaccatgatgtgaaggagagtgatgatggtggtgagagagagaatctcccccctgggtcttatgtagtattgcaattagagaaggaggagattttagcaccacatactcacttctgcttgatctgtggcaagggttttaaaagagatgctaatcttaggatgcacatgaggggccatggagacgagtacaaaactgctgcagctcttgcgaaaccttcgaaagattctagcttagagtctgcaccagttacaaggtactcgtgcccatatgttggctgcaagcggaacaaagagcacaagaagttccagcctctcaagacaatcctgtgtgtgaagaaccactacaagagaagccactgtgacaagagctacacctgcagccgttgcaacaccaagaagttctcagttatcgcggacttgaagactcatgaaaagcactgtggccgcgacaagtggctatgctcgtgtggaactaccttctcaagaaaagacaagttatttgggcatgttgctcttttccaagggcacacgcctgcactccctatggatgatatcaaagtaacaggagcatcagagcaacctcaaggcagcgaggcgatgaacaccatggtggggagcgctgggtataacttccccggtagctcatcggacgacatcccaaatcttgacatgaagatggctgatgatccacgctatttctcgccattgagctttgatccttgcttcggtgggcttgatgacttcactcgacctggatttgacatctctgagaatcccttctccttcttgccctcaggatcatgcagcttcgggcagcagaacggagacagctgatcgaggccaacgttaacgatgacggcaatggccttgcctacctttgtgtaccttgtctagccctattcttcctctgttgaaggagccattttaggtcattccttcttcctgaagtgtactttattttatgatcatcagtaatgatcaagtactttttatctttccttatagattgagatagcccaatcttggtatatatatgcaagaagcgtttctaattatctgaattggtgccattgttgtagtgcctacaccttgtcataacatgacatcaacatgtacatgacaataaaattctctttctgatg

SEQ ID NO: 6453 - DNA, 1641 bp, Oryza sativa
  Predicted polypeptide sequence is orthologous to G2834
gagcgaagttagaaaaaaaaaaggttgggaaatgaagtccaccacccacctactcgccggcggcggtggcggcggctccgtcgcgccaccaacggctgccacggcgccgacgctggccatggaagtaggggatccctctggcgccctcgtcggcggggccggcggcgccggagccggagggggagacggggatgcccgcgacgcgctcctccggttggttgctctcggcgaccgcatggccgccgtccgccgccgcatcgccgcatctatatccggagaatccgggcccctctcttcctccgacatccactccgtctcctccgagatctcctccgctgcccacctcgtcgtcctcaacgccgcctccctcctctcttccaccgtcgcctccctcccggctccacctccgcctccggctactaccgtccaggagctcccccccgtggtggtctccgtgcctcaggaacccccgcaagaagcagccaagggcgacggcgactacgacgtcgtcgagctcgacgcctccgagcttctcgcggagcacgtccacttctgcgacatctgcggcaaggggttccgccgcgacgccaacctccggatgcacatgcgcgcccacggcgaccgcttcaagaccctggacgcgctctccaggcccggccagccgaagccgcctgccggccgggaggtgcggttctcgtgcccctacgccggctgcaaccggaaccgcgcgcaccgccgcttccggccgctcaagtcggccgtgtgcgcgcgcaaccacttccggcggagccactgccccaagctctacgcctgcgagcgctgcggcggcaagaagcgcttcgccgtcctcgccgacctccggagccacctccgccactgcggcgaggaggcgcagtggcgctgctcctgcggcaccaccttctcccgcaaggacaagctgttcggccatctcgctctcttcgaaggccacacgccggcgatcgccgagccgaacaagggtgtggcgacagcggctgcagaggcatcgatttctatgatggaggaaggaggagttgaagcgaattgtgatcgagaggagggtgaggagggtggttttgatccgaagttcttccaggagtggatggaggagctcagaggtggcgctgttgcccccaattggtctgcgccgtcagaagctggacattagcagtgcagcaagagcaatttgggcctatggtaggaagagatgactgagaagatgaatgaagaagggtcctgtgaagaacagaccttcccccggcttgcctctgtctctctctctctctctcttcccctggtctccccatcttttaccgctcgctgttagcctgttatgcaactctcttttacccatgacaaggatctttataacctggaaagtagtggtatctgtttccgaagcagtcgaaataccaaatgatgaaagatattaaccgttggtacatcgtgttgtatgctcattgtgtatgtcttcatgattcagctttctacggtagtgtagatacaggtttctacacgttacagtagtattaaacacaacatcagcacccaacactgtaacgaacaccatacatgtgagatcttacaattgatcgaggtgaagtcacactgaaggcttctggc

SEQ ID NO: 6454 - DNA, 1444 bp, Oryza sativa
  Predicted polypeptide sequence is orthologous to G2834
catacgtagcatgattccaggcggtggcggcggcggcggcggcggcggaattagcccttacttggtgcagagccagcatgggcatggtggcggcgtcgacggcatggagatggaggagggcggcggcttcatgggcgagcagccacagtgccacccgctgctctacaacctgtccgtgctcaaggacagggtgcagcagctgcacccgctcgttggcctcgccgtcgcccacaacgcccacgcccacggccccctcgacgtctccgccgccgacgccatcatccaggaaatcgtcgccgccgcctcctccatgatgtacgccttccagctgctctgcgacctcggcacggcgccaaccaccgcgccatcacaggagaccgccgccgcctccgccgttgttgtcaagaacaacgaccatgccgccgatgccggtcagatggaggacgaccatctcatgcagcagcagtggcagcagaacggcagccgccagcacgattacagcagccatgcccatgcgccgccggtgttccacagcgaaacggcggcaccggcaggcgcgacgtcggcgacggacacgatcatcgagctggacgcggcggagctgcttgccaagtacacgcactactgccaggtgtgcggcaaggggttcaagcgcgacgccaacctgcggatgcacatgcgcgcgcacggcgacgagtacaagagcaaggcggcgctgtccaatccgaccaagctgctcgccaagggaggcgacgagacgatggcggcggcggcgaggaagtactcgtgcccgcaggagggttgccggtggaacaggaggcacgccaagttccagccgctcaagtcggtgatctgcgcaaagaaccactacaagcgcagccattgccccaagatgtacgtgtgcaaccgctgcggccgcaagcacttctccgtcctctccgacctccgcacccacgagaagcactgcggcgaccaccgctggctctgctcctgcggcacctccttctcccgcaaggacaagcttatcggccatgtctccctcttcgccggccaccagccggtcatgccgctcgacgccccccgcgccggcaagaggcagcgatcgtcctcggcgtccgtcgccgggaacattgacgacaccaccggcattggcatgggcgccgcctgacgaccttactaactaactgtgattgtattgttgccatcacctgctgcatatatatgtccatgaaagattcaatccagtactgcatggctagttaaattagcatgacaatgctaattggaacacacatgttaatttggaaatcgatcagggcagcaatttcaggcagtttatcagttagttctatacattagcttatgagatgtgtgatgaatatatactgtattagctaactagctaggggctttagctttacaatataatactaaggtttattac

SEQ ID NO: 6455 - DNA, 1684 bp, Oryza sativa
  Predicted polypeptide sequence is orthologous to G2834
ggggcgtccatggcgacgagctgggagtgattccccctgcttgatttgattggatttcagaggcgccatctcttttcctaataaagatcacgcgagattattcagaagcttgcaatggatcgcgaccagatgacgaacacgatgcgcgatcaggctgcgaacctgacctccatgaatcctctcttctacccgttcatggcggatgacgctctcctcggcatggcgccgccgccgccgcagcagctgctgccgtcggttagcatccagcacatggactggagcccggacacgatgctggacaacctcaccttcatcgaggagaagatccggcaggtcaaggacgtcatccgatccatggccggccgccgcgcctcgtcgtcgtcggcggcgacgccggagcagcagcttgtcaacgccgacctgacatgcctcatcgtccagctcatctccaccgccggcagcctcctcccgtcgctcaagaactcctcgttcctcagccgcaccaccccgccgcccgccgccgcggccggagccgcacaagcggtcagcctcgccgccggcgagagctccagctcggctcgtaataacgagacgaacagggaagatgaggaggagcagatgggtagccccgactacgacgagctcttcaaggtatggactaacggcggcgccatggacgaatgcgtcggcgctgccggcgacgagcaggatgcgagggagaatccggcggcggcggcggaggaggagaagtacgaggtgctgcagctggaggaggacgagatcctggcgccgcacacgcacttctgcggcatctgcggcaaggggttcaagcgcgacgcgaacctgcggatgcacatgcgcgggcacggcgacgagtacaagagcgcggcggcgctggcgaagccgccgccgcccgccggagggggaggagcagccgccgcagccggagaggaggtactcgtgcccgcacgccgggtgcaagcggaaccggatgcacgcgagcttccagccgctgaagacgatcctgtgcgtgaagaaccactacaagcggagccactgcgagaagcgccatgtctgcggccgctgcggcgccaagcgcttctccgtcatggccgacctcaagacccacgagaagcactgcggccgcgaccgctggctctgctcctgcggcaccagcttctcccgcaaggacaagctcttcgcccacgtcgccctcttccagggccacgcccccgctctcccccctcccccgccgccgccgacgtcgggtcgccgccgccacaagcaggaggagccggagttcacgtggggcggcggcggcggcaatgagtttcttgacgtcaaagggatcgccggcgtcgggtccggctccggtggtggggatgagttcttctccgcgggaagcttcggcgccatggatttcggattcgggcagttggatgcttcgctcgcgatgctgctgccatccgagcaattcgcgggtgatcatcaggaggagaatggtgacaagtgaaggtgcacatgatgcgtagcgagttgcatatgatcatatatatatatatatatatatatatatgacgtatgtatttcatggtgtaatagcattgtgttatctaaagtggaagaagttgttcttcccatcttgtaccatcttatatgcacttctttattaagatagttatgc

SEQ ID NO: 6456 - DNA, 1459 bp, Oryza sativa
  Predicted polypeptide sequence is orthologous to G2834
gacctctctcctcttcctttctctcaccgagcagggcaaccgacgggtgtggggaggagaccggtgggggaggcgggagacgggactccggcggtcggcgacgggcgacgaggcggcggcggcgacgacgcgggagcaggagggcctccccccacgccgccgccggcggaggaacgcagtgagctgccttaggtgggctctccggaggaagtcggcggcggtgtgacggcacatgcggcgaaggacaagacctccggcacggcgtaggcggcgagggacaaggccgccgagagcaaggaccagactagcggcttcctcggcgagaagaccgagaaggccaagcagaaggccaccgagaccgacgagacggcgcggtggagggttctgcatcggctccctgcacctgtcccaatttccatgccggctgccttttgttatattctaatcatcgtttttgtttatcaaatcaatttttgaacacaaccttttttactgaaggatgatgaaacaatgcacaagatcgtcttcagtaatcagtagttcagtggctggaagtttgcgtgcagcctgttgcgcttgcacccagtgaacgtgcacgagtaccgccgctccagctgctgcttgtccttaccaccgccgccggcggctttgtcagcatgggcacgctcttgtacttgtcactgtgtctacgcatgtgcatctgtaggttcgcgtcccgcttgagccacttgacgcagatggatcagaagcgcgtgtgctgcatcaggatttcatcctcctccgccggcgccgccaagcagaagaccaccgagacggcgtagtacaccaaggaatccgccgtcgctggcaaggacaagaccggtagcgtcctccaacaagcgagtgagcaggtgaagagcacggtggtcggcgccaaggacgcggtgatgaacacgctgggatgaccggagacaaggccgtcagcctatggcggcagcagcagtggctcacatcgacggcacacccaaggggatccgcggatggacgacggcggcaacgcgtcaccatcgtcctcgctctccagcgtcggcgcggcttgccctccagcgtcgcagcttccgccatcgccgcctcgtcgcccgctgcctcctcctctcccgcctcgccccgacgacctctccccacccgccgggcggcttgccgcttgcagttgcagagaaggagaaaagtgagagagagagagagaggagggatggagaggaaatggaagagagagggtgctgacgtggcatcctgacatgtgggttccacgctgagtcagccgtcacgtcggacaaaaccgtagtcaaaaccaccgatggatctaatttgcactggttttgtaagttggaggatgcgttgtatccagttttgtggttggaggacgattttgtaattcgatgacaagttaagggatcttcggggtactttttccttttgc

SEQ ID NO: 6457 - DNA, 1116 bp, Oryza sativa
  Predicted polypeptide sequence is orthologous to G2834
atgaatccacaggagttccaattcttccagggggtggagcaagagatgctcttgctatcccatggcggtggcggcgcggcggcggctgcctcggacgacgtgctcgcctaccatgtcggggtgctaagggacaaggtgcagcagctggagccgctggtcggcatggtcgtcgtctcccccgccgcgccgcacggccagctccggcgcgacgcggcggcgatggcggcgtcgagcgcctgctccgtcctgcaggagataactgccgccgcctccgccgtggcgcaccggctggagcaggccaacgccgcctcctccgcctccttcaggcgaggagtggctttcgccgacgacgcacacgccgccggtggcgtgcagatgttcgcggcgggcgcgcacggcggcggccaaggcggtgatgacgaagccggcgcctcgctgttccaccaccacgggccgccggccgtcggcgcgcccaccgtgttccgcgccggcgccacgacgacggcggccgcgtcgagcagcggcggcggagacgacgacggcgacggcgacggcgaggtggacgtggtggagctggaggcgtcgtacctgctggcgaggtacacgcactactgccaggtgtgcgggaaggggttcaagcgcgacgccaacctgcggatgcacatgcgcgcgcacggcgacgagtacaagacggcggcggcgctgacgagcaccggcgccggcatgagggcggcggcgaggcggtgcagctactcgtgccccgcggaggggtgccggtggaacaggcggcacccgcggttccaggcgctgaagtcggtggtgtgcgcgaagaaccattaccggcggagccactgcccgaagatgtacgtgtgcgggcggtgcggcggcaagcagttcgccgtgctctccgacctccgcacccacgagaagcactgcggcgagctccgatggctctgctcctgcggcaccttcttctcccgcaaggacaagctcatgggccacgtcgccctcttcgccgccggccacgcccccgtgcccgtcgcgccggaggcgtcgccgtcgacgacgaccaccggcaccacgacggacagatcacgtacgggattgattgattaa

SEQ ID NO: 6458 - DNA, 1158 bp, Oryza sativa
  Predicted polypeptide sequence is orthologous to G2834
atgatgatgagtagtagtgccgatcatttcagcaacaataataataatcaggcgatgtacttggagcaagatgaagatttctcccagatgatcatggagctgtgtgattttgatgcgagtagcacgacgcaagctcgccatggcggcgaagcagcagcagcagcagctgggaacgcgagggcggtgctgacgtacctgacatttctggagcagaagatcggccacctccgcggcataatctcgtcgacgccgaacccgccgccgcagatcgtcgccgccgagctcagctgcatcgtcgtgcagctcgtctccatctccaagaacctcgccgcggcgcgccgcggcggcgacgacgcggacgcggacgccaagcacgacggcagcagcgacgccgacgagggcgccgatggcgacggcgagcgcgccccgccgcggggctcctacgaggtggtccagatcgagaaggaggagatcctggcgccgcacgtccacttctgcggcgtgtgcggcaagggcttcaagcgcgacgccaacctgcggatgcacatgcgcggacacggcgaggagtacaagtcggcggccgcgctggccaagcccggcggttcgccgtcgcgttcgccggcggcggcggacgcggcggcgaggaggcgcttctactcctgcccgtacgtggggtgcaagaggaacagggagcacaagagcttccagccgctcaagacgcccacctgcgtcaagaaccattaccggcggagccactgcgacaagagcttcacctgccgccgctgcaacgtcaagaggttctccgtcgtcgccgacctccgcacccacgagaagcactgcggccgcgaccgctgggtctgctcctgcggcacctccttctcccgcaaggacaagctcttcgcccacgtcgccatcttcgacggccactcgccggcgctgccgcccgaggactacgacgacgacgccgcctccggtcagctgccgcacgccgccggcgaggcagtgggcagaacggtggacacgaaccgcttcttctccgatggattgatgatcaaaggcagcatggaggatgagcgaggaagcctctcgccgatggggctcgattactgtgaattcgatggaattgatctctttgcagcagcagcattcgatttttga

SEQ ID NO: 6459 - DNA, 376 bp, Oryza sativa
  misc_feature (84)..(84): n is a, c, g, or t
  misc_feature (358)..(358): n is a, c, g, or t
  Predicted polypeptide sequence is orthologous to G2846
gggcggagaagggggaggtggtcggcggtgggctggatccggagctcagcgtcgccaggatctacctcgggagaattgtgagtncacgaagctgtgtaattctgttggtgtatcttagaggccgcgattttgttaggggttttgggggtggagctgcaatgcgtggtgtttttaccacggaatctgtcgatttgtattagtttataaaatatggattagtagctgctttttttttggatcgtagctagtgtagtatctagttaacggttctggcatttatcggggttttagtatggtgggcgttttattattttgtaatttttcttcccgggttcttaaattggagtcctttgatgtnaaaaaaaaaaaaaaaaaa

SEQ ID NO: 6460 - DNA, 1616 bp, Oryza sativa
  Predicted polypeptide sequence is orthologous to G2846
cctccacattccaatcctcagctccgaacccatgcgatgcgtctgcacgccggcgcagtgcaactccagtatttcatgccccagcagggagccaccgccgccgccgccgccgaccaccaccaggccgactcggctaccgcgtgcagcgcctccacttcgccggccgccgccgccgccaccatgtgggagtatcatcaccagctgtcgacgcacgcggccttgcagccctcgtcctcttttccctacagttactggagcccctactccgggtcgacggcgctcgccggctcggccttcgccgccgactcctcctcgtcgtcgaccgacgtcatgcgtctcccggctgccggcgagcacgcccacggacacggctggagccacggcgaactaagcaacagcaccaccggcggcggctacagggagaacttcctcgatctgctcgcgtcgaagaacgtgacgccggaaatgttcgaggaagtccccgcctccgagcactacaatgtcgcacccgcggggacgaccctgacgacgacggcacggtcgttcgatcatcatgctcgctccgacgtctcgccgatcaagtacgagatcgccggctcgccgctgtacttgggtggcactaacaccgtcctccaggtccaggacatgaccatgatgagtagcacgccagcatgctacggcgaacaccaccaccaccaccatcatcagctgacgaaggaaggcagctgcaaccatcagcagcaggagcagcacgagcttgcgattagccccatggcctcatttctgcagcaaataagctccggcagtgctagcgttggcgtgcacaacagtagcctggattattcaggcttaggagatcagcctgacaagatttgctgccaggacggccgggaaatggaggctagtccttttggcatgaggagcttgccggatcttgggtcattcgccggctacacgccggccatcgagtcgacgtcggtgcaaccgtacatgagatgcgccaattcgtctgacagcaatcgacaagaacaggagactgtcccggcaaggagtagtagcagcggcagtggagcggcggcgactgatcgtaagaagaggaagtcagaggaaaggcaggaaagcactgtcaagaagtccaagcaagaggcttccaaagcatcacctcctaagcaaccagtgcctaaagtaaagctaggggagaagatcacagcacttcagcaaatcgtttcgccgtttgggaagacggatacagcatcggtactgtttgaaacgatcaagtatatcaagtttctgcacgaacaagtacagttgctaagtgagccgtacacgaactccagcaggagcaacaagcagggtaacagcgttccatggggagatcaagcagaagcgagcaagggagagacgatggagcatgacctgaggaatagggggctttgcttggtgcctgtctcgtggacgcccgaagtgtaccgggatggcaacgcgatggactactggacgccggcgtaccggggctgcctgtaccggtgacatctaactgaaatgcaatttgtttggagagctgaagattctaagacagctaatgagtattcagatagtgagattccagagaaact

SEQ ID NO: 6461 - DNA, 1948 bp, Oryza sativa
  Predicted polypeptide sequence is orthologous to G2846
gacttctcctcagctcgctttccccttcaccactgcaacttgctcatcacccacacaccaagcaagcactcactctctcttgctagctctctccaccacaagaagaaactagctagccaagaaacggaggatcgatcgaggttcaggatagagattattacatcgtcgtggtcgtcgatcatgggggatcatcagatgatgcacgcagctccggcggcgatgtacaacggcggcggtggtacgacgagctctcatggcgtgtggtggagcaacgcggtgggggtaccggcggcggcgacgtgctcgacgacgacggagctcgccgggtacaccgcctggtcgtcggctctggccgctggatacgatggcatggtagctgacaacggcggcaagcaggcgaagagcaccaccacggcgtcgtcggagtcgcccggcaacaacagctcggtgaccttccaagagccggcgagcatccccgacccggccgccgtcgccgccgtgccgcagccggggctcgccggcttcaccgactggacccagcctttcatgaacaacggtgctggtctgcatgagtttctgcaagatggccaccatgacatgagcgcgtcgagcttgatgaatcactcatcaaataacctagcactgcagcaagcaggtcaccaccacgagctgctgtccagcttcggctcagacctgctcttgtcgccgacgtcgccgtacggcggattccagtcctcgctgctgaggagcctcatggagccgacggcgaagcagcagcagcagcagccggctttggctggactccagcagtatcatcagtaccagcagcagatgggacacgcaccagcagctgctgccaagttcgcgcaggcagttggggccagggattcactccagttcaccaacgacgcgccgttctggaacccttctgccggattcggcatgccggcggctgtggcggtggcggcggcggcggcgcaagatcaagctagcgttcgctctgccaaacgctcgtcgccggcgccgccgcgtgcggcagcaacccttgcattaaagactgctatggaaggagtaggggactctagctcagtgatcaccaagaaggagacagcgttcaagaaaccgagactcgagacaccgtcgccattgccgaccttcaaggttaggaaggagaagctaggggacaggatcacagcgctccaacaactagtctctccttttggaaagacggataccgcatcggtgctccatgagaccatcgagtacatcaagttcctgcacgaccaagttggtgctcttagtgctccatacttgaagaacggtgcccatcaagtgccccacttgaagaactcaagtcctgacaagtccgagcacggcgagatatcactgaagggccgggggctttgtctggtgccgatatcgagcacgttcgccgttgccagcgaggtgcccgtcgagctgtggactccatttggtgccaactttattaggtagaagaacaagtcctggaactgaagaacactgatcagaagcgtcaaattaacgatcgagtagctagctgctaatatagtcgcctagctagcacaaatcgagatctgatgtttcttgattgtatctacgtactagttgtatgatgataatttcgtaaccctagtagtactgatgctgtggctgtaatcagcaaagcactgagctagttagctagatgaacctttggaatgagtgcttgaagacttggattcattcttcaggttcatcacagaataaggaatcggctagttgagaggggacagaattatgtactgatcatcatcaggttcttatgattggttgctaggttgcatcgtatcaatgagtagttgcggaagaatttgttatagaattgatggttcgattcaatggtggatcaattaagtaatgtagcaggtttctctctgttgattgtacc

SEQ ID NO: 6462 - DNA, 167 bp, Oryza sativa
  Predicted polypeptide sequence is orthologous to G2850
aggaagtttatattgtttttgttgttgatgctgctcacagcttgtcatgttcataaaatgcttaatattattattattattattatacatagatgatgtattgtttttgaccataagaccaggctgattaccaaataatacgtgtattaattaaaaaaaaaaaaaaa

SEQ ID NO: 6463 - DNA, 1506 bp, Oryza sativa
  Predicted polypeptide sequence is orthologous to G2850
caatgtgtgcgtgtgtggcctatcttttcttactctcttggaaggaacatcaaataaaaagatcatcatcattataaaccttttagtatcatcatcatgatggcctcctcctcttcctcctccagcctctgtgataatcatctcttgcaagatgacctgatcccatggccttccatgccctttgctcctgctcccaacacctttggattgaaccaccaatggagccagcctccaatgctaagcagcagtactgatcagttaagctcatatgagcttgaatcactccaatcagttgaaagtcagctggcagctgctgctcctccgacattaagcccccatctgcaggctcatcaactcagcacggtgctaatgatgcaggagctagggttccaatggagcagctgcgctgcgccagcagatcaacatagtattgcaagctccacgaataataatagtaatgtgatgatgaacgaggaggagctacggccacgtcctgatcaatccctaatcagcaatccaaggtcatgcagcgccaccacgcttcttcctccgccgcatctacatctggacggcgctgtgctcccgagcatcaacgtctcgcggctgcagaagctggccgccggcgatgagccgctgcagatatgttgcaagaggcaggctgctgctgctgcagtggtcggccatagcagcataagagatgagcatgtgccctgcccctatgctggccctcctgctcatctaattcaaggaccatccaacaccctgcagatgaagaggaatacgaatgcagcagctcaagggagaggtggccgccatgggagttcaacggagcacagatcatcaacagcgctgccgccatcgtcaaagaagccccggctcgagtcacactcctcctcaatgcttccttcattcaaggtaaggaaagagaaactaggggatagaattgccgcccttcagcaactggtctcaccctttggtaagactgataccgcatcggtactcatggaggccatcggttacatcaaatctcttcaggaccaagttgagactttgagcggtccatacctgagatcatccaagaacagcaagaaattagcctgcagggcagcacaacaacaacggaaggggacgtcaaatggaggggacgcagcagcaaagcttgacctccgaagtagaggactctgcctggtgcccctgtcgtgcacctcctacgtcaccaacgagaatggggtttggcctccacccaatttcagaggaaactgaactaatctatcacagattcatactactagctaggagtactatacaacaatgtcagctcatctagctagctagctacagcagatccaacacacaaagttgtactactcatcaaactgagcaacattactggactcggctggaggatctcagtatccgattcctctgcttttgtctggtgtgtatgtctcctctttgttaagaatttggtctttgctcaggcacacatcatatactacagcagtc

SEQ ID NO: 6464 - DNA, 644 bp, Oryza sativa
  Predicted polypeptide sequence is orthologous to G2850
tccaagaggctcaagacagcaactacggcgacgacacaacctccaaggcatggggtgaagtgccatgcaaagccaagaaatcaaactacgaaggcaacatgtaagaagaggagccagaaactgggcgacagaatcacagctctgcagcagttagtttcaccttacggcaagacagacaccgcatcggtgctccacgaagcagccgcctgcatacggcaactccaccaacaaatccagattctgacagcgccttaccctggaacaagctcctcctctgcatcgtcgcagcagcaggatgccggaggaggaggaggcacggcgacggagcttcgccggcgaggcctgtgcgtggcggcgctgtcgccggccgtcgtgagcctcgcggcagagggcggtcgccgccgcacggacgtcgaggatcagaagaggatctggttcagtaatcagtagctgcaactgtaaattaaacgagacgtggcagctcgtttgaacttactctaatcggagttacgggaatactactagtttggatgtttgattagcagtcacgcgtccacgaagttacggggctgtttggttcccagccacactttaccattacttgccaataaaagttgccacaccttgcctaaggtgaggtgatc

SEQ ID NO: 6465 - DNA, 2109 bp, Oryza sativa
  Predicted polypeptide sequence is orthologous to G2851
gaggccctatgctttttcttcttcttcttcttcttctccatctctcctctcctgtttctttcttctctccttgttgttgcagctgtcctctctctctcctcaaagagaaaattaagccactggcccctttaagattgacctgagatttccagtacacaagttgtgtgcatgcaaagagaggccaaagctaagctagcaaaacacacattcctttcccacagctagcttagcttgaagcaagcaagaactcatcatctttgtttctacatatcctttaatactctcctctctgtcactagcagtgatgaatagaggagaattccagagctccctggtgcagcagatgatctggagcggcagtagtacaggcacggctaccggcgtcggcagcggcggcggcgccggcagtttgatgggcagcttgaagccatgccatgaggatcaagaggcctctcctaacatgccctccttgtcttctccatcgttgatcttctcgcagcagtttcagcacagctctccaggtctagttccgatgaacggcaccgccggcgccgccgcttctcttccgagcttgcacgacggcggcggcggcggccatgagagcagcatgccggagtcatggagccaactgcttcttgggggattagctggagatcaggagaggtacagcgccactgcggctctcctgtcaaagggattagagaattggggagatcacgctgctgcagctgcagccagtgcatgcatggttggtggcatgaaggaggagggctccatggctcaagctgcagccactgctgctgctgctgcttacagcttctatgggagccaccttgctggtgatcatcagcatgagatccaagcagcagcagcaggaggaggtgctagcaacaagtctcagctgagccagatgctcatggcttcctctcctaggtcatgcatcaccaccagcctcggcagcaacatgctcgacttctccaacaccgcggcgccgccggagctccggagccaccaccacaactccgataattcatcagagtgtaacagcacagcgactggttcggccctcaagaaggctagggttcaggcctcctcttcagcacaatctactctaaaggtgaggaaggagaggctaggggatagaataactgcacttcatcagattgtatccccattggcaagactgacacagcgtctgtactgcaagagaccattggctatatcagattcctcctgagtcaaattgaggctctgagctacccttacatgggcgacgccaacgggaccggtcctatgcaaaatggaccagttggagaaaggaaccctggcctcttcccggaataccctggccagttgctaaaccataatggcaacactggagcacagcagcctgcagcccaacctgagcagcagggagcaaacgacgatggaaagaaggacctgaggagccgggggctgtgcctcgttccagtgtcgtgcacgtcgcactttggaggggacaatgccgctgactactgggccccggcgccgctcggcgggatcctacggtagaatgcatcgttgagattcgtgcatacaaagcgtggcggcacagcgagtactatatgttgatgcatgaggaggctacagacgaaataggtctcttaagaatggagaacagagtgtgcattgggtgcaggagtaacgtcgtcataacatcatgagcagtcattctctggtaagaaaaaaaattacctgtaaggttgattgctcttgatgctatgggagtgagaggtagctagctatagtataattaattaagcttctgggtctgcaaattaagaagcttcagttcaagaaggagaccttgcaaaagttgatgccccctttgatatgtatatgtaaaatctagcaagtcagtgaacactttgctcatactaccgtgctttgatttatcatcagaagcagaaaagcttgcgcggtagtgtcaatattccgtcagttgctcggctggtgtatgtaggaaattaaagttgatatcccatatcacatatatgtatattgacagttaatttgtatcagttatttactgagttaagtcagcaatattatttgtcttcgatgttgctg

SEQ ID NO: 6466 - DNA, 1762 bp, Oryza sativa
  Predicted polypeptide sequence is orthologous to G2851
gatatcagcatatcaagggagagggaatatggataggggagtcctccacaaatcatcagctctagtgggggagatgggggaaggccatggatggtggagtgtgaataatttgaggcccccctttgttgagcagcttcacaatccggcttctcttctcttgccatcctccaccaccacctccactactccctcctcctcctcctctcccctccattccttctcctccctgctgctctcgaatcactatcctcttccttctactgcgacgacaagcaccgccgccgcgccttggcacgacaccggcagccgccacggccaacatctccaggactcatggaaccatatcttacttggtggattggctagtggtgaagaggggtacaacaagaactgggaaggccaggtgctgttcccaactacaccagctgcagctgctgcagaagctgatcatgggagcaacagctacaacaacatctacagcaccaccacgactagccatgggagcagcacgagtgatgatgcttcccaattggcagtggctgcaaggccgtcgtcttctccatggggtggcatccatggccatcacccccaccacaacgccttgcagcagcaagcttcctcccctaggtcttcttgcatcacctctaccacctcccttggaagcaacggcgtgctggagttctcaaacaacacttcaccacgtgagtgcatcagcacagcatctggagcagctttcaagaaggccaggacccaagaaccctctccggctcaagctacagttaaggtgaggaaggagaagctaggtgatagaataactgcccttcaccagcttgtctccccatttgggaagactgacactgcgtctgtactccttgaagccattgggtacatcagattcctacacggtcaaattgaggctctgagctcgccgtaccttggcaatggcggcagcagcagcaatggtggaggtggtggtggaggtggctccaacagcaagctccagcatcagccagaagccagcagggtgcaaggagaaaggaacagcatatttccagaagaccctggccagctcctacatgacaatgccgtgaaaaagagaggacagcctgatcaagatgaaagctgtgaggaagcgaagacgatggatctgaggagcaggggcctgtgcctggttccggtgagctgcacggtggacgtcggcgtcgacgccggcccggcggactactgggcggcgccgccggctttcggcatagggttcggccgctagatcgatgcatggtccggtgatctctgtgggcgccatggccaatgaaatggctggctcggctggctaattaagctagctgaagaatcaatggaaatatagagatcatatcttacatattacatcacatgcatgcatgcttgcatttgggttaattagctgcataacatcaggagcagccatcctgctgaaaaggctggttcctcttgatgctatgcacgtgtatgctcatggtttgatgggtgcaacaacagagtatataactggtagtgtgtgtgtgtgtgtgtgtggctcttgtctagctagagattgatctctttgggtggattaatggattattatgcactggaagaatgaagaagggttaagttgtagacagctgccagagcgcacctatgcttgctatagcttggtgttgatcatcaaacatcagtaacacccttgtaatttaagtcttttatcttggtgaatgcatgcatgtcaccttgcttgttcacg

SEQ ID NO: 6467 - DNA, 1767 bp, Oryza sativa
  Predicted polypeptide sequence is orthologous to G2851
gaaaaggagctatgaaagaaagctctaaaaaaaggccatgagagaccttaaagattgacctgagatttgcacaggaaatttgcaacaacaacaacacaacgagatatatcaccttgatatatatatctgttgcaattgcaagaaaaattcttttctccccttgcaattattctgtgctcatctcaatcaagctagcatgctgagtagtggaggggagttgaagagctcctccttggtgcagcagatggtgtgggttggcacgggcaacagcagcagcagcagcatcatgggcagcttgaggcagctgccttgttctgaggagcaagatgcagcttcgtctccagcctccatgctcttcctcccccagcagctgctgcttcatgcatcttctaattcatcgccatgtctgaacattcctgaggtgaatctcagcactggtcttcatcctcttgggagcttccatggcgatgtgcagcagcaggagatcatcagcggcatgccagatcagtcatggagacaactgcttcttggtggattagttggagatcacgagaaatacagtgtggccacagctctcctgtccaaagggctagatgatgaggcctctatgcctcacgaggcatcagctgctgcttatgatttctatggacatggcggcggcgccggcgatgggatcctgcaggcatcgccggaggccagcagctgcaagtcgcagctgagccagatgctcctgcaggcggcggcatcctctcctaggtcatgcgtcaccaccagcggcctcggcagcagcatgatggatttctccaacaccgcggcggtggcgccggcggcggagccggagttgacgaggaaacaccatgcaggccagtcagataactcgtcggagtgtaacagcacagagacaggttcagctcttaagaaggctagggttcaagcctcttcttcagcgcaatctaccctaaaggtcaggaaggagaggcttggggacagaataacagctcttcaccagatagtttccccatttggcaagactgacactgcatccgtactgcaagagaccattggttacattagattcctcctgggtcaaattgaggctctcagctacccatacttggggcaatgctgctctgcgaaccccatgcaacagcaaactggaataatggcaggagaaaggagcactgatggcctcttcccggagttcccagctggccaggatgcagaaaaggatggaaagaagcaacaggcgaagaaggacgacgacctgaggagcagagggctgtgcctggtcccggtctcgtgcatgccccacctggccgccgacaacgacgtcgtcgtcggctccgacttctgggccgccgccggcggcggcggcggcggcggcgcgccgcccctcgccggcatgaacctgcggtaggccggccgggcctactgctacacgttcatcttcgatcatatgcacagacgacgacgacgacgcatcggtgaagttttggccaaattaatgcatccacgcacgtactattattttggttttgtttggtttcgtgtgattttaaacgatgattattttctccttatggcgtttatagggcttaattaattagctgtcgatcgattatcgaaatatacataccatcaggagcagtcaatctgtcatgattaaggctgattgctcttgatgctatgcaaagtatatatatgctcataaatatgtactattgcacacactttgctacgtatataatatacatttccttgctgttc

SEQ ID NO: 6468 - DNA, 802 bp, Oryza sativa
  misc_feature (560)..(560): n is a, c, g, or t
  misc_feature (600)..(600): n is a, c, g, or t
  misc_feature (691)..(691): n is a, c, g, or t
  misc_feature (793)..(794): n is a, c, g, or t
  misc_feature (796)..(800): n is a, c, g, or t
  misc_feature (802)..(802): n is a, c, g, or t
  Predicted polypeptide sequence is orthologous to G2854
gcacgaggggggccggggacgcgacgcgcgatgcagcagcctccgccgccgacgatgaacggcggccaccacgcggcccctcctccgccgcaggtctccggggcgcccccgccgccgcatggccactaccagcagcagccgccgcctcagccgtactaccagcagcagcagccgctgccgccgcactactaccaggcggggcccccgcacgcgcctccgccgcagcagccgccggcgatgtggggccagccgccgccgccgccgccgcagtacgcgccacctccgccccagcagttccagctcccgcaccagcagtacgcgcctccccctcagcattacgcgccgccgccgccgcagcagcagtacggggcgcagatggctggcgggcccgctccgggaggcgacgagatcaggtcgctgtggatcggggatctccagtactggatggatgagagctacctctccaacgcttttgcccccatgggacagcaggttacctctgtgaaagtcatccgcaacaagcagagtgggcactctgagggttatggttttattgaatntcagtctcacggctgctgcagaatatgctctggctaactntaatgggaggatgatgcttaatgttgaccaacttttcaagctaaactgggcttttagtggtgctggggaaaggcgtgctgctgatgatggncctgagcacacaatatttgagggggatttagcttctgatgttagagacttcatgttgggaaaaggcattaaaacaggtatccttcagttagaagggcaaagnngnnnnngn

SEQ ID NO: 6469 - DNA, 1710 bp, Oryza sativa
  Predicted polypeptide sequence is orthologous to G2854
gtattggacggctgggacaaccttaggggcatctctccacgattttatctcatccgtttggccctgctgctgctgtgctgccccttctctagggttttgactcctaaaccgccgcccccgtcctcccgcgccgccatgatgcagccgccgccgccgccgcagtgggcaatggggccgccgcctcctccgcagtacttccaggctggccctccgccgccgccgccacagtacttccagggggcgcatccacccgctgccatgtggggccagcccccgccgccgcaggctgcccctccgccggcgccggctggtggcgcagcaggggacgaggtgaggaccctgtggatcggcgacctccagttctggatggaagagaactacctgtacaactgcttctcccaggccggcgagcttatctcagcaaagataattcggaacaagcaaactgggcaacctgagggttatggtttcattgaatttggcagccatgctatagccgaacaagttctgcaaggctataatggtcaaatgatgcctaatggtaatcaggttttcaaattaaattgggcgacaagtggtgctggcgagaagcgtggagatgatggctcagattatactatatttgttggggatctcgcctcggatgttacagatttaattcttcaagatacattcaaggcccattaccaatcagttaagggtgcaaaagttgtctttgacagaagtactggtcgttcaaaaggctatggatttgttaagtttggagatttggatgaacagacacgtgcaatgactgaaatgaatggacaatattgttctagcaggcctatgcgtattggaccagcatccaacaagaaaaatataggtggccaacaacaaccaagtgctacataccagaatacacaaggaacagattctgatagcgatccaaacaatactactgtatttgttggtggtcttgatccaagtgtgactgatgaggttctgaaacaagccttcagtccatatggagaacttgtctacgtcaaaatacctgtaggaaagcgttgtggatttgttcaatattccaatagggcttcagctgaggaggccataaggatgctaaatggaagccaattaggaggtcagagcataaggctttcatggggtcgtagccctggaaacaagcagcctcagcaagaccagaaccaatggaatgctggctattatggatatcccccccaaggatatgatccatatggttatgttcggccgcctcaagatcctgccatgtacgcttatgcagcatatcctggatacgggaattatcaacaaccagcgccacagcagccccctcaacagtaagaacaagtgttggtcaagtgccctatcacaacatatgatgaaatagttttggcaactttggtgtaattggcatgaaaattttttgaactgttgcttgtgctatctttgttgaacgtcgtgtgcacgcccagcctatgttgtaacatgacattttactgaggcctaggtgacactagaatgacagcttttagggagggagtattggagtgaacatttttcgcttgctcaaaaagttttgtcgccatgggtaccattagaagaggagttgagcaagaaataataagtttgtaacattagacatcggcgtacattttaatcgggcactttggtattattgcactggagccgttttctgtttgcgtccct

SEQ ID NO: 6470 - DNA, 630 bp, Oryza sativa
  Predicted polypeptide sequence is orthologous to G2854
ggccggccccgaacccccgcgcggcgagccgatcgcgccgccgatgatgatgccggcggcgcagggcgtcgccgtgccgtccatctggccggcgcccgccggctccctctcgtgctacagctacaacccagcagcctacgaccagtcgtcatattacggcggcggcggctacggctacggcggcggcgcgttccaggcgcccgccgggtactacggcgtggcaccgccgccggcggcgccctacgaccaccagggatggtactacggcaaccggcagccgtactaccaccagcagcaatgctacgaggaccccaacgccggcgggtgcagcgtcatgtgatggccatctcgccatcgccatcgccatggacgacgggagcaatcagtgcgtgtgatcactctcgctcacactcactcatcactagctcatggccagtggtaaaaaaaaagaagaagaaaatatttcttttttttttgggtgtcgccttcttcttgtttattatgcctgtgcctttttttgtttatttagggtgttgagttgtgcatgtgaacagttgagttgtgatgttcttggtgtctagttggatcttcttccctttatgactatctgataatgacaatgagaaccat

SEQ ID NO: 6471 - DNA, 410 bp, Oryza sativa
  Predicted polypeptide sequence is orthologous to G2859
tcacctttaaggagcagtatcctgttcttaaccccctttggtagcttgcatccttgatccaacagcatgtccagcttggtaatgaggcatcccatagtgcctagggatgaactgattgcctgtattactctgtttttgcctccaaattgtgtaacatccaaagatgtggagttaattggcgttattgcatatacctgtaaatgcaaaagggaaaccatgtgaaagggaaatggatgaacacccacaagcaaatggaggcatgaaaatttggtgatggtgtttgtgaaaagcataacatcgtttatccatctatttttcttttcatcttttggggaaactaggtatgatagtttaattgtggatcagacatgagacttgatgaattaagggatggtaatgggattattgtt

SEQ ID NO: 6472 - DNA, 592 bp, Oryza sativa
  Predicted polypeptide sequence is orthologous to G2865
tgcgacgatacaccagtgacgtcacgcatgcgcagttcattcgttgtcccccattccgatccgactttgttgtgctgtgacaggcatttctctttctcaagtccaaccttgttgcgctgtgactgtcgggggtttcgcagaccggtccattaagtgcatctccccccacccattctcttgttgctcattccgtctcagattgaatcggatcagagtaccttttcgtgacgtctcatcacgttcacgctgcatgtgagacatttgtggcagtttggtgctacgattggcattcttcccctccaagttcaccctaacatgcaagttcaatcacaagttcgtcgagtcagaaacaggaacgaagtgcgttgaatgcgggaagtttcaccctattggctatgtgtgcttagatccggagtgacaatttgtgtctgctgcttcccccccttgttccctgccgctttgcagtcatccatgtgtgggattaaacgggagggggccgttcgacgaacgtcatgcgtgaaaaggagaacccggtaggtaagctgcgcttcgcatttctcgttgaagtgcctggctgcgtacagagccaacg

SEQ ID NO: 6473 - DNA, 650 bp, Oryza sativa
  Predicted polypeptide sequence is orthologous to G2888
agcatcgtcgaacaagttgttgtgaattatgtcacccgtttcttggtacatgacactttacaatagcatatcatcaactctccactgccctccgtaatgcactaatgctgtctcaggaaagtccaatgagaagcaaacaacaaaaagattccatgcacgtcacgattagcaagccctgcttagctttccggccggcaagacacaaaaaacactagctagcctagcagcatatgcagcgtctaattacaccacacgatctcgtcgtcttaatttgctggtgaaatggaacgtacaagaagagattcgatcagaggtagaccaagagatggcgcgtttcgcgagctagctgggctggactggattcttctttggctacatgatgcccatgctgttagcgtgctgtaggcgacgccgcgtggcgtcgacgacgtcgaggggatcgtcggcgtcgccgccctcggtgacgacggaggagacgtagctgcaggcgacgtcggagctcatggcggccggtagtggcgcccccgccgccgcggcgcggaacttgtggcggcagctgaagcaggtgatctggagcagcgtggcgttgacctgccgcacggcgtggtcgcggagcgcgtgggcgcggctcaactccacctgcgcctggt

SEQ ID NO: 6474 - DNA, 1263 bp, Oryza sativa
  Predicted polypeptide sequence is orthologous to G2888
atggtgttcgatcatggagcccgtgtgtacgtagacccagatgcggaggtggtggcgctgtcgccgaggacgctgctggagtcggacaggtacgtgtgcgagatctgcgggcaggggttccagcgggagcagaacctgcagatgcaccggcgccggcacaaggtgccgtggcggctggtcaagcgccccgcggcggcgacggcggcggaggacggcggcgccgcgggtggcggcggcggcgccggcggcggcgcgggcggcggaggggcgcggaagcgcgtgttcgtgtgcccggagccgagctgcctccaccacgacccggcacacgcgctgggcgacctcgtcggcatcaagaagcacttccggcgcaagcacggcggccggcggcagtgggtgtgtgcccgctgcgccaagggctacgccgtccagtccgactacaaggcccacctcaagacctgcggcacccgcggccactcctgcgactgcggccgcgtcttctcccgaaaaattaccagaagtttaaacctgtatagtgacatagccaattatttaagaatgaagtatataatatctctatcaaatatagcaatcaaagtggagagcttcatagagcaccaggatgcgtgtaactctggacgtgtgcgcggtgaggtcgtgcccgtggccacgacgctgccggtcatccgtcccgcggcgctgcggcatcatcaccatcatccgccgccgccgccgcctgagctgcagctcctcccggcgtccaccacggcgccgttggccgccgcgttctcgtccaactccacgaccaccggctcctcctcccacgagcaacacgcgacgacgatgacaacgacgaagctgcagctctcaatcggccccgccgccgtcgtcgccgcggcgtccggcggcggcggcgcctgcgccgcggcggcaggaggggaggaggagcagcagcgggaagaggtgaggcgcgcgctggaggagaagaccgcggcggacgcggcgcgggagcgggcgcgcgaggaggccgcggcggcggagcgcgcgctggaggacgcccgccgcgcgcgccaccgggcgcgcggggagctcgagaaggcgctcgcgctgcgggaccacgcggcgcgcctgatcgcgcaggtgacctgccacgcgtgccggcagcgctcgctcgccgtgatgtccatggccgccatcgacggccacggcgcgtcggcggtggcgcgcgagcacctgaggggcggcggcgtcggcgccggcatctag

SEQ ID NO: 6475 - DNA, 722 bp, Oryza sativa
  Predicted polypeptide sequence is orthologous to G2898
tactggtggctttcgccgctgcaaacctccgtctcctccggctccggctgctcggggcctaaaccctcgccgcgtgtactaaaaaccccggcggcccaggcggcggagggatgaagacgaggtcgcagacggcgccgaagccgctgaaaacggtgcggctgcctcctgtcaagccgcggcccaagccgccgccgccgcagccgcagccgccgccgtcccggaagaaggggcagcccctcgtcgaccggcgccgccccaagaagccgcccaccgccttcttctacttcatggaggattttcggaaaacttacaaggaagaaaatccaagtgtaaaatcaatgcaagaagtagggaaggcatgtggcgagaaatggaatacaatgacatttgaggaaagagtgaagtattatgatatagcaaccgagaagcgtgcagagtatgagaaggcggtggctgaatttgacaagaaaaaggaaagcggtgaattgtccgaggaatcagattacgactagaggtgaacgtcgggtagttgttccgatggttcacccaagtaattggatggacgaatcaattgtatattacagaactgaggcactgagctttgtaatggaatctatatatagtcagtttcctgctcattctagagtgaactatcgtcttgtgataaagtgatagctttggatcgagtattcgctggtacaccaccagtgcttgaaataact

SEQ ID NO: 6476 - DNA, 501 bp, Oryza sativa
  Predicted polypeptide sequence is orthologous to G2898
atggtcatcgccgctcaccgccaccaaggactgtcatgcaagtcatcgccgctcgccaccatggtcatcaccactctccacagcaaatccagcgagctcgcggcgagatctgataagctcacattcggatccagcggcggagggatgaagacgaggtcgcagacggcgccgaagccgctgaaaacggtgcggctgcctcctgtcaagccgcggcccaagccgccgccgccgcagccgcagccgccgccgtcccggaagaaggggcagcccctcgtcgaccggcgccgccccaagaagccgcccaccgccttcttctacttcatggaggattttcggaaaacttacaaggaagaaaatccaagtgtaaaatcaatgcaagaagaaagagtgaagtattatgatatagcaaccgagaagcgtgcagagtatgagaaggcggtggctgaatttgacaagaaaaaggaaagcggtgaattgtccgaggaatcagattacgactag

SEQ ID NO: 6477 - DNA, 986 bp, Oryza sativa
  Predicted polypeptide sequence is orthologous to G2907
aagaaatatgtggcttaggaggggctgaagattttgcagagtcgagttctgctcaacttgcttacagggattctcaggctgagtcactgaaggattcacttagcgctgttcgtaaatcaacgcaagctgcagccaggatatttcaagcttttagggtggagtcattccacagaaagaaggtggttgaatatggagatgatgattgtggattatcagatgagcgcactctttcacttgtatccattaaaaatgccaaacctggacagaacgacgggtcacattctgctgctgttcgtatccaaaataagtttagaggatggaaaggtagaaaggagtttatgattattcgacagaaaattgtcaagatacaggcccatgtacgaggacatcaagtaaggaaaagctatcggaggatagtctggtctgtaggcattgtggagaaaattatattgaggtggaggagaaagcgaaggggcctgcgtggtttccaaccggtaaaacagcttgaaggtccatcaccgatccaacagcttgaaggtccatcgcagatccaaccagcaaaggaagaggaagaggatgaatatgattacctcaaagatggcaggaagcaagccgaaggcagattacagagagcactagctcgtgtgaaatcgatgactcaatacccagaagcaagagaacagtacagtagaatcgcaaaccgtgttacagaactgcaggagcctcaggcgatgatgattcaggatgatatgcaaagtgatggagctattgctgatggaggcgacttcatggctgaactggaggagctatgcggggatggggacgcaccaatgcccaccattttgtgacattgaggagttttactagatcagttaggctgcgacctctgttctttaccaggctagctgtaaattcttgtgctagatgttcagtgctcaccgttcgactctatatagcgttatacctaataccatgcgacttctatt

SEQ ID NO: 6478 - DNA, 3514 bp, Oryza sativa
  Predicted polypeptide sequence is orthologous to G2907
ggaccccgaaaaatcccccacaaaaaaaagaaaaaaaaaacccaaaccccctcgcgcggaggccgagagagatcccccgctccgctccgatccccaggcgtgcgcgcgtgcggggctcgccgcgcgtcgcatggtggcggcgcggccgccggagcacacgcctcggcctcgataccccccaccacagccatggcggcggcggcggacgcgcggcgcttcgcggtcgtgccgcagctagatattgcgcagatactgaaggaggctcaacaacgatggttgcgtcctgctgaaatttgcgaaatacttaaaaactacaaaagtttccgtattgcaccagaaccaccaaacaggcctcaaagtggctcgcttttcctatttgatcggaaagtattgagatactttaggaaggacggccataattggaggaagaaaaaggatggaaagactgtcaaagaagcacatgaaaggctgaaatctggaagtattgatgtgcttcactgctactatgcacatggagaagagaatgagaacttccaaaggaggacttactggatgttggaagaggattttatgcacattgttcttgtacattatcttgagaccaagggtgggaaatctcgtactaggggcaacaatgacatgcatcaagcagctgttatggatagtccattaagtcaattaccttcacaaactatagatggtgaaagctcacttagtggacagttctctgaatatgaagaggcagaatcagatgtttattcaggaggaaccggataccactctttcactcagatgcagcagcagcaaaatggaattggacctgtgactgatgcttctatgttcagttctcgtgtttctgcttcatccataggtaattatcagggacaacatgctatgggacatacaacaaacttctattctagtagtcaacatgattcacctcttgttctcagtgatccaaaccttgaacttgcaaataatggacatgagtcattgtggaatggggttatgaaacctgatgaagggactgttcaaatgactcatctacaacctcctgttcatcctgagcaaggcatgttcaccacagaaggccaaggggttgaatatttgacattcgatgaagtatattctgatggactcagtctgaaggatataggtgctgcaggtgctgatgtagaaccattctggcagctctctagtgctactgctgatatatctgcaacagagaacagcgtccaacaaaatgatggatctctaggggcagctattggcttcccatttttgaaaactcagtcatccaatctatctgacatcctgaaagacagctttaagaaatctgacagttttacaagatggatgagcaaagagcttcttgatgttgaggattcgcaaattcagtctagctcgggggcatactggaacactgaagaggcagatagtatcatcgaagcatcaagccgtgagccactggatcagttcaccgtggcccctatggttttgcaagaccagctattcagtatagttgatttttcgccaagctggacatatgcaggctcgaagaccaaggttttagttactggtagattcttacatgctaatgaagtcacggagagatgcaagtggtcatgcatgtttggagaagttgaaattcaagcggagatttcagcagatgggactcttcgatgttattctcccccgcataaaccaggcagagtccctttctatgtcacctgttccaacaggttagcctgtagtgaagtacgtgagtttgaatttcgaccaagtgactctcaatacatggatgctcctagcccgcttggtgcaaccaacaaagtttatttccagatacgtcttgacaacctattgtccctggggccagatgtgtaccaagctactataactaaccccagtaaggagatgatcgacttgagcaagaagattagttcactgttggcaaacaatgatgagtggtccaagttacttaaattggctgatgataatgagcctcttagccatgatcagcaggatcagtatgctgaaaacttaattaaggaaaaattgcatgtctggcttctccataaagtaggcgatggtggcaaaggacccagtgtgttagatgatgaggggctgggtgttcttcatcttgcagctgcccttggttatgattgggccataaggccaactgttactgctggtgtgaacataaatttcagagattttcatggatggactgcattacattgggctgcattttgtggcagagaacggactgtagtagcacttattgcactgggagcagctcctggagctttgacagatccacatcctaattaccctgctgaaagcacaccagcagaccttgcatctgctaacggacataagggcatctctggtttcctggcagagtcctctctgacaagtcatcttcaagccctcaatctgaaggaagccaatatgtctgaaatatctggtctacctggtattggagatgtaactgagagaaatgcatctcagcctgcaattggagattccttaggtgctgttcgaaatgccgctcaagctgctgctcgaatatatcaagttttcagggtgcaatccttccagaggaaacaagcggtccaatatgagggtgacaaaggtggcatatcggacgaacacgcactttcactcctgtctatgaagccatccaagtcaggccagcttgatcccctgcatgctgcagcatctcgtatacaaaataaatataggggatggaggggagaaaggaatttcttctcttcagacaacgaattgtgaagatccaggctcatgtgcgaggccaccaggtgaggaagcattatcggaaaatagtttggtctgttgggatagtggagaaagttatattgcgctggaggcgaagaagggctgggttacgtggttttaggcctacagaaggtgcaatagagagcagcagtggtggcacaagtagcaatttggtcaaagataaacctgctggagatgattatgatttcttgcaagaaggacggaagcaaactgaagaaaggctgcagaaagctcttgccagagtgaagtccatggttcaatacccagaagcaagggatcagtaccaaaggattttgaatgttgtttcgaaaatgcaagagtctcagaccgtgcaagaaaagattttagacgaatcaaccgagatggatgaaggtgatttcatgagtgaattcaaggagctgtgggatgatgatacaccactccctggttatttctagtgttctagactaactggtggtgtctctgtaaatctcttctcttcagttctgctgaattgacacctgccgataacccaaactctcaacatagcatgaatagcatgatcttaaaatcttgaatgcttggatttggattcagttgtggtattcttgcttttatgttatagcgttatgtacagtagaatcttattttatcattgaaggagccatgtatatgcagtatgaaactaatgcagaaagttggtggttgtatc

SEQ ID NO: 6479 - DNA, 1654 bp, Oryza sativa
  Predicted polypeptide sequence is orthologous to G2907
gcgtccttatagcaaatggagctgcagcaggtgcattgacagatcctacttctgaatttccttctggaagaactccagccgatttagcctctacgaatggacacaagggaattgccggttttctcgcggaatctgctttgacaagccatctgtcagcacttactttaaaggaatcaaaagatagcaatgcggaagaagcatgcagattaacaattcctgaagatctccctgaaatgaattatggtcagcttgctgtacaggattctcatgctgaatcattaaaggattcattaagtgctgttcgtaaatccgctcaagctgcagctaggatattccaagccttcagggtggaatcattccacagaaagaaggtcgtggaatatggagatgatgattgtggattatctgatgaacacacattttcacttatttctcttcaaaaggtcaaacaagggcaacatgatacacgtttgcattctgctgctgtacgtatccaaaataagttccgaggatggaagggaagaaaggagtttatgatcattcgccagagaattgtgaagttacaggctcatgtgcgaggacatcaagtgaggaaaaactataaaaaagtagtctggtcagtaggtattgtcgagaaagttatattgagatggaggagaaagggacgtggtttgcgtggctttcgacctgagaaacaattagaaggccagacacaaatccagcctgcaaaaacagaggatgaatacgattacttgcaggatggcagaagacaggctgaaggcagactacagagggcactggaccgggtgcgctctatgacacaatacccagaagcaagagaacagtaccgtaggcttacaacttgtgttgctgaaatgcaacagtccagggtatgactaatactactcatctcttaccagatagtcacactattctgggtcatgcattagtgaaggaaaaatgtctaatttaccactgctctatcttgcttttatcattcgttccttttttttttccaataatgacaaactgatatcttcctcagctagacaaccgaaatctgaaaatgcttcatttgctaaagaccattagtaaatcatttgatttccgagcctagttgtttataatcaatcatcttatattcttctctgttaaggcccaatcttctagtgtactctgataaccaggtactacactaacaagcactaattcacagcacggtttttgaaaaataaaatcaaaccgaagaaagacttccattactttcgttagcctttccttttttttttcttttctctttttcaaaacagcctatatatctgtttgaatcttgcttagcctttggtgattttgggcagatgatgcaggacgagatgctaagtgaggcagctggtgctgacggaagtgatttcatgaatggactggaggacttgatatgcagagacgacccccaaatgtctgccatttggtgaagtcgaagttgttacatcagttaggctgatcattgccttgttcattgccatattagccttgtaaattcttccgcttgtatttcactcactgcttaatatctagctcatgctgttagtattatgtaactctgtgcactgatcataatagaatatttctctcctgtatgttacaggtaggttat

SEQ ID NO: 6480 - DNA, 3600 bp, Oryza sativa
  Predicted polypeptide sequence is orthologous to G2907
ggtcgtgtccaattgttctccctctcgcctcgcccccccaagcaacaccgccacctaccgtctctcgcgtcgaacccccgcacaaaaccccccgcgaaatctcgccccggatcgccggggaaagggaggtggtgggagcccgctcgcgatccgggaggaggaggaggagcggtgaatctgctggccggcgcgcgcgcgggcgggcgggttgttcgcgatggcggaggggcggcgctacgcgatcgcgccgcagctagatattgagcagatactgaaggaggctcaacgccgatggttacgtccgactgaaatttgtgaaatacttaagaattacaggagtttccgtattgctcctgaacctccaaataggcctccaagtggttcacttttcttgtttgatcggaaggtcctgagatatttcaggaaggacggtcataattggaggaagaaaagagatggaaagacagtcaaagaagcccatgaaaggttaaagtctggaagcattgatgtgcttcattgctactatgctcatggggaggagaatataaatttccaaaggaggagttattggatgttggaggaggattacatgcacattgtacttgtacattatctggaagtcaaggctggaaaattaagctctcgtagtacgggacatgatgatgtactgcaagcatctcatgcggatagccctttaagtcaattgccttcacaaactaccgaaggagaaagctcagttagcggacaggcctctgaatatgatgaaacagaatcagatatttattcgggaggagccagatacaactctttctctcggatgcggcagcatgaaaatggaggtggatctgtgattgatgattctatattcagctcttatgttcctgcgtcatctgtaggcagttatcaaggattacaggctacagcacctaatacaggcttctattctcatggtcaagataacttacccgtggttcttaacgagtcagaccttgggactgcatttaatggccctaatagtcagtttgatctatcattatggattgaagcaatgaaacctgacaaagggacccatcaaattcctctttaccaagctcctgttccctccgaacagtctccttttacaggaggcccaggaattgaatctttcacatttgatgtagtatacaacaatggactgagtatcaaggatgtagatggtgatgatacagatggagaaactccatggcagattccaaatgcaagtggtacatttgctacagcggacagctttcaacaaaatgataaaactttggaggaagccattaattaccctctcttgaaaactcaatcatctagtctttctgatatcataaaggacagttttaagaaaaatgacagtttcactagatggatgagcaaagagcttgctgaagtagatgattctcaaatcacatctagttctggagtgtactggaacagtgaagaagctgacaatatcattgaagcatcaagcagtgatcagtatactctgggaccagtgcttgcacaagatcagctgtttactatagttgatttttctccaacctggacatatgcaggttcaaagactagggtatttattaaaggtaatttcttaagttctgatgaagttaagagattaaaatggtcatgcatgtttggagaatttgaagtcccagctgagattatagcagatgatactcttgtatgtcattctccctcacacaagcctggcagggtccctttctatgtgacttgctccaatagattggcctgcagtgaagtacgggagtttgatttccgacctcagtacatggatgctccaagtccacttggttctacaaacaaaatatatctccagaagcgtcttgataaactattgtctgtggagcaggatgagatccagacaactctgtctaaccccacgaaggagattattgatttgagcaagaagataagttcattgatgatgaacaatgatgattggtctgagttgctaaagttggctgatgataatgagcctgccacagatgataagcaagatcagttccttcaaaaccgcattaaggaaaaattgcatatctggcttctccataaagtaggggatggaggcaaaggtcccagtatgttagatgaggaggggcagggtgtgcttcatttggcagctgccctagggtacgattgggcaataagaccaacaatagctgctggtgtgaatataaacttcagagatgctcatggatggactgcactccactgggctgcattttgtggaagagagcggacagtcgttgcacttatagcactaggtgcagctcctggagctgtaacagacccaacaccaagtttcccttcaggaagcacaccagctgatcttgcataagccaacggacacaagggaatctctggtttcctagcagagtcttctttaacaagtcatctgcagactctcaatctaaaggaagccatgcgtagcagtgcaggagaaatatctggtctacctggcattgtaaatgttgctgatagaagcgcctcgcctttggcagttgaaggccatcagactggatctatgggagattcactaggtgctgttcgtaatgccgcccaagctgctgcccggatataccaagtttttaggatgcaatccttccagagaaaacaagcagttcagtatgaggatgaaaatggtgcgatatcagatgagcgtgccatgtcactcttgtctgctaaaccatccaaacctgcacagcttgatcctctgcatgctgctgcgactcgaatacaaaacaagttccgtggatggaagggaagaaaagaatttctgcttattagacagcgaatcgtcaagatccaggcgcatgtgcgaggtcaccaagtgagaaagcattatcgcaaaataatttggtctgttgggatagtggagaaggttatattgcgctggaggcgacgaggtgctgggttgcgtgggtttcgacccacagaaaatgcagtcacagagagtactagcagcagcagtggcaacgtgacccaaaacagacctgccgagaatgactatgatttcttacaagaaggacggaagcagactgaagaaaggctacagaaagctcttgccagagtgaaatccatggttcaatacccagatgccagggatcagtaccagaggattttgacggtggtaactaaaatgcaggaatcccaggctatgcaagaaaagatgctcgaggagtcgacagagatggatgaaggccttttgatgagcgaattcagagaactgtgggatgacgacatgccaacgcctggatatttctaggatctaacgtcttgtgtatgcgcttgtaaattacttccaggtctttgtacatagcattaccaaatcgataacctgtagttgcattgctaaatttttgtatgttttgaagtttggttggtacattaatttttgtatgcgttttgtacagtaattcttctgtaaaatgtatcaaaatgatgtagctcgtgaaaagcttcagatagttggagaagctaggtctagaatctgcagatagtttgtgtaaggaaaaatgtttaatccttgctatgttttgactacggtgtctcgagttc

SEQ ID NO: 6481 - DNA, 3081 bp, Oryza sativa
  Predicted polypeptide sequence is orthologous to G2907
atggcggaggttcgcaagtacgggctgcccaatcagccgccagatattccccagatactgctggaagctcagaatcgatggctacgtcctactgaaatctgccatatactgtcgaactacaagaaattctccattgcgcccgagccaccgaacagacctgcaagtggctcgctttttctgttcgatcggaaaatattgagatacttcagaaaggatggacataactggaggaagaaaaaggatggaaagacagtcaaagaagctcatgagaagctgaaagttggtagtgttgatgtacttcattgctactatgcccatggggaggagaatgagaacttccagagacgtacctattggttgttagaagagggtttcatgaatattgttcttgtgcactaccttgaagttaaggggaaaaataatttttccagggtggcaagcaaagtttcagccgttctaaagaagctgaagagagtgcaggattatctaatgctgatagtcctgcatgctcaaactctttcgctagtcagagccagtgtatctaaagaaaaattcggtgcaacagataattgtcgagcaagctccagataccaccctttcgttgagatgcagcagcctgtggatggagtcatgatgaataatatgctgggtgtttcagctccaagtgcaggatatcatggtgaaatgcagactacaacagctaactcagacaatcattttgctactcattatgacatagctggtgtgttcaatgaagctggagctggattaaggggcgtttccaaaactctacatgattcagtgcgttttgctgagccctatcctgaatgctcagctgagtttatggagccagcactctattcttctaatgccaccatggagtccaacaatctggatgataactcacggttggaaacgttcatgtctgaggcactctacaccaacaacctcactcagaaagaagctgatgcactgagtgctgcaggcataatgtcatcacaggcagagaataatagctatacagatgggatccggtatccacttttaaagcagtcatcactagatctctttaagatcgaacccgatggtttgaagaaatttgatagcttctcgagatggatgagtagtgaacttccagaagtagctgatttggatatcaagtccagttctgatgccttctggagtagtactgaaacagtgaacgtcgctgatggcactagcatacctataaatgaacagttagatgcattcgcagtcagcccttcactttcccaagaccagctcttcagcattattgatgtttctccaagctacgcatgcactggctctaggaataaggtcctaattactggtacattcttggcaaataaagaacatgtggagaattgcaagtggtcatgtatgtttggggacgttgaagtacctgcagaggttttagcacatggctctctgcgctgctacacaccagtacatttatctggacgagtcccattttatgtgacatgctccaatagggtggcttgtagtgaagtgcgagagtttgagttccgtgattctgatgctcgacaaatggatacttcagatccccagacaacaggcataaatgaaatgcatttacatattcgtcttgagaagttactttcgttgggaccagatgactatgagaagtatgttatgagtgatggaaaagagaagtctgaaataatcaacactattagttccttaatgcttgatgataaatgtttaaaccaggcagttccattggatgagaaggaagtttccactgcacgggatcagaatattgagaaattggtgaaagagaaactatattgttggcttgttcataaggtacatgatgaagacaaaggtcccaatgtgcttggcaaggaaggacaaggtgtgattcatttggtagctgcacttgggtatgattgggctgtaaggccaataattacggctggtgtaaaggtgaacttcagggatgctcgaggatggactgcgcttcactgggctgcatcatgtggaagggagcggacagttggggccctgatagcaaatggagctgaatctggtttattgacagatccaactcctcaatttccagcaggtagaacagctgctgatttagcatcagaaaatggacacaaaggcattgctggtttccttgcagagtctgctttgacaagtcatctttcagcacttacactgaaagaatccaaggatgggaatgtaaaagaaatatgtggcttaggaggggctgaagattttgcagagtcgagttctgctcaacttgcttacagggattctcaggctgagtcactgaaggattcacttagcgctgttcgtaaatcaacgcaagctgcagccaggatatttcaagcttttagggtggagtcattccacagaaagaaggtggttgaatatggagatgatgattgtggattatcagatgagcgcactctttcacttgtatccattaaaaatgccaaacctggacagaacgacgggtcacattctgctgctgttcgtatccaaaataagtttagaggatggaaaggtagaaaggagtttatgattattcgacagaaaattgtcaagatacaggcccatgtacgaggacatcaagtaaggaaaagctatcggaggatagtctggtctgtaggcattgtggagaaaattatattgaggtggaggagaaagcgaaggggcctgcgtggtttccaaccggtaaaacagcttgaaggtccatcaccgatccaacagcttgaaggtccatcgcagatccaaccagcaaaggaagaggaagaggatgaatatgattacctcaaagatggcaggaagcaagccgaaggcagattacagagagcactagctcgtgtgaaatcgatgactcaatacccagaagcaagagaacagtacagtagaatcgcaaaccgtgttacagaactgcaggagcctcaggcgatgatgattcaggatgatatgcaaagtgatggagctattgctgatggaggcgacttcatggctgaactggaggagctatgcggggatggggacgcaccaatgcccaccattttgtga

SEQ ID NO: 6482 - DNA, 3280 bp, Oryza sativa
  Predicted polypeptide sequence is orthologous to G2907
atggcggagacacgcaagttcttgatgcccaaccagcccccggatatttcgcagatggtgctggaggctaggaagcgatggttgcgacccactgaaatatgcgaaatactctcaaactacaggagtttctctctctcgcctgagccaccaaacaggcccggaagtggctctctttttctatttgaccgcaaaacattaagatacttcagaaaggatgggcataactggaggaagaaaaaggatgggaagaccgttaaagaagctcacgagaaactaaaagctggcagcattgatgttctacactgctactatgctcatggagaggaaaatgagaacttccaaagaaggacctattggctgttggaagaggatttcacgcacattgttcttgtacactatcttgaagtcaagggtgtaaagcaaagttttagtcgtgctaaagaagaaattatgcagttatctggtgctgatagtccatcgtgttcaaattcgattactagtcagaaccagatgaccccacaaataatggatgcagctgaaagcccaattagtgggcagatttcagagtatgaaggtgctgaaccagcgaaattcggtgcagcagataattgcccagcaagctccagatacaaccctctcattgagatgcagcagcctctggatggaatcgtgatggataacattttatacccttcttcttcagccatctgtaaccaagtttcaggttatcatggtgaattgccaccaggaacatctaatctaaatggtcatacattttctcacagtgacatagctagaatgtttgatgattccagctctgggctaagagacatttccagaaccctgtttgattcaatgccttacgatgagcatttctcaggatatgcaaatggattcatggagccaactcttcattcttctttttccatgatagaggctaacaatctggaggatagctctcttctggagacatatacatctgaagctctttacactaacaacctcagccagaaggaagctgatgcactaagttttgctggcatatcatcgccagaggtgaatggtaataaatatactgaaggaagcaccaagcatccgctcctgaagcaattgtcattagatctatttaagattgagtcttctggtttaaagaaacatgacagcttttcaaggtggatgagtaaagaacttggagaggtggttgatttgggtatcaaatcaagttctgatgctctctggagtagcattgagattgtgaatgctgccgatggtcctagtgcaccaactaatgaacagttagatgcttatgcagtgagcccttcacttgcgcaagaccaactattcagcattcttgacatttcaccaagctgctcatatattggtttgaagacaaaggttctggtaactggtacattcctggcaagtaaagagaatgtggaaaattgcaagtggtcatgcatgtttggggatgttgaagtaccagctgaggttttagctgatggttccctacgctgctatgcaccagaacatcaatctggaagagttcccttttatgtgacatgctcaaacaggatcgcttgtagtgaagtgcgagaattcgagtaccgggattctgatgctcagtacatggagacatcacattctcaagccaatggtataaatgaaatgcatctacaaattcgtcttgagaagctactcactttggggccagatgacaatcaactgcttgtttgtggaaatgaaaaacttgagttaatcaatgctataaactccctgatgcttgatgagaaatggtcagatcagggatcaccatccggctctaaagatgttgtcaccccaaggaaccaaagtttaaagaaattgatgaaagaaaagcttcattgttggcttatctataaaatatatgattgtgagaagggcccaaatatactgggaaaggaaggacagggtataattcatttggcggctgcactgggcttcgattgggctataagaccaatactagttgctggtgtcaatgtgaactttcgggatgctcatggatggactgcacttcattgggctgcgtcttgtggaagagagcgaacagtgggcgtccttatagcaaatggagctgcagcaggtgcattgacagatcctacttctgaatttccttctggaagaactccagccgatttagcctctacgaatggacacaagggaattgccggttttctcgcggaatctgctttgacaagccatctgtcagcacttactttaaaggaatcaaaagatagcaatgcggaagaagcatgcagattaacaattcctgaagatctccctgaaatgaattatggtcagcttgctgtacaggattctcatgctgaatcattaaaggattcattaagtgctgttcgtaaatccgctcaagctgcagctaggatattccaagccttcagggtggaatcattccacagaaagaaggtcgtggaatatggagatgatgattgtggattatctgatgaacacacattttcacttatttctcttcaaaaggtcaaacaagggcaacatgatacacgtttgcattctgctgctgtacgtatccaaaataagttccgaggatggaagggaagaaaggagtttatgatcattcgccagagaattgtgaagttacaggctcatgtgcgaggacatcaagtgaggaaaaactataaaaaagtagtctggtcagtaggtattgtcgagaaagttatattgagatggaggagaaagggacgtggtttgcgtggctttcgacctgagaaacaattagaaggccagacacaaatccagcctgcaaaaacagaggatgaatacgattacttgcaggatggcagaagacaggctgaaggcagactacagagggcactggaccgggtgcgctctatgacacaatacccagaagcaagagaacagtaccgtaggcttacaacttgtgttgctgaaatgcaacagtccaggatgatgcaggacgagatgctaagtgaggcagctggtgctgacggaagtgatttcatgaatggactggaggacttgatatgcagagacgacccccaaatgtctgccatttggtgaagtcgaagttgttacatcagttaggctgatcattgccttgttcattgccatattagccttgtaaattcttccgcttgtatttcactcactgcttaatatctagctcatgctgttagtattatgtaactctgtgcactgatcataatagaatatttctctcctgtatgttacaggtaggttatgc

SEQ ID NO: 6483 - DNA, 2378 bp, Oryza sativa
  Predicted polypeptide sequence is orthologous to G2933
gtgctggcctaagctaactcaatcaaacctccctagcttggcagaatagttaatgttaatcacctgattaaaattagattagtcccctcctacccagctaactactgcttctatttcacggagaaaaatgtcttcctaggctttctctttcagctcgatcgatccacagctcagctagctctctctctctctagcgacaagcaagcatggagcagctgttcgtcgacgacccagccttcgcgagcagcatgtcgtcgcttgaggcggacatcttctccggcgccggccagctgccgtcctcgccgtggctggacctagacctcgacgacgatgtccaagacctctccatggcgccgacgacggcgaacgcggtgtcctccggctacggctccggcggatccggctcccacaggaagctcagccacaacgcctacgagcgcgaccgccggaagcagctcaacaagctctactcctccctccgcgctctcatccccgacgccgatcacactaagctgagcatcccgacgacggtgtctcgcgtgctcaagtacatacccgagctgcagaagcaggtggagaatctggagaggaagaagaaggagctgacgacgacgagcaccaccaactgcaaaccaggagtgttggggagccagctgatgagcgagggcatggctcccatcgtttcggctacctgcatcaatgacatggagatcatggttcaggtcagcttgttgagcaatgtggcgggttcagttcttcctctctccaagtgtatcaaagtactggagaacgaaggtcttcacttcatcagttcatcgacttcctccggatttgggaacaggacattctacagtatccatcttcagagaagtgaaggaacgatcaacgaggagtgcccagcattttgtgaaaggttggagaaagtcgtcaggaacaaagcaaagctttaagcactagtaccgcgcgcgcgtgcctatgataatcctgaattaatcaagggccaaaatctagctagaatcctacaactagcgtagtgtggtggtggtcgtcttcgagttcgacgcgccgccgccgccgctcatcgcgacgacaagagcctcgccagcgtccgcagtagcagcttcctagtcttgttgcactccgagatcgtctccagcctcggcgaccacggctggttcctccgccccatcagcagcgcgtaatgccgcttcagctccggcgtgctgcacagctccgtcgccgtcgccgtcgccgtcgtcgacggcttccggcggcgcgcaccgccgccgttctcgtcgcagctgatcaccttctcgatgaactccgggaggactcggatgagcgtggcgccgccctcgcccttgacgtactcgaacgggcactgccccggcccagccacggacaccttcttcgacggcgccggcgacagcgacgcgagcgccgcggcggtgagcaccttgaagcaggagaagcgctcggcggggaggacgaagtacgtccgccccgccatcagctcctcgccggcggacaccaccgggatcgggaggccgacgtagaaggagtcggccgcgcagacgtggtcaccggggagctccgccgtgacgtcccccgccacggcgcacaccccgccatcgtcgtccagcatcctcgtctgcccgccccagtacaccagcttcacccccgccgccgccgtcgccggcaggtgcatgcacggggagaggccgttgcccatggcaactgatgtgtctagaaccttctagaacgagctcgagcttgcagatggaagaagaggagaagaggagatgcttgtgtgaattggggctcgtggttgcgagaggggaatatatataagcgagcgttgaacggggttgactttggaaaattcaaagatggaggaggtaaatactcctactactactggtctggcttggtcagcggtcaaaggcgatggcttttgagacggaagcgggtcacgtggcagctgccgattgggccgcggagggggagaagcgagttgcgcgtgcgcatcgtcgttggtcggtgtcgccgatcgggttggatccaaccagatattcagaatttcagatcagatgcacagtagtacagttgcaagttgcaactagaagttgccgattaatttgacagcgcctggctgcaggctgctaccgcactccaacgccgacatggcaggtgttttttttttaaaaatcttgttccaaatttggagctgactgaagagagttttatactccgtattatgggtatgagttcatttatactcctatgtcacttatcatcgatttgttttcggacttattcactttgtagctattttcaaccattacaaaatttaacaattcccataattttagcaaatt

SEQ ID NO: 6484 - DNA, 515 bp, Oryza sativa
  Predicted polypeptide sequence is orthologous to G2964
gggttcgctcgtcgcctcgcgtctcgtctcctgttcggctcgactccacccgccgcgagagagagagagagagggagggagcaaaccctatctagggttttgcccgcccaccgccctcgccgtcgacgccatggaagccggaggaggcaagcgggccgccccggagggcaccaacggcgccgccaagcgcgcgagagcatcggagtcgtctcaagtgggtgtaggaagcaaattgaagccatgcaccaaatttttcagtacttctggctgtccttttggttcaagttgtcattttctccataacttccctggtggctaccaggctgctgcaaagatgaccagccatggtgggacagctgttgcagctcctcctggaagaatgcctttaggacctggtgctcataatgggccacctaaatccagcgtgaaaactcggatgtgtaacaagtacaacactggagaaggatgtaatggggtagcaagtgtcattttgctcatgagagagggagcttgga

SEQ ID NO: 6485 - DNA, 1365 bp, Oryza sativa
  Predicted polypeptide sequence is orthologous to G2969
atggcgggcggtggcaggtgcagctcgctgctccgtggcttcgtgtcactcttcttcctcctgttcatccacattggccatgccggttgctgcttctcgacgggatcttccacgcagacgctggaggaagatgacactggacatggggccgacgggaggggcggcggtggcggcggcagcaagaggaggaagatatcgccgctcgcgttctccccgtcggtgtcgtcttctacggtggctgacgagaggtccagagccaggcggaggcaggtgtcgtctctagccaccagcgtccgcttctacctccaccgcatcttctcctactcgtccggagccaagaacggcgctggcgctccagccgcggaggaggaagacgaggcggtgacgacgaccgtgtcgtcgccgctcgcgcagtcgtcgtcgtgcctgcctcagcgccaggcctcgtcgtcggtggtgctgtccacgccgtcgtcgccatgcgcgtcgccgttcctgtccccgctctcgccgcagtctctcagcattactcctgcggtgccgtcgtcgccgcacaacaggcagatccctcaggcgaccaccaggcagtcgtcgttcaggtcgttcgccgcccgcggcgacgtgttcccgtgcaaggtgtgcggcgaggtgctgagcaagccgcagcagctggagctccaccaggcgatgaagcactccctctccgagctctccagcctcgactccagcatgaacatcatccgcatgatcttcctcgccgggtggaagccggccgttatgcccggcgccggcgagccaccgtcggtgcggcgcatcctcaggatccaccacaacccccgcgtgctcacccgcttcgaggagtaccgcgacctcgtccgcgcccgcgccgcccgccgatgcgcgggcgccggcgcggcggcggtggaggagcggtgcgtcgcggacggcaacgagcggctgcggttctactgctccaccatgctctgcaccctgggcgcgggcgtgtgcgggagcccctactgctgcacctgcagcatcctgcgccacgggttcgccgggaagcaggccgacgtggacggcatcgccacctactcctccggccgggccgcgcacgcctctctccccgacgacgtggagcgcgagttcgcgttcctccaggtgcgccgcgccatgctggtgtgccgcgtcgtggccgggcgcgtcggccgcggcgccgcggacgacaaggtggcctacgactccatggttccactactgccaacctcctccttcgctgcagctacccgtggcgacgacgacgtcgagctgctcgtgttcaacccccgtgccgtgctcccatgcttcgtcatcatctacagttgctag

SEQ ID NO: 6486 - DNA, 1041 bp, Oryza sativa
  Predicted polypeptide sequence is orthologous to G2981, G2982
atggtctccggcgcggcgcattcggcctccaccagtggcggcggcggggggagcgagggctcccccaccggccgcgccgcgccgggcatgcagggcggcggcagcgccgccacgcccgccgcctcggcctccgcgtccacgccggccagcgagaccaccgtcgcccgccgcctcgacggcctcgacatccagggcgacgacgcgccctcgtcgcagcccgccacgagcaagaagaaaaaaagggggcctggaacacgtgcaacgggccctgacaagggtggccgtggattgcgccaatttagtatgaaagtttgtgagaaagttgaaagcaaagggagaacaacctacaacgaggtggcagatgagcttgtagctgagtttgcagaccccaacaataattttgcatcacctgatcctgacaaccctaacacaccacaatttgatgagaaaaatatacgacgaagggtttatgatgcattgaatgtcctgatggctatggatattatatctaaggataaaaaggaaattcagtggaagggcttgcctcggacaagtatgagcgatgttgaagaattgaagacagagatcatcggactgaaaggtaggatcgacaagaaaaatgcatatttgcaggagttagaagatcaatttgtaggtcttcaaaacttggcacagcgaaacgagcagctttatggttcaggaaatgctccttcaggaggagtggcattgccatttatattggtgcagacacgtcctcatgctacagtagaagtggagatatcagaagatatgcagctggtgcattttgatttcaatagcactccatttgaactgcatgacgattcctttgtactgaaagcattggggttctctggcaaagaaccagatgatacgcaagcctgggttggaaatggaggtgagtgctcaaccacacctatctatcatcaatcaccccaagttgcgaggccaaacggagttagactaccaacatcgccccctattcccggtatacttaaagggcgtgtcaagcatgaacattag

SEQ ID NO: 6487 - DNA, 1140 bp, Oryza sativa
  Predicted polypeptide sequence is orthologous to G2981, G2982
atggtctccggcgtcgcccaccgcccggacgacgacggcgggcgcgccgcctcgacgttccagcgcccgccgcagccggccggcgcgcggccgtccctggccacgccgccgccctcgggcggagcgcaatccgcttcgacgagcggcgggagcgcgggctccccgtccagccgcagcgagcagcatgtccccgcagccgcaggcatggcggcgggggcggcggcggcctctactccgattagtgagaataccttcctccgcctcaacgaccttgacatccacggcgacgatgcgccttcctcacaggctccaacgagcaagaagaagaagagaggagcacgagcagttggtcctgacaaaggtggcagggggctgcgccagtttagtatgaaggtttgtgagaaagttgaaagtaaagggagaacaacatacaacgaggtggcagatgaacttgttgccgaatttgcagatcccaataacagcattttgccaccagatccggataatcccaatgcacaacaatatgacgagaaaaatatacggagaagggtttatgatgctctgaatgttctgatggctatggagattatatctaaagataaaaaggaaattcagtggaaggggttgcctcgaaccagtataaatgatattgaagatttgcagacggaacttgtaggactgaaaagtaggattgagaagaaaaatacatatttgcaggagctgcaagaccaatttgtaggtatgcaaaagttgatacaaagaaatgaacagctatatggttcaggaaacattccctcgggtggagttgcattaccatttatccttgttcagacacggcctcatgcaactgtggaagttgaaatatcagaagatatgcaacttgtacattttgactttaatagcacaccatttgagttgcatgatgactcatttgtactgaaagcaatgagttcttgtggagaagaacaaatcgacggtattcatgatctaatttcaaatggaggtgagagctcaagcatgccaaatatttataggcagcaagtgcagcaacctgcaagatcaactaatggtacagctagattgccaagctcaccccctattccaggaatactgaaagggcgagtgaagcacgagcattag

SEQ ID NO: 6488 - DNA, 1174 bp, Oryza sativa
  Predicted polypeptide sequence is orthologous to G2981, G2982
ggctcgagccgcaatggcgcctccctgcggcgatgccgcggcggctgcctccgccgcgcccggcctggccaacctgctcattcgcgaaggcgccggcctcccttcgcgtcccgaacggtacccgccattccggccctgtacttctgattcctttgctccaatctctagggaaggggacgatattcccccccaaaaaaaatcggtttctttacgcagcggcggcggcggcaatgcggcagagagggaggagggcggtgcgaacaggaacgggaagaaggagaagaccggggcgcagaggatcaccgggtgggggctccgtgagttcagcaagatagtttctaagaaagttgaggccaaaggaagaaccacatataatgaggttgccgatgagatttttgcggagctgaagtccattacgcagaacggtctggagtttgatgagaagaatattaggcggagggtatatgatgctttcaatgtgctcattgcaattcgtgttattgcaaaagataaaaagaagataaagtggatgggccttactaattatagatacgaaaagatacagaagttggaggaagttcacaaagaactcatcaccaggatcaagaataagaagaagcttctccaggaaattgaaaagcagtttgatgaccttcagaatattacattacgcaaccaggctagtcagaggccagcagaaagtgttaatggcatcctccttccgttcttattgatcaagacatcccgaaaagcaagggtggaaattgagatttcggaagattcgaagtttgcacggttcgacttcaacggtgcaccattcaccatgcatgatgatgtatcaatccttgaagccatcaggcgtaacaaaggaagagctggcctctccattcacccttaagaggcacaagaatgtgacaaaaccaattgaagtgtcaaaactcaaaactggcaccaccagtttcttttgcacagttatgtatagctatagcgtacctttcagtatggaaactcgacctagtttataggacagtctctcaggctttttagcagatatgacctgcgaattttgcctcttttttgtgcctagcaggtgagtatggaatagttttttcttgcgtgtgctgctatgtataaactcaattgccgtttcaattcgaagcttgtgtacaagctc

SEQ ID NO: 6489 - DNA, 467 bp, Oryza sativa
  Predicted polypeptide sequence is orthologous to G2981, G2982
tggttcaggaaacattccctcgggtggaggtgcattaccatttatccttgttcacacacggcctcatgcaagctttggaagtttgaatatcagaagatatgcaacttgtacattgtgactgtaatatgaaacaacggaatatgggatacacgaacaacttcttgtgaacatctttacacgctggtgtgattatcctcaacttcagtgaccagaaagaaactgcaaatgcatctcggttgaaccatcacaccttcacacttcattagagcgtttggagtgttggttctctaggcctttcgtccgccaatcagccaatgtattttgaagagtccaccaattttccattgccattagagcaagtttaatagtatagccaactactagttccaagttcatttataatcaatctaatagctcattcatacaatacttacatactacactattaatatctggtcccatctgtc

SEQ ID NO: 6490 - DNA, 413 bp, Oryza sativa
  Predicted polypeptide sequence is orthologous to G2982
agtgctggtgctgccgccagcagtgccactggcgacaacgctggtgccatgcccactgctgccgtcgctatgggtgctcttatgggtggtgctgctctctttgccaacatgtagattggcatttacggaagacaacagtaataatgaaataaacggtcaaatcttcacgcgccatcattttaaccaacatggagctcttgtgtatatccaattctgatgaagcaaggatatgacagggttcgggatcttaattaactagcgttgcacatctaccgttagtgtgatgaaaaggggaatctggaattgagggatgccaatgtctggtgcagcctttgtaacggtgactttgtcaatagcattacttacatgaaacgttctcgaccttggatattaaaataaagatgtttcgtatt

SEQ ID NO: 6491 - DNA, 714 bp, Oryza sativa
  Predicted polypeptide sequence is orthologous to G2983
atgaggcttcaccatctgcatgtggcctacctggatcacaaagcgtcgtcgtcctcgtcgtctccggcgccaccatccatctccccgtcgtcgatccccggatcggccgccttccctgctttctccttcaaatgcctccgcccgctcgcgcccaagatctcgctgccggagccgaggaagatgatcgcgccgccggacttcgtcgtccctcgcgccagaaacgcttccaagctgctcaactacactgtgcaggtgccggcggcggggacgacgaggtggaacccgtcggcggagcagataaaggtgctggagatgctgtaccgcggcgggatgcggacgccgaactccgtccagatcgagcggatcacggaggagctcggcaagtacggccggatcgagggcaagaacgtcttctactggttccagaatcacaaggcccgcgagcgccagaagcagaagcgcgccgccctcctcaccctcaggacgctcgacccttccttgctgcgccgaccgctaacgaaaccaaataggcaccgtacaacaaggagaaggacgtggaagatggattggcgagctgcaagcggcggtgcaaggcgtgggttgacggcgccggcgatggagacgcggtggtggcgacggaggcggcggcggctgcaccgacgaagtgtccctggagctcttcccgttgcatcccaaatcgtcggacctgtagga

SEQ ID NO: 6492 - DNA, 964 bp, Oryza sativa
  Predicted polypeptide sequence is orthologous to G2989, G2990
cttgcattcactgcttctgctcggctgtgaacttggtgcggaaccgcttcctcggcatcccggcgccgccggagggaggcgcggtcgccgccggcgacatcacctacagcgggagcctttgcgcctgcccgctcgagcccagcgagagtagcatgtgctgcgccgaagggtaatacggctggtgcaccaccggcgccggcaggtgcggtggcgacggcggggacacagaccgctcgtcgtagtattccgagccatccgagttgttgtcagactcgtcgccatcaaccccagggagccggacctcgggcgtctcctcctcgcggtgcagctggccgtggagcacgttcgccggcatgggcggcgcgggcagcgccagcggcggaggcggcggcggggacccctccagcagccagcagtggaagttgcagtggcagccgcacgcggcgcacatgagcgacgtcgggtcggtgggttcaccgccgacgacggcatgaactcctcgcagccgtccagcgccgtgtccgcccaggctcgctgcgtggttcttggggcactcctggtacaccgtctctcctccgcccaccgccggctgtgctcgtcgcagctgtagctacggaggggtacagcccacaagctccacctcagccatgtctccggcgacgacgcggacgaagctgggcgacagtggcgcggcgaggtcgggcggcggcacgaccttgcggtgcccggcgaggagtggcgtagcaagccgagcattgctcggcgcggcatcccgaggctgacgtacggcggaggtgcggctgctgaccgaggtggcggcggcgctgagcgctgtgacggagatgacggaaaaggagggggatagatggaaaacttgacgagagtggcacggttctaatttctgtaaaattttaatggcacgtttacgaataagcgaattataattgtatttttctgaatggcg

SEQ ID NO: 6493 - DNA, 1080 bp, Oryza sativa
  Predicted polypeptide sequence is orthologous to G2989, G2990
atggaggccgtcgtcggcgtcaagtacaggccggtggtgttccccaacggcggcgcggcggcggctgcggcggggaagagcaaggcgacgccggcgtcggcgacggcggcggtgtacagggagtgcttgaagaatcacgcggcgagcttgggcgggcacgcggtggatgggtgcggggagttcatgccgtcgccggcggcggatgccgctgatccggcgtcgctcaagtgcgccgcgtgtgggtgccaccgcaacttccaccgccggctccccgaggcgccgccctccccgcctctcctcgcgctgcctccgccgccgccgccaccgccaccgccaccgccgccgccgcagcctcagcagcatctgccgcggaccgcggcggtggcggtggcgccgcagctgctgctgcatgggagccaccagcgtcgcgagcagtcgccggagaccgaccgcgtgcgcgggcccgggcaccaccacgacgacgacgccgccgccgacgatgatgattccgaggactccgagatgtccgactacgacgacgaccgctccgcctcgccgctgcaggcgccgccaccggtgctctctccggggtacctcccctccgcgacgcacatgctgctgtcgcttggctccgcgtccgccccggccgtggcggcgtcgaggccccacgccgccgccgccgccatggggcccccgcctccgccgggcgccgcgacgtcggcgtcgaggaagcggttccggaccaagttcagcccggagcagaagcagcggatgcaggcgctgtcggagcggctcgggtggcgcctccagaagcgcgacgaggccgtcgtcgacgagtgctgccgcgagatcggcgtcggcaagggcgtcttcaaggtctggatgcacaacaacaagcacaacttcctcggcggccacagcgcccgccgctccgccgccgccgccgccgccgcgccactcgccccaccaccagtgctcactgacttcagcatcaacggctcatccacgcatgccgccgccgccgaccacgccgcggcaacggcgagtggcggcggcggcggctcgccgcagtcgacttaa

SEQ ID NO: 6494 - DNA, 300 bp, Oryza sativa
  Predicted polypeptide sequence is orthologous to G2989, G2990
gctatcaacaccaacaaacaccgcgcctcgcctcgtctcctccgatagctgacgccgccgccgccgccgccaccgacgccgggagtgacagcgagtgagatcgtcatgatggatcacctgagccttgtgccctacgagggcggcagcgccggcggggtgaggaggtgtaggtggaggtggtggagggaagtacaaggagtgcatgcggaaccacgcggcggcgatgggcgggcaggcgtatcgacgggtgcggggagtacatgccggcgtcgcccgactcgctcaagtgcgccgcgtgcg

SEQ ID NO: 6495 - DNA, 1286 bp, Oryza sativa
  Predicted polypeptide sequence is orthologous to G2991
gacctgttgttttcctcactcccttgacccgtcgtcccatgctaaagccaaagcttaggcagcagcagtaggcttaagcttggttggtcaagggcgagtggccatggaggccatggacgtcaagtacaagccgctcgtgttccccaacggcgccatcaagaaggcggcgaagccggcggcggtggcgcctgcggtgggcggcggcggagggggagagacggtgtaccgggagtgcctcaagaaccacgcggcgagcctgggcgggcacgcgctggacgggtgcggggagttcatgccgtcgccggcggcgaaccccgccgacccgacgtcgctcaggtgcgccgcgtgcggctgccaccgcaacttccaccgccgcacatgctgctgtcgctggggtcgagcgggcaggcgcagaggctcccgccgcaggtgatgtcgccggcggcggcggccgcgcctccccccggcggcgggcggcggcgggatgccgaggaagcggttccgcaccaagttcaccgccgagcagaagcagcggatgcaggagctctcggagcggctcgggtggcgcctccagaagcgcgacgaggccatcgtcgacgagtggtgccgcgacatcggcgtcggcaagggcgtcttcaaggtctggatgcacaacaacaagcacaactacctcggcggccacagcgcccgccgcagcgcctcctcctcctccgccgccgccgccgccgccccgccattcaaccctcccacctcacctcctcctcctcctcctcctcctccacacgccaccgacttcaacatcaacggaacagccaccgccgccaccgccgccgccgccgccaccatcgccgccggcaaccaccaagagaacggagcatcgtcgccgcaatcagcataaaaactagagagaaaaagagacagcaagtagccttcagtgatcattccattttcctttttttttgcttcttagatcgctcatccaagaaattaaccccaagaaaggacgccgcggctgcagatcagttcttgatgcctagttacagcaaaagaaaaaaaaagaggagaaagaagtccaatctttccttatccctgtatgttcttgggatccgatgatgatggagaattagggattttaattagattatctcatctcaaaagtggcacctctcttggctgttcttgtcctccctttgaagcagaggtaggaggagagggttcttccttctagaattctaggatctctcttctctttgagaaaaaatgtatacaaaaatggaagcagcctc

SEQ ID NO: 6496 - DNA, 607 bp, Oryza sativa
  Predicted polypeptide sequence is orthologous to G2991
ttccggaccaagttcagcccggagcagaagcagcggatgcaggcgctgtcggagcggctcgggtggcgcctccagaagcgcgacgaggccgtcgtcgacgagtgctgccgcgagatcggcgtcggcaagggcgtcttcaaggtctggatgcacaccaccaccatcaatctcctcgtgctactactgttcacgtcgtctccccccgcccgccgccgccgcgccactcgccccaccaccagtgctcactgacttcagcatcaacggctcatccacgcatgccgccgccgccgaccacgccgcggcaacggcgagtggcggcggcggcggctcgccgcagtcgacttaatcaagactagtagcacagtcgaatcaaggttgtctctttcttttcttttctttttttttttcctctttttttgtagcctttttcctgtctaattaaccaaccctaatggctaatgaaatgactcatcagtcaacctagcaagtagtagtagcagcagcaaattagcttttgctctaatggtgaggcccaagcaaagattagattcataaacaaaaatgtggcctttttttttggatctgaaaaaaaaaaaaaaaaaaaaag

SEQ ID NO: 6497 - DNA, 719 bp, Oryza sativa
  Predicted polypeptide sequence is orthologous to G2994
gtaggatcgatattgttgtatcaggatcatcatcctagagatcctactatcaggatgggatattacaatggccctaccagatatagatactactggtccatcatgatatgtattgaaaggttctggctggactgtgatgtaataggatcatacctgaagagatgtatagggaagctacaaccttgcaagtaaagacggcaagaaaaacttaagtttgtcttgcgggcaataaatattcaggggagcccacttagggactgtacacaggtgaaaggatataaactagacggaaatagtttgtgttgtgctctcatgctgtcctagtgtgagaatggagaaagacctcttctctgcctgttcaaatggggtcttaactcctcgtgctgacttcctgaacttccagtttatatggtgagctgcctcgacgtcaacctggttggtgcatgccatgctctcttcgaccatggttgacaccaatccgcttgtgctgctggcctgttggtgcttatcaccaactccaccaagctcatcttcaccgcttatcgtctgcacctccctcaccaacatggcttaccctctctgcaccaacctgagggctgatgccacttagcggttttggagcgttgaacatgtggcacgcgtgctttgcatcaccgactcatcatcaccaacctcgacctcatcatccagcaagttccacacgttgtctacatcgactg

SEQ ID NO: 6498 - DNA, 628 bp, Oryza sativa
  misc_feature (557)..(557): n is a, c, g, or t
  Predicted polypeptide sequence is orthologous to G2997
ggaaggaggggggctctaccttccccgctcatttcgatcgaacctttgtctcctcccatacatggcatcctgcctactgctgctgttcctgcctgttctcctgctgctgtttctgcttgaagctatgcttgttgttgtgcatccacaccttgagcgcttgcctccggacgccgacctgcgcgcagaagtgctccaccgtcgcctcctcctgccgctggatcctccaccccacgcgctccgcgaacgccagcatctgctccttctgctcccgcgtgaacgtcgtgcgtgaccgcctccgtggctgcaccggcgagggccgcagccgctcgtcgctggaggacgcggtcgtggtgccagtgccgccgctgggcgtgccgtagccagggaacggcaaaccttgcttgctggcggccgctgcaggcggcagcagcagcgcgagtggtgcgcgcgagttgatggacgccggcaggtgcagctgcggcagtcgtgctgcgcccgcgcggcccgaagaagggtcccggcggtggaagctgcggtggcagccgcatgccgcgcangcgagcggctcctcggtgtacgccggcatgaactcgccgcaccatccacgacgtggccgcccgaggccgtc

SEQ ID NO: 6499 - DNA, 1096 bp, Oryza sativa; identical to SEQ ID NO: 2069
  Predicted polypeptide sequence is orthologous to G2997

SEQ ID NO: 6500 - DNA, 1891 bp, Oryza sativa; identical to SEQ ID NO: 2059
  Predicted polypeptide sequence is orthologous to G2997

SEQ ID NO: 6501 - DNA, 1169 bp, Oryza sativa
  Predicted polypeptide sequence is orthologous to G2997
aagtgttttcctagctaggtagctagctagctagacgagcttgccggccggccggccggcgacggcgaccatggacttcgatgaccatgacgacggcgacgaggagatgccgccgatgccggtgagctcgagctacgagactccgccgcagcatggccttgccggcggtgggatggcgcccaagcctcctggtgagattggcagccgtgtgaagggccccagctgcggtggcggcaggtaccgcgagtgcctcaagaaccacgcggttggcatcggcggccacgccgtggacggctgcggcgagttcatggcggccggcgaggagggcaccatcgacgcgctccgctgcgccgcgtgcaactgccaccgcaacttccaccggaaggagtccgagtcgcttgccggcgagggctcgcccttctccccggccgccgtcgtcccctacggcgccacgccgcaccaccagttctccccgtactaccgcacccctgccggttacctccaccaccaccagcaccacatggccgcggcagccgcggccgccgccgccgcagccggcggctacccgcagcggcccctcgcgctcccgtccacctcccacagcggccgcgacgacggcgacgacctgtccgggatggtggggcccatgtcggcggtggggccgctcagcggcatgtccctcggcgccggcccgtccggctccggctccggcaagaagcggttccgcaccaagttcacccaggagcagaaggacaagatgctggcgttcgccgagcgcgtcgggtggcgcatccagaagcacgacgaggccgccgtgcagcagttctgtgacgaggtcggcgtcaagcgccacgtgctcaaggtgtggatgcacaacaacaagcacaccctgggcaagaagctgccatgaccgggagcaaatgcatttgatctcatcgtcggcatgcatgaccaagttgtgggacgacgcatgcatccatgtccatcccaagctagctgagctgatcgaccggccgtggcttagccacccggaccccggtatggtaggtacctgaaccttatttatttagagttggacttaattaattggtggcttaggttaatctgtagcaagagagactgagagagcattcgttctcggctctagtaggtggttctttcttcttttc

SEQ ID NO: 6502 - DNA, 717 bp, Oryza sativa
  Predicted polypeptide sequence is orthologous to G2997
atggagcagcagcaggagcggccgcgggaggtgtacagggagtgcatgcgcaaccacgcggcgaagctggggacctacgcgaacgacggctgctgcgagtacacccccgacgacggccacccggcgggcctgctctgcgcggcgtgcggctgccaccgcaacttccaccggaaggacttcctcgacggccgcgccaccgccgccgccggaggggcgggaggcgccggcgtcggcgtcgcgccaatgctgccggcccccggtggaggcgggccgccgggatacatgcacatggcggcgatgggaggagcggtgggcggcggcggcggcgtcgacggcggcggcggctccggggggaggcggcggacgcggaccaagttcacggaggagcagaaggcgcggatgctgcggttcgcggagcggctcgggtggcggatgccgaagcgggagcccggccgcgcgcccggggacgacgaggtggcgcgcttctgccgggagatcggcgtcaaccggcaggtcttcaaggtgtggatgcacaaccacaaggccggcggcggcggcggcggcggcggcagcggcggccccggcgccggtggaggcgcccagacgtcgtcgtcgacgaccaggggcggcggcgacgtcggggtgggcttgtcgccggcgatgggcggcgacggcgaggacgacgaggaggtgagggggagcgagatgtgcatgtag

SEQ ID NO: 6503 - DNA, 1071 bp, Oryza sativa
  Predicted polypeptide sequence is orthologous to G3008
atggccagcagttcgagcggcaagagggtttcttcctcctcgacctcgagccaccagcagcatgccaagcgccggcgacgcgctcccggcgacgagctctcccagacccacggcgtggcgcgcaatgcggtggcggccatgcccatggttggcgtcgcgccgttgatgctgtcgccggtgaccatgcaagcgcagcttctctgctacgtggcgatgccaatggcgccggtggccggcggcggcgtcccgctcgccgccgcgctctgcaggctccgcaacggcacgctggagcgcatgatgagggagatggcgcaggagtgcacgccgccgctggtggcgcggcgggacaggaagagcggcgccacgccgccgccgccgccgccgtggtggccgacggcggaggagccgtggtggggcaccgaggtggcggcgcacctgcgcgggaggcggatggcgacgcccgtgccgttcgcgagcccgcgccgcctcgcgaaggccgagaaggtggccgtgctcgtcgccgtcgtgaggcacgtcgcgccggacttcggccgcctcgccgccgcggccggccgctccaggctgaccgagctcgagtcctccatatgggagagcgcgctccgcggcgagcgcgagcgccgctacgtcgtgatgccgtcgttcatcctgctgccgccgccgccgccgccgccgccacagcacgcgcactccgccgagagcgcggcggcgcacgcaggccctgagcctgagagcgccgaccaaaccgccgtcgacttctccgtctccggcgaggataccgtcactaccgggccggagctcgaacagctggtgggcgacggcaatggcgccactgtcgagggagaagggcagaagacggaggactcgccggtgccgccattgctcgagcaacacggcggcgaggatcatgatcaccaccggcagcatggtggcttctccggcgaggtctccggcgcggcgccggaagatgttgactggtttgactacgacgaggtgcttcgcgggctggacgagctggagattcccagcttttttggcggctactatatttga

SEQ ID NO: 6504 - DNA, 683 bp, Oryza sativa
  Predicted polypeptide sequence is orthologous to G3044
tttttttttttttttttttttttgaacttaaaatcttagcacagagccattccgtatttaatactcagattatccaattgcgcagctaataacactgttccaactcaacgatataaatgggtcctgaagtcatgacccccggtttagagaacacactctggcacatcggcggttttaaacaacatggccggcaactacgacgttttgttataaaagatgatctgctgcgccatgaacaatatcctgttggaggcaaaaacagacagggccttagatgggctcccaagaacatccagggataccttgagtgactcgcccatctgcaaagcgtcgacgatggcgtactggattgagccgactaaaatgggaagaatacaacgggctatttgccttgatagaaatcctaatcaatacacacggcaggtgcataatttgccttttctgcggtcagttcacgcgcaagtattaaaaccttcaatttcctctttactttcgcagccgctacttgagattgaacgacgggacgttgtgatagcagctcaccgattttgctcatagtgtaagcatgcttttttagatctcccttgtctcgtactaatctcgtttatcgatacacgttgcctaaagggggggcccggcacccagttaagcttatagtgagtggaattaaccgcgctcactgg

SEQ ID NO: 6505 - DNA, 1104 bp, Oryza sativa
  Predicted polypeptide sequence is orthologous to G3055
atggattacaccaacgccatccacatcatcccggacgcggcgggccccgacgcctgggcgaacgcggcggcgcagggcggggacgccgggatatgggccaccgaggacgactacaacagccagtggaacgccgacggcggcggcggcggctcctcgagggccgggagcgagcagccacctccgggcaagaaatcccgcggcggcggcggcggcgaaggcggcgggaacacgagcaagtcgcgggcgatcgggaagatgttcttcaagacgaagctgtgctgcaagttcagggcggggacctgcccctacgtcaccaactgcaacttcgcccacggcatggaggagctccgcaagccgccgcccaactggcaggagatcgtcgcggcgcacgaggaggccacggaggcgagggaggagcaccagatccccatcatgacgtcgtcgggacccaccgccggcggcgacgcgggctgcggcggcggcggcggcggcggctccgggagggcctacaaggggaggcactgcaagaagttctacaccgacgagggatgcccctacggcgacgcgtgcacgttcctccacgacgagcagtccaaggccagggagagcgtcgcgatcagcctctcgccgagcgtcggcggcggcggcggtggcgggagctacaattctgcggccgccgcggccgcctccgcctccgccgcggcggggaatgggccgatgcagaagccgtcgaactggaagacgaggatctgtaacaagtgggagatgactgggtactgcccctttggcagcaaatgccacttcgctcatggagcagctgaactccacaagtatggtgggggacttgttgacatagacagcagggatgctgcagcaactcccgactccaagcaagctgtggtatctgcgaaagctccagcagagaccgctgctgcatccaccacagtgctccctcatgcagacgtgtaccatctaggcgtgcaggcgcagcgttctaccattgccggccaaaggtctgggcaggtacagaggcccattcagaaatggaagggccctgacaagatcagcaggatctatggtgactggatagacgaaaccgagtag

SEQ ID NO: 6506 - DNA, 3135 bp, Oryza sativa
  Predicted polypeptide sequence is orthologous to G3060
gggttcgctcgtcgcctcgcgtctcgtctcctgttcggctcgactccacccgccgcgagagagagagagagagggagggagcaaaccctatctagggttttgcccgcccaccgccctcgccgtcgacgccatggaagccggaggaggcaagcgggccgccccggagggcaccaacggcgccgccaagcgcgcgagaggtgagcctcttcgtggtttccttcttcttcttgttttttttcccttttcttggttgctggctcttccattggaaggatggctggttcctagggtttctccagccggctaccttgttggggggctcggattctcggcggcgctccggcttggttttgagctgggtggtgattggtgaagacgggagacgaagatttggggggtgttgggattggggagcttgtggccgccttaagcctttcatgtttttttttcttgttttgttcgtttggagatgatgacggaaggctcgccactatttttttaaaatttatttttggcaatatttcgcaaagagatctagaaacgcgattggtgacctagtggacctgctaaatatgtgaacggatctagctgctcgtcgaattttcttgagtgagttgaaagagatgtccgatttctcaaggcgttaatttgaaagtgaaactcattaagctctggatactggacattattgtattgtaccatttaccttttttttttctttctgagaaggtaatgctcagtggcttttgaaatgattaatgtgtacatgttgtttatatacatgccatgttttagtaaaaatcaacgctattaaccggcggaaataataaatttggtgtaacagcatcggagtcgtctcaagtgggtgtaggaagcaaattgaagccatgcaccaaatttttcaggttctaatctaacttaaaatgaactatcacctgtttacacatgctattctgcactttgctgtggttttgccttaaataattataatttgttattttgctaagaaattgttgttgaggggtaacaaatgggttaagtaagatttttctacaggtttccattgtgtataatggataacatagcagctatatgtaaaactccatttctgatgaacaatcaaatctatctgttacactgtggtaccatatcacctgcagcaatcaagataatagtattaaacgttccatatgggattgcaattgacttgccattatggaattatactacttactaaatgataacattcagtgtagcagcttattttcagtacacgcacagtgtgtttaccttgaatttgaacttggagagatgtttttctttttatattctactattgattgatcatgtgttttagttatcacatcgatataagctactccttctgctacactcctgagttgcaaaagatgttcttattatatacaattgtgaatgaatcatgcagtaaagtgataatgtgttgtcatgttcatataagtaaagtagctataagacaatagggaaataacttctttgacaaactaaaattctattattttttttaaaaaaaatggtgacacactgataggcaaattattctgtgttgctgtatgcctttattaatatgtatgctatatttactgtttaccacagtatatgtttgcttctgtattaatatgttcagtttcatgtgatgctacgagtgcttcttaataattagatagtattcaccatcaagctttgaccactggtaaatctagattgatcccattgaaaataactttgtagatttacttaacctgtgaaaataattttacagataagatatccacataatgattatagatgtgttttgtacgtcaattattaatgtttaatgtcatttatatgaatcaaaagagagaggtggtttcatctattttgtgttgtttactcgtatctgttagcagtgacctaataaggttccatcttcagctaaatataacattacttgtttcatccatattgggtcactgtaattttcctttcgtacacatttggtcgctgtaattttattccttaaatgatgttttctttgtgcagtacttctggctgtccttttggttcaagttgtcattttctccataacttccctggtggctaccaggctgctgcaaagatgaccagccatggtgggacagctgttgcagctcctcctggaagaatgcctttaggacctggtgctcctaatgggccacctacatccagcgtgaaaactcgcatgtgtaacaagtacaacactgcagaaggatgtaaatggggtagcaagtgtcattttgctcatggagagagggagcttggaaagccgatgctgctggacaactcaatgccacatccaatgggatcaatgccgtttgaggctccaccaatgcctggcccggacatcgttcctccctcaacctttggtgcctcagccacagcaaagatcagtgttgatgcatccctggctggcggtatcattgggaagggtggaaccaacacaaagcatatatcccggatgactggggccaagctagccatccgggataacgagtccaaccccaacctcaagaatatcgagcttgagggtacatttgaccagatcaaacatgctagtgctatggtcacggagctaatcgtccgcatcagtggtaatgcccctccagccaagaacccgggcagggggtcgcatgctggggggcctggaagcaacttcaagaccaagctgtgtgagaacttcaacagaggctcctgcacgtttggagacaggtgtcatttcgcccatggtgaaagtgagctgcgcaagccgccggctgctgcttgagacatgcgtgtcgtggcttggactagacggccagcatacctgagctccaaatatgaaaacgattgcacacaaggtgaaaatgatatgtgcattgttgctgcttctgcagcatgagatattttgtcatgggaggaaactggatgtaatctgggaggaaatagataacagggaatttcggtgtctttgatttgtagaattaccttggagtttttccctcggcgcttcagtcaaattttgtaatgcttcgaatgcactatataacctagcaaaactacaatgattccatttacttgggtgctttctgatgcttc

SEQ ID NO: 6507 - DNA, 1349 bp, Oryza sativa
  Predicted polypeptide sequence is orthologous to G3060
gattccgcggctggtcgcttccccttccgcttccctccgccaaccacgagctagggtttcgatctcgcccccgaccggcttcccctcccttccctcctcctccctccgcgcgaaggctcgccatggagggagccggcgccgcccgcaagagatcccggccggacacggccaacggaggcgccgccggagggaagcgctcgagagaaacggagtcatttcaaactggtctatcaagcaaattgaagccttgcaccaagtttttcagcactatcggatgcccttttggcgagggttgtcatttctcgcactttgtccctggtgggtatcaagcagtagcaaaaacactcaatctaggcaacccagctgtgcctgcaccggcaagagctcctatggatcatgctgctggtggtaattctcatccagcttcttctggcaagacacgcatgtgcaccaagtataacactgcagaaggctgcaaatttggtgacaagtgccatttcgcccatggtgagagggaacttggcaagccagcttacatgtcccatgagagtgccatggctcctcctatgggtggtcgatatggaggccgacctgaaccacctccaccagccgctatgggtcctccagcaggaaactttggtgcatctgctactgccaagatcagcgttgatgcctcgcttgctggtggcataattgggaagggtggagtcaacacgaagcagatatgccgagtaactggggtcaagctctcaatacgtgaccatgaatcggattcaaacctgaagaacattgagctcgaaggcaatttcgaccagataaagcaggcaagcaacatggtgggtgagctcattgcaacaatcagcccgagcacaccagccaagaaacccgctggttcagcagcaggagcagcaccagcaggccgaggcggccccgggggcaggagcaactacaagaccaagctgtgcgagaacttcgtgaagggaacctgcacgttcggcgaccgatgccacttcgctcatggcgagaacgagcagcggaagggcgctgcttgagagccgaaacgcatcttgggcgcggcgcactaattctccattgccttttgtgactatatatatctctgcatctttaggtgattagcctgttgtattgcgattttctatatggattgttacgttttcggttcagcttttgatagatgtctaagaagcaaataacttagtctttctggggtgtatgccagtgtagagctccctctttcagtatcttcaccctcactttattcatctatagtagtttcatcagttgaggacagtggagttcattttgcccaaaactgagacccttgaacg

SEQ ID NO: 6508 - DNA, 921 bp, Oryza sativa
  misc_feature (593)..(593): n is a, c, g, or t
  misc_feature (603)..(603): n is a, c, g, or t
  Predicted polypeptide sequence is orthologous to G3060
aggatcggcggaatcctgggtgaccacgcgtcggccgcgccgcgcgacgagccggaaacctagccgagctccgaggcggcgtgcgcgagcgcgagcgcgggcgcgggtgtgggggagccgagagatggaagtcggcggccgcaagaggggcaagcccgacggtgcgaacggcgccggcgggaagcgcgcgcgagaatcggagtcatttcaaaccggtgtaggaagcaaatcgaagccatgcaccaaatttttcagtacctctggttgcccctttggtgagggttgccacttcctccaccacttccctggtggctaccaagctgttgcaaagatgaccaatcttggtggtccagctattgcgccgcctccaggaagaatgccaatgggaaatgctgttcctgatgggccaccaacacccactgttaagactcgcctgtgcaacaagtataacactgcagagggatgcaaatggggggataagtgccactttgcgcacggtgagagggagctcggcaagcctatgttgatggatagctcaatgcctcccccaatgggaccaatgcccactggtcactttgcacctccaccaatgnctagccctgncatgttcactccagccagctttggcgcttcggacacaggcaagatcagtgttgatgcatctcttgccagtggcataatccggagggggggggttaacaccaaggagatatcagaatcacggggccagctggccaccgggacataattagaaccactttaaacctgtgcttggggccttggacaatgaacgctgtgctgtgagacgatgacatcggcggcccccaggcgaactggggacccggggagcgcaaacatacaagtggacaccaggcgctgacgcgatcgaaaagaagccaagggcagaccgggcagagctaa

SEQ ID NO: 6509 - DNA, 1230 bp, Oryza sativa
  Predicted polypeptide sequence is orthologous to G3061
atggcggcggcgcaggagccgagagccaagaagaagaggagcctccccggcaacccagacccggaggcggaggtgatcgcgctgtcgccgcgggcgctggtggcgacgaaccgcttcgtctgcgaggtctgcaacaaggggttccagcgcgaccagaacctgcagctccaccgccgcggccacaacctcccctggaagctccgccaccgcgccgccgctgtctccgccgtgacgacagcggcgccggcgccgaggaagagggtgtacgtgtgcccggagccgacgtgcgtgcaccacgacccggctcgggcgctgggcgacctgaccgggatcaagaagcacttctcgcggaagcacggggagaagcggtggcggtgcgagcggtgcgggaagaggtacgccgtgcactccgactggaaggcgcacgtcaagaactgcggcacccgcgagtaccgctgcgactgcggcatcctcttctccaggaaggacagcctgctgacacacagggccttctgcgatgccctagctgaagagagtgcaaggcttcttgctgctgcaaacaacagcagcagcatcactactaccacctgcaacaacagcaacatcagcagcaacaacaacaacaacaacattaacagcattagcaatagcaataatcttctgatcaccagcagcagcagctcaccaccactgttcctgccattctccaccactcctgctgaaaaccctaaccctaatcagctcctgttcctgcaacaacaccaagcagctcaccaccagctgcttcttcctcagttccagcagccaccctcctcgccgccggcctacttcgatcacctcgcattcggcggcggcggcggcgtcatcaccggcagcagctgcaacgacgacaatagctcgatcgccggcgatgtcatggtggctgcaggtggtgacagtgtcagcttcgggcttacctcggaaggctccgtgaccatgcacgccggcgacgtcggacggcgccggctcactagggacttcctcggcgtcgatcacgacgccggcgaggtcgacgagctcgagcttgatgagctgccggctgatctgtccaccaccgccgccgcctgccagggttgcaacttcgccgccgccaccaccgccgcctgctgcgccaccgacttcaccaccggcagcaggcagtacctcggccggctgccgccggtgaacgagacgtggagccacaacttctaa

SEQ ID NO: 6510 - DNA, 1694 bp, Oryza sativa
  Predicted polypeptide sequence is orthologous to G3067
ggcgtcctcctcctgtgccgccgcgctctctctctctctcgcttcggatgccgctattgctgctgctgcgcctgtggctgccataagtatatcgcactccacggtgaccgaccgaccgacgcagtcgtcacgggcgcggcagatagctggctagtggctagcaccgcgcgtcgagacgggatgggcgagaggaggcgccgtgccagcgctgtcgccggcggccgggctgaggatgagaaggctgcttcggcgcctgcggccgcggccccggcaccgacggtgtggttcgcgctgaagaggtcgctgcactgccggtccgagccgtcggaggtgcacgtgccgaggcccaaggccgtcgccgccgccgctgcgggcggtggcgggcacctctcggcgattgtgaccaagcgcgcggcgccgcggtcgggttgctcccggtcgatagccaacctgcgggacgtcatccacgggagcaagcgccacccggagcggccgccgagctgcagcccgaggtccatcggcagcagcgagttcttgaaccccatcgcccacgaggtggtgctcagcaccaactcccgctgcgagctcaagatcaccggcttcggtggctgcggcggcctcgcggcggcggcggcggcggggggcggcgtactcgcgtcgccgcacgaggcggacggcgacggcgccgtggtgtcgtcgttcgttggcacgctccggccgggcaccccggggcccggctggagccacggcctgcagtacagcggctcgtgccggggcagcatgcggtgcacgcctccgaggtcgccgaatgtgctgctggacagcagggacgccgccgcggccggggtgaccgctcaccgcgcgtcctgcgaggacgccgtcaagagctttggcaagggcggcggcctaagctgccaccgttgcggtgagcagttcagcaagtgggaggcactggaggcgcaccacctttccaagcatgcagtgacggagctggtggaaggggactcgtcgaggaagatcgtggagatcatctgccggacgagcctgctcaagtcggagagcagctgcgtgcggatcgagcgtgtgttcaaggtgcacaacacgcagcggacgctggcgcgcttcgaggagtaccgtgaggcggtgaagctgaaggcgagcaagctgcccaagaagcacccgcgctgcctcgccgacggcaacgagctgctccgattccacggcgccacgctctcctgcgcgctcggcggcgcggcgggctcctccagcctctgcgcctccgacaagtgcgccgtctgccgcatcatccgccacggattctccgccaagaaggaaggcaaggccggcgtcggcgtcttcaccacgtccaccagcggccgcgcctacgagtccatcgaggcctccgccggcgccgtcgtcggtggcgacgacccggcggcgacgcgcaaggcgctgctggtgtgcagggtcatcgccggcagggtgcacaagccgctcgagaacctcaaggagttcgccggacagaccggcttcgactcgctcgccggcaaggtcgggccctactccaacatcgaggagctctacctgctgaacccgagggcgctgctcccgtgcttcgtggtcatctgcaaggcttaactccagagtcatgcattgcaaacgactaattaatcaagtaattaaccattctttcc

SEQ ID NO: 6511 - DNA, 2297 bp, Oryza sativa
  Predicted polypeptide sequence is orthologous to G3067
gcataagaccaaagagcaatttcagaggccagccagtcccaattatttttacctaccagtttactccaagataatgccggcctctagctagctgcatgtgccaatgagacccgttcagtttgaactttgcatccatggaggcagtaatactctctggccagctgaaggtagaagaagaagaaggcaatgatgaggaatgaatgacattagcagttacagacttacagttagcagtgcacagtcattgcagtattcagcaatcggattgtccggcgaggaaggggagtcgccggagaagggggagatgccgacggtgtgggcggcgctcaagaagtcgctcaactgcaaatcgggggattcttgcggcgtgatcgagcgggaggaatctcagggcggcgtcacagccggcaagaagtcgtcgtcgacgtcggcggcggcgctgcgcaggtcggggtgctcgcggtccatcgccaacctgagggacgtgttccacagccagtacggtggcagccggaggcaggaggacgccgtcgccgccgccgccgccggcgaaggcgatgggggatgcggtagcccgaggtcgatagggagcaacgacgtgctgaacccggtgacccacgacgtgctgctcgccgccaggtcggacgcgaagtgcgagctccggatcagcacccccggccgcggcgcgtgggccggcgccggcggcggggtgccgttcccgcacagcccgctcctgctgcggtgcagcaccacccctgtctcgacgaggaagtccccgtccgccatgtcgccgctccgccgcgccgacgacgacgacgacaacgccgaggcgccgtcgcccgctcccgccagggcctcctgcgaggtcggcatccggtgccaccgctgcggcgaccgcttcgccaaccacgacgccctggagtcgcaccaccactctagacacgccgtgaccgagctggtggaaggcgactcgtcgaggaaggtggtggagatcatctgcaaggccgggtgggcgaagacggagaacgcgctgggccgcatcgagcgggtggtgaaggtgcacaacgcggagaggtcggtggcgcggttcgaggagttcagggaggcggtgaaggggaaggcggcgaggctgtccaagaagcacccgcgctgcctcgccgacggcaacgagctcctccggttccacgccacgacgctcgcctgctccctcggcgctggcgactcctccaccctctgcacgtcgggcagctgcagcgtctgccgcatcatccgccacggcttctcggcgaccagagagatcaaggacggcgtcggcgtgttcaccacctccaccagcaagcgcgcgctggaatgcatcgccggagacggagacggcgacgaggcggcgaacgcgggcgtgaggaaggcgctgctggtgtgcagggtggtcgccgggaggatccaccggccgctggagaatctccaggaagtggcggcgcagccggggttcgactccgtcgccggcaaggtgggcgcctacgccagcatcgaggagctctacctgctcaacccgagagctctcctcccttgcttcgtcgtcatctgtaaaccttgatgattccttctgcaaaactgcttttaagaattgaggaatcgaatcattgtttagagtggtgatctgatcccaggaatccatgatcaacgcactgtacgacgctgttcttgatgatttcctcaacatcatactcgaacctgaaccccaaatccctcagccgcttggacgataccaccgacgggtttgaaaggagggtagtgcaaggacagaatctgagcaatctgggccatcggatagctccctccggcgcacagataccgtccatccgcttgctccgtctccatcaagaacacgtgagcgtcgcacacgtcctggatgtgtgccaatggcacacacccgaacctggagtgcacagatgccagcagagaatacagcttcggatcacctgcatatggagatgaacacacaaattgattttcagaacaatgctgttgatcattgcaagattagtacaatctgtacatgattatgtacttgtgtgatggagaatttgtttgcctgtaattggtgagaggaggagctggatgctggtaggcacattcggcgtcaagaacgggccggccactgtcggcagcacgagcgacgccagattgatgccattctccctcgcgaacccgaatgccgcctcctccgtcatcagcttcgacaggatgtaaacctgcaaaatgttcattgatccatggaacactaagtttttcagagg

SEQ ID NO: 6512 - DNA, 619 bp, Oryza sativa
  Predicted polypeptide sequence is orthologous to G3074
aaaaagcctcgttcgtcacgtcggttggcaccctccccgcgccgcgacacgacgcccgactccgactcgccgccggcttctccccttcgccatctctctcgcgatctcgccgcgccctcgccggaggagcgaggaggagatggaggcgaccaagacgcgcggcaccggcaatgcggctgcggcggcggagaagaggagggggcacggatcgacggcgctgttcgtggcggtggactacgccttcctgctcgccttcgccgggttcctctcctacctcgtcgtctcccacctcctcccctccgtcgcctcctcctagatctgctctgttttccctgtttttgttatgtttctttttttttttcgtttgctcgatcggatccgacgcgggtgacgtcacttcagatcgcctcgtcgtcggatgccatgacatctccgatgtgtaattccgtgtaatgggatgagaaaccagagctgcagtttcttggaaatttggcatggatttcagttcttgcttgcttgctcatttgttcttcaattgttcatgtcctggtcccgattggttggcctctggatctgatactgttcttgtcaatgcaaatttctgaatgccattgttgcc

SEQ ID NO: 6513 - DNA, 1049 bp, Oryza sativa
  Predicted polypeptide sequence is orthologous to G3074
gggtggaggagcggaggcggaggcgaacgcgaggaggaagacgaagatgaggaagaagctgggcacccgcttccccgcggcacggatcaaaaagatcatgcaggctgatgaggacgttggcaagattgcactagctgtacctgttttagtatcgagggcccttgaattgtttttgcaagatttaattgaccgaacttacgaaattacactgcaaagtggtgcaaagacattgaattccttccacctaaagcaatgtgtgaggaggtacagttcttttgacttcctaactgaggttgtcaacaaggtaccggacctcggtggcgctgactcatgtggagatgatagagcattacccagaagaagaaaagccttgccaaatggaagtgacccagagaatgaggaatctcgatcaagcaaaatggccgtaagaagtgcaaatatcagtcccagaggacgtgggagaggtcgaggtagagggcgaggacgaccacccaccaagcggaaggaagttggttatgtacaatttgaggatgagagcagcatgtttgctgatcagggcgaagccttaccaggagaggagacggttccagagaccatccatggcaccgagagcgtacctccaagcacacaccctccagcagaagccccatcggcagcagagataccagctccaaatccaaaggtggaagaagcgaaaaacgacgaccatcagccggattggcctatgccagatgcgattgggaacatcggtgtcggaccatccggttttggacatcttacggtgcaagttgacgaggatgaggactacgacaacgaggattagccacggccatcttctgattgttatgcactaacagggcagttctcctggtgttgtaaaatgtaaatatgtagctgcagctagctgtgatgtgctgctgatgtaatgcagtatgtagttgtcccgtgtaactttgtctgttttccaataattgcttgctagttgcctcacattgttgacatgattgactactgaagtgttttgtcagaattaacccggtattgaagcc

SEQ ID NO: 6514 - DNA, 1210 bp, Oryza sativa
  Predicted polypeptide sequence is orthologous to G3074
ggatgtcctcctccgctccggccccctcatcgatcgagctcgcagccgccgtgttccccgccggggaaggtcgtccttgccgttgggtggtgttcccggcgctggattgacgccatgaggaagaagctggacacccgcttccccgcgcctcggattaagaaaatcatgcaagcagatgaagatgttggcaagattgctttagctgtacctgttctagtgtcaaaagcattggaattatttctgcaagacttgtgtaataggacatatgacattacagtgcaaagaggggtcaagactctgagttcttcccatttgaaacagtgcatacatagttataatgtttacgatttcttgagggatgtcgtcagtaaagttccagacatgggtacatctgatgctggtgttgatgataaacttggcaaaaggaggaaaactgctgaagatgacagtgaagaggaatcaaagcggacaagaaatgaggcagcaagccagacaagcactggtagagggcgtgggaggggtcggggaagaggccgacgtggtgggcgtgtgtctgagagggagattatttccgcttacgaaaaatttgaggagaaccatgagtttcctccaggtcaatttagcaagccttctcagctgaaggtagatgtttcagttgatggtacagatgcaattgaaacaaaggaggctaccccattaagcaacgcaagagcttctctaaggaacattgacttaaacatagagcttactgactatgatgatgagggttcagctccactggaggtccagcctccagctccggcagcaggtgtggttacaacctcttcaggaccacttgtttcggaggtgaacgaagaggcgaagaccaaagactttctaggatggcaattgcctgagctgaccaagatggccatggaccctgttcagtttgccttgtcttcaaaccataggttagaggaggatgaggattatgacaacgaagaatgataacttgccccttttaggttaagaagctgatagatagacatgacttttgtcttttgtacatccttgtagcccagcttaactctgtagctgatcttgtataatgtgtgtacctgctgaagctgcagtagtttaggatgttacagaggtttatcgatcgatagctagcaactatgttgacagacagattcatcagttgtacatcctatctgatctccagtttatg

SEQ ID NO: 6515 - DNA, 1475 bp, Oryza sativa
  Predicted polypeptide sequence is orthologous to G3075
gattgagtttcagcatcagcgcccccaaaccaaataattttgaactctccggactccggccgccgccttccagaggaacctcgcggctgccggtgccggtgccggagaagacatggccgggaagaagaaggccctaacaaatcccgcctctccctccgcctccgcctccgcttccacccctaagaaatccaccgccacctccaaggaccgctccacgccgaaaccccgcaaaaaccccaaccccaaggaggaggcaccaccgccgccgcccgccaacaacaagcgcctcaacccccaagggggatccaaccgtaagaagaaggccgatgcggggacgccctccaagaagccgaagcgccagccgccggagcccaaacctcggaagcacaagggggccaagagcgagaagccgcaccgggtttccggcgaaggggagaagcccacgcccacgaagaagaagaagaagaaggagagcagcaaggagcccaagcgcgagaagcagcaagcgtccgcgcctatgtcgactccctcgaagaagaacaaggaagccaaacgcgacacaggaggagcggggaagcccacgcccaccaagaggaagctcggcgacgtggatcccccacaggagcgaccgtccggtgaaggccaggcaagctctcccacgcccgccaagaagcggaaggacaaggcggcggcggcggaggcggttgccgaccacggcgccggcagcttcccgatggctcgggtgcggcagataatgcgggccgaggacgccaccatccgcccctccaatgaggctgtcttcctcatcaacaaggccaccgagatattcttgaagaggtttgcagacgatgcttatcgaaatgctttgaaggatcggaagaagtcaattgtgtatgataacctttcaacagcagtgtgcaaccagaaaagatacaagtttctctcagattttgttccacagaaagttacagctgaagatgctttgaaggctccagttagcagccaagtgaaccaaccacaataagttgctagtgctccgcgagggaggtcatcctttcacgagttatctcctgggagggttctgcaattgtaaacgccagctgtgcagctcatgttgccctcaggactggcatcttgcgacatgttcaatatgattctgatcagaatcggaggcttaaaagaagattataaggggaaacctgagtaatctacatatgaaagaagcatgatgaaactttttgtcatgagaatcacttgaaatatgcttgcttagagcctcaaatcaggatcacctttttggctgtgtaagctgtgggttgtgtgaggtggatgtagcttaggctaaatgttactgtgtatttttttttagataatacgttactagtagtatacatttgtgagttctgacttgttcatgtactagttcattacatatattttcgcaggtgcatgctttaccaattacttgctggtgc

SEQ ID NO: 6516 - DNA, 834 bp, Oryza sativa
  Predicted polypeptide sequence is orthologous to G3076
atgcgaacccccgcggcgccgtgcgcgcgcgcgtgtccgccgcacgccaagaaaccgcgcccgatttatgccggcccagggtgggaggggcaaagaatgccggcgtcgtacctgcagccgcgccgcgggacgaacgggcggcgtattatggagcacggcgcgggcgaggagatggtggcgttctacgaggcgtgggtggggcgcgaggagcggatcgtcgcggacctcacggacgcgctcctcccggcgcggcggcggcgggacgtgctcgccccgctcgtggacgccgcggtgggccacgtgtcggagtactacgagcgcaaggcccgcctcgccgaccgcgacgtggtggcggcgctggacccgcgctggctcaacccgctcgagcgcaccttcctctgggcgtggggctggaagcccgcgctggtgttccgcttcgcggacggcgccgtcgccggcggctcgtcgcaccagcagcagcgccgcgcgctggagcgcgtgcgcgccgccaccgcggaggccgagcgggaggtggaccgggaggtggcggtcgtgcaggagtcgctcgccggaccccgcgtgctggcggcgctgcggaggcagcacccgcggaacggcgaggccgacgaggccgtcgccgcggtcgggcgctcgctccgcgtgctgctcgccgcggccgacgcgctccgcgagcgcacggtgcgggacgtcgtcgggacgctcgcgccagaccaggccggcgcgttcctcgcggccatgctgaggttccacctcggcgtgcaccgcgccggccgcaactggggctccggcaacggcggccggcggggcctctag

SEQ ID NO: 6517 - DNA, 381 bp, Oryza sativa
  misc_feature (79)..(79): n is a, c, g, or t
  Predicted polypeptide sequence is orthologous to G3076
gtataactggtgctccttcaacttctcgagtaccagacggagatgctgctcatgttcttcttcagactttgagtagatnagtatatcgtcgatgaataccacaacaaacttgtccagaaactccatgaacactttgttcactagattcatgaagaatgcgggtgcgttggtgagtccgaaagacataaccgtgcactcatataacccgtaccgagtggtgaaggccgtctttgggatatcctcttcccggatccttaactggtgatagcctgatcgcaggtctatcttggagaacaccttagctcccttcagttgatcaaacaaatcatcaatccgcggtaaaggatatttattcttgatcgtgacctcattgagtgcgcg

SEQ ID NO: 6518 - DNA, 1336 bp, Oryza sativa
  Predicted polypeptide sequence is orthologous to G3083
ctccaccacaggttcagctcgcctcctcccgtagccaacttccacgcagagatcgccaaccaccatgccgccgccgtcgccgcacccacctcaccgcaacggcaaccacgtcccggcgccctccggcgagtcgttcgccaagttcttcgagtgctggatctccgagcagtcccgcgacctcgccgcgctccgctccgccgcgtcggcggcgacgaaccccgcggcgccgcccgacgacgccgagctccaccgcctcgtcaaccgggtcctcggccactacgagcactactaccggaccaagtccgccgccgcctccaccgacgtgctccgcatgttctccccgtcgtggacctccaccaccgagaacctctacctctggtgcagcggatggcgccccactgccgcgctccacctgctctactccaagtccggcgcgcagctcgagacccagctcccggtgttcctcgccggcggcggcctcggggcgggcgacctcggcgacctctccgccgagcagctccaggccgccgaccagcttcagcggataaccgtcagcaaggaacgggagatcgagaacgccgccgcgagtgcacaggtgagtgatggttaatttgttctttcatcagtgaggtgagctcgatcagcatccggatgcaaacgtgaacaatgcaggagtcgttggcgacggtgaagatggtggagctagccggaggcggcgggatggacgcggaggggatggagatggagatgaggagcaaggcggacgggatgaggcgcgtgctggagatggcagacgggctgaggctggagacgatgagggaggtggtggcgctgctccgcccgtcgcaggccgtgcacttcctcatcgccgccgccgagctccacctcgccgtgcacgagttcggcaggcgcaaggacggcgacggcgccgcgtcgccgccgccggcgtgacgcgtgcgcgctcgtgtcgtgtcgttgccgttccaagtgcgcggcgtggtctccgatgcgtaggctcgtcgtctagctctggtcaactcaagtcgtcgcgataagctttgaccgatatttatttatgcagtactcgtacactagtatttctctctctctctcttttttttctgcgatgaagccgatgatacctgtagggttttttttttctttcttttttgcgtttgcatgtgatggaattttactaccgtactttggagcagctgtttctatatagacagtgagctaacctgcgtgatatttctaatcaattcgggaagggaaggataaaattgttttttgttgctatgtgttcgaatcttaatgttaatcacaccgcttaacc

SEQ ID NO: 6519 - DNA, 512 bp, Oryza sativa
  Predicted polypeptide sequence is orthologous to G3083
cctcagcccgtcgcagctggcgcagatcgacgacctccagcgccggaccgtcgccgaggaggacgggctgtcgcgggagatggcgctggtgcaggagggccacggcgcggtcgccgtcggcggcgggatcgacgtcgacgggatagtgggccgggtgcggggcgtgctcggccgcgccgacgcgctccggctgcgcaccgtgaagcgcgcggtggagatcctcgagccggcgcaggcggccgagctgctcgtcgccgccgccgacatggagatcggcttccgggagttcgggctcaagtacagctcggcccgcagcgactagcgcttccaccccgcggcccagcttacaggcccagtttttttctccaatactgttggttttactgggccgaaaaagccataaaatcttagtgagtggtgtgctgggacgtggctgggcaggactagccctctgttaagagaaaaaatgtaataaaatgcaagcaactatgatcgttttttgctgtgcacaa

SEQ ID NO: 6520 - DNA, 1039 bp, Oryza sativa
  Predicted polypeptide sequence is orthologous to G3091
cgaccacaagtcggcgggggcgagaagagcagcgtggtgcacagcttcaccccgtccacgcctccggcgaccgccaacagctaccgcaccggcaagcgtcgcaagggcgtcccgcaccggtcgccgttcggcagcctcatggtggagttctaaagcagggcagaagcaatgggggcatgccggtctcgcccccgaaacagtggtacactgtagcatacacatatccatatctatctctatagttatagcatacatagccagtgaaaaggaggagcttagtaataacaagattcttcattgcactcttgtgcttttggatgaggaggccgggtgctaatgcaatgtttgacatttactttattttttcagttaatgtggtagtgaccgccgtttttttttattttttctcattttcgtctgctctccttccgctcgtactttattttaagttaataccgcccccctatatttttcgcccgctcttctcttctcttatctgtgtctcacttgtttcagtgtgttttatttttccgctgtcacttcgttcttttctttctgcgattgtacccacttttctttctgattacaacactccaacctaatacttatcttacttcgtgtacgtggttgttgctttttatcttatcgataatacctcttgctgtcttcttttgtgagttcagaatgttactgttctttttttacattgtctcatcttcatatattatgtctttatatgcattgtttcttttctgtttcttatatgtttttgcatctttttttttatgtttttgttttttaatatgttgtattcccctctcttcttccactccataatcatttctctttaccttaatttttgtatcttttttacttttatattattctgttttttccatttcttccactttcatcatcactgttatttttactgtagtgtttcttttgtgtatgtttgtacgtcgagcaatctactatttacgcgacttttttctatattttctaataggtacagccatagatccgtttattggtgtgg

SEQ ID NO: 6521 - DNA, 475 bp, Oryza sativa
  Predicted polypeptide sequence is orthologous to G3091
tcacaggatctacacttattgatcatctcactacggtcccgatcacaacttctgatcgagttcgccacccctgtggactttgcatatgttgatggatggtgcgtatgaatccagggggcagagccctgccctgcgaccttggggcttgtcaacgagcatacagtataatattttgctgttctttcagtgattaaaaacgaaaattttaaagaaaaccttgaatgccaattagatctgcccaggttctcaaatttctttagctccgcccctgcttgaatcgatgtcatatgctgcaaattaagtggattggagatgtgcatatgctcgaatgttctcggttatattgtaattgtggggtagcaactttatcttgggtacaccatggaacagggtgaaattgtactaattcttatttgtgtaccattgatatatctcattacttcttgcattctgttaaaaaaaaaaaaaaaaaaaa

SEQ ID NO: 6522 - DNA, 1474 bp, Oryza sativa
  Predicted polypeptide sequence is orthologous to G3091
ggttggtttaccaccaccacccggtgcggttcggtgatagttgcaaacctttctccggtctacaaagacctcagctttcatacctccacttcttctttcttccacaaagcccattccttttcctcccgttcttctcccctcccttctttttccacccactcgaatcctcccttcacattctagttctagctccgcacctttgctgcgcgcgcggatttggttcagggtttggaaatggcaatagacgatgaatcgccgctcagaatcaataccaccagaggcggcgccatgggaggaggaggggagtgcgacggggcggagaaccagcggtggccgccatggctgaagccgctgctggcgacgagcttcttcggccaatgcaagctgcacgcggactcgcacaagagcgagtgcaacatgtactgcctcgactgcatgaacggcgcgctctgctcgcagtgcctctcctaccaccgcgaccaccacgccatccagatacggaggtcctcctaccacgacgtgatccgggtgtcggagatacagaaagtgctggacatcaccggcgtgcagacgtacatcatcaacagcgcgcgcgtcgtgttcctcaacgagcgcccccagccgaggcccggcaagggcgtcaccaacacctgcgaggtctgcgagcgcagcctgctcgacaccttccgcttctgctccctcggctgcaagatcgtcggcacctccggcgactaccgcggccggaagaggcacgccggcggcggcatcaagaagacgaagaagctgcacaagggcgcggcggcggtgccgtcggactcggacgactcctccacgaccacaagcggcgggagcgacaagagcagcgtggtgcagagcttcaccccgtccacgcctccggcgaccgccaacagctaccgcaccggcaagcgtcgcaagggcgtcccgcaccggtcgccgttcggcagcctcatggtggagttctaaagcagggcagaagcaatgccgccatgccggcctcgcccccgaaacagtggtacactgtagcatacacatatccatatctatctctatagttatagcatacatagccagtgaaaaggaggagcttagtaataacaggatcccccattgcacccctgtgcttctggatgaggaggccggtgcaaatgcaatgtgggacagttacttcatagttacagttactgtgctagtaacaacggtttgggtttgggttctctcttgtggaagaggagaggaggtggtagttactccctgtcataactactaagttttgctgaaaccttataggtctttattactcttttagttactctgtgtttgatatggtagatgaacatatatgtatatcacagatggtggggggaatggtagtaggagatggtgctcccggtgttcatattcgtgcttgcctgtaataaagatgagaatgctgctcctgatggccttcaatgtc

SEQ ID NO: 6523 - DNA, 1321 bp, Oryza sativa
  Predicted polypeptide sequence is orthologous to G3091
gtgtgctttctttcgcttcgagcctcttcctctcttttctctcgtctcttccatccacattcttctctctctctcgattgcttcgcactgggaatggcgatagaccatgcgtcccctttctcgctgaagaacagaggcgacatgggaggaagggggtatgaggaggaagaggtggagaaccagcggtggccgccgtggctgaagccgctgctgtcgacgagcttcttcgtgcaatgcaggatccacgccgacgcgcacaagagcgagtgcaacatgtactgcctcgactgcatgaacggcgcgctctgctccctctgcctctcccaccaccgcgaccaccacgccatccagatacggaggtcgtcgtaccacgacgtgatccgggtgtcggagatacagaaggtgctggacatcaccggcgtgcagacgtacatcatcaacagcgcccgcgtggtgttcctcaacgagcgcccccagccgaggcccggcaagggcgtcaccaacacctgcgaggtctgcgagcgcagcctcctcgactccttccgcttctgctccctcggatgcaagattgtgggtacgtccggtggataccgcccaaggaagaagcacggcgggtgcggcggcggcggcggcggcggcgacggtggcaagaagaagaagaagagggcggcgctcaaggacgcgcggtacgagtccgaggactcgtgcacgagcaccagcggcggcagcagcgacaagagcagcgtcgtgcagagcttcacgccgttgaccccgccgccgacctccgccagctaccgcaccggcaacaagcgccgcaagggcgtcccgcaccggtcccccttcggcagcctcatcgtcgagttctagggagtctcgacgcgtccgcgcctgatcaacatagtgtactgtacacatgacatagccaaacacaataaccgtgtgccccggaatggcggcgagccaggcgcttcccttcccggaggccggccggcgtaatgccggagaagggcaagagcagtaagccacgtcacatacatattatagcttgtttgttacttttcagcttcggtttttagttacagttcagttactcctagttagtacccagtcaagtccaagcactgctgggtgcttacgactcggtaacggcaactaagttttgcaaccgtgtaaaaatatagtagcagtagtagtaacctccatattgtagatgtacagagctgtggtggggtaggggacagtcacacagtgggatattcatatgtgcattatattacccatgtaataaaaaaaaaagagttgctgctccaaattaccccgg

SEQ ID NO: 6524 - DNA, 1538 bp, Oryza sativa
  Predicted polypeptide sequence is orthologous to G3091
attgagaaagcaccaaccacaccacactggtctctaccttcctttcttgctttctctcctgctgctggttgcgtctgccggtgccggcattgccattcgtcggcgtcattgatgtcggagggcgcagcagggacgacgaggttgccggagtggctggagacgctgctgtcgacgcgcttcttcctggcgtgcggggcgcacccggcgtcgccgcggaacgagtgcaacatgttctgcctcgactgcccttccccctccccgcccttctgctactactgccgctcccaccgacaccaatcctaccgagtcatccagatacggcgttcttcctaccacgacgtggttcgggtgacggaggtggaggacgtcctcgacatctccggcgtccagacctacgtcatcaacagcgccaaggtcctcttcctcaacgagcgcccccagccacgcggcgccggagccgccgccggcaaggccgccgcctccccctacaactgccagatctgcgcacgcgccctcctcgaccccttccgcttctgctccctcggttgcaagctggtggacaccaagacgggtggtcgcggggccaccgtgcagcccggcgatgcgaccaatgacgatgccgccgccgccggcggcagcagcaagaacggcggcgcacggccgcaggggaggcggcgcaaggggattccccagcgcgccccgttcggttcgtgagtcatcgtcatcaacatcaccaggtaacgcaacgcaaagcaaagaaccaacaattaagaaagcaaaagcattcttggcgaggcaatgccgacaagggagcacgcgaaaagtaagcaacgcaaggcttcttctatctgctactcgcattgctcatcccaacagattccacttcttctctccatccatccatccttcgatcgatcaccaccattaacagatggaggaggaggaagaagaagaagatgatgcgtccaaacaaaagaaaagaaaagatgcgcattgtccatctccaaaaaagaaaacccaaaagcaacccaaccaccgggccaacaccagcaaatcatcctctcctactgtccatctcaacaccattgtaagccaagccaccagaaaacacacatactacacacacacacaccacaccagttaagtttattgccctatacacaagatacatacaccgatactttttacccattcattcattcagtaggtaggtaggagctcatgtccatgtcattagcttagatcaatccctgctaccttgtcgtcttaggcactagcaggagtacatttttagaggatggacttctaatattagtcactattgattcttttcaagattttgttattgattgactgatgatgataccgcctggtaattacattgttacaaaattagctgattcattcccacattgctgttacaccctccatgcatgatcatatatatacaagattccttgttatttaaaaatcattaaatgttgttgtattgtacgtccacattgttactcactacctcaccctgcttaagaataaag

SEQ ID NO: 6525 - DNA, 1190 bp, Oryza sativa
  Predicted polypeptide sequence is orthologous to G3091
atggccatcgaccacgagtcgccgttcaaggagctccgcctcaagaacaggaggatcatgggaggaggagggcctgagccggaggaggaggaggcggtggcgcacggagagcagtggccgcggtggctgagcccgctgctctcggccagcttcttctcgcagtgcaaggtgcacgccgactcgcaccggagcggcgagtgcaacatgttctgcctcgactgcgccgccgacgccgacgccgccgccgccgcgctctgctccctctgcctcgcccacaaccaccgcgaccaccacaccatccagatccggcggtcgtcgtaccacgacgtgatcagggtgtcggacatccagaggttcatggacatcggcggggtgcagacgtacgtcatcaacagcgcccgcgtggtgttcctcaacgagcgcccccagcacaaggccggcaagggcgccgtcgccaacatctgcgaggtctgcagccgcagcctcctcgacaacttccgcttctgctccctcggctgcaaggtcgtcggctgctccccccacgccgccaccgccgccgccaccgccaccgccaccgccgccaggaggaagagactacgccacgcccacgccatggcctccacctccgactccgacaactccacctcccctgccaagaggagcttcacgccgtccaccccgccgccgccgcccaccctgccgcccaagcgccgcaagggcattccacaccgcgcgccattcggcagcctcatcgtcgagtactagccattgccaaccaacagcaacttcacctgcaggaatccagcgcgtgcgcaattgggaatcgcattgcaaagcggccgccacctcgtcggcctttgcccattgccattaccattgttgccttttggtggtgcttctcgaggtggatgccattagctttgcacaaaggaaaggaggaagatgaagaaaaggaagggtacaaaagcactagcttttccattgctaattgctccattaccattactaggaacacattaaaaatacagacaggatatgtatacatctttaattagtgaccaccccctccctctctctcttgtgttcaaccttctatatagtcttttttttttcattttgagatgtttcaaattttagatgtctttgagcagacttgtagctaatactcctagtggattagcagtgatgat

SEQ ID NO: 6526 - DNA, 897 bp, Oryza sativa
  Predicted polypeptide sequence is orthologous to G3094
atgctctcaaaaatgcatatgaaatggttttcctttttagaatggccaagtgccacctttgcctctagcttcataaaaacccagtcctctttggcacagtactatttgctcatgttcgtgaaaatcattgagctctgcaagcttaagggtaaggagaccagggcggagccggaggtttccagcgtcagcaaggcctcggggggcagcagcgagcacatcaacaagctgccaccgccggtgccggtgcaggaggaggaggaggcgccggaatggctggacgtgctgctgcggacgaaattctgggggcagtgcaagcagcactgggacgcgagccgcgcggaggtttgcatcttctgcctccgctgccgccaggtgctctgcccgcgctgcagccatgacgagcccggccaccggctgctcaaggtccgccgctacatgtaccgctccgtcgttctcgccagggacttgcagggcctcaacgttgacgtgtccagggtacagacatacattgtcaatggccaaaagggcgtgcacctgaggcccatgaggaggtccccgcaattcaagcctcacgttggtgtagatatatctcaggatgatttctcaggacctgaagctgagcgtaggcataagcagactctgggaattgtggtggagtcatctcctcaacagagcatcccacaaccatttgatgcctcacctgtgagaaatgaagatgccaccatggttgaagctgagtgtggtcaagttcagacgaatgcgacggagtcggagtcgtcagcggtaggagatgcagatgaggttatacctaaagttactaagttcaatgttgatatccactctttgaggaggcgagttcgcaagcaggcggcaccacagagggcccccttcttctga

SEQ ID NO: 6527 - DNA, 755 bp, Oryza sativa
  misc_feature (722)..(722): n is a, c, g, or t
  Predicted polypeptide sequence is orthologous to G3095
ggactggaacttagcctaagatcaagcttcctattataatttgcaatgaaaggaggagagtcggtgccttcatgggtagaactactgctctcgacgcagttttttactacttgcagtagccatctcatctctccttgcaacgaatgcaacttcttttgcatcgattgccagacaccacaagcatccttttgctattactgtcgtttaagtcatcattcctctcatcatgtaatccagatcagacggtcgtcataccatgatgtggtgaaagtttctgagttggacgatatccttgacataagtgatgtacaaacttatgtgatcaacagctcaagggttgtgtatttgactgagcgtcctcaactacggagttgtggtgtttcaaatacaaagttatcatcatcacaaacttataaatgtgagatttgcagccgtactcttcttgatgatttccggttctgctctcttggttgcaatttcgcagccataaaaagagacaatgagaagaatgtggctcaaaatggtattgcctccaatgcaaatgacgttaagattggcaccaacaatggcagcacaaatgctggaagtgccaatgagatatctagtgatgctaataactaccgcaatgaaataccttcatcaacaagagttattcgtcaccgtcgggaaggggattcctcgccgtgcaccatttttctgaagaaaaggcctcaattggacgntgccgaagaaatcaataaatgggacatgtagca

SEQ ID NO: 6528 - DNA, 1762 bp, Oryza sativa
  Predicted polypeptide sequence is orthologous to G3095
gaatatctacggacacatccatccattttttttccctcctcttctcatcaatcaacttcttctttcttcgtgttcttcagctctgctagctactaaccctcggagcagcttcgatagctagcttagctgcttgaattggtgtttgtttcaactctctgaagctctctggaagaacgggcggcggcggcggggtatatcatgacgtggtgcaggtgatggtggggatgatggagacgagcccggacgacggcggtggcggcgaggcgatggcggcggcgcagcagacggaggaggacatggggccaccgtggctgcggccgctgctgtcgacgagcttctttgtggcgtgcgcgtcgcacccggagctgagcaagaacgagtgcaacctcttctgcctcggctgcaccggcgacgccctctgcgcctactgcctccccgcccaccgcgaccaccacgtcgtccagattcggaggtcgtcgtaccacaacgtgatcagggtgtcggaggtggggaagctgatcgacatatcgcacgtgcagacgtacgtgatcaacagcgccaagatcgtgttcctcaacggccgcccgcaggcgaggcccgggaagggcgtcaccaacacctgcgagatctgctgccgcagcctccccgactccttccgcttctgctccctcggctgcaagctgggaggaatgcggtgggacccaagcctgacattcgccatccggccgaagcgcgggcaggactccggcgacggcggctccggctccgactacgactccttcagccccaagaaggcgaggagggcggcggccggctacgatcagctcggccggttcgaccggggcatgatccggtggtccgacgacgagggcagcaagtccaacacggcgccgatcacgccgaccacgccgccgatcagccggtgccggccgtcgaggaggaagggcatcccccaccgtgcacccttctacggttagctcacacactacaccaaccaaaaaaaaaattatcacccatcaccagcatatactagtctgtccttaaaaaaagcaaactctagctacgattctagacatatcgtagctaggattgtaattttttttggacggaaggggtatatcactagctcttcagccaaagtgaccaaacctagctatcaccagttcactgctagtactagctagccacatatatgtacatgatcaagtgtcaggtctgaaatagtgaagtgatatccaatcagctactgttaggtcactagctagatatgatatgttgattagcagctagcctgatacatatagttgtataaaatatacaagtgtacacaataattaatctaggtcatgaagtaagtatatatgtgtacatatgaaatatattggcaaatgttgtcatctggagtaagttataaaggccatggtggtgatggcctgctttcatgcatgtagacacaaggttaagttaagacaagaaaaagggagacacagggaggatagaaacataggtagtggtttttaggtaggtcgagattaatatgtgaaaaaggaataagcatcatgtatttatctcggtttgtgtagtagtatatacttggctgtttgcccccaccacccaatgcgtttattagcgttgtggtgtgtagttttccacttttaagtttcagagtttctcctttgatcctctgggacttaatttgtatagacaatgtatgatgttttacttggaaaaataagggaaaaaatagaatgatggatgactt

SEQ ID NO: 6529 - DNA, 681 bp, Oryza sativa
  Predicted polypeptide sequence is orthologous to G3095
atgaagggagaatttgtgcctccatggttagagctcttgctttccacacagttttttaacacctgcactagccatcacaactcccctcgcaatgaatgcaacctgttttgcatcgattgccaagcaccagaagctgccttttgctattactgtcgttcatgtcatcattcttctcatcgtgtaatccagattaggcgatcatcataccacgacgtggtaaaagtatctgagttagaggatatccttgatatcagcgatgtacaaacctatgtaatcaacagtgcaagggttgtgtttttgaatgagcgacctcagctacgtggttgtggtgttttggcaataaaatcatcgccatcctcattgtcctcttataattgtgagacttgtagccgtgttcttcttgatgcattccgcttctgctcacttggttgcaatctcataggcataaaaaatgatgtggagacagttgtagctaacgatggtattgcccacaatgataaagacatagagattgatggcagcaatggtactgcaaacaccaatggtactggaaagggcatagagatttgtggcaacaacggttctcaagcggacggagtttcagaggcacctgctcattccgatcatccgttcgcgcgggatgaacagaaccgaggaaacagagagacaacgcaggaatag

SEQ ID NO: 6530 - DNA, 1058 bp, Oryza sativa
  Predicted polypeptide sequence is orthologous to G3111
attgaacctaatcgccatggaggcattatcttaatcatgaggattacaaagaaaatgtatataccattagcgaacctggcgcgcccacgaaagctacctgcatccaacctgccttagttgcagcttgcctctgctctctgctctagctgctatccgtttctgtctcggacaggacgagcttaaagctgcgtcgcccatgtcgccgttgctcagtgacaagtgtcgtcgcgcacgcgcagcgatgtcgtcgtcgccggcgccggtggagtccccgtggctgacgatgcgcgccatgcggcgcgttggcggcgcggacggcggcggcgggcagcggagcgcgctgatggtggcgtcgtacccggtgctgctgctgctcgtcgtcctcgccgcgttcgtcaagtacgtgtggatcgcgctggcgctctacagcgcgctcctgctgctgttctcgtgcgcgtcgcgccgcctggcgctggcggagcggctgccgtcgccgctgggaggaggcggaggaggaggaggagtcgccgcggtcaccgcggcggaggagctccagggcgcggcggcgcggggcggggtgtccggggagacgctggcgtccatcccggcgttcgcgtacgacgcgtccgcgcacggcggcggcggcgaggcggcggcgcagtgcgcggtgtgcctggaggcgctgcgcggcggcgagacggcgcgccggctgccgtcgtgcgcgcacacgttccacgtcgcgtgcatcgacatgtggctgggctcgcacgccacctgtcccgtctgccggcgccgcgtcgagcgcaagcacaagggcggcgtgctgccgccgatgccgccggagccggagacggagccgccggtgtagctcgtcgtacttcctgtgtcttcctcctagtgatgcagaagattgcagaatggcagacaaaatttgtcaaatttgtactacatgtttagattagaggtacaataggccagtttttcttgccactctgcttattctgctgtttgtagatgctaacgcgactcatctttgtgaaatctgaagcctgtcgcat

SEQ ID NO: 6531 - DNA, 931 bp, Oryza sativa
  Predicted polypeptide sequence is orthologous to G3111
attgccttctccatttttcaccatttttaggtcagtgtattgcttaactggcccctcgtcggcacagtggttggcagtgctctcagtctcaccttcacctaccatgcgtcacttgctgcagtcgtcggagcacctgaccgccgcgacggcgacggcggcggcgtcgggcggccggggcgtccacacggacacgttcctcatcctcgccgccgtgctctgcttcctgctctgcgtcgtcgggctggcgctggtggcgcggtgctcgcggctgtgcaacccgtcgtcgttcgccgtcgaggcggaggaggcaatgcccccggcgccatgcaaggggctcaagaggaaggcgctgctgtcgctgccgaccgtgtcgttcgccgaggcggcggcggcggaggaggaggaggagcggccggagtgcgccatctgcctcgccgagttcgcgcgcggcgacgaggtccgcgtgctcccgccgtgcggccacggcttccacgccgcctgcgtcgacgtctggctcgtgtccacctccacctgcccctcctgccgccgcgccatcgtcgtcctcgcggcgccgtcgcctgcagtcaccgccgccgccaccgaccccccgccgccgtgctgcgccgccgacgcggcacaggcgtcgtcacagccaccgcaacccaccggcgccagcgaccgcggcggctgccggacatcggtgccgtagagctccagctctctctcgctcgcgtacgtgcatcattcgattgtacatacacacacacctagcaaaaacgtgaatagtagatacgtgttccgagagattttttcttgtactacgcagcaatgcaactgtagtagatacatgtgttctgtaaatacatgcatgtacacatctctgttaattaaccatcattttcccttctttttcgaacgataattaaccgtc

SEQ ID NO: 6532 - DNA, 563 bp, Oryza sativa
  Predicted polypeptide sequence is orthologous to G3111
aagcagagcaaactcattcactccgatagattgattgatttgtcagtccgaggccgaggcggctccatccaagtcgagcagaaaagaatgcgagttctcgtccactccgccgagtccccggcaacaccggcggcggccatctccatcgactcggacatggtggtcatcctggcctccctcctctgcgccctcatctgcgtcgccggcctggccctcgtggcccgctgtgcctgccgccgccgaggcgccgctaccaccaccaccaccactactactacaccggctgctacatcccctgcacccaaaggcctgaagaagaaagccatcgacgcgctccccaccgtgtccttcgcactcaagcagcagcagcagcaggcggagtgcgccatctgcctggctgagttcgccggggggggaggagctacgcttgctgccgcactgcggccacgccttccacgtctcctgcatcgatacgtggctggggacccacgccacctgcccctcctgccgcgccaccgtcgggactagtacattattcctccctctccccggccgctgccgga

SEQ ID NO: 6533 - DNA, 768 bp, Oryza sativa
  Predicted polypeptide sequence is orthologous to G3111
atgctccggccgccgacgccgacgcggcgcctcctccagagcgtcggcggtgggagcaaccccaaccgcatccctggcatcccgcccgccgatcccccctccggcggcgtcagctccgatgtcgtcgtcatcctcgccgccctcctctgcgccctcatctgcgtcgtcggcctcgccgccgtcgcccgctgcgcccgtaaccgccgcaacagcggcggagccggcgccggcgccggctccgcctccccgtcgcacagcccggcccacgcggggcacttcggcggaggagggagcggaggtggcggcgtaacgacgacgacggcggcgacgaccgccgccaaggggctgaagaagaaggcgctgaaggcgctgccgaagctggcgtacgcggacgcggtggcggcggcggcggcggcgaggggcacggtggtgggggaggaggaggaggggaaggtggaggtgctcgccgagtgcgccatctgcctttccgagttcggcgagcgggaggaggtccgcgtgatgccgcagtgcggccatggcttccacgtcgcctgcgtcgacacctggctccgatccaactcctcctgcccctcctgccgccgccccatcgtcctcgacgacccctcgccgcccaagcgctgccgcaagtgcgaggccatagtcctcgaggccgtcgtcgccgcctcctcctcctcctcctcctccgccgccaccgccaccggcagcggcggaggcggcggcggtggcggtggccgattcttgccgtag

SEQ ID NO: 6534 - DNA, 4252 bp, Oryza sativa
  Predicted polypeptide sequence is orthologous to G3967
accgagccgtttctctccctctctctctcctcctccttcccctgcgcctcctccaccgcccgtgtcgccgccgcgcgcgtctatcccctcgccgccgccgccgtctacgccgcgtgaggtcaggattggttgaaaggctgatcgagtgtagagactctgaagctcatatggttggcattggttgatatgatagcgtgtcacgttgtgagatgcagacccccgttatgggggttgattgaatgaagtggatagcactcttataactttcttgctcgaagtttcttgataccaaggcaagtagcttataagaagatttggactttggtggcataaatggatgaactaactggcggcttcaacgtggtgttgattacagtttcttgggcaggctcttgagctaccaagtatgtcagcttcaaatgagaagtggattgatgggctccagttctcatcactgttctggcccccaccacaggattcacaacaaaaacaggcacaaattctggcctatgttgagtactttggccagtttacagctgacagtgagcaattccctgaagatatagctcagctaattcaaagttgctatccatcaaaagaaaagcgccttgtagatgaagtattagcaacttttgttcttcatcatcctgagcatggccatgcagttgtgcatccgattctgtcacgcatcatagatgggacactcagttatgatagaaatggtttcccgttcatgtccttcatctctttatttagccatacttctgagaaagagtactcggagcagtgggccttggcctgtggagaaattcttagagttctaactcactacaacaggccaatcttcaaagttgatcaccaacatagtgaagcggaatgtagcagcacatctgatcaggcctcatcatgtgagtctatggagaaaagggctaacggttctccaagaaatgaacctgaccggaagccattgaggccactatctccttggatcacagacgtattgcttgctgcacctctgggtattagaagtgactattttagatggtgtggtggagtcatgggaaaatacgcagctggtggagaattgaagcctccaacaactgcttacagccgaggatctgggaagcacccacaacttatgccatccacgcccagatgggctgttgccaatggagctggagttatactaagtgtctgtgatgaggaagtagctcgttatgagacagcaaatttgactgcggcagctgttcctgcacttctattacctccaccgaccacaccattggacgaacatttggttgcggggctccctcctcttgaaccatatgctcgcttgtttcatagatactatgcaattgctactccaagtgctacccaaaggttgctttttggtcttctcgaggcaccaccatcatgggccccagatgcacttgatgcagcagtacagcttgttgaactccttagagcagcggaagattacgattgtggcatgcggcttccaaagaactggatgcatcttcatttcctgcgtgctattggaactgcaatgtcaatgagagctggtatcgctgctgatacgtctgctgctttacttttccgaatactctcccaaccgacattactttttcctccactgagacatgccgaaggagttgaactccatcatgagccactaggtggctatgtatcatcgtacaaaaggcagctggaagttcctgcatctgaagccactattgatgccactgcgcaaggcattgcttccatgctatgtgctcatggtcccgatgttgagtggagaatatgtaccatctgggaggctgcgtatggtttgctacctctgagttcatcagcagttgatttgcctgaaattgttgtagctgctccacttcagccacctactttgtcatggagcctatacttgccattgttgaaagtatttgagtatttacctcgtgggagtccatctgaagcatgccttatgagaatttttgtggcaacagttgaagctatactgagaagaacttttccatcagaaacctctgaacaatccaggaaaccaagaagtcaatctaagaaccttgctgttgctgaactccgaacaatgatacattcactctttgtggagtcctgtgcttcaatggaccttgcgtccagattactatttgtagtattaactgtttgcgtcagtcatcaagctttgcctgggggaagtaaaaggccaactggtagtgataatcattcctctgaggaggtcacaaatgattcgagattaaccaatggaagaaacagatgtaagaagagacaaggaccagttgctacattcgactcatacgttctagcagccgtttgtgccttatcttgtgagctccagctgttcccttttatttccaagaatgggaaccattcaaatctgaaggactccataaagatagtcatacctggaaaaaccactggtatcagtaacgagctacacaatagcattagctcagcgattcttcatactcgtagaatacttggcatcttggaagctctgttctccttgaagccatcatctgttggtacttcatggagttatagttcaaatgagattgttgcagcagctatggttgctgctcatgtttctgagttatttcgtcgatccaggccatgcttaaatgcactgtctgcgctgaagcaatgcaagtgggatgctgagatttctaccagggcatcatccctttaccatttgattgacttgcatggtaaaacagtgacctccattgtgaacaaagctgagcctctagaagctcacctgacccttacaccagtaaaaaaggatgaacctcccattgaggaaaagaacattaactcatcagatggtggtgcattggaaaaaaaggatgcttcaagatcacacaggaaaaatggttttgcaagaccactcttgaaatgtgcagaagatgttatactaaatggtgatgtcgcaagtacttctgggaaagccattgcaagtttacaggtggaagcttctgatttggcaaacttcctcaccatggaccgaaatgggggttacagaggttctcaaactctcctaagatctgtactgtcagagaagcaggagctatgcttctctgttgtctcattgctctggcagaagctcattgcatctcccgaaatgcagatgtctgcagaaagtacatcagctcatcagggttggagaaaggttgtggatgcgctttgtgacattgtttcagcctcaccgaccaaggcttcagctgctatcgttctgcaggccgagaaggacttgcagccctggattgctcgagatgatgagcaaggtcagaagatgtggagagtcaaccagcgaatagttaagctgatagcagagcttatgaggaaccacgatagcccagaagcattggtgatccttgctagtgcttcagatcttcttcttcgagcaactgatggaatgcttgttgatggtgaagcttgtactttaccacaattagagctattggaagtaaccgccagagcagtccatctcatcgtcgaatggggagattcaggtgtatccgtcgctgatggcctctccaatctgctgaagtgccgtctatcaaccaccatccgctgtctttcgcaccccagcgcgcatgtccgtgcactcagcatgtccgtccttcgcgacatcttgaacagcggacaaataaactccagtaagctcatccaaggggaacaccggaatggcatccagagcccaacctaccagtgcttggcagcaagcatcatcaactggcaagccgatgtggagagatgcatagagtgggaagcccacagccgccgcgccaccgggctgacgctcgccttcctcaccgcggcggcgaaggagctcggctgcccactcacttgctgacaaggccacaccatgactgtcactgcaagcagctgctgtaggatcagcgagtaggaaaggatgacttgccggccagtttcctgagatgtgatttaagactgatattagctgatgttcccaagcatgatacggggcttgctcccaagatgtgatttttactttacttttggttaatgtgctaccgctgacattagatgttcaagcatatgaaaactgcttgtgctgtaacttgtatgtctgtaacgtaaaaatctttccatatggtaaccggggaagcagaggtatatccttttctgctgttgtatctatttccagtttcctgctgaacttgcaaatgaatattcagcaatttccgttttgctc

SEQ ID NO: 6535 - DNA, 881 bp, Glycine max
  misc_feature (777)..(777): n is a, c, g, or t
  Predicted polypeptide sequence is orthologous to G28, G22, G1006
ccatcaatttgttatatattcttcattattttcattgtcatgagatacaactattcatattacaaagaaaaaggaaaaaaaaatactatgacaaactatcctcacacttctgcaatgccataagaatggcaagatagtagtaatacatttcatatatatatatatatatatatatattcccttttattattgccacctcgtgtctattgaaaactgccacatatttttgaatcatatatccagctccaaatctgtcaaggagctatctttactccgctttatggctaccgtggatgacaaaggacactataaagaaacatccgacaaatgtttcaatgtttctttagcgtaaccttaattggctcatgatccgagccaattaaatgaggaaaattcagcttagcttttgagccccgcatcttaaatgcagctcgatcataagctaaagctgcatcctcagcggtttcgtaggttccaagccacactctcacaccattcctcttagtgtccctaatctccgccgcatacttcccccacggcctcctccgcacgcctcggtagctcaaccccttctttggaggcgtgcgagtgccacgcgcggctgtagttttactattttgaccctcattttccattttcacagctacactaacattactcacctcatttccattggcggggaaccatccggtggcagcagcatcacgcaaagcaccgtagatgaccatgtcattggtgtcgttctccttcaacggcagctccgcccaattctctgtncagaaaatgttccggaagctagaactccggcagaacgctgctatggacggcaccgatgcagaaacgtcctgaaacggcgtcgttacgggtatctcaaagtgatc

SEQ ID NO: 6536 - DNA, 761 bp, Glycine max
  Predicted polypeptide sequence is orthologous to G28, G22, G1006
atacagtgagcaaagttagctgaaaattaaaacatggtttccgccaccgtggattccgattttgcattcttggaatctgttcaacaatacctacttggacatgattccatcaatctcatgtctgaaacccaccaagctgcatctcatgatccattttcagaccctaataaatgtgatggtgattcagggaacattgctttccgaagtgaggatgcaacggctgtggtagcgcgtgatcatgcgccaccaacatggaagcattacagaggggtgaggcgtagaccgtggggaaagtttgcggccgagattagggatccaaagaagaacggagctagggtttggcttggcacgtatgataccgaagagaaggccgctttggcatatgacaaagccgctttcaaaatgcgaggccaaaaggccaagctgaattttcctcatcttattgattccgacaattccgatgaattgtcggagccagtaatgatgacaacttccaagcgaagtttgttagaaatttcatcaccgtcgtcctcgtgttcagatgatagctcagaatcacaagggacaaagaggaggaagagcctggctgaactactgaataaattagccaagaatagaagccaagtcaaggtggaatgttgaagtggctagaggaatatgcatgttgtacaatttgatcaatcattaatatgagacttcaacgattgtaatgtaatctggtgttcatagaattaatgcaattttgttcccaaaaaaaaaaa

SEQ ID NO: 6537 - DNA, 886 bp, Glycine max
  Predicted polypeptide sequence is orthologous to G481, G482, G485, G1364, G2345
ctgcaaatattatatattatataataatctaaagaaaacactcaaagcaagtgcttctcaccatgacaagctacatggcgaatcacatgcaataaccccaaacacatctctcccttgagttggtcaggcagctaaatatgacatgtataatgtattaataaaaatctaccttagtaccgtaacaaaattctgacactgatgccttctaaacgagaacctaaatattaaatcaccaaaccattgtttccacccattccatgcgtacaagcattcaagggaaataaataagatgcgtagaagcatctaaactattcatggccttgcattgaaggcataaccagatgttgtggttgcacctgcaaaccaatatagttcagcgaaccctgatgaacaagctgagcattttgacctgcaaggccaacttgatctggtctagcagatccatcaccacttctagcagatcctttagtgtcaccctccgcctctctgtacctagccaggtacaccttaagcggctcaatgtagtcttcaaaccctaaagttgccatggcccatagtaaatcgtctccattgattgtctttctcttctccttctggcatttctcactcgcctcgctggtaatgaagctgatgaattcagaaacgcattcttgcattgtgtcttttgcatccttcgcaatcttgccattgggaggcagagccttcttcatgatgcggctgatgttggcaatgggaaggtaccggtcctgctctctagccgcgccggacaacgagccgcgagggctctgctcgccaccactctcgtgactcggactcgccggtgcatccgacatctcacaaaccctacaaattacaatacaaaatatttctgatttccgacagcaac

SEQ ID NO: 6538 - DNA, 940 bp, Glycine max
  misc_feature (1)..(2): n is a, c, g, or t
  misc_feature (61)..(61): n is a, c, g, or t
  misc_feature (922)..(922): n is a, c, g, or t
  misc_feature (940)..(940): n is a, c, g, or t
  Predicted polypeptide sequence is orthologous to G481, G482, G485, G1364, G2345
nnaaggagggggtggggggggatgaggcgctcttctgtgggggcggctgtcgcgccttttnctcctcactcacgggaacaaaagctggagctccaccgcggtggcggccgctctagaactatttttatcccccgggctgcaggaattcgacacgagtctcccagttcatcagcttcatcaccagcgaggcctctgattagtgtcagagagaaaagagaaagactattaacggcgatgatttgctctgggcgatggccactctcggtttcgaggattatatggatcctcttaaaatttacctcactagataccgagagatggagggtgatacgaagggctctgccaaggctggagactcatctgctctgagagatgttcagccaagtcctaatgctcagcttgctcatcaaggttctttctcacaaaatgttacttacccgaattctcagggtcaacatatgatggttccaatgcaaggcccggagtaggtatcaagtttattattgaccctcttgttgtaacgcttgttttctacgccagttaccaagtgctcacggcatattgaatgtctttttatgttatgtgaatactgacaggagatgttggctcttgtgtccgttattcttttgacattaaggttcgtatattatctctggattcgaattattatttgatagctatgattatattgttaatcctagagccctgttgtctgaatccatcatgctgcttgttcaagaccgagatgttaggactgatcgaagcataataccgaatattctctgcctaattcctctcacaatgatcgatgatgaatgctcgaagctctctcatctagagaactaacattactcgaggaggggctcggtactccattcgcttatagggatctattatctcgctactgatctcgtttacacgntcggactgtaaactctgn

SEQ ID NO: 6539 - DNA, 906 bp, Glycine max
  misc_feature (538)..(538): n is a, c, g, or t
  misc_feature (683)..(684): n is a, c, g, or t
  misc_feature (702)..(702): n is a, c, g, or t
  misc_feature (706)..(706): n is a, c, g, or t
  misc_feature (709)..(709): n is a, c, g, or t
  misc_feature (715)..(736): n is a, c, g, or t
  misc_feature (739)..(739): n is a, c, g, or t
  misc_feature (741)..(741): n is a, c, g, or t
  misc_feature (745)..(745): n is a, c, g, or t
  misc_feature (758)..(759): n is a, c, g, or t
  misc_feature (767)..(770): n is a, c, g, or t
  misc_feature (780)..(780): n is a, c, g, or t
  misc_feature (786)..(786): n is a, c, g, or t
  misc_feature (797)..(797): n is a, c, g, or t
  misc_feature (867)..(867): n is a, c, g, or t
  Predicted polypeptide sequence is orthologous to G481, G482, G485, G1364, G2345
acatgatctgctgtagttacccccagcgcgcatttaaccctcactaaagggaacaaaagctggagctccaccgcggtggcggccgctctagaactatgtggatcccccgggctgcaggaattcggcacgagagaaggccttgccggcgaacgcgaagatctcgaaggacgcgaaggagacggtgcaggaatgcgtgtcggagttcatcagcttcataacgggtgaggcgtcggacaagtgccagagggagaagcgcaagaccatcaacggcgacgatcttctctgggccatgacaaccctgggattcgaagagtacgtggagcctctgaagatttacctccagcgcttccgcgagatggagggagagaagaccgtggccgcccgcgactcttctaaggactcggcctccgcctcctcctatcatcagggacacgtgtacggctcccctgcctaccatcatcaagtgcctgggcccacttatcctgcccctggtagacccagatgacgtgctcctctattcgccactccctagactttntatattatattatttaattaaactctcttctccactcaacctttgcaagatcactgggttggttagtcttgttacttgttactgtttctctctatcatacctatactcactcttcctcctcatctattatttacatccaatgcannatctcaaatatttctttntcanaanaaaaannnnnnnnnnnnnnnnnnnnnnaananaaanaaaaaaaaaaaannaaaaaaannnnacaaaaaaanaaaaanaaaatcctggnagcgggggagccggacccaatttcgccctataggagtcgataccgccgtactgtggcgggttttaaacgntgacatgaaaaaccctgcttaccaacttattcccttacc

SEQ ID NO: 6540 - DNA, 929 bp, Glycine max
  Predicted polypeptide sequence is orthologous to G1274, G1275
aggaggcaaaacttttattattaaacagagtacaagagagatactctaatcctaatacaagatacttacttttaagatttgaacaactttacacatggagaatcatgttccttgttacatgaactagcaaaggctgatttttaattgagagatatattaaacgtggaaccaaaaaaaggtatagaaactctcttcaacctattacagcatgaaaataaattatgattgattagacaatgcaatgatacatagcttcccctgctcgatcgaatcttccaagctttttcttggcacataattaagctagggaggtgtaaatgcccaaaagggtttgaagttggtgtcatttgaaagtagtatcagaatgtacgaaggagatggggctgtagtatgtggtaaatgggctctcatgattgtgcacaccttcatatgttgttatcacgtagctgtagtcatctctatccctttccacccttttcttcacactgcatcctccacttgaacatttgtagtagttccttagattgggactgctcttcacggacttcttgccgtacttcctccacttgtatccatcatccatgatctcaagctctgatttggttctaaacgcgatccttggacccactccacctttgttttcattaatcccatttttgcagtttatgttattattcttagaggttgcaccagtactgaatccgtgagtggcatcattgaaggttgctttttcagatgactcggtgctttgtgatgatcgagaatcttgatgatcaacatagtcatcgagcatgagataatcggatagtgcaatctcaggggaagatagagccatattaagagaattatgagcataattattgggataaggaggagagttccaaagtagaaagtcattgctgataactaaatatggtagcgacagcaac

SEQ ID NO: 6541 - DNA, 801 bp, Glycine max
  Predicted polypeptide sequence is orthologous to G1760, G152, G153, G860
gatcacacatatgtatttagaatttatataaaacaacaccagactcacttgtgttatgtttttattgcacaaaatttacaacggcagtcattatgtctgatccttaacagcaattaaatgcttcttgatagataatctcgtaccataaatgcgttgtactgttgaatggaactaatatggttgatgaactacaagatccaactcaaagaagcctgatcattctaaggagaagttgttgctttgttggctggcttggcacaaatgacaacctccctgattactgaacagttttgctaatgcagctgcaatccgagtttcattgctttggttgatggttcactgtatttgtattgagactgtggctgacttagctggagactgatagatgcaagtgaatcatatccatttctgacgttgtaagaaggattggatgccacattttcttcatttgtactccttgcttcataaaccttcttttgtagctctgcattttctttttggatctgctccatcttttgatagagttcaacattttcttgatgaatgatatttcccttttggcgtagttctttaatctcattagttaaaatttgatcctttttcatgcggacaccctttaaactcatctccagttggttttccagattttgtagttctttaatacccaaacccgtaagttcttcccccattaattgccttgtgcttgcatagtcataaagcttcccagtgctggagaacaccatcaatccgacttcagcatcacaaaagattgataattctctagctttcttcagcaatcca

SEQ ID NO: 6542 - DNA, 764 bp, Glycine max
  misc_feature (1)..(1): n is a, c, g, or t
  misc_feature (535)..(535): n is a, c, g, or t
  misc_feature (562)..(562): n is a, c, g, or t
  misc_feature (764)..(764): n is a, c, g, or t
  Predicted polypeptide sequence is orthologous to G1760, G152, G153, G860
naaggatgcagctggtagaagcattacgccaagctctaatacgactcactatagggaaagctggtacgcctgcaggtaccggtccggaattcccgggtcgacccacgcgtccgaaaatgaagaaactagcaaacttgaggatgcaaatattacattccaaatgatatttttcagtcaattctttttccacattcaggcatttctaatggtctatgcaaattatatatctcctaagtaattcatgtgaagattgtaaactcccatgcatatattggcgcaagatatctataataactaccttaatttctgaagctgaactcccaagttgacaaggttcttcttttgatttgttgtatcggtcaattactgatttcatgctggaaaaagtcattcaacaacaaaatgcgtcagatatgtgctctgttgactgtaacattcaacaaaagcaattaggttcatccaatgcagattgtaggaagaaatgtttatacctcaataatcttttatcaattataaacttgttcacatgtcttangaatatgagatttggggatggatgctntaattgatgtagtaattatatccggtctttactgtgtaacttcaaaattactctctctctcttcgagaagggggagtaaattgtgtaatatattagttcatgacaaaaaaaaaaaaaaaaaaaagggcggccgctctagaagatccaagcttacctacgcctgcatgcgacgtcatagccctttttatgggtcaccttaatn

SEQ ID NO: 6543 - DNA, 653 bp, Glycine max
  misc_feature (569)..(569): n is a, c, g, or t
  misc_feature (590)..(593): n is a, c, g, or t
  misc_feature (595)..(595): n is a, c, g, or t
  Predicted polypeptide sequence is orthologous to G1760, G152, G153, G860
aacaccagactcaattgtgttatgtttttattgcacaaaatttacaaaggtaaacattatgtctgatccttaacagcaattgtatgcttcttggtagataatctcgtaccatacatatgttgtactgttgaatggaacaaatgtggttgatgaactacaagatccaactcaaagaagtctgatcattctagggagaagttgttgctttgttggctgcttggtacaaaatgacaacctccccgattactgaacagtttttgctaatgcagctgcaatccgagttttattgctttggctgatggttcactgtattgaggctgtggctgacttagttggagactaataggtgcatgtaaatcatatccatttctgaccttataagaaggattggatgccacattttcttcatttgtactccttgcttcataaaccttcttctgtagctctgcattttctttttggatctgctccatcttttgatagagttcaacattttcttgatgaatgagatttcccttttggcgtagttcttcgatctcattagttaaaatttggtcctttttcatgcngacaccctttaaactcatctnnnntnggttttccagactttgtagttctttaatacccaaacccataagttcttcccccattaa

SEQ ID NO: 6544 - DNA, 903 bp, Glycine max
  misc_feature (15)..(15): n is a, c, g, or t
  misc_feature (41)..(41): n is a, c, g, or t
  misc_feature (579)..(579): n is a, c, g, or t
  misc_feature (667)..(667): n is a, c, g, or t
  Predicted polypeptide sequence is orthologous to G1945, G2155
catgatgagggttangatcggctggttggagaccaccccgngcgcgcatttaaccctcactacagggaacaaaagctggagctccaccgcggtggcggccgctctagaactagtggatcccccgggctgcaggaattcggcacgagcgcacctctccttcacttcttatttttttacaataaccacccaaaccccaatcatactcccactcgggattggttattcttattctaagagataatccaaatccaaaaaaaaacacaatgaaaggagaatacctagagcaacagcaacaacatcctaagagtgaaacaacaccacctagtatgttctcaaagcttcaaccccaacaccatcctttcccacaccaccctttccaactctccgcggaagaagaaaaccgtgttggcgccgccaccaccccaagcaccgttcagaaagcaaactcctccggcggcgacggcgcgactatcgaggttgttcggcgtccgagggggcgtcctcccgggtccaaaaacaaacccaagccacccgttatcataacccgagacccggaacccgctatgagtccatacattntagaagtgtctggtggaaacgacgtcgtggaggccatcgcccagttcagtcgccgcaagaacatgggaatctgcgtgctcaccgattncagaaccgtcgctaacgttacgctccgtcaaccttctactactcccggcacaaccgttacttttcacggcacgttcgatatcctttctgtttccgcaccttccgttcacagcagtcaggcgctgcagcgcagattccaacgccttgctcatctcgctcgcacgaccgaatgagcagatcgtctgaaggactagtgccgccgactgatgaccccagcacagattcatgatagcacct

SEQ ID NO: 6545 - DNA, 919 bp, Glycine max
  misc_feature (1)..(2): n is a, c, g, or t
  misc_feature (14)..(14): n is a, c, g, or t
  misc_feature (25)..(25): n is a, c, g, or t
  misc_feature (521)..(521): n is a, c, g, or t
  misc_feature (725)..(725): n is a, c, g, or t
  misc_feature (735)..(735): n is a, c, g, or t
  misc_feature (919)..(919): n is a, c, g, or t
  Predicted polypeptide sequence is orthologous to G3
nncgctacgccctngtggattacgnctgcgcgcaactaaccctcactaaagggaacaaaagctggagctccaccgcggtggcggccgctctagaactagtggatcccccgggctgcaggctgagtctgaacggaatcccacttaaaagtcgttctccttcctcttcgcagctgttatatagtactattttcatttcatatgtttatgcacctctatatatacatagacacatgtaaatggttgcaaaggaagataagataggtaccagctatcacatagtttatttaatccgttatatgccacctgatatataggcatattagctagttaggtaggtatagtagtttaagttaattcaaccatggaagacagggatcactgttgttccaacaattcaacgatgatcacaacaacaaagaaaagaacgggtagaagaagtccaacatcggataagctcaagaatcaacaccgcgagaagcagtcgatgaaaccttaccgtggaataaggatgcggaagtggnggaagtgggtggcggagatcagagaacccaacaaaaggtcgaggatatgtgtgggttcttacacgacacccgtggccgccgcacgtgcctacgacaccgctgtcttttacctcccgggtcccaccgcgcgccttaacttccccgaactcttgttccaggacgacgaccaggaaggcagtggatcggtgcagcacggcgcagcanggaacatgtncgctgattcatttcgcgaaagccacgcagtccgtcgcagagtcgacgctctccaaaccgcgcttaccacccacgcgccagtacccactctctcaactcaagcccgacttgtacgagtccaaaactcgagaagcttcagatgaataaacaaaatcatatcaatccatataataatttctagtctn

SEQ ID NO: 6546 - DNA, 771 bp, Glycine max
  Predicted polypeptide sequence is orthologous to G3
gggggaaaaatatttgataaatattaaatttataatttatctcccccccccccaggtgggtagagcgctgtagcatcagcacgccaaacgctcaattaaccctcactaaagggaacaaaagctggagctccaccgcggtggcggccgctttagaactagtggatcccccgggctgcaggaattcggcacgagggcggagattagagaacccaataagcgttcgaggatctggctgggttcttacgccacccccgtcgccgccgcacgcgcctatgacaccgccgtcttccacctccgaggcccttccgctcgcctcaacttccccgaattgctgtcccaggacgacgacgtttcgacccaacaacagggcaacatgtccgccgattcaattcgcaaaaaagccacccaagtcggcgccagagtcgacgcgctccaaaccgcgcttcagcaatcctcgtcctcacactccgctaattccagccacgtcagcagctctgacaaaccagacttgaacgagtatcccaaacctgaagattagtaattttcttccaccttcaagattaatattgatccaccaatcacgcgtcctgatgtgacatatatatagggcttcaacttgccctcttcacctatgctaatttgaagaagaagaaaaaaaccttattatatttgtcatatgattatatatatatcttagtagatatgtttcttccaaataaaaaaaaaaaaaactcgagggggggcccggtacccaattcgccctatagtgag

SEQ ID NO: 6547 - DNA, 1539 bp, Glycine max
  Predicted polypeptide sequence is orthologous to G4
attgagccaaagctttgtattttctgcgataattttccattgggtggaagaaagtctcaacctttattcgaaagagcaaggatctgagttgagttgagtgatcatgtgtggtggtgcgattatctccgacttcataccggcaggtcccgccagcggggcgcggcgcgtgaccgccgacatcctgtggccgagtttgaggaagcgcttctcgaagccgctgctggacgatgatttcgaggctgggttcagagaattcaaggatgattcggaaatcgaggatgttgatgacgaggacgatgaagacgaggaggagttgaagaagaagccctttgggttctctcgctccagcaacaaggctgcttctaagcctctctctcgtggagcaacaactgtgaaatctgtggaatcaaaggggcaagctgagaagtgtgccaagagaaagaggaagaaccagtatcgcggaatccgccagcgtccatggggaaagtgggctgctgagattcgcgacccaagaaagggggttcgtgtttggcttggaactttcagcactgctgaagaagctgcaagagcttacgatgctgaagcaaggaggatccgtggcaagaaagccaaggtgaatttccctgatgagccttcaggcgctgcttcctcaaaacgtctcaaggcgaatccagaggctcagccaatgaagaaaaatctgaactctgtgaagccgaaaataaaccagatgttcaattttggtgacaatcttgagggctactacagccctatagatcaggtggaacagaaaccactggttaaccagtatgttaaccgtgccccgtttgctggaaatggagttcaagtctcacctgttactccatctgctgatgttactgcttacttcagctctgagcattcgagcaactcgtttgattattctgaccttggatggggtgaacaagtccccaagacccccgagatctcatccttgctttctgctgctcctttggagggtgctgctgatcaggttcagaagaccaacaactcgcaggatgtggtggctgcacaagatgattctgcaaaaaccctttccgaagagcttgcagacattgaatcccagctcaagttctttgagaccccttcttttcttgatgaagcctgggctgatgctacattggcgtctttgctcggcggagacgcaactcatgacgccgccggaaaccctatgaacctttggagcttcgacgacctgccttccatggcaggagtcttctgaacaccctttatctccccttttatgtaaataaagctacaagaattgtgatcgtgatgttggtgatggagtccacagccaagaaacctgcttaaagcttatgtggagtttattttatcttgtagctaatgcagtagtataggactatatataggtttttattatagggtatccttttgtgaactcaaagacctcgttttcaggggattttctgtttgatgtccttaaggattatcaattatgttatatatggtcttggataaaaataaaaaaaaaaaaaaaaa

SEQ ID NO: 6548 - DNA, 998 bp, Glycine max
  Predicted polypeptide sequence is orthologous to G5, G974
agtagaataatatattttataagatgatgaaattgaagtagattacagcgatgcacttgaaaaacatattaagcggactaattctccctggtcaagcaagaaaaaaaccagctgtgagcaaggtagagagattatacacagaatagtactagccctgcaattgccaaaaactccattgcagtagcagccacctaagagacactaagacctagactagaccatacataataggacacttcacagagaatcccaatcgatctcataagaggggtacttctggagattataattatccgaatcaccttcccactgagcctcgctcacgtcagcaaacgtcagatccgaaagcggcgaagaaccttccgacgaccaggacgcagcttccaccttacaagagttgttgttctccttgtcggaaacaaccttctccgcgagtttggaacgcgacttcctcggaggcttctcggtcttcccctgtttctgcagctcagccaggccttcgcaaatggcctgaagcttggcgtcaacagcggaatgaagaggcttgtactccccgaaatcaccaccgacggaggaaccctggtgtcgcaggtttgggaagttgagcctggcgaagtcacctcggagcttgtacgcggccttgtcgtatgccagagcggcttcctcggcggtgtcgaaggttcccagccacagcctggtccggttcttgggaagtctgatctcagccacccactttccccagtgcctctgtctcacccctctgtaaagcttcgtgggcttcggaggcatgcccgcgtgcttcatggggatgggcttcggcccaaggaagctcagggtgttgctgcgattctgatgctgctgggcctggatctggatttgggcttggatctgagagatctgagatggggttaggtggttcaggcccacaagagatgtgggttgcgcttgcccgaagcaattaagctttgggtgttgctggatacccgtttgagtaagat

SEQ ID NO: 6549 - DNA, 996 bp, Glycine max
  misc_feature (41)..(44): n is a, c, g, or t
  misc_feature (55)..(55): n is a, c, g, or t
  misc_feature (62)..(62): n is a, c, g, or t
  misc_feature (90)..(96): n is a, c, g, or t
  misc_feature (99)..(99): n is a, c, g, or t
  misc_feature (978)..(978): n is a, c, g, or t
  misc_feature (996)..(996): n is a, c, g, or t
  Predicted polypeptide sequence is orthologous to G5, G974
gcgagcgcaaactacggacggacggtccgggggcgcccccnnnnccccagtcccnccaatcncgccaacatacaaaggggggtggggccnnnnnnnccntccggatgtaaggctaccgaagaaccgatatttttctttggctcggaaccttcgacacagccgaggaagccgatttggctcacgacaaagccgtggacaggctccgaggcgacttggcgaggctgaacttcccgaacctgaaaggctcgcgccccggcgaggagtacaagcctatgcaggctgcggtggacgctaagctcgacgcaatctgcgcgaacttggcggaaatgcagaagcaagggaagaacgagaagggtgccaggcggggaagaagtcaagcaaggccgacctggagggaagcccgaacctgaacttaggattccggtgctgctgctcttgctcctgaaagtgagggttctgcggattcttctgctttgtctgatcttacctttgatgtaaccgagccgcaatgggaggatgcttcagcacattgtaattcgcaaaagtttccttcttatgagatcgattgggattctctctgaagactctctgctttttatttttatgtctagtcttgtgggtaattaataatttagttataattaggattgctcttgtggctgctgcaattgagattttgaagattgcagtgctacttgtacgatgtggattatgtcagtctgtcttcttcttgcttctcttcttaaacgcgcgtatcggctactcgatggtcaacatgatgctaatctctctaccttggtcagctggatgttttgttcttgctcgggcatggaagatgactccaggttagagccctgatcatgtttcagtgtccgcccagtaccagtattcgagtgatctaattctatgtgtatctaagaagcttatgtcctctagcgaggctgaatctagactggcctgtgcgtacgtgacaacgangggataggaaaaccgtgn

SEQ ID NO: 6550 - DNA, 953 bp, Glycine max
  misc_feature (1)..(1): n is a, c, g, or t
  misc_feature (533)..(533): n is a, c, g, or t
  misc_feature (736)..(736): n is a, c, g, or t
  misc_feature (780)..(780): n is a, c, g, or t
  misc_feature (833)..(833): n is a, c, g, or t
  misc_feature (843)..(843): n is a, c, g, or t
  misc_feature (845)..(845): n is a, c, g, or t
  Predicted polypeptide sequence is orthologous to G5, G974
naaggactcgatagcgacggtaatacgactcactatagggaatttggccctcgaggccaagaattcaagcggcctccgaagcccacgaagctgtatcggggcgtaaggcagaggcattgggggaagtgggtggcggagatcaggctcccgaagaaccgaaccaggctctggctcggaaccttcgacacggcggaggaagctgctttggcttacgacaaagccgcgtataggctccgaggcgacttcgcgaggctgaacttcccgagcctgaaaggctcgtgccccggggaggagtacaagcctgtgcattccgcggtggacgctaagctcgacgcgatttgcgccaacttggcggaaatgcagaagcaagggaagacggagaaaggtgccaggtcagcgaagaaatcgaagcaaggtccgaaccaggaggccaagcccgaacctcaagcttccgctgaaagtgagggttctgcggattcttctccgctgtctgatcttacctttgatgtaaccgagccgcaatgggaacattntaatttgcagaagtttccttcttatgagatcgattgggattctctctgaacttcgtctttgtttttatgtctagtcttgtggctaataataataataatttaggttagtcttgctaggtggctgctgcaattgagtttttgaagattgcagtgcttcttgtaggatttcgatttttttttttagcatttggttattggctatntggtcaatatgatgtaaatctctctaccttggtcagctgggttntttttttttattattaatatcttgcttggcctgcgagaatgacttctagcctntctacgtgtngnctattgcttgatggtcatcccagtatgtattattatcaaaaaaaagctattcctttagtggggttatctagctggccctgggcgcgtttacacgtgtgactggaaaac

SEQ ID NO: 6551 - DNA, 809 bp, Glycine max
  Predicted polypeptide sequence is orthologous to G8
gaggaaaacagaaacatcgctgtgctagtgcactaaaaatagcatttgcttcaaagatgatgtatccaaacatggggcattatagtttaagcaagagacagcaataaggtgtcgaatctcagtatacaccaatcagtggctgaattataaaaagaatttggaccgaaaacacttttgttttagtttgtctttaatctgtactgcaaaatcagctatggtggtgcctgtgggggcttaacctagtaataatattcagatgcattgcgggtaggcatgctggatgaagtaaaacagagactctggggaattgagttcatagaacttgttggaaagatggcagccgatggaaaggtagctgaaattgagaatcctgatgatgctgcagcagagaacgttggtactggggtagcattgacctggccatgtgtttgccacgcccagttggggagtccgtttgaaggatcaacgccgattctctctgctctttcctgcccattgggaaagaaattaggagacatgccattccataatgaaggacgatcttcagttgcaaccatccttttcaaagatggattaccaattccagaactaacattggtttccatcattgaacttcttccaccatgtgtattgtaagggaaggaggggaactgaagttgcccccaattttctttgggaggtcctggggttgctatgcccaaattgagatcaagattctgactgcctccttcattaatggctgcagatttcagctctccttcataagtacttggctcaaagttggtcactgcttcccttccgacagcaac

SEQ ID NO: 6552 - DNA, 742 bp, Glycine max
  Predicted polypeptide sequence is orthologous to G12, G24, G1277
agggtgttatattaaactcggccgaataattaccaatttaatacgactcactatagggaatttggccctcgaggccaagaattcggcacgagggcttacccagatgacaagcttagtgcgcgagtctctctcccttataacccttcttccacttccgtgtcttttacgagttagatttctcattcgtcatggaacaacacattcactctctctctctttagtgattttttcgatttgattgacaaacacaacgaaccaaagttaactactttagagagagagagagagagagagagagagagagagagatggagagtgaaggaagaagagaaggaggagagagagaaacaacagcagcgacgaggaaggtggagggtgctgagagaagatacaaaggaataaggatgaggaagtggggcaagtgggtcgctgaaattagagaacccaataagcgttcaaggatttggctcggttcctattctacccctgtcgccgccgcacgtgcctacgacacggccgtcttttacctccggggaccctccgcacgcctcaacttcccggagcttctcgtcagagaaggcccggccgccctagtcgccggctgcgacatgtcagcggcttctattaggaagaaggccaccgaggtcggtgctagagtcgatgctcttcagggcacccttcaccaccactacgtgccccccgcggcaacttctcttctgcggggggtgggggtccgggatat

SEQ ID NO: 6553 - DNA, 628 bp, Glycine max
  Predicted polypeptide sequence is orthologous to G15
agttttcctctcatcgtacgaggaaaatgtttaatgtaacagttaacattttaaacatgggcacaagctccctattgtactagctggaaattcacaccctggtttagtaaacaagcattcaaaacaagcttttgccattttgatggaggtaaaaaaacataggattatgcatcggtccaagcagcaaaaattggcatctgaggaatagaaagcgaaggcctgagattggaagatagatccaaagaatccacgtcagccaataatttggacactgttgaaggcattccaaagagcattggcaagcttgtcttatctgggctctcttctcttgagctactcaaacttgtcaccagagaagaaggatttgacaagtgtgttcccatgttactcgattcctcaacttggtgatgaaacatgttatctaaagcagttgacaaggactcagttctactacactcaattctttgtggattctgatcaagctgttgggaggatggatactgaaccatcttccattctgattggcttctgcatcttttctgcatcagaacggtttcttgagtagtacaaggtttttggttaactgtagcctcgcttctagttccatcatccatctctcttttccgct

SEQ ID NO: 6554 - DNA, 906 bp, Glycine max
  misc_feature (1)..(2): n is a, c, g, or t
  misc_feature (25)..(25): n is a, c, g, or t
  misc_feature (519)..(519): n is a, c, g, or t
  misc_feature (576)..(576): n is a, c, g, or t
  Predicted polypeptide sequence is orthologous to G19
nnggagatatcgacaatagagacanctgcagattccgccaagcgcgcaattaaccctcactaaagggaacaaaagctggagctccaccgcggtggcggccgctctagaactagtggatcccccgggctgcaggaattcggcacgaggccgccatacgcatccgcggcgacaaggccaagctcaacttcccggccaccaccatttccgccgccgccgctccgccaccttccaaaaagcaacgctgcctcagccctgacatcatcactgaagaaagcagcagcagcagctcacattccaccactggatccaccggcgaaagcggcggaggaaacgacgaactcgacctgaaacaaattgaatggtttctaggtttggagaatgagctgcctgttagcaacaacattggtgctgagtgggacaacatggatgacctgtggatgctggacgacgtcgttgtgcccaaccgtcacttaatttactagaaggctaataattaataaatggcgttttcttaagttntagttttactttataaattgtagtataaaactatgttggtatttgtgttcttagttntcttctgctgttatgtctcttctctggctatggtaatttctgttttggacggttgaatgatttcaaaaataggtacttaattacaccctatcatgattgggatgatgattatatattatgattatgatgattatatataaattaaaggtggataagttaaaaaaaaaaaaaaaaaaaaaaactgaggggggccccgtacccaattcgcccttagtgagtcgaataacgcgcgctacttgccgtcgtttacaacgcgtgactggaaaaccctgcgtccccactaattgcctgcgaacatccccttcgccagctggtaaaaacagaggccca

SEQ ID NO: 6555 - DNA, 899 bp, Glycine max
  misc_feature (1)..(5): n is a, c, g, or t
  misc_feature (45)..(45): n is a, c, g, or t
  misc_feature (765)..(765): n is a, c, g, or t
  misc_feature (767)..(767): n is a, c, g, or t
  Predicted polypeptide sequence is orthologous to G19
nnnnncccccccccccccccccccccccccccccccccgctgaanggattaccgaagcagcgccgccagctctttacgactcactatagggaaagctggtacgcctgcaggtaccggtccggaattcccgggtcgacccacgcgtccgggctcggcaccttccccaccgccgaggaagccgcccgagcctacgacgacgccgccaagcgcatccgcggcgacaaggccaagctcaacttcccggccaccgctccgccaccctccaaaaaacaacgctgcctcagccctgacaccaccaccgaacaaagcagcaactcacattccaccactgaatccaccggatcgccgccttccgccgccttccacggcggaggagatgaactcgacctgaaacaacttgaacggtttctagggttggacaacatgggtgctgagtgggacaacatggatgacctgtggatgctggacgacgtcattgtgcccaaccgtcacttaatttactagaagggagataattaattaattaataaatggcgttttcttaagttatagttttataaaactatgttggtgtatgtgttcttagttgtctgttttgtcttgtcctctcactgtgataatttctgttttgtacagtcaaattatttcaaaattaagtgcaacatatcatgagaagaatgattatatattatcattatgattataaataaaagccgaattaaggtgtattaacagtaggtcatgcagaaaaagaaaactgtggcncngcgcgtgcgactccagccgcaggctcgttggatatcgtatggcggccgggttcgccgagaaaaaaagaaaaaaaaaaaaaggccgccgctgtgtttcttggttttaaaaaaaagaaaaagtatacttccccc

SEQ ID NO: 6556 - DNA, 776 bp, Glycine max
  Predicted polypeptide sequence is orthologous to G21
gctctcttaccttttatttttatttaactctgtattttacttgaaaaaaagaaaagaaaaaaaaaaggctctaaaattctaatagttctcccaaaaaaatgattcctcaagcctaaagccactatcaactgcacacaaatgccaagaagaaaaagagcaaagtccattgtttccatcagggaaaagatctggaagatcaaacaaagtgtcatcatcattggtagagtgagaacttgaaggctcttgagtgttgtccattgagagagttgaagatgtttcttgttctgcttggttttgttcttgttcttgttcttcagttatttgacaatgcttaaccacctcaaaggcagtgtttgctgcttttgatgctgcagcttgaatgtccttaggagatgtgctagcaggccttggaagttcttgagccaattcagggaaattgaggtatgctgaatggcccttgatggctaaggcagccacatcatgtgctctagctgccatttctgctgtagggtatgttccgagccatattcttgatttctttcttggctcgcgaatttcggacacccatttgccccaattcctcatccttacacccctataagtagggtggtgattctggttgctattgtctctctgcctcttcttgcactcttttgagtcctctttattttctaatgaggtttgagaaatggttgagtcattttgaggggttttggtgtgttctttggtgcatgaatctttgtttgaggttggagatgttgatgatgatgaggagg

SEQ ID NO: 6557 - DNA, 803 bp, Glycine max
  misc_feature (1)..(4): n is a, c, g, or t
  Predicted polypeptide sequence is orthologous to G25
nnnnaaggtgggcggtttgccatgactccgccaagcgcgcaattaaccctcactaaagggaacaaaagctggagctccaccgcggtggcggccgctctagaactagtggatcccccgggctgcaggaattcggcacgaggaagaagcaagcatgtgtggcggagcaatcatcgcagatttcatacctcggcagcgtccccgcaccctcacagcctccgaactctggcccaagcgcagcgaacctcaacctcaacctcctcctcctccagttaagaggcagaggaaaaacctctacagagggatcaggcagcggccctggggcaaatgggccgcggagattcgcgatccacgtaaaggagttcgtgtctggcttggcaccttcaacaccgccgaagaagccgccagagcctacgacaaagaagcccgaaaaatccgcggcaagaaagccaaagtcaatttccccaacgaggacgaccctctgccgcaatacggatcttgcaagagcctcaacttggagttcggttacgatctcaaccaaacagggctgttcccttcttctaacgctgatgagaattgcgggtcccacgtggcttactccgttacggaagccaacaacaaagtagagaagctttccgaggagcttatggcgtacgagaatctaatgaggttttatcagattccggaaaacgtcgttagggatatgtggccttttctgacacctctccacctctttgatgtctgtgccatcggttctctatcattattttccattctgttcttaaatatgatgttgtacatcagga

SEQ ID NO: 6558 - DNA, 874 bp, Glycine max
  Predicted polypeptide sequence is orthologous to G38
gcacttgaaatagaaatttacattagcaaggaaagtagtagaaatttcaataacccgcactagcagggaaacaaagactagataacattatccaaagtaaaatagacacaagaaactagtcatctatcatgcatggcagaatacatttcacatcttacaacatgacaagatatccagctgcattaggtcaattccagaagaatggaacacttctcaaccaagtgaattttacaacagctaatctccaggtactaatagcaagatccattcatcctaagctaatccatccaccgctatgaaggctaagatttctagccgcggccaaatcagtgtatgtggaacatacatcaagacaatgaaagataggaagaactggtccctgattcatcctccccttcctcgtgcttcacacgtttcacacttaaggataaggaaaggtcttccatgtcatcatcctctgctgcgtctccaccagagttgttcggcaatatcatgcactcagaactctctaatatcatcaacgcatgaccggattgactagcagctggagaatttctcgaccggttagcagcagctggagaatttctcgacgattcctcagacaaagttgaaacttgaacgttgggaaagttgaggcgcgcacaggaaccatacattgcccttgctgcttcatcataagcgagagcagcgctaatggcagtgggaaaagtacccaaccagagcctacttcctctgtttggctctcggatttcagcaacccattttccccaagtcctttgcctaactcctctgtagttacagcgtgagttctcgggccctccttttcctttcatacaccctttctttgatcccttggcagggaccttcctagccc

SEQ ID NO: 6559 - DNA, 931 bp, Glycine max
  misc_feature (1)..(4): n is a, c, g, or t
  misc_feature (496)..(496): n is a, c, g, or t
  misc_feature (544)..(544): n is a, c, g, or t
  misc_feature (604)..(604): n is a, c, g, or t
  misc_feature (746)..(747): n is a, c, g, or t
  misc_feature (907)..(907): n is a, c, g, or t
  misc_feature (926)..(926): n is a, c, g, or t
  Predicted polypeptide sequence is orthologous to G38
nnnnggcggcgccgtaggaacgactgcacatttcaccctcactaaagggaacaaaagctggagctccaccgcggtggcggccgctctagaactagtggatcccccgggctgcaggaattcggcacgagggctggtgaaccctaattagttgtcggtgtttgttggaagagcacatctctgttttcttcgtcatcttcccctcccctccccaaccagagatgcgccccgcaacacatatgtactaaagctttcaacttttcagcatcctttcaggcagatgttagcgaaaacccataacaaaggggatggatctaagtccctggctaagatactggcaaaatggaaagaatataatgcccagattgattccagcagtgatgcggataagccagttcgcaaagttcctgccaagggatcgaagaaggggtgcatgaaaggtaaagggggccctgagaactcgcggtgtaactacagaggtgttaggcaaaggacttgnggaaagtgggttgctgaaatccgagagccaaacagaggcaataggctntggctaggtactttccccactgccattggagctgcccttgcatatgatgaagcggccagngcaatgtacggttcctgtgcccgtctcaactttcccaatgttcagtttccagtttctctgaagatcttccaagattcttcgttggaatcattgggtcgtcaatgcagtgtctgcaacgagccatgattcacaagtacctcgnnggggtgcgaagatgatgtgatatgagccatttctatccttactgtaagcatgaaaatggggaggatcgggggtagtcttcctcttcccatgagtcttgaactgctatttttacgctgtctttgtatggtagctagttatcctatgatcctgagatactgngaaataaatgactcgtgcnaaatg

SEQ ID NO: 6560 - DNA, 889 bp, Glycine max
  misc_feature (30)..(31): n is a, c, g, or t
  misc_feature (647)..(647): n is a, c, g, or t
  misc_feature (662)..(662): n is a, c, g, or t
  misc_feature (674)..(674): n is a, c, g, or t
  misc_feature (676)..(676): n is a, c, g, or t
  misc_feature (680)..(680): n is a, c, g, or t
  misc_feature (683)..(685): n is a, c, g, or t
  misc_feature (687)..(690): n is a, c, g, or t
  misc_feature (692)..(692): n is a, c, g, or t
  misc_feature (749)..(749): n is a, c, g, or t
  misc_feature (756)..(756): n is a, c, g, or t
  Predicted polypeptide sequence is orthologous to G43, G46, G1419
gggcgagggtcggtgagcgggccgggcaannatccctcactaaagggaacaaaagctggagctccaccgcggtggcggccgctctagaactagtgtttcccccgggctgcaggattcggcacgagggaggttaagaaatgcaatatttctcctgaaccattggtgtcatcaaaagagaagccaaagaagttagaatacgataaggcaaagcgttataggggagttagaagaaggccttggggaaaatttgctgctgaaatccgtgaccctacaaggaaagggacaagggtttggcttggaacctttgacagtgaaattgatgcagctaaggcctatgattgtgctgctttcaagatgagggggcagaaggctattctgaacttccctcttgaggctggactgtctgatcctaagcctaacagttgtggcaggaaaaggagaagagagagccatgatcatgaattggagctgccacaagtccaagttcatcatggtgtttcctgagaaaaagtgagaagatataataatagatttagttgttttgtgagtagcattaagtttgttgcctagaaaaataaggttgctgtgccttttagtttgtacgtagaagcaaggctaatgtgaaatgtctatatgaatctatgcanaaagcatgttacganagtctactaaananaaanacnnncnnnnancaaaaaaaaaaaaaaaaaaaaaaaactcgaggggggcccgtacccaattcgcctatnagtagtngtttacgcgcgctcactggcggcgttttacacgcttgactggaaaacctgcggtacccactaatcgcctgagacatcccccttcgcagctgctattacgaaaagcccgacgatcgccttcaacgtgggcactg

SEQ ID NO: 6561 - DNA, 890 bp, Glycine max
  misc_feature (1)..(1): n is a, c, g, or t
  misc_feature (49)..(50): n is a, c, g, or t
  misc_feature (59)..(59): n is a, c, g, or t
  Predicted polypeptide sequence is orthologous to G129, G136, G140, G146
naattccaacctcgaacaatatacatggctgagtatggcgacagctggnncgcctgcangtaccggtccggaattcccgggtcgacccattcttccggcacacacaacttgtcacatatcatattttgttcatcaagtttataattccttatctttgaacttacttacatccaagtaaggtctaagctagctggagttgattagatctagctagctagttttcgatctgcttaatttgttttccatgatctcttatatatagtaattttatttccctttaattaattaagaaagagttgaagaagaatgggaagggggaagatcgaaatcaaaaggattgagaacacaacacatcggcaagtgaccttctgcaagagaagaaatgggcttctgaagaaagcttatgagctgtcagtgctgtgtgatgcagaagttgccctcatcgtcttctccagccgtggccgtctctatgagtattccaacaacaacataagatcaacaatagagaggtacaaaaaggcatgttctgatcactcaagcgcgagcactaccacagaaatcaatgctcagtattatcaacaagaatctgcagagctgcgacagcaaatacagatgctgcataattctaacaggcacctgatgggtgatgccttaagcacactgactgtgaatgaacttatgcagttggagaatagacttgaaagatgatcactagtatcagatctacgaacatgagagctactggctgacattgatactccagaacgggacgatgactggatatgaaatcttgctccgactagatactgcctgagagatcacatgtacatgttctggccgactgagcatcagcatagctacgtactttcatcaatagtgcagtggacgtc

SEQ ID NO: 6562 - DNA, 788 bp, Glycine max
  misc_feature (578)..(578): n is a, c, g, or t
  misc_feature (581)..(581): n is a, c, g, or t
  misc_feature (586)..(586): n is a, c, g, or t
  misc_feature (592)..(592): n is a, c, g, or t
  misc_feature (609)..(609): n is a, c, g, or t
  misc_feature (613)..(613): n is a, c, g, or t
  misc_feature (621)..(621): n is a, c, g, or t
  misc_feature (652)..(652): n is a, c, g, or t
  misc_feature (696)..(696): n is a, c, g, or t
  misc_feature (788)..(788): n is a, c, g, or t
  Predicted polypeptide sequence is orthologous to G129, G136, G140
gggagcgctgctagaaggcgccgagcgcgcaattaaccctcactaaagggaacaaaagctggagctccaccgcggtggcggccgctctagaactagtggatcccccgggctgcaggaattcggcacgaggggaaatagagctgcaaaaccataataattttctgagagctaagatagctgaacacgagaaagcacaacaacggcaacaggatatgataccgggaaatgtgtgcgagtcaaccatacctccacaatcatatgaccgcaatttcttccctgttaatctcatagattccaataatcaatattcaaatcaagaccagactgctcttcaacttgtctgataaacgatttgaaattatgccgcagcctttcaagtggtgtgggatcccttacatcgtcctatgtttcgtgaaggagagtgcccttagaaactcctctgctaaagttcttacaacggagaacaagagaaaaactaatcagcatttgtaccaatacatcatttgatattgtttatgtatctttcaatatatatagtttctattcagtcctggcaaaaaaaaaaaaaaaaaaaaganganggggngggggnggggagggggggggaangggngggggagngggagagagaaaagaaagaaaaaaaaaaaanacctccgggggggggcccggccaccaattccccctttgggaggngtaatagcgcccccacatggccttgtttacccaggggggagtggaaaaaagcggggtccccaaattaatgccgttggcgcaaaacccctttn

SEQ ID NO: 6563 - DNA, 733 bp, Glycine max
  Predicted polypeptide sequence is orthologous to G131, G135, G155
tttttttttttttttttttttttttttaactcaacgcttaattagttcagatacgagaccggtctttcagcaacttaactatatatagcaaagcttccacttaagaaagcctagcctggggaccaaattataaacttacaacacacaataaacattaacgtctgcagagtagggaaaaccacaaaacatagaggcatatataagccctcaaatatgttgtcaaatgccataccaaagctatataatatcatccacctcaaagaaagtattcaaaagcatccaaggtgacaggaatataatggttccagagtcaggtcaagttcattcctccctacttctgatgcttcctcacggtaattgccacccatgttcaaaagtggctgcggtagcaagaaagatgcattaactccggggttgggatgctcccattgtgcttgctgcgctgcaaccttttctttctccttgatcttcttggcaagcatgttattctgctcctgtatcactttctccttcttttgaagctccgaaatggactcgtacatgagttggtttctgcgggtacgaatttgcttgagagcagtatctaactgctgctccagactctgaagctctttgaggctcattgaacctaaatcttctcccatatagtgcctatggtttctctgcaaaaggtcaatcttggccttgagtctagtatactcaatggtccaatttccctgtgactcggaatcat

SEQ ID NO: 6564 - DNA, 835 bp, Glycine max
  misc_feature (40)..(44): n is a, c, g, or t
  Predicted polypeptide sequence is orthologous to G131, G155
gtatcattttatatgtagatcatttaatatacctagcagnnnnntatacaatccaggtggtatagtcaccgtcaaatgcctctgatgatgtatatagctagcctttgtacaagtggtattcgtatttaacaagaataggcttctattcatttgtaggaagaggcatcaaagggggaagaatggttttaggtcgacatgaggttggagtttcttcattagatttgacttctggggagcctccaatagtcagggactccagtggttgagttacaaggacagagctcacatccatgttattttgcagtccttcttgctcttgtggggtcagctccttctctttttcctttatcttcttggagagcaagttgttgtgttcacggagtgtcctatcctgcatgatgaaatactaaatcatcatttataccgaaggcagctgatccaaaacttttggtcaatgaaaacaatgtgtgcatattgttactgaaaattaatgttagaaagatatgtatcaattgatattcagcaatttacaattctcacaaaaacaatgattagccagtgttcattctcagaaatttagaaaatagtacattctcaagaaactccttgaaaatgtagagaattaattcataccttttttggttggaacatgtgtgtactagtttcaagccaatcgttcacccttcttttaagggaaggagaaaaagaaacattgttcactatcatttatgcaagggcaagaaagactcacctttttctgaagctcagaaatagattcattcatggcttggttctgcacgttaacacccagaattacaatgacattcaattcatt

SEQ ID NO: 6565 - DNA, 949 bp, Glycine max
  Predicted polypeptide sequence is orthologous to G133
ggaacaagtgaattagctagaagcattgaaggacgtagctgctatggctcgaggaaagatccagatcaagaggatagagaacaccaccaaccgccaggtcacttattctaaacgacggaatggccttttcaagaaggccaacgagctcaccgttctatgcgatgccaaggtttctattattatgttctccagcactgggaaactccacgagtacatcagcccctccacctcaacaaagcagttcttcgatcagtaccagatgactctaggagtcgatctctggaactctcattacgagaatatgcaagagaacttgaagaaactcaaagatgtgaataggaatcttcgtaaggagattaggcagaggatgggagattgtctgaacgatctgggcatggaagatctcaagctccttgaggaagaaatggacaaggccgccaaggttgttcgtgaacgtaagtataaggtgataacaaatcagattgacacccaaaggaaaaagtttaataacgagaaagaagtgcacaacagactcctgcgtgacttggatgcaagagcagaagatccacgttttgcattgatagataatggaggggagtacgagtctgtgatcggattctcaaatttaggtccacgcatgttcgcattgagcctacagccaagccatcctagtgcccaaagcggagcagcaggctctgatcttaccacttaccctttacttttctggtacgcaagcttaagcagctcgatctcttcatcaatcagaaataccacattcactcaaatttcaataagaatatgacttgtgatcgatatcttaagttatgcacccgtacgtgcagtttgtacttaaccacaaaacaatctcacgaatcttctcttctcggtcgatcgcatatatgcatgtgtgaattattcagttgcaaaaaaaaaaaaaaaaaaaaaaaaa

SEQ ID NO: 6566 - DNA, 597 bp, Glycine max
  misc_feature (517)..(517): n is a, c, g, or t
  misc_feature (562)..(566): n is a, c, g, or t
  misc_feature (569)..(576): n is a, c, g, or t
  misc_feature (587)..(589): n is a, c, g, or t
  misc_feature (592)..(596): n is a, c, g, or t
  Predicted polypeptide sequence is orthologous to G135
ggcttttgacaactgaagtatcttacaattcagcaaactaagggaactacactgatctaattcaaagataataatgtaattattgggcctaaagagcctaatgcccaaaaaagaattatacagaatgaatatctatcggaaaaaaaaaaaaactaccaaagcgaaagctaaactaagcagtccacagactcagctacatattttacatcagaagcaatttatgctgaaatgatagaacattcttgtacgaggaggcaatgttgctgcaatgtgccttataatgggcctcaagtgaatcttaatgcatgctcaattacccatacaataaatatcctgttcgaaaccccaccaaataccacaaaaattgcgccatgtaggaatcacaaaacatatacgtccaagacataatcaactgattacaggttgaaataacttcttgaattcgtcataaaaccacctgcaaaggaaaatgggctgcactttagaagtttcctcaattcctaactgacatcgcagnccattttcttggttaaatttatcagatgggaggacttcacatggnnnnngannnnnnnnagccatttcannnctnnnnnc

SEQ ID NO: 6567 - DNA, 931 bp, Glycine max
  Predicted polypeptide sequence is orthologous to G137, G145
gagatgggaaggggaagagtggagttgaagagaattgagaacaagatcaacaggcaagtgacctttgcaaaacgaaggaacgggcttttgaagaaagcttatgagctttccgttctttgtgatgccgaggttgctctcatcatcttctccaatagaggaaagcagtacgagttttgcagcggttcaagcatgctcaaaacgctggagaggtaccagaaatgcaactatggagcgcctgaggacaatgtggcaacaaaggaagccttggtattggagttaagcagtcaacaagaatacttgaggctgaaagcacgttatgaagctctacaacgttctcaaaggaaccttatgggagaagatcttggccctctaagcagcaaagagcttgaatcacttgaaaggcagctagattcgtctttgaagcaaatcagatcaataaggacccaattcatgctggatcagctttctgatctacaacgtaaggaacactttctaggtgagtcaaacagagatctcagacaaaggttggaagagtttcaaataaatccactccaactgaatcccagtgctgaagatatggggtatggacgccatccaggtcagccccaaggccatgctctctttcaaccattggagtgtgagccaaccttacaaattggatatcatcctgatccagtatcagtggtgacagaaggcccaagcatgaataattacatggcaggatggttaccatgaaaagagtgtcaagtgtggagcgtaattaagatcctgccgtttaatttcaaatttatttgaagttaggaaacggaaatttgtaatagcacgtaatggacttacactagactctaccttctaattaagctaggaacaatataagcagtgattttgtgtgtgagctttcataaacagtacctagctagcctcttccttg

SEQ ID NO: 6568 - DNA, 675 bp, Glycine max
  Predicted polypeptide sequence is orthologous to G137
cggcggggggtgtcaggtagtacatcgtagtagacacgccaagcgcgcaattaaccctcactaaagggaacaaaagctggagctccaccgcggtggcggccgctctagaactagtggatcccccgggctgcaggaattcggcacgagaggaaatcaatgtagccctacaaccaacatgggaagctagggagcaaaatgctccctacaattgccaccctccccaaacagagggatattatgagacagcaacagcacattgcagcagtacattgagaattggctatgattcttcaggattaaatgaagcaggaggagctgcaggagcctcagcccaaaatgctagtgaattcatgcatggatggatgaactaaatttatttccaatttagtacttaaattcatgatcatcagaaaaatgatgcttttgtagagatcttggcctacaagaacaggctctaataataggtgtcatgcagcataaaatatacttatgctattcttaatattccaaaaaaaaaaaaaaaaaaaaaaaaaaaaaaaaaaaaaactcgagggggggcccggtacccaattcgccctatagtgagtcgtattacgcgcgctcactggccgtcgttttaaacgtcgggactgggaaaaccctggcgttacccaacttaatcgccttgcagcacat

SEQ ID NO: 6569 - DNA, 927 bp, Glycine max
  misc_feature (1)..(1): n is a, c, g, or t
  misc_feature (653)..(653): n is a, c, g, or t
  misc_feature (668)..(668): n is a, c, g, or t
  misc_feature (699)..(699): n is a, c, g, or t
  misc_feature (704)..(705): n is a, c, g, or t
  misc_feature (712)..(712): n is a, c, g, or t
  misc_feature (714)..(720): n is a, c, g, or t
  misc_feature (723)..(723): n is a, c, g, or t
  misc_feature (835)..(835): n is a, c, g, or t
  Predicted polypeptide sequence is orthologous to G137, G145
naagtgctcagtcggtggcatgagccccgccagcgcgtaattaaccctcactaaagggaacaaaagctggagctccaccgcggtggcggccgctctagaactagtggatcccccgggctgcaggaattcggcacgaggctgatcttcagaataaggagcatatgttggtggaagcaaacagatctttgaccatgaagctggaagaaatcaattcaagaaaccagtataggcaaacatgggaagctggtgagcaaagtatgccatatggaacccaaaatgctcactctcaaggcttcttccagcctttggagtgcaaccccacattgcagataggttctgactacaggtacatccctgaagcctcagagcagcagctagctgccacaactcaagctcaacaagtcaatggatttattcctggatggatgctttgacctaagatctcagtattttagatggctacataaataaaattagcaaacacctaaggccaaagtcaaaatgcctcttgctgttggaaatgtgtaaatgctgttgttcttctgttaatttgttttggcataaaaacagcagtgactgacttaaaactattaaaactttagccatagacataggatgtggcatgaaggttatagtatttaatttgaatattntggaaggacaagttntatctgactgaatgaccagttagtgtcattntttannaaaaaantnnnnnnnaanaaaaaaaaaaaaaaaactcgagggggggcccgtacccaattcgccctatagtgagtgtattacgcgcgctcacttgccgtcgtttacaacgtctgactgggaaaaccctgcngtaccaactaatcgccttgagcacatcccctttcgcagctgcgtaatagcgagagcccgcaccgatcgccttccacagtgcgcacctgattg

SEQ ID NO: 6570 - DNA, 792 bp, Glycine max
  misc_feature (1)..(3): n is a, c, g, or t
  misc_feature (531)..(531): n is a, c, g, or t
  misc_feature (581)..(581): n is a, c, g, or t
  misc_feature (792)..(792): n is a, c, g, or t
  Predicted polypeptide sequence is orthologous to G137
nnnaaggatgatgcgctgcgatgaaccctcactaaagggaacaaaagctggagctccaccgcggtggcggccgctctagatctagtggatcccccgggctgcaggaattcggcacgagcagccattggaatgcaaccctacattgcagattggtcctgattacaggtacaatgatgtagcttcagatcagataactgccacaactcaacctcaacaagtgagtggctttattccagggtggatgctgtgaaattaggctcagtattcagttggagacataaaagcaaacaccttacaaaagggcaaagccaaaaatgcatcttggtgttggcaaggtgtaaatgtaaccctgcttctattattattttggtataagaaacagatgtgttgtgacttgttcaaacttgtgagaacctttttagccatagacatatggcaatttataacattcggaatcttttgaaggatccttttttattatttaaatatccgagcgaccggtttcaattaaaaaaaaaaagagaggagganagaaaagaaaaaaactcgagggggggccccggacccaattcgccctatantgagtcgtattacgcgcgctcactggccgtcgtgtacaacgtcgtgactgggaaaaccctggcgttacccaacttaatcgccgtgcagcacatccccctttcgccagctggcgtgatagcgaagaggcccgcaccgatcgcccttcccaacagttgcgcaccatgaatgcgaatgggacacaccctagaacgcacatttaagacaggaggn

SEQ ID NO: 6571 - DNA, 1253 bp, Glycine max
  Predicted polypeptide sequence is orthologous to G151
gcccagagaacacaacacggagccatgcaaagttgccgtttccagcaaacctctctggttatttgaggtaaaacgctttgcagtctcgcaaatcgcaacaaccccttcgtcttctcagtaaaaggggtcttacttacttagtgtcttcgttcgtatcttcaaccctgaattcgcttctcctcccaaagcaccaccaccacctctaattaattcctcgttcagttgggcatgtttgcgcatttctgagagagcgagaaaataaagccaatgggtcgagggaaaatcgagatcaaaagaatcgacaatgccagcagcaggcaagtcacgttctcgaagcggaggaccgggttgttcaagaaggctcaggaactttccattctctgtgacgccgaggttgccgtcatagttttctccaacaccggcaagctcttcgagttttccagttccggtatgaagcgaacactttcaagatacaacaaatgccttggttctacagatgctgctgtagcagaaattaagacacagaaggaagattctaagatggtggagattctaagagaggaaattgcaaagctagaaacaaagcaattacagctggtgggtaaggatctgacaggattgggtttaaaggaattgcagaacttagagcagcaacttaatgaggggttattgtctgtcaaggcgagaaagctagagcaatctagagttcaggaacaacgggttatgttggagaatgaaactttgcgaagacagattgaggagcttcggtgtctgtttccacaatcagaaagcatggtcccattccaataccaacatactgaaggaaagaatacttttgtagatactggtgccagatatctcaacttggccaataactgtggaaatgagaaagggagttcagacacatcatttcatttggggttgcctgctggtgttcaagaggaaggcccccaagaaagaaaccttttcaaatgactcagcctagttctctgattttcttatttcaacagggaaaatagaatttcagactaatttattgcatttgtagttatgtacaatatagattagggagaaaaggtatgaccaaaagtgattctcaagttataaattggaatttggctcttttagaatattgacaagatgcacattgaccatttttaccaaattctggcctaattaactgtgaaaggtcttatgaagacaatgtttaggtttttttttaaaaaaaaaaaaaaaaaaaaaaaaaaaaaaaa

SEQ ID NO: 6572 - DNA, 481 bp, Glycine max
  Predicted polypeptide sequence is orthologous to G154, G627, G1011, G1797, G1798
tagtactctaacgaacagtttgaaataatgactgtggtacataaattatttaagtaggcgtacacaaccgccgttgtgattggggtacaacaagaatacatatcttaataagacatgaatataacagtctgcaaggaagctagcagcgtttgtatgggcataagtaatttttaatctttaggattacgctatgtatgcatgagcactatatgttgtaggtatcaactttaacggcatatcttctctcaggtcttcctatgaataagtccgtctccacctcttctccctcctttttggtggcgaattcgacatcctgatcactcaaacaacgttgtcgtacaatccggtactgctcacgtaagcgtttatttacttcgagtaagcacttttcctcttctttgagctgctcgattcgcttcctgaacaattgattcttagtagccctaattttgtccaggctgcgttcgagctggttctctag

SEQ ID NO: 6573 - DNA, 728 bp, Glycine max
  misc_feature (1)..(1): n is a, c, g, or t
  misc_feature (673)..(673): n is a, c, g, or t
  misc_feature (728)..(728): n is a, c, g, or t
  Predicted polypeptide sequence is orthologous to G154, G627, G1011, G1797, G1798
nggggttttcaatagacgctctgacatgatcacgaatttaatacgactcactatagggaatttggccctcgaggccaagaattcaagctggggataggtggatgaataaggaaagcttggtctgattagtctatactatatgccttgctattccactttttctgagtttttctctgcactcctttgctagctaccctctcttttgggcttttttgggccttcaaatcttgcttggagaaggctcaattttggtggaaacctctcacacaagaaagcatagtttcttttgggttcattctacttggtgtttagagatggtgagaggaaagactcagctgaggcgcatagagaacgccacaagcaggcaagtcaccttttcaaagcggcgtaatgggttgctgaagaaggcctttgaactttctgttctttgtgatgctgaggttgctctcatcattttctctccaagaggaaagctttatgaatttgcaagctcaagcatgcaggacacaattgaacgataccgcaggcataacaggagtgctcaaacagtgaacagatctgatgaacaaaatatgcagcatttgaagcaagaaacagcaaacttgatgaagaagattgagcttcttgaaagctcaaacggaaactcttgggagacgggttgggtcatgctctnagaagaacctgcacgatcgaaccacagtcgaaaggagtgtaagcagtgttctggn

SEQ ID NO: 6574 - DNA, 453 bp, Glycine max
  Predicted polypeptide sequence is orthologous to G154, G1011, G1797, G1798
aagcagtgttcgtgcaagaaagaatcaggtttacaaggaacaaattgatcaactaaaagagaaggaaagagccctatatgctgaaaatgctaggctgtgtgagcagtatggtggtatccagccacagccagcaacaaaggatccgaaagaaattcaaccctatgcagaaagcagtccaagttcagaagtggagactgaattgttcattggactactcaggtctagctattgaacataatttaatccttgcctatgcaaatatcaaataagaagcccaactgcaatgtataaatatcacatgtttcctaatactgagatgaataatattatcgcttgtattatataaagaactttctagccttatgattagggtttaattattgatatgtttgcctttcctcaaaaaaaaaaaaaaaaaaaaaaaaaaaaaaaaaaaaaaaaaaaaaaaaaaaa

SEQ ID NO: 6575 - DNA, 790 bp, Glycine max
  misc_feature (1)..(3): n is a, c, g, or t
  misc_feature (761)..(761): n is a, c, g, or t
  misc_feature (770)..(771): n is a, c, g, or t
  misc_feature (774)..(777): n is a, c, g, or t
  misc_feature (782)..(782): n is a, c, g, or t
  misc_feature (785)..(785): n is a, c, g, or t
  misc_feature (787)..(788): n is a, c, g, or t
  misc_feature (790)..(790): n is a, c, g, or t
  Predicted polypeptide sequence is orthologous to G157, G859, G1759, G1842, G1843, G1844
nnnaagggtcgctggcattacgccaggcgcgcatttaaccttcattaaagggaacaaaagctggagctccaccgcggtggcggccgctctagaactagtggatcccccgggctgcaggctccagcaccggaaagctctacgagctctgcaacggtgacagtttggccgaggtcgtgcagcaatattgggatcatttaggagcgagcggtactgacacaaagtcgcaggaactatgctttgaaattgcagatatctggtctggttcagcgttttctcaaatgatcaaaaggcacttcggtgtttctgaacttgagcatctgagtgtgtctgaccttatggaactagagaaactgactcatgctgctctttcgcgaatcagatcagcaaagatgcgattgatgatggaatctgtagtgaatcttaagaaaaagattgaggcactagaaaaaactaatgacgtcaataacgtggtgacacggtctattgactgtgatcaaacagatggggtgactcataatctgttcccaggtctctaatgggactgatagccactactctgtgtctaactggacactcaacccttgaaatttccagtgtgtgttttattcctgcattagggaaccattccatggctaactacttgccttttatattttctattttgttgaaccattgagcatcttgaagatatgtagcctggggaacttgctttcacctctacttttgtgctaattatttattatacgtgcttttcatgcccnagacaactnnatnnnnttatntantnnan

SEQ ID NO: 6576 - DNA, 596 bp, Glycine max
  Predicted polypeptide sequence is orthologous to G180
tttttttttaacgaaatataaaatatattaattttatatgaattgtaagtggtcaaattcatatgggaacaaacttagttccctaatatcttacaaaggatccataatagttcattgcaagtatgtcatcatttaacctttactaaagaaactatttacaaaaacaacacttactatgaataaccaaagttgaataatgtcatttcaccagtagttccactagtatacattattgtatagatgagtcctcactaaggcttattgtgtcaacctaaaaatccttttctgtctcaatccctgtataattgctacttggcacttcattggagtcatctttcttgggtgaaggctattcttcacaactttctaaccatacttcttacatttgtaacaatcatcaagcacatctacatcatttcttgtttggaaacaaaaccgtggctctcttagattcctcctcactttcatctagttcttctccgagcctgcacttcaccatgtgttgttgccaccatcactagtatttccagtgcaattttcatcattgacagctttgggatccagtgttcgcacctgatagttaattataaggtagt

SEQ ID NO: 6577 - DNA, 778 bp, Glycine max
  misc_feature (1)..(1): n is a, c, g, or t
  misc_feature (778)..(778): n is a, c, g, or t
  Predicted polypeptide sequence is orthologous to G181
ncgtgtagtcggatcgacaatgcgcgcgcgtaatacgactcactatacggcgaattgggtaccgggccccccctcgagttttttttttttttttttcacgattaatgaggaaaataaaattccctccaagtacgtatttaatacattcagtactcgaactcaacacctattgttaggttaaaataatcttacagcatttgatctacatgtgcgtgattaactaatgatatttaaacataaacgaaatgtgcttgatatgcatgtagttgtaggagagaaaccagttccaccttacaagctggcaagaaactgtatttgcttgcaggaaagggttaaagtttccatcaacttctcgcacgggtggttgtgaattccctcgtaagtcgtcaccacaatgcttgtgtctttggatagcctttgcacttgtttcttcacattgcacgtgtgatgcgtgcagcggtagtagcttcttggatatgtgttattcttcacagctttctgaccatatgtcctccagcgataaccatcatccaaaatatcatctgcacttctcgttagtaacgcaaaccttggcactggtgttgatatgttcatactcccaccatttcatttgtccttgtctccctgtatctgttcacaagctaccttatgttaagccacataagaagaagaggaagcacattagattgcgtcgagtgcatccccattaagcatgaggctgtcttgagcagacgaatagttactcgaggcgatgtcacataggcctaaatgctgtggn

SEQ ID NO: 6578 - DNA, 789 bp, Glycine max
  misc_feature (1)..(2): n is a, c, g, or t
  misc_feature (630)..(630): n is a, c, g, or t
  misc_feature (633)..(637): n is a, c, g, or t
  misc_feature (639)..(640): n is a, c, g, or t
  misc_feature (644)..(644): n is a, c, g, or t
  misc_feature (646)..(647): n is a, c, g, or t
  misc_feature (649)..(650): n is a, c, g, or t
  misc_feature (653)..(653): n is a, c, g, or t
  misc_feature (655)..(655): n is a, c, g, or t
  misc_feature (657)..(660): n is a, c, g, or t
  misc_feature (665)..(665): n is a, c, g, or t
  misc_feature (667)..(672): n is a, c, g, or t
  misc_feature (674)..(678): n is a, c, g, or t
  misc_feature (680)..(684): n is a, c, g, or t
  misc_feature (686)..(686): n is a, c, g, or t
  misc_feature (688)..(690): n is a, c, g, or t
  misc_feature (711)..(711): n is a, c, g, or t
  misc_feature (757)..(758): n is a, c, g, or t
  misc_feature (766)..(767): n is a, c, g, or t
  misc_feature (776)..(780): n is a, c, g, or t
  Predicted polypeptide sequence is orthologous to G183
nnaaggtggcgcgcaattaccctcactaaagggaacaaaagctggagctccaccgcggtggcggccgctctagaactagtggatcccccgggctgcaggaattcggcacgaggcgaatacggaatccatgtattgaaagagcaaagtagcatggaggatattcgattcagtgatcctgatcctgatcaaagtagcatggaggatttttcattcagtgatagtgatcctgatcctgatcctgatcctgatcaaagtagcatggaggatattcgattcagtgatcctgatcctgatccttttagaaagagaaaaatgtgtagttcagaggttggggttggggaaaaagcaaagattagtacgcagtgaagttgttgagacacaatttgtagagcagcaacaacatatgggttttttctcacgcgtgtggaactgggcactatcacttgtaatgtctcgctgctccggcaatcaataattggatgaaagagagaattcaagttcagcagtggcttgttatcaacgctgacaaaagacaacactgtaactagccctactgattcttgttgtctagtcaaatttggttatagatattggattctgctgtagattcaatgaaaatagatccatccnaannnnntnncatnanngnnttntntnnnncgttntnnnnnntnnnnntnnnnntncnnnaaatataaatactccgagggngcccccggtccccaatttccctttagggatttttattacccccctnnctgcccgnnttttacacnnnnngatggaaaa

SEQ ID NO: 6579 - DNA, 787 bp, Glycine max
  misc_feature (1)..(3): n is a, c, g, or t
  misc_feature (9)..(9): n is a, c, g, or t
  Predicted polypeptide sequence is orthologous to G184, G186, G916
nnnaagggncaaaactgaatatccaatgggcgctcactaaagggaacaaaagctggagctccaccgcggtggcggccgctctattactagtggatcccccgggctgcaggaattcggcaccagcaagctcccagaccacccttgcagccaagccaacatccctcactggctgacacggtcagcgccgccgcctctgccatcacttccgatccaaacttcaccgccgtgctcgctgccgccatctcctccatcattgggggagctcacaattcaaacaacaacaacaataacaacagcaacaacaacacgagcaggactactattagcagcttttcaggaaactgaacattttctttttggttccattaactttgtatttttgtacttgggtactataagggaaaatgaaaccataaatgttcatattctttttagtccatgtattgggagggatatatcatatattagatcagaaaaaaaatgtttcatttttttgtatcatcaaaaaaaaaaaaaaaaaaactcgagggggggcccggtacccaattcgccctatagtgagtcgtattacgcgcgctcactggccgtcgttttacaacgtcgtgactgggaaaaccctggcgttacccaactaaatcgccttgcagcacatcccgctatcgccagctggcgtaatagcgaagaggcccgcaccgatcgctctttcccaacagtgcgcaaccctgattgcgaatgggacgcgccctgtagcggcgcatgtagcgtcagcgggtgtgtggttactccc

SEQ ID NO: 6580 - DNA, 562 bp, Glycine max
  Predicted polypeptide sequence is orthologous to G184, G186, G916
caaacaggtgcaaaggtgtgctgaagacagaacaatactgatcacaacatatgaagggaatcacaaccaccctttgcctccagcagctatggcaatggcacaaaccacttcctcggcagcaagaatgctgctttcaggatcaatgtcaagtgctgatggcctaatgaatgcaagcttcctcacaaggacactcctcccttgctcttctagcatggcaactatctcagcctcagctccattcccaactgttacattggacttgactcagtctccaaatccattgcagttcccaaagcaaccaagccaattccaaatccccttccctggtgtccctcagaactttgccaattcacaagcctcattgctgcctcagatatttggtcaggcactttataaccaatccaagttttctggccttcaaatgtctcaagattcagacccttcccaattgagtaatcaatctcaaaggccaccaccacaccttgctgacacagttagtgctgccattgcagctgatccaaacttcactgcagctttggcagcagccatcacttccattatt

SEQ ID NO: 6581 - DNA, 552 bp, Glycine max
  Predicted polypeptide sequence is orthologous to G189
ttttttatctgaacctggaacaccccatcaattaatctccttcggagataaaactctgcgcgagtaaaagatttcaattgtacaagccatgaatgacatgatcaaaatatactactttgtgatgggaaacgatgattaatttagttaagaggattctaggatgagattagtagcttctgccgcagagagagtgtgattgtgctctccttcataggtgactaccaacatagatggatcatcaagggccctctctacatgcttgcgcgctggacaccctctaacactgctacacttgtaataacctcttggatgaggggatcctttaatgggtttctgtccgtatttcctccaagagtaatcatcgggtggaatatcagccatcttcaagcttatagctggtaccctcagcaccctcttctgcctcatttgtctgctcttctttgaacaatggcatcggctagaggaactggcacacttggcagagcccaagttctcagaactacacttcctcttcaacgaagaggacgaaagtggaggctttcccccggagga

SEQ ID NO: 6582 - DNA, 864 bp, Glycine max
  Predicted polypeptide sequence is orthologous to G189
atagaacatatctgaacctggaacaccccatcaattaatctccttcgagataaaactctgcgcgagtaaaaatttcaattgtacaagccatgaatgacatgatcaaaatatactactttgtgatgggaaacgatgattaatttagttaagaggattctaggatgagattagtagcttctgccgcagagagagtgtgattgtgctctccttcataggtaactaccaacatagatggatcatcaagggccctctctacatgcttgcgcgctggacaccctctaacactgctacacttgtaataacctctgcaattaattattcaaaaaaactcaattcagtgattcactaccactacaactcacttaagccattcagaattaactccacaacatcacataaataaaaactcaaggtagaggacagaaagaaaaaaaccatctcaggatctttctaaatttagaccatacggaaaagaaaaaaaggaaacaaattagggggattcaatttagtaaaacaaaattaattacgggtccattttgaaatttgaaattgaagggtcaacgagcaagccaacatattcaaagataaaatcataaaattattaggtacctaagtcgtgtataattcaaatcagaacacgatgtgaaggtgcttatgatataattataataatgttaagctatgtaccttggatgaggggatcctttaatgggtttctgtccgtatttcctccaagagtaatcatcgggtggaatatcagccatcttcaagcttatagctggtaccctcaccaccctcttctgcctcatttttctgctcttctttgaacaatggcatcggctagaggaaactgcacacttggca

SEQ ID NO: 6583 - DNA, 962 bp, Glycine max
  misc_feature (1)..(10): n is a, c, g, or t
  misc_feature (55)..(55): n is a, c, g, or t
  misc_feature (60)..(60): n is a, c, g, or t
  misc_feature (66)..(66): n is a, c, g, or t
  misc_feature (639)..(639): n is a, c, g, or t
  misc_feature (696)..(696): n is a, c, g, or t
  misc_feature (743)..(743): n is a, c, g, or t
  misc_feature (757)..(757): n is a, c, g, or t
  misc_feature (761)..(761): n is a, c, g, or t
  misc_feature (764)..(764): n is a, c, g, or t
  misc_feature (767)..(767): n is a, c, g, or t
  misc_feature (773)..(773): n is a, c, g, or t
  misc_feature (782)..(783): n is a, c, g, or t
  misc_feature (803)..(804): n is a, c, g, or t
  misc_feature (812)..(812): n is a, c, g, or t
  misc_feature (821)..(821): n is a, c, g, or t
  misc_feature (823)..(823): n is a, c, g, or t
  misc_feature (830)..(830): n is a, c, g, or t
  misc_feature (841)..(841): n is a, c, g, or t
  misc_feature (882)..(882): n is a, c, g, or t
  misc_feature (888)..(888): n is a, c, g, or t
  misc_feature (951)..(951): n is a, c, g, or t
  Predicted polypeptide sequence is orthologous to G189
nnnnnnnnnncccccccccccccccccccccccccccagacgcgcgcggctcaancgtcnagactngatagtaacgcccagcgcgctattaaccctcactaaagggaacaaaagctggagctccaccgcggtggcggccgctctagaattagtggatcccccgggctgcaggaattcggcacgagtagcaccattttgaccaaggcgatatagctaacagctattcgcccccccatactttctttaattttctccttctcccatggtgtaattgctccaactatggccgtggacctcatgacgaccggttacacccgaaacgacaacatcagtagtttcacaaccaaagccgaggaaaatgccgtccaagaagccgcttctggtctagagagcgtcgagaagctcatcagactcctctcccaaacccaagcccaagcccaagcccaccatcaattcaacaacaacaatagctctagtaatgaaatcgccatcgccatggactgcaaagccgtcgctgacgtggcagtctccaagttccagaaggtcatttccctcctcggccgaacccgtaccggccacgccaggttccgacgcgcccctctccccaaccaacaccaacacacccaacctccctccganaccgccgttctccacgctaccccgctgcaccagatcccacctccctcccttcaccanatccccataaccgagaaacacctcaacgattcatcgtctaagacgcnttcattctcatacncctncgncgntacttncttcgtctnnctcctcaccggcgacgccgnncgacacanacaaccatncncggcggncacgaccacgnacctccactttcagatcacgagccctctctcacgtgtcgtnccgggnggaagccttcgctttcgtcttcctctttcaagagaagtgcagctctgaggatttaggtctganagtgcgtagtt

SEQ ID NO: 6584 - DNA, 821 bp, Glycine max
  misc_feature (1)..(1): n is a, c, g, or t
  misc_feature (821)..(821): n is a, c, g, or t
  Predicted polypeptide sequence is orthologous to G194
ngggtgccgaaacttagcaatatgatcttgccaagcgcgcaattaaccctcactaaagggaacaaaagctggagctccaccgcggtggcggccgctctagaactagtggatcccccgggctgcaggaattcggcacgaggccagtgaggttttctatgatgaacagaataaaactgtagatcaagcacctgaacaccaaaagacaaaggaacagttgaaggctaagaagacaaatcagaagagacagagagaaccgagattcgcgttcatgacgaaaagcgaggtggatcatctggaagatggatacagatggagaaagtacggtcaaaaagctgtgaaaaacagcccctttcccaggagctactatcgttgcaccagtgtttcatgtaatgtgaagaaacgtgtggagcgatcttttagcgacccaagcattgtggtgacaacctacgaaggacaacacacgcatccaagcccagttatgggtcgctccaacaactttggttcggtaattatgtctggatctgctggaaactacatgtcccaatattatcagcagcagcatcaacaagtccacatcgatgcattgtcctctatgggtttcctctcttcttcgtcttcaaggaatgccactcttcctcaagagactgccttgttaagtgactatgggcttcttcaagatgttgtttcttcacatatgttgaaagaagattagatgattacttcattactggttgtatgtgatatctcggtattagttactgtagagaatttagaatgaggactttgctgctgccctgtcgatatgaaggtttatatgcatn

SEQ ID NO: 6585 - DNA, 775 bp, Glycine max
  misc_feature (1)..(1): n is a, c, g, or t
  misc_feature (773)..(773): n is a, c, g, or t
  misc_feature (775)..(775): n is a, c, g, or t
  Predicted polypeptide sequence is orthologous to G194
ntggtggctcgagtcagattacgccaagcgcgcaattaaccctcactaaagggaacaaaagctggagctccaccgcggtggcggccgctctagaactagtggatcccccgggctgcaggaattcggcacgagggaatgtgctccgtcagatctcagatttttagagtagatggtgtcttgatgccagcctattttggttttttgaagcttccaagattatggattttagtttaacagtcagattatagaggaagcattctgaaggcccgcaggtgatcctactgatgcagcatgggatttttccttcccatttgtttgaactgcaatgctaatggtggccttgttgcatttcttgacacgaattcttgtataatatttgttagaatttgatgatagttaggtagctagatttccgtagcatgtgtacattgctaactgctgctgcgcattgagttccattgacaacatgtttttttgattttgtgctagcagattcaaaatcttagtaccatacgaagataatatgtaattccttcgtgaagtctcattccgtgtagtttataactgaaaatgcaagtcgtagttagtttaaaaaaataacaacaatgcttgttgcgttcgtgcttgcagcgcgatgaatgcttttgtggctccgaggtacggtgtgggtccatttattaagaagaaaataataccttgtaggggggccgacgcaccttgtcccctttatggatgtttttatcaccgccctctgggcggtgttttaccacggngn

SEQ ID NO: 6586 - DNA, 615 bp, Glycine max
  misc_feature (550)..(550): n is a, c, g, or t
  Predicted polypeptide sequence is orthologous to G194
agtcctcatctatattctcctacaaaaactaattataagaaatcacatagaaacagtagtgaagttattatcatctagtcttctttcaacatatgtgaaggaacaacatcttgaagaagcccatagtcacttaacaaggcagtctcttgagaaaaagtggcattccttgaagacgaagaagaagagaggaaacccaaagaagacaatgcattgacgtggacttgttgctgatgataatattgggacatgtagtttccagcagatccagacattaccgtaccaaagttgttggagcgacccataactgggcttggatgcgtgtgttggccttcgtaggttgtcaccacaatgcttgggtcgctgaaagatcgctccacgcgtttcttcacattacatgaaacactggtgcaacgatagtagctcctgggaaaggggctgtttttcacagctttttgaccgtactttctccatctgtacccatcttccagatgatccacctcgcttttcgtcatgaacgcgaatctcggttctctctgtctcttctgatttntcttctttgccttcaacctatttacccaacaacatcaaccacatcccagaaaaaaaaaaatcatc

SEQ ID NO: 6587 - DNA, 900 bp, Glycine max
  misc_feature (643)..(643): n is a, c, g, or t
  misc_feature (659)..(659): n is a, c, g, or t
  misc_feature (666)..(666): n is a, c, g, or t
  misc_feature (672)..(672): n is a, c, g, or t
  misc_feature (685)..(685): n is a, c, g, or t
  misc_feature (710)..(710): n is a, c, g, or t
  misc_feature (714)..(714): n is a, c, g, or t
  misc_feature (785)..(785): n is a, c, g, or t
  misc_feature (857)..(857): n is a, c, g, or t
  misc_feature (883)..(883): n is a, c, g, or t
  misc_feature (894)..(894): n is a, c, g, or t
  misc_feature (896)..(896): n is a, c, g, or t
  Predicted polypeptide sequence is orthologous to G197, G255, G664
ggatgatcgctctgattacgccacgcgcgcaattaaccctcactaaagggaacaaaagctggagctccaccgcggtggcggccgctctagaactagtggatcccccgggctgcaggaattcggcacgagccccttgctgtgagaaagcacacacaaacaaaggtgcatggaccaaagaagaagatcatcgcctcatttcttacattagagctcacggtgaaggctgctggcgctctctccccaaagccgccggccttctccgttgcggcaagagctgtcgtctccgctggatcaactatctccgccctgacctcaagcgcggcaatttctccctcgaagaagaccaactcatcatcaaactccacagcctccttggcaacaagtggtctctaattgctggtagattgcccggtagaactgacaatgagatcaagaattactggaatactcacatacgcaggaagcttctgagcagaggtattgaccctgccactcacaggcctctcaacgattcttctcatcaagaacctgctgctgtctctgcccctcctaaacatcaagagtcctttcaccatgaacgctgccctgacttgaaccttgagctaaccattagtcctcccccatcatcctcaacctgatcatncgcacttgaagacctngtgacanactcanacctttgcttccnctgcagtctggttgcataatagcanaganggtacgtggccctcacactatactgccacgctactgctactgctatgatcttgcctgaaaaacgacgcgtntgatacagaccctgacatgaatgaatcatatactgaatctcttctttcttcttcttctttctcctaataatnctactactactactacttactactgntatgttgatgntntaat

SEQ ID NO: 6588 - DNA, 127 bp, Glycine max
  Predicted polypeptide sequence is orthologous to G198, G1328
gcaaactacttgaggcccgatataaagagagggagattctcattcgaagaagaagaagccatcattcagttacacagtgttttgggaaacaagtagtctacaattgctgctaacttgccaggaagaa

SEQ ID NO: 6589 - DNA, 731 bp, Glycine max
  misc_feature (4)..(5): n is a, c, g, or t
  misc_feature (9)..(9): n is a, c, g, or t
  misc_feature (16)..(17): n is a, c, g, or t
  misc_feature (34)..(35): n is a, c, g, or t
  misc_feature (581)..(582): n is a, c, g, or t
  misc_feature (608)..(609): n is a, c, g, or t
  misc_feature (613)..(613): n is a, c, g, or t
  misc_feature (657)..(658): n is a, c, g, or t
  misc_feature (694)..(695): n is a, c, g, or t
  misc_feature (701)..(703): n is a, c, g, or t
  misc_feature (705)..(705): n is a, c, g, or t
  misc_feature (714)..(715): n is a, c, g, or t
  Predicted polypeptide sequence is orthologous to G206
attnnatcnttaatanntcatttattgatattannatcaagtaactctagcctaattaaactataattttctaaaatacaaaaatgttagagcatcgctgtcttcaactaaaagaaagaaagtcagtgatttcactagtagattacatgtgtacattacatatcattagccttttcgcattactctggctggtttctttgtcaatggatgcctctagatcttgcagctggtgataatgctgtccccacaccagaaattatcgtaccctttagttgtaacggtcaaattcaagctataccatttcatttaaactactctatctgccaaatttaataataccctcattcaacgtgtcacatgaaaaattcagaactctgacaattctattgaatcattggtcctggtgaatatgtcataccagaaatccatgccatcatcaaagtttgaatcataagcatgactctgttggaaagtttcctcatagttagcaaaagggtattgaagtggcatgtcatttgagattgtgatcaaagattgtgatgacatggtgggggtttcatcatcaattgcagcttctgacnnaaagctctcatctatcacaggcattnnttcnatagactctatgtcttcactcttgataatatttttgctgtcacnnaccgtgactgatgaaaaatcactactagaagtattnnatgctnnngntgttgtgtnnatttctctgaatctaa

SEQ ID NO: 6590 - DNA, 931 bp, Glycine max
  misc_feature (7)..(8): n is a, c, g, or t
  misc_feature (60)..(60): n is a, c, g, or t
  misc_feature (644)..(644): n is a, c, g, or t
  misc_feature (662)..(662): n is a, c, g, or t
  misc_feature (664)..(664): n is a, c, g, or t
  misc_feature (742)..(742): n is a, c, g, or t
  misc_feature (770)..(770): n is a, c, g, or t
  misc_feature (813)..(813): n is a, c, g, or t
  misc_feature (879)..(879): n is a, c, g, or t
  misc_feature (928)..(929): n is a, c, g, or t
  Predicted polypeptide sequence is orthologous to G207, G227, G230, G242
gaattanntccccccccccccccccccccccccccccccccccgaaggaactgaacgagnagcttatctcaagcgcgcaattaaccctcactaaagggaacaaaagctggagctccaccgcggtggcggccgctctataactagtggatcccccgggctgcaggaattcggcaccagaccatagcccgattattaccgggccgaaccgataacgccgttaagaaccactggaactccacgctcaagcgcagagccaagggtattaacgttaatgttaatgatgccgacaacgaggatgacccgttgaccgcattgactcttgctcctcccggtattgctaatgccactttgaccgaagacgccgtaccggaccaccgggcctcgccggagagtgcggcggaggggttttgggatatgatgagggatgtgatcgcgagggaagtgagggaatatgtgtcttctaatttttctgataataactagggttttcattaaatcaatcatcataagcataatttgttattatgtcttccttttttttttaggcaaattattctgcaatttgattttgccttactggactttggaatcggatcagggaaataaattaaaacccttctggcttctgctgttaataacaactntctcttgttgtgaatcananaaaaaaaaaaaaaaactcgagggggggcccggtacccaattcgccctatagtgagtcgtattacgcgcgctcactggncgtcgttttacaacgtcgtgactggganaaaccctggcgttacccaacttaatcgccttgcagcacatccncctttcgccagctggcgtaatagcgaagaggcccgcactgatcgccctttctcacagttgcgcagnctggatggcgaatgtacgcgccctgagcggcgcattagccgccgcgggnngt

SEQ ID NO: 6591 - DNA, 956 bp, Glycine max
  misc_feature (32)..(32): n is a, c, g, or t
  misc_feature (40)..(40): n is a, c, g, or t
  misc_feature (769)..(769): n is a, c, g, or t
  misc_feature (794)..(794): n is a, c, g, or t
  misc_feature (827)..(827): n is a, c, g, or t
  misc_feature (850)..(850): n is a, c, g, or t
  Predicted polypeptide sequence is orthologous to G207, G227, G230, G242
cccccccccccccccccccccccccccccccnagctgggnctcggagctagacatctgcccccgccactaaccctcactaagggaacaaaagctggagctccaccgcggtggcggccgctctagatctatgtggatcccccgggctgcaggaattcggcacgagggagtcgcctcgtgtttccgtttccgtttcaatttcctctcacaggctttaaccttaccagctcgagataagacatggaccggatcaaaggcccatggagtccggaggaggacgaggctctgcagaagctggtggagaaacacgggcccaggaactggtctctgatcagcaagtccatcccgggccggtccggcaagtcctgcaggctccggtggtgcaaccagctgtccccccaggtggagcaccgggccttcacggacgaagaggacgacaccataatccgggcccatgcccgcttcggcaacaagtgggccaccatagcccgcctcctccacggcagaaccgacaacgctatcaaaaaccactggaactccaccttgaagcgcaagtgctcttcaaccatgatcgacgacaacacccaaccgctgaaaagatccgtgagtgccggcgcggctattccagtctctactggactctacatgaacccgcccacaccgggtagtccctccggatacgatgtgagctgagtcagcttacctgttgcatactcttcgcacgtgttccgtcctgtgcctagaaactgcaaagatctaccatccgtaganaccacgtcgtcctccaatgaccctncaactttactttctctatcacttccccgttgtnggtgtgttgactaatcgaagctncaatcggaccactgagccgattcatttacacccgccatgccacatcgtcgatactatgcctctgctggcaatgatgacgtcgtttcagcgacggggatagcgcgct

SEQ ID NO: 6592 - DNA, 702 bp, Glycine max
  misc_feature (1)..(1): n is a, c, g, or t
  misc_feature (238)..(238): n is a, c, g, or t
  misc_feature (427)..(427): n is a, c, g, or t
  misc_feature (444)..(447): n is a, c, g, or t
  misc_feature (533)..(533): n is a, c, g, or t
  misc_feature (570)..(570): n is a, c, g, or t
  misc_feature (671)..(671): n is a, c, g, or t
  Predicted polypeptide sequence is orthologous to G207, G227, G230, G242
nggggaggaagggtcccccattacgctcagcgcacaactaaccctcactaaagggaacaaaagctggagctccaccgcggtggcggccgctctagaactagtggatcccccgggctgcaggaattcggcacgaggaagcaaccaacagaagctcttcctccacttcctcttcctctgattgctgctcttccgagtccaaccccaacaagcccgacagaatcaaaggcccatggagccncgaaaaggatccggatcctgaccggaactcgtcgaacgatacggccacgaaatttggtccctcatcagccgctacattaggggaaaggtccgggcaagtcatgccggcttcgaaatggtgcaatcagcttaccccccgcccggtggagcaccggcccctttctcggcccaaagaggacgacaccatctntcgcggccatggcccgnnnnttggtaaaaaagggtgggcccactatagcccccgattggtaccgggccgaaccgataaaaccgccggtttaaaaccactgggaacntcactcttaagccaaggccaaaaggggttttaaaatntttattgtattagcaaaacaacaaaaaaaaagggggttgggtttttttttttccgcctctcttccttccctacaaaaggagaagaggaaagaaaacgtggnaacccccggttggtcttccttccctctttta

SEQ ID NO: 6593 - DNA, 779 bp, Glycine max
  misc_feature (779)..(779): n is a, c, g, or t
  Predicted polypeptide sequence is orthologous to G207, G227, G230, G242
gggtcagctctaatcgactcactatagggaaagctggtacgcctgcaggtaccggtccggaattcccgggtcgacccacgcgtccgcggacgcgtgggtgggccaccatagctcgcctgctcaacggccgcaccgataacgccgtcaaaaaccactggaattccactctcaagagaaaatcctccgccgttagtgacgacgacgtcgtcacgcatcgtcagcctcttaaaagatccaacagcgtcggcccggcccacttgaaccctgccagcccatcagtctccgatttgagcgatccgggccttcccgctctgtcaaacccctcaccttcggcccattacatgcccaatctcatggaaactgcttcttccgctcccgatccagccacgtcacttagtttgtctctccctgggttcactgtacctcaaccagtgtctccgccgccgccgccactgccactgccggcggagacggtggaggagcgagggaagcaaatgttcaacgcggagttcttgagagtgatgcaagagatgattaaaaaggaagtgaggagttacatgtcatggatggaagaacagaagaatggggtcagaatgcaaaccgaagccattgggaacgcgtggtgaagcgcattggaaattgcaacattgagtggagaaaaagaaaacggtgtggtttcgggattcgatgcagcgcacctgcgacgtgatgatgatgaagtcacaagagtggagaaagggagaacgagaatggggaacggaggtgagagtgttcaattn

SEQ ID NO: 6594 - DNA, 802 bp, Glycine max
  misc_feature (19)..(20): n is a, c, g, or t
  misc_feature (802)..(802): n is a, c, g, or t
  Predicted polypeptide sequence is orthologous to G208
cacaacagcagaaccttcnncaggtacataaccacgcggtaaccctcactaaagggaacaaaagctggagctccaccgcggtggcggccgctctagaactagtggatcccccgggctgcaggaattcggcacgaggggagatccctccccaaagctgctggcttgctgagatgtggcaaaagttgccgactcagatggataaattacctcaggcctgatctcaagagaggcaacttcactgaagaggaagatgaactcatcataaatctccacagcttacttggaaacaaatgggctttgatagctgcaaggttaccgggaagaaccgataacgaaatcaaaaactattggaacactcacatcaagagaaaactctacagccgcggaatcgacccacaaacccatcgtccactcaacgcctccgccactccggcaaccaccgccacagccaccgcagttccatctgctaacagcagcaagaagataaacaataacaacaacgacatcgacaatgatatcaacaacaacaacaatggttttcagttggtgtctaatagtgcttatgctaacacaaagattggaaccaacttggttgctgctgaagattctaacagcagcagcggcgttacgacataagaatgcagccctcatcatcaactcaactaggaccttttcattggccttccgtctcaagcgcatggttcttggttgaacccagaaaagtgaaaccgagaccggaagagcatgatgatcagaagccacggttttagataagtggtatggaacataactagccatctgn

SEQ ID NO: 6595 - DNA, 423 bp, Glycine max
  Predicted polypeptide sequence is orthologous to G214, G680
atacagctccatcgaacacaagtgaaagtcaaaataacactgcacgatcttctgttcatcaatcatttcttccttatcctcccttcacacaacacaaccaagacgattaccaatcatttcttcacatgtcttcaacattttcaaatcttattgtctctaccttgatgcaaaacccagcagctcatgctgctgcaagtttcgctgctacattttggccgtatgcaaatccagaaacttcagcaaattctcctaggtgctcccaaggaggttttacaaatagacaaattggttcccctccaagcgttgcagctattgcagctgctactgtagcagctgcaactgcatggtgggcagctcatggattgcttcctttgtgtgctcctcttcatacttcttttgcctgtcctgcatcagtgactacag

SEQ ID NO: 6596 - DNA, 918 bp, Glycine max
  misc_feature (697)..(697): n is a, c, g, or t
  misc_feature (699)..(699): n is a, c, g, or t
  misc_feature (720)..(720): n is a, c, g, or t
  misc_feature (756)..(756): n is a, c, g, or t
  misc_feature (771)..(771): n is a, c, g, or t
  misc_feature (778)..(778): n is a, c, g, or t
  misc_feature (788)..(788): n is a, c, g, or t
  misc_feature (803)..(803): n is a, c, g, or t
  misc_feature (807)..(807): n is a, c, g, or t
  misc_feature (821)..(821): n is a, c, g, or t
  misc_feature (895)..(895): n is a, c, g, or t
  Predicted polypeptide sequence is orthologous to G214, G680
tttgtttgatgatccgatcaggattacgccaagctctaatacgactcactatagggaaagctggtacgcctgcaggtaccggtccggaattcccgggtcgacccacgcgtccggcaagaaatgcagttctatttgtgatggggtgcagaaaaatctgctatttgtcaaagataacaatgaggaggagggactgctaaccataggtcttggaccaggaaagctaaagactcgtcgaacagggtttaaaccttacaaaagatgttcggtagaggccaatgaaaacaggatcggaacagcctgcatccaaggtgaagaaaaaggtcccaagagattacgcttgaatggggaggcttcaacttgatgcctgatatttcccatgcaaccacacaaagaaaatctctagttttgcatatatttctaagtttccttgttcattgtctgtattgcttattttctaattctgcagctcacgaaacttgtcgtgtaggtctgtgtaccatattaaattactacatacacactttttaaaaaaaaaaaaaaagggcggccgctctagaggatccaagcttacgtacgcgtgcatgcgacgtcatagctcttctaagtgtcaccaaattcaattcacttgccgtcgttgtacaacgtcgtgacttggaaaaaccctgcgttacccaacttaatcgccttgcagcacatncncctttcgccagcttgcgtaantacgagaagcccgcacgatcgccttcccacagttgncagcctgaatgggantggacgncgcctgtacnggcattagcgcggcngggnggggggggttcacngaccttaacttgcagcgcctacgcccgtccctcgctttttccttctttttgcacgttcgcgttttccggaagcnttaaatcggctcccctttggtca

SEQ ID NO: 6597 - DNA, 825 bp, Glycine max
  misc_feature (1)..(3): n is a, c, g, or t
  misc_feature (14)..(14): n is a, c, g, or t
  misc_feature (720)..(720): n is a, c, g, or t
  misc_feature (759)..(759): n is a, c, g, or t
  Predicted polypeptide sequence is orthologous to G214, G680
nnnttatgaaacanggtacggggcaatttcacacgacttactatagggaattcggccctagaggccaacaattgtgatgctctacatatgaaatgggtccatgatgagaaaacagatggtctggattgtgcattaacaatagatgggatgcaaggcaatcagaattaccctagacatgttactgtgcacgttgttgacgggaaccttggaacaaatactcaaaatccatcacaagatatgttgtttcgagactctatgtttcagccaataggaggggttaatggacaacaaaatgttttcaccaattcagctccatcgaacacaagtgaaagtcaaaataacactgtgcgatcttctgttcatcagtcatttcttccttatcctcccttcacacaacacaaccaagacgattgccaatcattttttcacatgtcttcaacattttcaaatcttattatctctaccttgatgcaaaacccagcagcccatgctgcagcaagtttcgctgctacattttggccctatgcaaatccagaaacttcagcaaattctcctaggtgctcccaaggaggttttacaaatagacaaattggttcccctccaagcgttgcagctattgcagctgccactgtagctgctgcaactgcatggtgggcagctcatggattgctccctttgtgtgctcctctccatacttcttttgcctgtacttctgcatcngtgactgcagttacatcaatgactactggtgaagcaccngcactgaaggcagagcatgataagactactctacagaatcctcctcttcaagatcagatgcttgat

SEQ ID NO: 6598 - DNA, 593 bp, Glycine max
  Predicted polypeptide sequence is orthologous to G224
tttttttttttcgctattaaggctaagctaaaaatcctgtaagagatggaaggatataaatgcaaagcgaataaaacggcaataacatcatgatgaaataaatttaaacaaaacatattaatgaaatagcagtttcatcattctgcctattacttttctatgcaatataaaaccagaagaatccataagccataatacaacagcagcatcaaaaaatagtgaagacatccaaaaatatttcaccatctaatttttctggttcgctatggttagtcgtctgcttcagcttgctggccatcagaagggagtgaaagtagagaatctgtatacacagccatacagtgtgcagaattgccccttgtcattacatttcagcaatgtagttgcaggttggccatctcttccaagaatatcaccacaacaatggtcttagtccaaggtgactgcactttggtattctttcatcacccacatttttttctgaatggttcttcatcacagcaatccaccaatggccacagtcttgaaacggataagagacttcagcggcaacctcatgatcaattcccacggcagaaacaccggcctcgtgc

SEQ ID NO: 6599 - DNA, 763 bp, Glycine max
  misc_feature (670)..(670): n is a, c, g, or t
  misc_feature (690)..(690): n is a, c, g, or t
  Predicted polypeptide sequence is orthologous to G225, G226, G682, G1816, G2718, G3930
gggctgagctgctagtggattccgccaagctctaatacgactcactatagggaaagctggtacgcctgcaggtaccggtccggaattcccgggtctacccacgcgtccgggaaatcgagggtcttccaaagttgaattttctgaagatgaggaaaccctcatcatcaggatgtataaactggtggtctataattgctggaaggattcctggaagaacagcagaggaaatagagaagtattggacttcaagattctcgggctctagtgaatgaagctccggagtactacgattggtgttcagtctaggacgagcaagaagattttgggtgcaagattagtgtgattttgtgggacataaaaactgaattaaagttggcatagtttataggtatttgtattggctataaaaaaagaagtggggcagcaactatagaagctggtttgtgttatatttctccatcttgaaatgttccttggtgtgatattttccatcttgaaatgttccttggtgattggtcttttctgaattgtacttagtgctgttcatcttcgtgtatcttattcatttaccattttggctttttatcttgcgtctgaaatctgtattggaaatgagaattaattagagacaggttcagtattgtcaaaaaaaaacaaagaaaaatatatnatttcctgggttgctttgtngtattgtcgcatcgtaagatactgatcgatcgtatcgtgtataaaaaaaaaagaaaaaaaaaggggggggcct

SEQ ID NO: 6600 - DNA, 874 bp, Glycine max
  misc_feature (1)..(3): n is a, c, g, or t
  misc_feature (687)..(687): n is a, c, g, or t
  misc_feature (702)..(702): n is a, c, g, or t
  misc_feature (710)..(710): n is a, c, g, or t
  misc_feature (792)..(792): n is a, c, g, or t
  Predicted polypeptide sequence is orthologous to G225, G226, G682, G1816, G2718, G3930
nnnaattgcttgtcatttgtaccctcactaaagggaacaaaagctggagctccaccgcggtggcggccgctctagaactatgtgtatcccccgggctgcaggaattcggggcgagattcaatatacaacactgaaactttcaaagctcttttgagaacttgttattgcaatggctgacatagatcgctcctttgataataatgtttctgctgtttctactgagaaatcaagccaagtttcagatgttgaattttctgaagctgagaaatccttattgccatggtgtataatcggtgggagaggtgtctttgattgctggaagaattcctggaagaactgcagaagagatagagaaatattggacttcaagattttcgactagccaatgatcggtggcagaaaacgaagcaaggaaatttttggtgcctacaagtcattacagtgactttgtggggatatgaaatggaaattgatcctattaatcatatgggtacttatatttgcattttgcggtaaccaacaaaaaggggcatgccattctaaaagcccttatgtgtaatgttacttaattttatctttgtaatgttcccaagtgttttaggcaatctatgattcagatctgctcgatcatggcaagaacagtatgtacttaattaatgcagatcacctgcatgtgcatgtgtaaanaaaaaataaataaanacaatatnattaataatcactccgagggggggccaggaactccaattcgccctatagggagtcgtattacgcgcgctcacttggcgtcgntttacaacgtgtgactggagaaaccctggcgtaccccactaatcgccttgcagaacatcccctttcgcagctggcgtatagt

SEQ ID NO: 6601 - DNA, 877 bp, Glycine max
  Predicted polypeptide sequence is orthologous to G233, G241
agtaatgaacacacacacctttattataatcacatcgagtaacagtcgtaatggacacactttattaatttctatctaggaaattaattcaagtccaaacaatagaagaacaatgacatgatcttttgttttccgttgaatgaaggacttggtctctactaattaagagcaacattaactaacatcacaattccaataactgcgtaaattcctcagctctggcataaacattgcaccaaaagtccatgccgtcgtcgcacacactcgacgaactagcatctataaggaccccttcttcggtcattagaggagacatcggtagaaactgatgatcatagtcaatggtcggaaatccgcttgttgtctcaccggaattatcagacgacaacacttccgaccagaaatcctcgtccaatgcaagattattctccggcgtgtcgatatcatcattaacatttaaggacatgtcatggttattgttaatgctaccgttgttgtcactagtggtgagggaggaggaggacatgtggctagaacattgtggaggagatagtggcatcatgtcctctgagttcgatgcatgaaagggaaaattattattcacgggctcttgttgttgttctagtttggcgtcttggtttgatttggaggcgtccacatctaactttggttgttttttgcttcgttttttctggtcgtggctttgtttataattttgtggcagcctcttcttcaagtgggtgtgccacacgttttttatctcgttgtctgttctccctggcaaccttgccgctatagccgaccatctgtttcccaacatttcatgcaaactgattatggtgtcctcttcttctctggaaaagttgccccgtttgat

SEQ ID NO: 6602 - DNA, 897 bp, Glycine max
  misc_feature (1)..(1): n is a, c, g, or t
  misc_feature (7)..(7): n is a, c, g, or t
  misc_feature (728)..(728): n is a, c, g, or t
  misc_feature (735)..(735): n is a, c, g, or t
  misc_feature (751)..(751): n is a, c, g, or t
  misc_feature (774)..(774): n is a, c, g, or t
  Predicted polypeptide sequence is orthologous to G249, G1322
ngatccnaaagctttcacgagtctatcgcgctttttaaccctactaaagggaacaaaagctggagctccaccgcggtggcggccgctctagaactagtggatcccccgggctgcaggaattcggcacgaggccaaacagagggtggtccaaaattgccaagcatctacccggaaggactgataatgagattaagaactactggaggacaaggatccagaagcacctcaagcaagcttccagcagcttccagcaacagagtagtaattctgagataatttatcatccccaagcttgcactagccaagtgtccaccatggcgcagcccatagaaacctattctccacccagttatcaaggaatgttagatccattttcaattcagttcccaacaaatcctcatcattctagttgttgtaccaatgacgacgacaacaacaactattggagcatggaggatatctggtcaatgcaattagccaattactgaacgggaattaaacctataaacataaatataaataatatatataaacctaagtgtctaagttccataaattaagctgtagtctctggcttaaaacatgttacgtttgtttatacaagtagttggatgtttggagtacttcggtcttttgcgtaccatcaatatttaagaactaagttagttatgttccgtaacttatgggctcttattaaactatatctgcacaaaatatatatatatcanatgtgantgtatgtggactatanaaagatatggttgagaaccacanactttgaaacttcgaatatatattgccagtgacagtcttgttgatttgtttaaaaaaaaaaaaaaaaactcgaagggcggcccggtacccacttcgccttatgtgagtcgtatacgcgcgcta

SEQ ID NO: 6603 - DNA, 717 bp, Glycine max
  misc_feature (1)..(1): n is a, c, g, or t
  Predicted polypeptide sequence is orthologous to G249, G1322
ntgagattattacttgtaccattatgcggccaagcgcgcaattaaccctcactaaagggaacaaaagctggagctccaccgcggtggcggccgctctagaactagtggatcccccgggctgcaggaattcggcacgaggtctcgagttttttttttttttttttttttttttttttgaaaccatttgactcatgtattatagcacatgaaaattagaaatgtcttaaaagtcttttcttctttaaattccttttgctgttaaaagcaaatgaagaaatatttgaatcactgacactgtagcttaaatgcaacatatacgcaatgcaacatttaatggatgagaagtcgtcaaattagggttaagtggccttcaaaggacaccacatgaaagggaagaacctcttccatgaagggttggtttcaagcactaaagggtggaatgtttggaattccttgtttttgtgattcactcatcacactatcaaaattttgatcatagaacttcttgcaaagtggggcaatgggtggtccaaaattgcaaagcatcttccaggaagaactgacgatgaaattaagaacttcgtgagaactaggatccagatgcgcatgaagcagactgagacgtcacgacgacttggggattgcatgaagaatggtataatgatcttcggcgagcggtatgactgacaggatgtagctcggggcgtcctaatgagt

SEQ ID NO: 6604 - DNA, 782 bp, Glycine max
  misc_feature (3)..(7): n is a, c, g, or t
  misc_feature (19)..(21): n is a, c, g, or t
  misc_feature (32)..(34): n is a, c, g, or t
  misc_feature (644)..(646): n is a, c, g, or t
  misc_feature (722)..(723): n is a, c, g, or t
  misc_feature (739)..(739): n is a, c, g, or t
  misc_feature (741)..(743): n is a, c, g, or t
  misc_feature (745)..(745): n is a, c, g, or t
  misc_feature (754)..(759): n is a, c, g, or t
  Predicted polypeptide sequence is orthologous to G249, G1322
ggnnnnngaattatatttnnnagttttgaaannntgtggttcttaaccatatcttttacaatgcacatagcatctcatttgaaatatatatatatatgctaataatggtacgcaaaaccaaacatatccaactacttatataaacaaacctaataataatatgttttaagccagagacattccagtgttttatggaacttatacaagaatttaggtttatcttgatatatcaatatttaatccccgttcagtaactatcattgaccagatatcctccatgctccaatagttaatgctgttgttgttgtcattggtacaacaactggattgatcaggattaattgtggggaactgaattgaagaaaatggctctaacattccttgataaaagggtggagaataggtctccatgggttcagccatggtagaaacatggctagtgctagcttggtgatcatttatctcagagttattgctgatttgttgctgaaagttctcagcttgcttgatgtgcttctggatcctggtcctccaatagttcttgatctcattatctgtcctaccaggtagatgcttggcaattttggaccacctgtttccccactttgcgtgaagctccatgatcaaaagttgttcctcgggtnnnatattccctcttctaacatcaggacggaggtagtttagccaccttagccggcaactctttccggtacgtttgagannagcagctttggccaangnnntncaaacaccnnnnnnatgatttgcaatatagttgatca

SEQ ID NO: 6605 - DNA, 533 bp, Glycine max
  Predicted polypeptide sequence is orthologous to G256, G932
tttttttttttttttttttctcttattaatcgatcggtacgtacatagcaaattaacaaaggagacaaatgtacttgcaatgtacaattcttgttgtagagtgagaggctattaattaccttctcgtacgtacatagctctagaaaagttttccatttgcaatagctcaagagactaggaagagaggacttttcccactaaaagaaaaaggcataataaaggaccttagcttaaagctgcaatttttctaaaacaaacctgcggtactttcttccagcgacatgttcatcagatcttcatggcactgagcagccccatcatcaaagagccaattctccagcagagtaagaggcacttgcgtctgagatgaagagccatggtgtttggaggagtttagggttaacaaggagtcaaaaccctgatcttgtgttgtagtagtggtgttgctatgtgctccctcactagaactggatccagttgtagtgttattattgaccatgttgctgaaggaagaagaataataccctggcgaa

SEQ ID NO: 6606 - DNA, 972 bp, Glycine max
  misc_feature (830)..(830): n is a, c, g, or t
  misc_feature (931)..(932): n is a, c, g, or t
  Predicted polypeptide sequence is orthologous to G256, G666, G668, G932
cacaatgaaatacactttattcatatcttactgaatttatttgagttgggtaggagtacaattcaaacaatatgaacattaactttacattgctaaaatttgttttgttttctgtatgtttaattacaaattattcttcctttttgagcagccttgtaaactccttcctagtacttctacataccatgattggttaggctgaaattgctacgtaactcattcccgggaatacaattcatgaaatcacttccatccatttgatttgttgactttatttgtgaattatagacctcagtggttgaactgtgaattagacgattatgatactcctcaccaaagttttcttctaacatatgcattatagcttcttggaaagttgaattttgatcaaattcattccccaagaccaaggaatcatcagaattcactgagattccaccatttacttgatccactgatagccactcagaaaataagagttttggtagtggtagagaactctgataagcctccttggaaaagttatagcttttcgagaaaaagttatcattttgtgctattgatttgtcaaggttttctaacaacccataacttgaatcttgtgttgcaagtttctgaggagagagtgcgttttccactgtgtctgaacttgagccggcatgttgaatttgtttatcagattccatttccttagctttgatgactttctttttcaaatatgaatgccagtaattttttacctcattgtcagtccttcctggcaaatgctgtgctatctgagaccaccatgccagttcatggtttgaccgtcttatctatttttccttagnatttaagtagaacccaattgcttttgtttcctaacatatggtgtagggccatgattgtatctttctcatgtttgctgaacacccctctctttcatcctggnnctcagtagttaatccaccttagtctgcagctcttcccatt

SEQ ID NO: 6607 - DNA, 854 bp, Glycine max
  misc_feature (727)..(727): n is a, c, g, or t
  misc_feature (796)..(796): n is a, c, g, or t
  Predicted polypeptide sequence is orthologous to G256, G666, G668, G932
ggcatctaacacagtatgataacaataatcataatttcaatagttattaacatatacacgtctagcaccaaaggcttgaaaaacttctctctctaaggccaaagcgaagattaattgatgaggccctacctataacttatgaaataaaataaaaaattccacagtctcatatatgtcacaaaatgaacccaacttagaaaaacttggcatcatcaccacaaccaactaatttctcttggcaaccagcctcatcaagaagccatttctcaagcaaagagaatggcataatttctgcaccaataacatcaggcttgctttcatcttgcaaaacagtggcctcaggagacaatgaccgagagaattcatcagagtttgaagactccaaagactgatcaaaatcaaacaatgattcaaaattgttttcagacaattcagcactgcttggtggtccctttgctccaatactagaagcagtatcagcacctgctgcagcaaagttgttgaaggagttctgagtcacagatgatgagtttgttcttgaggactttggtgggtttttcatccaaccctttagcattctagctatgttgtcagcacttgaggcatagcacacagtttgtgttgttgttggttttgtggaagagaaggagctgctactatctgaagggtttgagtttgaggcagataaattacaagatggcttctctggtgaaagagcttcactganggctctcttttgcatttggatatcagtttggagccttcttttccactggcctctagggattgccttgangctgaaacccttctccaagctacccactcacaactactgcatcttctcagcttcttct

SEQ ID NO: 6608 - DNA, 798 bp, Glycine max
  misc_feature (32)..(33): n is a, c, g, or t
  misc_feature (93)..(95): n is a, c, g, or t
  Predicted polypeptide sequence is orthologous to G259
taaaccacattacataactacagcatatgctnnaggggtgtcttaattagtttcttgatgcacccaatatgatagccaaaataactacaacannngggcaaaaatactctttgcaagcctagcaagctaattaatcaaatatttgattattactcttcagtatctatacccaatacttttaaaaagcctctatgtatgatatcatatctagctatttgcatgactgagacaacataatgcttgtgctttcactcatctcagccctattcctcttcatctccctccctccttgaacctctaatctcactccaaacaacattggcctttcatcctttttctcctcctttgcatgtgatgaatatgtggcaaccaaatcaagcagttccttgcacttccttttcatgcttgtgagctcagagttcagcaccccattctccttcttgagtcgcttgttttcatccacaagagtagtgtaaccaaaagatgatgaggttgatgaggacctttgatcctcatcagagtcttggggtgtgccttggtttggtgcattaggttgttgcttgctgctccaagctttccttcgccgaatctcatgtagaagttctctttcacctttcttgaacttgtcattgaaaaactcccatctgcttgttgcaactttacgaaagccataagtattgagctggcgtacaaagctagagaagttgctgtgcttgaagagtgttgggaggagatcccgagcaaactccggcggctgccacaccacgaacgccgtccctttggcattccacgaaatga

SEQ ID NO: 6609 - DNA, 844 bp, Glycine max
  misc_feature (414)..(414): n is a, c, g, or t
  misc_feature (416)..(416): n is a, c, g, or t
  Predicted polypeptide sequence is orthologous to G261
cyattccattttctctggaaaaaaaaaccaattcattaatactgtcgaaaaacatggtcagaatttgagcttttggcaactatggacagagatatgaactttccatatttggaggagaagcaatcccttttgtgtttcgctgtttccattttcagcttttttcttgtgtttgagcatttgaatctggacaaaggtttcacctttgggtgagtgattcaacaccagctatagctgggggagtgaaggtaaggttgtgagcattaatttgcttgamggagggtttgtgaattgaattggtaaaaagggtctctgttttatgggaattattaattggtgtttactgggattaatgaaaccyagatagaaaggaaaagggggaagaacaagggagtctattttttatataaatatgtntnttgttttgtagtggttaamtttgtgaaaaggtaaaagcgtttttttctttctttctgggtatactacagggcttttgagagttcactttgctgtgagatttgtgtttttgatgatggaggaagctcagggcaattctagttccctgccacctttcctcaccaagacttatgagatggtggatgatccttccactaattctattgtttcatggagtgccaccaataggagtttcattgtttggaacccaccagagttttcaagggatttgttacccaaatactttaagcacaacaacttttccagtttcatcaggcagctcaacacttatggctttagaaagattgatcctgaacaatgggaatttgcaaatgatgattttgttagaggcmgccacatcttttgagaatatcctaggcgcaacctgttc

SEQ ID NO: 6610 - DNA, 689 bp, Glycine max
  Predicted polypeptide sequence is orthologous to G261
attgaggggcatcacaagctaaaaggaataatcaattgcaactaagtttgctctgctttgctaagaatgccccatctgttctggagggttatttacattcctaatgttccaccaaaatttggcattacttctgccatcagaatcctctctttcagactgagcttcctgcatttctgacgaaccaggattctctgtcaagaatcgttcccagaatatgtcattaacaccagtagtcagaggagctgtttcgacaggttgttcttttgatgcatcaagatcaggagccgcaactacagctggctcagaactcacgttgattccatgtgacttaggctgatcttcaacttctagttgcacacaagatatagctggactatctgcacaacttgtagattcatcaaaatccaagtttaaatgactttgaacaaagacgtcaccaacatcatgtgtaatattctcccaaaacgtcatggatgactcaaggagatccaaccgttctgtgctcgatgagaaaatagaagcaccatctgcattttcccttggtaatacttgggaagtttccatatgatcttcaatgctagcgtcatcactaaagagaccacttcttggcaacctccgttttctatccatgttttctgtcaacagcaagagatttaaggcaatcccaggtttctgcaacacttgagaga

SEQ ID NO: 6611 - DNA, 1410 bp, Glycine max
  Predicted polypeptide sequence is orthologous to G263
gaattccgtggggaattatggtaattaattttgagggtttgactactcatggattatgatggtatgagaaaaccttccaaaaacttatttcactctcgcttcttcctttttgggttctattgctgggattgggagttcttgaccgctctcctcctttttagttcttccccttaatcttctttcttcacaatttttatttccttccttattagacgtattagatcagattgaacaaaagggtttttctttctttctttcttggggaataatagaaataagaaaagattagtgaggttgaaatgtcgcaacgatcggtgccggcgccgttcttgacgaagacgtatcagttggtggaggatcaggggacggaccaggtgatatcgtggggtgaaagtgggaacacttttgtggtgtggaagcatgcggattttgcaaaggatttgcttccaaaatatttcaagcacaacaacttctccagctttgttcgacagctcaatacctatggattccgaaaaattgtgccagacaaatgggaattcgcgaacgagcatttcaagcgagggcagaaggagcttctctccgagatcaaacgccgcaagaccgtgcctcaatcgtcggcacatcccccggaggccggaaagtccggcggcgacggcaactctccgttgaactccggcagcgacgacgcgggctccacctcaacctcgtcctcgtcctccggttccaagaaccagggatcggtggaaacaaacacaacgccttctcaccagttatcgagcgagaacgagaaactgaagaaggataacgaaacgctgagttgcgagctggcacgtgcgaggaagcagtgcgatgagctcgtggctttcctcagggaccgtctgatggtgggtcccgatcagatcgatcgcatcatgcggcaaggaagttgcggatctgaaaacgtggtaggtgaaggcggtggaggagactgtttgaaactgtttggtgtttggttaaaaggggatacgctaacagacaaaagaaacaaccacaaaagaggccgcgaagaccaaatgggcttcggtgggcctcgcctcaaggagtcaaagcccgttgttgactttggagctgtaaatatcatgatgaagagcaacagggtttgcaactgaatgaggctctcacctcgccacgtaatcttttaagcaattaaagaaggaataggataatgattagtgaaaaaagaaaaggctaagcgataattattttgggtaaaagaccaaatgcactagcctatgctttctacacatgttgaggttgtgtaatttgtaatgtacgtaggtcaatgcctctatgaatattgattaggaaattaaacaggttttaatagtcaattatgactttttatgtcaaaaaaaaaaaaaaacggaattc

SEQ ID NO: 6612 - DNA, 868 bp, Glycine max
  Predicted polypeptide sequence is orthologous to G268
gcggccgcaccgattttcttttcttttttttggtccaacaataaacataactgatatcaacccgaagatgatgggaggtaagggaaagaccatattacaagtgaagctttattgatacatactaaacaaatttcccgcagcatttggtccattctacacaataacttaagcttacatcacactagaatcaaatagacaaaattatcatctaaacatatctgtttataaaaaaaaaaaatcatctaaacatatctgtttatcaaaaaaaaaaaatcatctaaacatatctagtaattctgtagagattgatacaaggcaagttctttaaagtgtttagaagaaaacctgttagttgggattcaacattgtaattaagactaccgtttctggcaaattatgggttagttttggccaacatttctggcacaaaatgagatttcagttgggagtaccatatatggtgttctataagttactgacgcaattgagcaattcagaaccgtttatcagaccttaatatcttccagcttgaatagggaccctctcctacatcatttatggtagttgaccatcccaatgcagttgcaatttcttgaagctcacctataacaagtgtggtgtcgcgtatatacactcgtcctcccggtcttagcatccgatccatctcaagcataatggttgagatgttacacttttgcctctttttctcaacagagaaaagacctgcagcgtgcagcagatcatatgttcttgggtatgtatcaaatggttcacaccaatcatgcataactcctgtcagcccgcggtcatatataacaggccaggtattaaatccactgacaggaacaacattcataacccaacagtc

SEQ ID NO: 6613 - DNA, 794 bp, Glycine max
  Predicted polypeptide sequence is orthologous to G268
ccagagacatcgccatgactcggccaagcgcgccaattaaccctcactaaagggaacaaaagctggagctccaccgcggtggcggccgctctagaactagtggatcccccgggctgcaggaattcggcacgagggttaattggagttatgcatgactggtgtgaggcatttgacacctacccaagaacctatgatttattgcatgctgcaaacctactttctgttgagaaaaaaagatgcaatgtctcatccattatgcttgagatggatcggatactaagacctggcggacgtgtgtacattcgcgattctcttgatatcatggatgaacttcaagagattgccaaggcaataggcttgcacgtgatgttgcgagacacagaggaggggcctcatgcaagttatagggtattggtttgtgataagcacttgctactctcttaaagctaaatggggtatattgcatgatattttctacgaccctgcaagtggaagtcatcaacagaacatggcaaaatctgtcattgtagaagtgtaggaagatgcaagtgcaagtactactaggcatttgagaagtgcaggaagatgcaagaacacatccttacaaacgtgtaggaagatggtcagcatttattcatcgataccactattcatgagatccctaaagctggatgagatcagtgcatcatctaacctatttgtagattcaatttattttgatattccaaagctgtcgttggctaaataatttgggttgttccaagaatttaagtccctgtaagggctgaacctaa

SEQ ID NO: 6614 - DNA, 286 bp, Glycine max
  Predicted polypeptide sequence is orthologous to G268
tcgacgatttcctccatctccggtggcgaatccagaaagagtccactcctaaccaaaaccaccataaccagagccaccatcgccttccacacgctctgcacttccactcttgttaggggctgtgacccttctttttctttctctcttcttttcagtgtgtgtttgtgtgtcgatagtagtgctaattagggaattgacgccgctctgtgttttaatgtccagagggaaatttataacaacggagagaatcaatttctctctgcttccaaattaaaaaaaaaaaaaa

SEQ ID NO: 6615 - DNA, 770 bp, Glycine max
  Predicted polypeptide sequence is orthologous to G270
accagagatgtctccatgagcatgacgcgccaagctctaatacgactcactatagggaaagctggtacgcctgcaggtaccggtccggaattcccgggtttacccacgcgtccgtgaagcttctcgattactcttctagttttccggtggacgaaaatgtccctgaacctcaattgaatcgcggagaaaagtttgaggctgaagctgaattggatggtggtgaacgtgttgcgcctaagaaccctaggtgggctgtttatgggaggggtttggaggatgtcactgagtttttcaatagtgacaactatgaccctactgctaaaacccctggaggtcgccggaagttgtttaataaggaggagaaggttgtgttgaataagaggataccagacttggcagctgctacttcagataaatggcttcccctgcacactctcgctgcttgtggagaatatcaccttttagattctctgttgaagcataatgttgatatcaatgctgtggataaggatggtttgactgcccttcacagagcagcaatgtggagaaaagcaggccatagtcaattatctcctgagagactcagctaatccctttgtcatgataatgaaggagccacattgatgcactatgctgtactaacagcttctacccggacaataagaatactcttattgtatatgaggatataaatctccaggacaatgatggctggacaccattacatcttgctgttcgagctcagaggacggatatagtggagcttttgc

SEQ ID NO: 6616 - DNA, 883 bp, Glycine max
  misc_feature (1)..(1): n is a, c, g, or t
  misc_feature (350)..(350): n is a, c, g, or t
  misc_feature (670)..(670): n is a, c, g, or t
  misc_feature (754)..(754): n is a, c, g, or t
  misc_feature (871)..(871): n is a, c, g, or t
  misc_feature (879)..(879): n is a, c, g, or t
  Predicted polypeptide sequence is orthologous to G274
nacgtggatttgatgacatttgctgattacgccaagcgcgcaattaaccctcactaaagggaacaaaagctggagctccaccgcggtggcggccgctctagaactagtggatcccccgggctgcaggaattcggcacgagacatatccaaggacatatgaccttattcacgcccatggtgtctttagtctgtacaaggataaatgcaaggccgaagatatacttctggagatggaccggattttgcgaccagaaggtgctgtcatattccgcgacgaagtagatgtgctaattaaggtaaagaaaatagttggaggaatgagatgggacactaaaatggttgaccatgangatggtcctcttgttcctgagaaggtgcttgttgctgtcaagcagtattgggttactaattccacatcaacacaataagccactatatcaaagttgaagaactggcttggcctttggctgccagtacatttctctatacgatcttcacagaattcatattgtggctcaattggtcattgcaatttgcaactgtggcacagaagaggggtttgatggagttttgcacgattgtcacttacctaaggtttcctatgttgttaatttattgatgaagaaagctacaaagctatgcttaaggtttatgcatgccacttgccatnttttggtcttagttgttatcttgggacattactacattcgaagaaaacacggtctctcttcttttgtaattaaatatatatatnccttattttaatgttttatttgacacccggaaaagttcttttttattattattcttaaattgagtgtatctctatgggccccatgggatttcatttgggatgggacacttcattttnttagcatnctaa

SEQ ID NO: 6617 - DNA, 931 bp, Glycine max
  misc_feature (833)..(833): n is a, c, g, or t
  misc_feature (857)..(857): n is a, c, g, or t
  Predicted polypeptide sequence is orthologous to G275, G837
aaaagacgaacacataattaattacctaactacaatggtacataataatgacggaagtacagttacaaagaattttgagcagccaaaacccgaaaaatcatctataacaatcttgctggcgtcttaaccaatagcatactcgagtgtctccaattctttaggccgccacatggacttctggacacataaaaagcccaccttatctttagagtaagtcatgcgaacctcccactgcatggacttcaccatactttccatctcgttaatgatttcaacagtgtcccggacaataagctttccctctggcctaagaatccgatcaatctcagccactacagcttttaaactacacctgttcttaatatttgaaaatagattatctgcatgaagtagatcataggacctcggataggtgctaaatgattcacaccaatcatgatacatgccaaagagacctcgctcataaataagaggaagtgtgtctgcggaatttactgaaaccacattcatgacccaaatattcaaatccttcaaggcagcagcaaaccctccatagactgatctcatatccatgacattccgcatattggaccaattaattcctatcccattaagataagacttggacactatacgtttccagtgtccataatcagcagtaaaatcttcaggggcaggttttccataaactccaacttgagaatttgtcaaccaataaggtatgttggttagtcttgctggccacttctctggccattgtgacccacgttctgtcgaactcactggcactttgtgcatgcaagcttgtaatggaacgttccatgctgcattangatcgtcagagtctggacatatangaagctgattctgagaacgtttctcataacactcattagaagttggtttcttatacacagctatcgacagcaac

SEQ ID NO: 6618 - DNA, 955 bp, Glycine max
  misc_feature (815)..(815): n is a, c, g, or t
  Predicted polypeptide sequence is orthologous to G275, G837
agattaatatgaccatttctggtgaagtgaatattcaaaattgtcaactattacaacgcttataattatataacccaatggcctctacatttgcaagaatgcgatcaaatttccttcatgctatggcaccatgttacaacagaggacaccaatttaataaatataaataaaggatatcaaaattaatacccaacaggaaaaaagaagaatacgtagatattcctaactaacatgatacatatgactcatagtggaagcacagttacacaggaatttcgagtagccaaaaaacccaagaatttgggaatctcatcccaggcttaaacaatagcatactcgagcttttcctgctccttaggtcgccacttggacttctccacacataacaagccctccttatccttggagtaagtcatgcgaaccttccattgcatagacctagccatgctctcaagctcttcaacgatctccacagtgtcacgaacaataagttttccttcaggcctaagaatccgatcagcctcggccactacagctgccaaattgcaccttttcttaagctttgaaaacagatgatcagcatggaggagatcataggtcctaggataggtgctaaatgattcacaccaatcatgatatataccgaacagacctcgttcaaaaataatgggaagagtatcaggggagtctattgtaaccacattcatgacccaaacattcaaatctctcaaagctgcagcaaatcctccatagatagacctcatatccatgacattgcgcacatttgaccatttaattcccatcccatctagatnagactgggacactacacgttttcagtgttcataatcagcagtgaaatcttcaggggctggcttttcataaactccaacttgggaactcaacaaccaataaggcactttggtcagtctggctgcgacagcaacgggaattc

SEQ ID NO: 6619 - DNA, 790 bp, Glycine max
  misc_feature (1)..(1): n is a, c, g, or t
  Predicted polypeptide sequence is orthologous to G275, G837
nttttaagatgcccccctccccgccaactatctcgtggtggccctcactaagggaacaaaagctggagctccaccgcggtggcggccgctctagaacttgaggatcccccgggctgcatgaattcggcacgagggatatttggtcataagagacaatgttgaaactattggcgagatagagagcatggctaaatctctacactgggatattcagttgacatattccaaaaatggggagggattcctttgcattcagaagacattctggcgtccaacaaaggttgaaacagttgcatcagccattgcatgattaggagacttcagcttcaccatctcaacaaggctggcacactcctttgttttggcagaatacgtcttcttttacttctatggttgtattactagtattaaagagtgacacatttacttctctatgtaatatctatctattatttattattatctaatgtaaattcgtgctgtattattcatctaacacccctcttactttaaaaaaaaaaaaaaacatataataataataaaatctcgggggggggcccggtacccaattcgccctatagtgagtcggatgacgcgcgctcactgtgagtcgttttacaacgtcgtgactggaaaaaccctggcgttactcaacttaatcgccttgcgcacatccccctatcccagctggcgtaatagcaatgaggcccgcaccgatctgcctttccaacagttgcgcagcctgaatggcaaatgggacccgcactgtagcagcgcaataagcgctggg

SEQ ID NO: 6620 - DNA, 952 bp, Glycine max
  misc_feature (1)..(1): n is a, c, g, or t
  misc_feature (13)..(14): n is a, c, g, or t
  misc_feature (19)..(20): n is a, c, g, or t
  misc_feature (27)..(27): n is a, c, g, or t
  misc_feature (33)..(33): n is a, c, g, or t
  misc_feature (111)..(111): n is a, c, g, or t
  misc_feature (941)..(941): n is a, c, g, or t
  Predicted polypeptide sequence is orthologous to G280
naaatgatacacnnaaacnnagcaaanccaccntactgcaggtgcgtatttagaccctcactcacgggaacaaaagctggagctccaccgtagtggcggccgctctagaanagtgcatcccccgggctgcaggaattcgggaccagctataggccacccctgccactggcaggccaagaggaaggcctaagaaggttgctcgctcaccggccgtgccgtctcccaccgccgtctccactggaaggcctagaggcaggcctcccaaagtgaagcctcagttgacagaagtcagggttgagtcatagaatggtttctgtctttctttctaattgatggcaaatgtagggatctactctcgtcgaagggatggcgcgtgtggtcttagatattgggtcaatataatttctttgtaaaatcaagtagtggtagcttgcttattaaaaaaaaaaaaaaaaaaaagtatcaccttgcagtgatctatataaaaaaaaaaaaaactcgagggggggcccggaccccaattcgacctatagagaggcgaattacgcgcgctaactgggctgaggtttacaacgtcgtgactggaaaaactctggcgttacccaactatattgccttgcagcacatacccttgtcgccagctggcgtaatagcgataaggcccgcaccgatcgcccttccaaactattgcgcagcctgaagtgcgaatgggactcgccctgttgcgtcccattatactgcgctgatagtgttggttacgcgcagcgtgaccggtacacttgcaacgcgccctacgtgccagttccttacggtttcatcatttgccttactcgcacgttcgcgcgctataccacgcaggctctaatgagtgcgtaccctcagggttccgattatgcgtacatgtcactcgaacgcaataattgatatgtggatggtcacgnatgtgcatgcc

SEQ ID NO: 6621 - DNA, 710 bp, Glycine max
  misc_feature (28)..(28): n is a, c, g, or t
  misc_feature (710)..(710): n is a, c, g, or t
  Predicted polypeptide sequence is orthologous to G280
ggtggcgggtcagctttggatgaatcgncaagcgcgcaattaaccctcactaaagggaacaaaagctggagctccaccgcggtggcggccgctttagtactagtggatcccccgggctgcagggaaaaagatcccaagccaaaatcaagagtatgaaatgtgtctgttcgtttcctttggctgtatggttaagaaatgttaatgaaacgaaaaaaattgtggtgatgctaagcctaagggtgggtcccatgttgagatgtgaatagaaggaaatatgggattgggttcacatcaccatttattgtaccacttgaaagatttgtcgtcaaacttgggtggggctcatcaaagcactactccttcccacgtaacttcacttcacatttctctcctgcaacatttatatttttttgaaaaatacaagctctatggtgtcggaggatgacatttttataatttcctttttaagtttttatgcctaagctaattctcttatttacaatgtaccccaaccaagaaggattagtatgcctcatatttcttttgcaatgcaagtgaacaagtaaagttcttccttgtaagcgtgtgtatatttgtagtgatttattcttgcgtgaagttctaagcacagaaattgctctgtggtgacaaaataaaacaaaaaaaactcgagggggggtcctggtcccaattcgccctatagtgagttn

SEQ ID NO: 6622 - DNA, 832 bp, Glycine max
  Predicted polypeptide sequence is orthologous to G280
attggaacctgcctctgttaaagtttgtatttttctgagtgggtgggttgattgagagtgctgtgcaagctttggaactttttcccaacctgctacttcaatggccactgaagaggttaacaaacctcaatcacttcctccataccctgagatgatagtgaaaacacttgaagcactgaatgagccaaatggatcgaacaagtcagcaatatcaaagtacatagaaaccacctacggtgagttgccagacgcaaccgttttggggagtcaccttaacaagatgaaagacagtggagagctttctttcaaacagaacaattacatgaaagctgacccaaatgccccaccaaagaggggccgtggaaggccaccaaagccaaagactccattgccaccaggcactgttgtgtcccctccaaggccaaggggtcgtcccccaaaagaccctaatgcccctcctaagtctcccaaggctaaggccacccctggaagtggcaggccaagaggaaggcctaagaaggttcctcggtctccggccgtcgccgctccgaccgccgtctccagtggcaggcctcgaggtaggcctcccaaggtgaagcctcagttgacagaagtcagtgttgagtcatagaatgacttctttctttctaattgatgtcaaaagatgtagtgttctactcttgaagaagtgatgatgggtgtgatcttagattttgtgttgatgtaatttctttgtaaaattatgtagtggtagctaacttatcatgaggttctgtgttggtttttcttcctaaattattatcaaagtgaacagtgacttgaactaatgtgc

SEQ ID NO: 6623 - DNA, 809 bp, Glycine max
  misc_feature (655)..(655): n is a, c, g, or t
  Predicted polypeptide sequence is orthologous to G291
agtggtcggtagataccgcagctctaatacgactcactatagggaaagctggtacgcctgcaggtaccggtccggaattcccgggtcgacccacgcgtccgcacgcgcgctccggcggcaccatcgaggtcatgggcctcatgcagggcaagaccgacgccgacgccatcatcgtcatggacgccttcgccctccccgtcgaaggcactgagactcgcgtcaatgcccaggccgatgcgtacgagtacatggtcgattattcacagacaaacaaacaggcagggcggttggagaatgtagtgggatggtatcactctcacccctggttatgggttgctggctgtcggggatcgatgtttcgacgcagatgctgaatcagcagtttcaggagccgtttctggcggttgtgattgacccgacgaggaccgtttcggcggggaaagttgagattggggctttcaggacttaccctgaagggtataagcctccggatgagcctgtttctgagtaccagaccattcctcttaataagattgaggactttggtgttcactgtaaacagtattatgcattggacatcacttactttaagtcgtctcttggttcacacctcttggacctgctgtggaacaagtattgggtgaatacactgtcntcttctactctgtttggtaatggagataatgttgctggacaaatctctgatttaactgagaaactagaacaacagagaatcagttggcacactcacgcctttggccactaatacaaccaaaacctagaagaaaaaagaggaatctccacttgct

SEQ ID NO: 6624 - DNA, 771 bp, Glycine max
  Predicted polypeptide sequence is orthologous to G307, G308, G309
gcttatattagctatttggcattaacaaacaactacttgtaattactaattaggcagtggtatgactcaattgactaaaaaagagaaaagcactttggttgggtttttgacaaaaagagaaaaaccccaaccaaagtcacgtgtgatagagaattcaacaacagaagaattttacgcaaaaatgaccacattattattattcaccactcttcccgtgtactactactgctactagttactagaataaacaaaaacaagtgatctgttctgttctgttcttttcctcaatgctcaaaacgcagcgtttcgtcgtctcccagaggcgcggcttgccaagccgaagctgcaattagggggcggctatgccaacccagagtcaaagagccttgattctcttggacgcagaaaccctcagctgagaagagagtgagcaacatgctggcttgcttgtaggcgttgaaacccaaatgcaaggctctgaagccggctttccccagccgatccctccacttagcgagcggctcgtggcgctccagccgcgccggtccctcgcagcacaccacgttgcatatctccctctgcagatacatctccgccaaagcagccttgtccggttcgaccggacacgcgtcgagcgagtcgaaaacgctggaatagtaatgcaaagcctccgtgaaccgctccaaaaacccttccccgttgtggttggcttcttgttccacaaccgtcacgattttagggttcagaatccggatccatcccagaacctct

SEQ ID NO: 6625 - DNA, 906 bp, Glycine max
  Predicted polypeptide sequence is orthologous to G307, G308, G309
caccctctcatttatttatcctcttgctgcctggaaggctcactgactcggtcactgactcagttcactggaacaagtccaattaatctatagttttacattcactgagtcaagccactagactcgctggaggagggaagcttccaagcggaggtagcgatgagtggcctagtgtgccagccaagcatgaggcagccgttattctcctcaaccctatacccatcaccgcctgcgaatagagcaagtagcatactcgcttgcttgaatgcgttggacccgagatgaaccgggtcgaacccggccgagtccaatctccccctccactgagtcaaagtctcgtgccgctcgacccggtccgggccctcgtaagccaccacgttgcaaatctgtctcccaaggtacaactcggacatcaacagatcctgactcggcgagcccaacccggtcgaagaagaagacgaaccctcaagcgagtcgaaaagactggaatagtaatgcaaggcttcagtgaaccggtctagaaaacccggtccgttgtggttcgcttcttgttccacgatggtaacgatctggggattaattttcttgacagtgtccaagaccttgtcgacggatccggaccgggcgagcatgcggtggagttcgaagacggaattcaccgccacggcttccccgggtcggatctcgagcatattcgggtcgagatccgcgaggctgttgcaaacgaagccgcggaattcgaactggacgccgatgatttgggccaattgggctaatttcaagcccacctgctgcagcgcgtcggtgttgtcgggctgtgggggcccgattccggttaaacggaaagtcgggggcccgccgggccgtaatgcgagggcctgcatgagtgccggccactgcatccct

SEQ ID NO: 6626 - DNA, 976 bp, Glycine max
  misc_feature (48)..(48): n is a, c, g, or t
  misc_feature (976)..(976): n is a, c, g, or t
  Predicted polypeptide sequence is orthologous to G307, G308, G309
gggtttcctcccccccccccccccccccccccccacgcggggacttangagaggtgctgggcgcggttgttcctcactaaagggaacaaaagctggagctccaccgcggtggcggccgctctagaactagtgttttccccgggctgcaggaattcggcacgagagatgcagtagtagtagtgggtggtaacagagaagaaaatagggggtttggtttggtgagttacccaagagaaaggatgaagagggaacgcgagcagcttggttccatcgcagggacctcaagctgcggttattcaagcggaaaatcgaatctttgggaggaagaaggaggcatggacgagcttcttgcggtggtgggttacaaggttaggtcatcggacattggcggaaagtggcgcagaagcttgagcgtctcgaagaagccatgggaaatgtccaagatgacctcccggagatttcaaacgacgtcgttcattacaacccttccgacatctccaactggctcgaaaccatgctttctaattttgaccctctcccctccgaagagccggaaaaggactccgcctcgtcggactacgatcttaaggctattccggggaaagcaatttatggagctagcgacgcgctaccaaaccctaagcgcgtgatagccgacgagtcaatgcgcgcggtggtggtcgttgactcgcaggagaacggtatccgcctcgtgcacagcctcatggcgtgcgctgatgccgttgatgacaatcacctcgtcgtggggtagacgctgtgaacacatcggcttctttgtgtgtcgcagatcgtagctatgagtatgtgtccatctactttcgctaccgctcgctagcgattctcgtagctatcctggcacacttttgttcgatcgttcacattagctttactaactgtcatagttagtctgacatctgcggaatcgtgtgatctcatcgtgcaagaatgacgcgtn

SEQ ID NO: 6627 - DNA, 711 bp, Glycine max
  misc_feature (510)..(510): n is a, c, g, or t
  misc_feature (533)..(533): n is a, c, g, or t
  misc_feature (550)..(550): n is a, c, g, or t
  misc_feature (572)..(572): n is a, c, g, or t
  misc_feature (647)..(647): n is a, c, g, or t
  Predicted polypeptide sequence is orthologous to G307, G308, G309
ttgaattcgtgatgaagagggaccacaaagatagctgcggcggcggcggcgccgccggagggactgtgaagggtgagtgttcctcaatgcagtcaaacgggaaggcgaagatgtgggaggaagagcaacagcagcagcagcagcaacaacagcaacaacaacaacaggggatggacgagttgctggcggcgttggggtacaaggttcgtgcttccgacatggctgacgtggcacagaagctggagcagttggagatggtcatgggttgtgcccaggaagacggaatttcccacctggcctccgacaccgttcattacgaccctacagatctctattcctgggtccaaagcatgttaaccgaactcaaccccgaacccaacaacaacctcgatccatcttctttcttgatcgacaacaacaacaacatcatcaacagcacagcccctgttttcaacgacgattccgaatatgacctcagagccattcctggcatagcagcctacccttctnctcttcctcaagacaaccacctngacgaaatcgaaacggntaacaacatcaacaagcgcctnaagccatcttcagcggaatcagcagacttccgccgcgtctgagcccacgcgccatgtcgtcctcggttgaccatnaaggaacccggccgttccgtcttgtccaacacttttcctggcggtgccccggaaggccgtttca

SEQ ID NO: 6628 - DNA, 784 bp, Glycine max
  misc_feature (566)..(566): n is a, c, g, or t
  misc_feature (717)..(717): n is a, c, g, or t
  misc_feature (728)..(728): n is a, c, g, or t
  misc_feature (737)..(737): n is a, c, g, or t
  misc_feature (742)..(742): n is a, c, g, or t
  misc_feature (747)..(747): n is a, c, g, or t
  misc_feature (749)..(749): n is a, c, g, or t
  misc_feature (759)..(759): n is a, c, g, or t
  misc_feature (767)..(769): n is a, c, g, or t
  misc_feature (771)..(779): n is a, c, g, or t
  misc_feature (781)..(784): n is a, c, g, or t
  Predicted polypeptide sequence is orthologous to G312
gccatgggatgactacgccaagcgcgcaattaaccctcactaaagggaacaaaagctggagctccaccgcggtggcggccgctctagaactagtggatcccccgggctgcaggaattcggcacgaggcctcgtgcgcacgaggcacgtttcggctttgtcaaccgcttcaagactgcgtttaagtacttctctgctgtgtttgagtctctggagcctaatttggccgcggactcgccggagaggtttcaggtggagagtcttcttctcgggcggcgaatcgcggcggtcattggggggcccgggtcggtgaggagggagagtatggaggacaaagagcagtggagggttctgatggagcgtgctggttttgaatcagtgagtctaagccattatgcaattagtcaagctaagatacttctctggaattacagttacagttctctgttttcgctggtggaatctacaccaccggggtttttgtctctggcttggaaggatgttcctctcttgaccgtctcctcttggcgttagtgaatgggtccgaactagttgattgttattgganaaggggtgccaccttgctccttttttcctggtagtggacacgttattattattattattattaatattttgcgatatgccatggatgatcgatcatgtttggctatgcttagcctcttcattgactgatgttatgcgaaagatttgattgngattcggctgncactaccancaatngaggntntgggagaatngacacttnnncnnnnnnnnngnnnn

SEQ ID NO: 6629 - DNA, 943 bp, Glycine max
  misc_feature (793)..(793): n is a, c, g, or t
  misc_feature (885)..(885): n is a, c, g, or t
  Predicted polypeptide sequence is orthologous to G324
gcaagttgcttcctctgatttgcacgcttcttgatttcatctataaatggggccaatgcttcaggaggcaacatctcactcaaatcaacttcacaaagctgaaaggttgtggttaatggaaaatgactaagaaatcgataccgcctcctgatggcttcagtctgagtaactgtttccaactgtagaatccttccacttattctgtgaggaagcatatcatagctcccataatggtgaagcaaacacttcatgttcagaggatgaagaattagatgctgaccatcagcagcctggtagaaactgtatgaactattttccttcacatctccaataacaccttctgaatgcctttgattatcatttttctcctcatatgaagaagataaattcatttcctgctctattaattctttctccacatccaagttttgatccgaacaggctccagcagttgacttatccaacatcataaccttattttgatcaaggaaatcagaagaagaagttattgatccattagaacagttttcatcatcagtatccatagaatttgcaactgttgatggtatctggtgtccacaatcaataatcatagaagatttttcactgtcatgagacctgtgctcactccaatacctcttcctctgttctaattgttgcattgcagcacaaacataaggaagcttctccaggtcatcaacaagacctgaatcagctctggctagccaaccatctagatcggatattgcatgcttcactgagagatctacatctgatataagagtgaacttanaaaagggatcacagatatctccatcgacacctgatgtggtatttgtctctcgtttatttttagtgacagagaaaggaatcctttttccgtgntaaaaaagtgaaactcacatatctcctactgatactgttttacattgtgatgtgcaag

SEQ ID NO: 6630 - DNA, 677 bp, Glycine max
  Predicted polypeptide sequence is orthologous to G326, G1337
gggaagtcagacgagctgcgccagctctaatacgactcactatagggaaagctggtacgcctgcaggtaccggtccggatttctcgggtcgacccacgcgtccgattcgctatgaatcaaggaaggccagggctgatactagaaaaagggtgagagggagatttgtgaaggcaagtgatgttcaagcgtgatgatgagtgccttttcagaaatctcatccgagttcaatgctcgtgtgtgtgtacataagttacactataagagaaatatggatatattatagttttcatgaactccctgagcattgattgatttgaatcttttttggtagttgatttatttgaatttttgtttgttacattatatgggaagagttttttttgtgtgagattctctcataagagggtgatatataagagagacactgacaataaattggtgagtttgtgttagaaaaaaaaaaaaaaaagggcggccgctctagaggatccaagcttacgtacgcgtgcatgcgacgtcatagctcttctatagtgtcacctaaatgcaattcactggccgtcgttttacaacgtcgtgactgggaaaaccctggcgttacccaacttaatcgccttgcagcacattcctcctttcgccagctggcggtatggcgaagaggcccggaccgatcgccc

SEQ ID NO: 6631 - DNA, 653 bp, Glycine max
  misc_feature (20)..(20): n is a, c, g, or t
  Predicted polypeptide sequence is orthologous to G326
ggtttaagctatgaaccacnattatgccaagcgcgcaattaaccctcactaaagggaacaaaagctggagctccaccgcggtggcggccgctctagaactagtggatcccccgggctgcaggaattcggcacgaggtgctgatggatggttataatggtggaaccatagtgatgcctactgtcccaaaaaaagttgcagaatacatgtgttctcaaagccctgacagtgacataagctgtagtagtcccatgtctgattagaggttagcttgtgcagaaagtgtttccatatgtataccttgtatatttattggtaactgtcttttagaccatgacctagcaattatagagtagttcaacatgaaaactttcaacatttgttccgagctacaatacatcctttacaggaatgtatggtggagcatcaaatagttacttcaaaccgtgctttagctttaccactgtaaagaagttcggattttaatattcaggcaaacgacaaattctgccttcaaaaaaaaaaaaaaaaaaaaaaaaaaaccttgagggggggcccggaacccaattcgccctatagtgagtcgtattacgcccgctcactggccgtcgttttacaacgtcgtgactgggaaaaccctggcgttacccaacta

SEQ ID NO: 6632 - DNA, 758 bp, Glycine max
  misc_feature (1)..(1): n is a, c, g, or t
  misc_feature (758)..(758): n is a, c, g, or t
  Predicted polypeptide sequence is orthologous to G343
nacgggcgagggcggctagtagcatcagcgcgcgtaatacgactcactatagggcgaattgggtaccgggccccccctcgagttttttttttttttttttatttttaaaaaaattgacattaaaatataaaattcaaagataaattcattatacttattacatttaaattctttatttttaaagatcaatttattagtgcatcactggtcgaatttgattatttattcaaaagaagaaaaaaagaaaaaagtaaggacagacaagagacacgtcagcagactttgaagtcgtggtgagtgtgacggtagcattgttcttgctgctggtggcggagcagctccttctggcgacggagctccataaccttgcggtgcgagttcgagtgctgagtcatcacgaacgtagggctcgcggcgggtcggtattcgggtacgagccgacccgacttgaaccgcacgccgcacgcgttgcagagcgtcttcggccccaacggtcccgtgcgccactgcggggtcttatccgtcgcacagtggctgcagcgccgcacgcacgcgccggtcaccgacccttcccttcttgctctcgattttaccgccaacaccggtgaagatgatgatgatgtgggatattcgttattattatcgagtcctggatgggtggaaagaaacgggcatatggtgagaccaatgagatgcggaagggggaatgtgagtgtcatcgacgagaggatgtggagaatgatggaaaggcacggtgn

SEQ ID NO: 6633 - DNA, 837 bp, Glycine max
  misc_feature (757)..(757): n is a, c, g, or t
  Predicted polypeptide sequence is orthologous to G347
ggacgaaaattacaataactaatcctttgatatttgatttagtgcgtgtacacatttgaatttctgcgccagttgactctaggcaccttatcaggttatatgcttgcataataaaatcaagtcaccaaagaagaggaatcaaatgtgcatctaggacttgtaattcgagatgcgaaaaaccctgtgatacaactgcagcaaaaagaggaccttggcaattcaataaatgacaagttgtgtgccctttccactggtcctcgtatacatatatgtaaattaaatcagtctaaatctcatttagaacaaaaatatctttaacttataagctgcaatttcatatacacgaacaatattttcaagcaccagcagttgacgagtcaaatgatgttccctttacacttgtgtaacattttcatgtggcaagtatcatttcttatctgttgtaacgcccacaacgacattcctcaccaatttcccactcgaatcaacagacataggattttctactacgacagtttggctctgagaataaggcattgacgatgaagttgaagatactgttccagagttggctgttccatttggtctctgtacaggaattgaaagccttccattggtcatactgatattagtaatatagcaacaaattgcacatttgactgaggaagctccataaggatacatgagtgttgtccggcagttcgcacaatgaatgacttgattagattctggtacaaggttaatagtgtgacagcangaacatctcacacttgtagcaccacgtgtgtacattagcaatgtcgtacagcctccacaatagagttgtgacatgtccat

SEQ ID NO: 6634 - DNA, 515 bp, Glycine max
  misc_feature (2)..(2): n is a, c, g, or t
  misc_feature (41)..(42): n is a, c, g, or t
  misc_feature (246)..(248): n is a, c, g, or t
  misc_feature (382)..(384): n is a, c, g, or t
  misc_feature (415)..(418): n is a, c, g, or t
  misc_feature (474)..(474): n is a, c, g, or t
  misc_feature (476)..(479): n is a, c, g, or t
  misc_feature (489)..(490): n is a, c, g, or t
  Predicted polypeptide sequence is orthologous to G347
ancacagttgaacacgaaaaaggatttacttttcacaacannaataacaagtaaaatttgtgtcaaggcgccacatcacgccctgtgggctctctacaaattgctcgcctcatatccattaatacatacaggatcttggtccaaatcttatattggaaaaatattgatttccaatgacccattgccggctgcaatatcatatatatattcatatacacaaacaatatcttcctgtgacagcaactnnngtgatgcgtaatgacgcgaactgtacctttcatatgtgatgatgccatttcttatccgctgtaacgtcaacaacaacattgctcaccaatttgccacttgaatcaacacacattggattttctaccactaccgnnngactttgaaataggggcattgatgacgatgnnnnaggtaatgatccaacatcgtttgccccatagggtctatggaccgggattggaaacntnnnnttgctggccnnaaaattaaacggacacatagcacat

SEQ ID NO: 6635 - DNA, 945 bp, Glycine max
  misc_feature (1)..(8): n is a, c, g, or t
  misc_feature (44)..(44): n is a, c, g, or t
  misc_feature (705)..(705): n is a, c, g, or t
  misc_feature (801)..(801): n is a, c, g, or t
  misc_feature (810)..(810): n is a, c, g, or t
  misc_feature (831)..(831): n is a, c, g, or t
  misc_feature (834)..(834): n is a, c, g, or t
  misc_feature (859)..(859): n is a, c, g, or t
  misc_feature (878)..(878): n is a, c, g, or t
  misc_feature (886)..(886): n is a, c, g, or t
  misc_feature (892)..(892): n is a, c, g, or t
  misc_feature (896)..(897): n is a, c, g, or t
  misc_feature (909)..(909): n is a, c, g, or t
  Predicted polypeptide sequence is orthologous to G351, G545
nnnnnnnncccccccccccccccccagcgaagtttgacggtcgntggttacgccacgcgcgctatttaccctcactaaagggaacaaaagctggagctccaccgcggtggcggccgctctagaattagtggatcccccgggctgcaggaattcggcaccagcacaagcataagcacaagcacaagcacaagcacttctctaattccctttcacactctattacagatttcacaagtgcttacacttcaaatggctttggaagctcttcaatcacccaccacagccactccatcgtttagtccctttgaagaaaccagtctcagttacttagagacaccgtggacgaaaggaaagcgttctaagcgtagccgcacggagcaacaactgcaacacccttcatgcaccgaggaagagtacctcgctctttgtctcatcatgctcgctcgcggcggcgccggcagtgtctccaccgccaaacccgctgtctccgacaacaattctgcgccgctatccgccgccaaactgagctacaaatgttcggtttgcaacaaagccttctcctcttaccaagcactcggaggacacaaggccagccaccggaagctcgccggagaaaaccacccgacctcctccgccgtgacgacgagttcggcgtcgaacggtggtggtaggacccacgagtgctccatctgccacaagacgttntcgacaggacaggccttgggaggacacatacgttgtcactacgaaggctgtaacagcgccgttacctgctctgagggagtgggtccactcacacangaagccacncgcgaattcgatctcaacctnccnggctttccggactactcagcagggntcttcgtcgatgacgaggntaccagtnctcatncatnncagaagtcccgnttcattttgaccatacccatgattgaaaatcctcat

SEQ ID NO: 6636 - DNA, 996 bp, Glycine max
  Predicted polypeptide sequence is orthologous to G351, G545
aaaattctcactctctctctcatctcgagatcatagtatcatattcaatatcatttcataccaaacacatggctttggaagctctcaactcaccaacaacaaccgctccatcttttccctttgacgacccaactattccatgggcgaaacgaaaacgttcaaagcgttctcgcgaccatccttctgaagaagagtacctcgccctctgcctcatcatgctcgctcgcggcggcaccaccaccgtcaacaaccgccacgtcagccctccgccgctacagccacagccacagccgacaccagatccttccaccaagctcagttacaaatgctccgtttgcgacaagagcttcccctcttaccaagcgctcggtggacacaaggccagtcaccggaaactcgccggcgccgccgaagaccaaccccccagcaccaccacttcctccgccgccgccaccagctccgcctccggaggtaaggcccatgagtgctccatttgccacaaatccttccccaccggacaggcccttggcggacacaaacgttgtcactacgaaggtaacggtaacggaaataacaacaacagtaacagcgttgtcaccgtcgcctcggaaggcgtgggctccacccacactgtcagtcacggccaccaccgcgacttcgatctcaacatcccggcctttccggatttttcgaccaaggtcggagaagacgaggttgagagccctcaccctgtcatgaagaagcctcgcctcttcgtcattcccaagatcgaaatcccccaatttcaatgaactcgttgaatttttagtttatttttcgactatatattttggagaattttgagagttactataatttgattttgtacatagtacttggaagttttgttggaccgtaccggacccagttctctggttgaggttgtactttcacaacagtggcagatttgcaattcaattcaatttatttgtttattttaaaaaaaaaaaaaaaaaa

SEQ ID NO: 6637 - DNA, 962 bp, Glycine max
  misc_feature (22)..(23): n is a, c, g, or t
  misc_feature (25)..(34): n is a, c, g, or t
  misc_feature (49)..(54): n is a, c, g, or t
  misc_feature (57)..(58): n is a, c, g, or t
  misc_feature (65)..(66): n is a, c, g, or t
  misc_feature (68)..(68): n is a, c, g, or t
  misc_feature (847)..(847): n is a, c, g, or t
  Predicted polypeptide sequence is orthologous to G355
aaccccccctcccccccccccnngnnnnnnnnnngcatttattgatatnnnnnnaannggttttnnangcgggtgttttatttctctcactatacggaaagctggtacgcctgcaggtaccggtccggaattcccgggtcgacccactctttcgcggacgcgtgggcaaaagttgaattggcgcttggacttgaacttgacgccattggaggaggatgatcttaagctcaacctaaggacgcccgtgctcaattgtttcatttgattggaaattaattttgtactaaaccagattctttttttcttattaatatagttaatgtgtatttttcgtaatttattattatacgtacgacctataggtagctcattttgtagtcatattgtgttcataatacgaaacttcttagttcttatccaaaaaaaaataaaaaagggcggccgctctagaggatccaagcttacgtacgcgtgcatgcgacgtcatagctcttctatagtgtcacctaaattcaattcactggccgtcgttttacaacgtcgtgactgggaaaaccctggcgttacccaacttaatcgacttgcagcacatccccctttcgccagctggcgtaatagcgaagaggcccgcaccgatcgcccttcccaacagttgcgcagcctgaatggcgaatgggacgcgccctgtagcggcgcattaagcgcggcgagtgtggtggttacgcgcagcgtgaccgctacacttgccagtgctctagcgcccgctccttttgctttcttccttactttctcgcacgttcgccggctttcaccgtcagctcttaatcgggctcacttatgttcgatntatgcgtacggatctcgacccaataactggttaggtgaggtcacgtatgttcatcgcctgtagacgctgtcgccctggcgttgagtcagtcttatatgcctctgttcaactgaca

SEQ ID NO: 6638 - DNA, 799 bp, Glycine max
  misc_feature (1)..(4): n is a, c, g, or t
  misc_feature (630)..(630): n is a, c, g, or t
  misc_feature (639)..(639): n is a, c, g, or t
  misc_feature (656)..(656): n is a, c, g, or t
  Predicted polypeptide sequence is orthologous to G355
nnnnaaggatacgactgccagactcggccaagcgcgcaattaaccctcactaaagggaacaaaagctggagctccaccgcggtggcggccgctctagaactagtggatcccccgggctgcaggaattcggcacgaggcacaacacaaacacattcaacaacatggtagcaattctcaagagacagggagaaaacgaatccgaagaaaccatcataggcttggcaaaaagtctcatgcaactctcgcgtgtccaacaacaaagcaataagcctcttctcaaaaccttttctccaacggagttcgagtgcaaaacctgtaaccgcaagttttcatcttttcaagctcttggtggccacagggctagccacaagaagcccaagttcgaagctgaagaactcaaagaagaagccaagaagactaaacccaaaatgcacgagtgttcaatttgtggcatggaattctctctgggccaggcactggggggtcacatgagaaaacacagaggtgccattagtgagaacgacaataataatgaagcgttgtcttctataaagcaagcaattgcaaaagctccggttttgaaacgatcgaatagcaagagggtcatgtgcttggagatggacctgaatntgacgcctntggagaatgacttgaangtgttgttcgggagacaaaggctcgctagagtcgatcttttctttgtagaggattaattgattattcctgtatctttcgattcattatttgtgtaaaaatttagtgtgactttgctttcttaattcagtcctcgtgtagacga

SEQ ID NO: 6639 - DNA, 723 bp, Glycine max
  Predicted polypeptide sequence is orthologous to G361, G362, G370, G1995, G2826, G2838
ctactctggaaagtactgtttaactattcgagcctttaattggtaaagcaagctcgcataatctgaaggggcgagaaaaaaagataagatctatttggagcaaagaaggctgaagcagctagaaactagcactaaaaaaattaataataatcaatctaagagttataatttgagatggacatcaacttccctgctctcagcagaaaaatcacggacgttaggagcagattgcagtacagagggtgaggcataaagctgaaaaggaaaggatggagtgcaattagtacggtggtaggtggaagaaggaatcaaaatgggccgtgatgggaagtgcttagtgttattgggttgacgaggatggaagatgggtagaagagaagaagtagtaggagggcctcctcgtaagtaaatggaggagggtagcgtagtaactgtaactgaaggtactgatcttattattgcatgtgagttgagaacagaagcagaagatggtgctgcaatggagcgtctatgagtgtggatttggaaacgcctcgccctctgacgctctttcttgtgggcgttttggtggccccctaaggcctgagagtttccgaatactcgtttgcagtagtggcatctgaattttctgtcctctccaacctcgtattttctttctgcatctgaattcaattcctcctgctctgttagtgggaaaccgaatagtttcggtggcgaggtctg

SEQ ID NO: 6640 - DNA, 706 bp, Glycine max
  misc_feature (591)..(591): n is a, c, g, or t
  Predicted polypeptide sequence is orthologous to G363
gatgcgtgagcgcgcgtaatacgactcactatagggcgaattgggtaccgggccccccctcgagttttttttttttttttttttttttttaatgaaaattcaaataagctaaataagccattgaaaatacaagtctcactgtacagtacaatcaccataaatcaataatttaaagtctgaagagaatgaaactaaagatgaaaaagctttaaagctttacattgagaacatgaggaggcttgtacagatatgtttgtgcatgccacaaaactagtatttgaattcaattaagatgaaaaatctcaaagcctcagagtgagatcaggagacacagatgtttgtgcttgaggtgcagttgctactacaaaactagtatttgaattatgagcatgctcaccatgcctcaaattaacataacccctttcatcaatctgtctgaaacttccaggccaaaacagaccaacatcatcatcttccacgaagatcgtgtccgaaaatagtctttcccgaatttcgctgcagcactcatatcaggagccctcattgaatgatgcacatgcccttggtgcattgcagcatgagcttcgagtncaagcgaccgaaaagcagaaccatggagaggcacctgagccccggggatcactagtctagagcggccgcaccgggtgagctccacttttgtcctttatgaggtaaatgccgctgg

SEQ ID NO: 6641 - DNA, 895 bp, Glycine max
  misc_feature (1)..(4): n is a, c, g, or t
  misc_feature (463)..(463): n is a, c, g, or t
  misc_feature (470)..(470): n is a, c, g, or t
  misc_feature (619)..(619): n is a, c, g, or t
  misc_feature (686)..(686): n is a, c, g, or t
  misc_feature (716)..(716): n is a, c, g, or t
  misc_feature (737)..(737): n is a, c, g, or t
  misc_feature (756)..(756): n is a, c, g, or t
  misc_feature (803)..(803): n is a, c, g, or t
  misc_feature (805)..(805): n is a, c, g, or t
  misc_feature (812)..(812): n is a, c, g, or t
  Predicted polypeptide sequence is orthologous to G363
nnnnggattgaggtcgacctgatacgccagcgcgcattaaccctactaaagggaacaaaagctggagctccaccgcggtggcggccgctctagaactagtggatcccccgggctgcaggaattcggcacgagcacaaacatgatgactccaaacttgaacttggaaatcgaaaatcattcagaaggcagcagccaagtggcttcaaatgtatccttgcatgaagcatctcatgatcttacaaagggcagcaccaccacttcctcctgtctcacaaaggatgaaactgatccaggtttcattacccttgacttgacactcaacttcaataattccggtgatggcgagttgaaagtctcgagtgatgctagcagtgaagttggagctgaagctcctgcttcagcatcagcaactccaagggttttctcttgtaactactgcaggaggaagttctatagctctcangcattanggggtcatcaaaatgcacacaaaagggagaggacgatggctaagcgcgcaatgcgaatggggatgttcactgagagtttacaagcttggcatctctacctcttcatggtcacctttcaggtctcttggccctgaagctcattctgcaantgcacgaagaaccgtgccatcctccgtgacagcactgagggctcctgatatgagagctgctgcaaantttgagagaaaccaaatttggatcactgtnttcaaatgagatgggatgagntgatctttgggcccctggntcaaacagtagaccaacaaagagctctggtaaggtatgagaatgccnanagtcaanagctagtacttccatgtgcctctcacaccagttctgattttctgtctacaatgagaacctagttaggttagacatgcatcctc

SEQ ID NO: 6642 - DNA, 794 bp, Glycine max
  misc_feature (7)..(8): n is a, c, g, or t
  misc_feature (513)..(515): n is a, c, g, or t
  misc_feature (687)..(689): n is a, c, g, or t
  misc_feature (728)..(728): n is a, c, g, or t
  misc_feature (738)..(739): n is a, c, g, or t
  misc_feature (742)..(742): n is a, c, g, or t
  misc_feature (754)..(758): n is a, c, g, or t
  misc_feature (764)..(766): n is a, c, g, or t
  misc_feature (785)..(785): n is a, c, g, or t
  Predicted polypeptide sequence is orthologous to G363
atcattnntccattatcctgaacgctgtatcatggttcatgaataacgaagtaaaatacatatgagaggaaaccattaataacatgtgagattaaaataagctaaaatcgccattggaaatacacatctcactgtacaatgcacgccctattaattaataatttcatgtctgaagagaatgaaatcaaagactaaaaaatctcaagagaagtgatacatacacacataaaaactctgataattaaatccctcacaatgaaaatgagtggttgagaaaattttggctgaatgcaaagcaatggatgagtcagttcttagccacttatttattactttgtgaggcctttgcttgtgtatgtatcatcattcttaagccttaaacttaaagcttcaatgtgagatcaggagatgtagaagcttgtggtggaggaggcaccattggaattaaactagcatttgaactttgagcatgtcctacattaacaccagctccttgttggtctacctgtctgnnnctgccaggccaaaagaatccaacatcatcatcttccacgaaaaccagtgatccaaattggtttctctcaaattttgcagcagctctcatatcaggagccctcagtgctgccgcggaggacggcacgtgtcttcggtgcattgcagaatgagcttcaaggccaagagacctgnnnggtgaaccatgaagaggtagagatgccaagcttgtatanctctcagtgnncanccccattcgcannnnncgcttnnncattgtcctctccattttntgagcattt

SEQ ID NO: 6643 - DNA, 646 bp, Glycine max
  misc_feature (8)..(8): n is a, c, g, or t
  misc_feature (14)..(14): n is a, c, g, or t
  misc_feature (21)..(21): n is a, c, g, or t
  misc_feature (33)..(33): n is a, c, g, or t
  misc_feature (59)..(59): n is a, c, g, or t
  Predicted polypeptide sequence is orthologous to G370, G1995
ttttaaanctatgnaccctcnattacgtccagncgcgcaattaaccctcacttaaaggnaacaaaagctggagctccaccgcggtggcggccgctctagaactagtggatcccccgggctgcaggaattcggcacgaggggttcttccattccaacaccaccaccaccaacaatgcgcttatccaacatggaacaacaacaacaacaacacgcgcttctacggaacaacaacaacgacgtcgttttctcaccaccaccaacaccaacaacaacctattaacggaagccccttagcattttggcgaattcctaatggcaccaccattaataataataaccctagtttcagccacgagcgttcttcgacgttgccgcctttgttcgcgactgaggaaatagcgaacgtgagagcctcctcgcaggttgttgtcggagcctcggggccgatgacgacgcaaaaccgctacgtgtatgactcgaaacaacgcgaccatgtgagtttggatcttcatctgtaatagtagtaacatgtttcatgttttcgtacatagtattatcatgagccagtaataacaactctattatgatgatgatgatggcatggcgctacgagagaatcgagggatttgcaggcagcgactctttt

SEQ ID NO: 6644 - DNA, 607 bp, Glycine max
  Predicted polypeptide sequence is orthologous to G370
tgaatctggtgagcaaatatggagctttgttggcaaacatccatccatggttcttgaagaagcatggagataaaggggtgtgagagggtcctcaccactcacactcctccacttaaaacagtttgttttggcttagctttggcttctctaatcaacaagggatgtgttctaacattctctcttgagtggcagaagcagatatgcattctccaaaggaggagaggctttggctacagcctggcaaaccggcaagtcacgaaaaggcaatggactccattggggtctctatggctatctattgctcatctatgtagttcttcttgctgtagaatgtaataaaacaaagttggccttcctttgagaagttaccaacttttgctgtccaaattactcaatttgcagctgactagaattcctttctctctgatcagtttctgcagatgagtaggtaggtaatttgtgatcactcccttcccttcatgtctgtgttcccttttccatgcttgtttgtgttgttagttataaccttatgaggaataaaagaatagtacaattctagtccctcaaagtttaggattgtattctattgaactttaatagaaaagct

SEQ ID NO: 6645 - DNA, 745 bp, Glycine max
  Predicted polypeptide sequence is orthologous to G375
atttatccttacaaaaattgcctgcacatacatacaaccaatcatctgtaaaatattacaagcgaatatatctacacatatctacctgtatattttgtacggttttgtgatttacatcacttttttacgaacaatgggcaacaagaatgaggaagaaaaaaagtagcaaaatcagcagcagcagcagcagcacagcataggcttttttctctttcagctttgttgaggtacacctctccagagatccattaaaatcatcaaatatttttttgctagatttcatacgacaaactcatgcagcaaatggggattgccaaacctgtgttgttgctttcctgaatccgtgaaatgataatctagcaaatcagtctccggggaagaggccaatgcttgattacgtcgtttgcgtatggcatcatcagacatggcaaacccatcactttcacagttcctcaactccaatgcaagggaaacgtggctacccacagtaaagttacccaactctgataaatcatatgtggcatgagtagaacaacccattaggcctccatcattctggttggttgagatagaataaaagttgttgttgttgttcatgccaagcctttgttggttttgatcaccctgcaatttcccagttccagaatccatcaccacattttctacattgacccctctatccagttctgcttgaggttggacttggacactgtcaacagttactaaattgtcccgacagcaacga

SEQ ID NO: 6646 - DNA, 728 bp, Glycine max
  Predicted polypeptide sequence is orthologous to G377
cccacgcgtccgggcaagtggggaggggggtttgtgtttttttgttatatttgtatgttgttctgtgctgagtccttaatttgtggctgagaattaattattattattatcaattatgggtctctcaaatttcccaagtgcatctgaaggggtgctacctgtgcttgtgataaacacggttctctcagtggcagtgttgaagaacatgtttagatccatgctccaagtagtacttggtggcagtgctgctgctaatggttcaaacattgaacatgatgaaagttcatcatcatcatgggaaaggagggtgtcaataactcagtacaagtcattgtgccacagccacgacataggaggaacaagtatggctatggtggagtgctgcgtttgtttgtgtcgttttgaagccaatcaagaggtcagtgagttgccttgcaagcattacttccacagaggttgcttggacaaatggtttgataacaaacacaccacttgtcccttgtgccgttccatcgactagacagacatatacatacaaaggttgattaattaccattagagagatagctagctagttaattagttgttgctatatactgttaactggttatagtgaaaagaatcaatgcctcttttcatttctttactttagatttgtaaaactccttcaaccaactcagtttctctttgttttaggttttatggaacgtaatgagagatgacgttgc

SEQ ID NO: 6647 - DNA, 766 bp, Glycine max
  misc_feature (766)..(766): n is a, c, g, or t
  Predicted polypeptide sequence is orthologous to G377
gaagttatacctctacgatgactacgccaagctctaatacgactcactatagggaaagctggtacgcctgcaggtaccggtccggaattcccgggtcgacccacgcgtccgagtgggttggcttgtgtttttttgttatatatgttgggttgtcctgtgctgggtctggtctcattctccttattaatttgtgttaagtagcaaaccaaaaccaaaccaattttgtggttgtgtgtgagtgagaaactgagaataattatcaattatgggcctctcaaatttcccaattagtgcatctgaaagggtgcttacctgtgcttgtgataaacacggttttctcagtggctttgttgaagagcatgtttagatccatgctccaagtagtgtttggtggcagtgctgctagtagttcttcaaacattgaacatgatgatgaaattagttcatcatcatcatcacgggaaaggagggtgtcaataactcactacaagtcattgggccacagtcatgacataggaagaggaacaagggtggtatggtggagtgctagttagttcgtatcagcagcagacaatcaagaggacgacaggaggctgaggcgagacttgacgagaggagctagacaagaggtcaagttaatacaaacacagacaaaggactatgacggacaagcatgattaacaagacaagcgaacaaagtggatagacacgtcggcggacgccgggcttagtatagctactcgcacaggagacagcgaacgataan

SEQ ID NO: 6648 - DNA, 791 bp, Glycine max
  misc_feature (52)..(58): n is a, c, g, or t
  misc_feature (526)..(527): n is a, c, g, or t
  Predicted polypeptide sequence is orthologous to G380
tatataagtaaataaaatcaccccaaacgcgtaaatccagtaccaatgattnnnnnnnttgaatcatattttttgtacctagttttccgttcagcctaactccaatccgaacaatattaaaaaatttcataaatgtaaaccaagccttgtcaacttgagttaagaagcgctccttcatcacctaaaccgggagacctttggatttagataataaataaacaaattcgggggagggaggcagggtaggggaaacctctgtcagtcaggtacgacaatttactaggctagaaacagaagacaaggcaccaagaaccagaatttcctgggtaaattgtgccaattttttttttccttcatggtcatggtatttgcctgaggacagagagtcacatacatcatgttgccaagcccgttgtcttacaaatgggacacagattcttatgcattagccactgtttgatacagctgctatggaaatcatggccacaatcaagcgttccaatatcattcccatcaccataatccnnctgacaaacacaacagggttctgcatcagtctcagaccctttttcaaccgagtgttttctctgtttcaagagtttcgatagggtttcctcactcaatccagtactcacatttccaatgcgctcttccagagccaacaactcctcataagacatgttatcaacatcaagtcgcatatccctgtgtcgatcatgaacatcagctattctagaaagaaatgattgatgctcaaggatcacaacatccagtcttggcctgtttctttt

SEQ ID NO: 6649 - DNA, 704 bp, Glycine max
  Predicted polypeptide sequence is orthologous to G384, G385
tttttttttttttttttttttttttttttttttttttttgtgaaactgtgacggcggtaacatctgtgacaacactagagaaagagatgaagtttacaatacaataggaaaagtcaacataaccacacttaggaaagtttgctcaatcctacaaatactactccaaaattctacgctaaaataaatagcgagtctgaaatttgcagtttttctaagttaaaatactacagctggatggaaccattttagtcttcaattcataagtgaaagtcaatacccgaacctaagattcttcaaactcctaacgttgaagtgatactccgaggtgcgttcattgacttcttgcccttgttttggaaacgaaataggcaccactccaagctcgatcgttactttctctaccttaatttgttcttctgacatgtttttgaaagttctgaattgaaatcaggtgttgttgttgtcccgtttgactgcaactttgatcctttcaactgtgcacttaattaaactgttaacagtggccactgaacccagagataactttgcggttggagctgaatcaactaagatctggaatccaactgtgagtagagaacctccagatccaacttcatgctttggcccaccatttaatgccggaggcccatcaggaagaatagcaaagcccgaggggagcagggcaacataatctggatctcctc

SEQ ID NO: 6650 - DNA, 802 bp, Glycine max
  misc_feature (612)..(612): n is a, c, g, or t
  misc_feature (645)..(645): n is a, c, g, or t
  Predicted polypeptide sequence is orthologous to G384, G385
aatgaactgcatgagaagactacgccaagcgcgcaattaaccctcactaaagggaacaaaagctggagctccaccgcggtggcggccgctctagttctattggatcccccgggctgcaggaattcggcaccagatcgttctcagtgctgcaacttctttttggcttcctgtgtcaccaaaaagggtttttgaattcctccgcgatgagaactccagaagtgagtgggatattctttccaacggtggagttgtccaagaaatggcacacattgccaatggccgagacactggaaattgtgtctccctacttcgtgtgaatagtgcgaattcaagccaaagcaacatgttgatattacaagagagttgcgcggactcaacaggatcttttgtgatatatgctcctgtagatattgtggcaatgaacgtggttctgaatggaggggacccggactacgtggcccttcttccttcaggatttgctatactcccagatggaaccactgcacatggaggtggcattggtgacactggacatggtggttctctcttgactgtggcatttcaaatattggttgattcggttccaaccgcaaagctgtctcttggatctgntgctactgttaacaatctcattgcctgcactgntgagagattaaagctgcttatctggtgagttgctgacctaatgatcatcctttagaaaaggataaagggtgcaatgcatttggacaaatgggaggtgtggaacttcgcttataccaaaatgataagaattgaaagtcagaacgcctttctggatctt

SEQ ID NO: 6651 - DNA, 880 bp, Glycine max
  misc_feature (1)..(2): n is a, c, g, or t
  misc_feature (16)..(16): n is a, c, g, or t
  misc_feature (334)..(334): n is a, c, g, or t
  misc_feature (592)..(592): n is a, c, g, or t
  misc_feature (661)..(661): n is a, c, g, or t
  misc_feature (698)..(700): n is a, c, g, or t
  misc_feature (703)..(704): n is a, c, g, or t
  misc_feature (880)..(880): n is a, c, g, or t
  Predicted polypeptide sequence is orthologous to G386, G707
nnaagctgcgatgcangtagataactactgcgcgcaattaaccctcactaaagggaacaaaagctggagctccaccgcggtggcggccgctctagaactagtggatcccccgggctgcaggaattcggcaccagatcactgaacgtggtgatgagtggtggagattctgcatacgttgcactcttgccttcaggctttgcaattctccccgatggccactgcaacgacaacggctgcaacgggactttacagaagggtggcggtggcaatgacggcggcggaagccttctcacagtcgggttccaaatactggtgaacagtctcccaacagcanagctcacagtggagtcagtggacactgtgaacaacctcatctcctgcaccattcagaagatcaaagcttctctcagagttgcatgatgatgacaacaacaaccattttgttaatgcagtaataataatgcaagttaagttaccttaaattattattttgtggtctttatatttttggtttctaagatgaatatttattcggagaggggttatataatttggctgggtgtataggaattataattatatagagagtagntggaagaggagctgaggcagaaaggatcgcgtaagaaaggtttcgagtcaagaacgaaccgcgatggangaacttgtttgcatgcagcttttctgcctcatagtgnnngtnntcggggtttaaaatttttttggggggaaacccttttttccgcgttttttcaaacccccctttggccggggaaaaaaggttttttaagtctctgtgctcttgttggatacattagaaaaacaacacatgtgcctgtgtacttacttaaattattactagtgcccatcctatcatcan

SEQ ID NO: 6652 - DNA, 349 bp, Glycine max
  Predicted polypeptide sequence is orthologous to G386, G707
cctcatctcgtgcacggttcagaagatcaaagccgcgctccactgcgaaagttaaacgtcacgtgatcggtcacgtgagtctggtttttttttgttattttgtatttattgaggttcttgttgaaaattttaacgttgttgacgatggatggaagggtggcgcgtgtgaaagacgcgtgggttggttgagtcaagaacgaaccgcgcgtggggaaaaaaagagaaaactccttgcatgggttatgttccttaacacaaggcaagggtcgtggttcgggtattgactcgggtcgaccttttttgtttgctcgagtacaagaaagcaatagaggaatggaaaaaaaaaaaa

SEQ ID NO: 6653 - DNA, 673 bp, Glycine max
  misc_feature (528)..(529): n is a, c, g, or t
  misc_feature (582)..(582): n is a, c, g, or t
  misc_feature (621)..(625): n is a, c, g, or t
  misc_feature (629)..(631): n is a, c, g, or t
  misc_feature (640)..(643): n is a, c, g, or t
  misc_feature (650)..(651): n is a, c, g, or t
  misc_feature (658)..(659): n is a, c, g, or t
  misc_feature (661)..(662): n is a, c, g, or t
  misc_feature (664)..(666): n is a, c, g, or t
  misc_feature (668)..(669): n is a, c, g, or t
  Predicted polypeptide sequence is orthologous to G388
actgcataacggaattaacaaatgataattctatacacgccatacttaatactctaggttctaaaagctttttgtctatctttctacctacagaactgcagatacagatatacaaactcaaccaaccctccttggtagtggaataatgagtaaaactaacccagaaacggagaaaggggacaaaagcaagctatttttgccaaaccgaataccatccaaaaaagggaatagagagcctaagattatcacagctaattaaagtctatgactctctatcaagtgattatctgattttgactagccatcttcacattgtagactcgttcggatatttctcaatgtacaagatacaagagtgttgaccgagtccacagactccattgttaacttggcagcgggagaagcattggtaagaatctggaatgccattgtaaacaaagatcctccctcggtatttttttcttcctgccttgaactaatcaccaatggccttgactcaagaccatcaggaataatagagaatcctgnnggcagtatggcaagattgctcgaatcacatcctgtcatcacagactgagtgcnagtaatgtccacagaagcatataccaccattgactcatnnnnntttnnntagctatcnnnnagtatcnncacactnntnncnnncnnttta

SEQ ID NO: 6654 - DNA, 788 bp, Glycine max
  misc_feature (658)..(658): n is a, c, g, or t
  misc_feature (716)..(716): n is a, c, g, or t
  misc_feature (734)..(734): n is a, c, g, or t
  Predicted polypeptide sequence is orthologous to G390, G391, G438
ggaaaaagcagtctataattcaacaaggagtttatatacgaagaaaggtacatacttagtaaaagcataaagcaatgctaatctaatggcacacaaccatgcgtgttcataaaatccagacattagttaacattcgttgttggtgtgacaatttctttgtaaaatactccaaacataaattaatagatataataagtatctaaatgatggctccccccatcagacaaaagaccagttcatgaacacaaaggcaaggcagtggttggaatcatcatcatcgagaactttccaagcaatggcctgctcataagacactggtcgattcatacttgatacacatattcctgctggcagatatgcaaatccctgttgcattatcttggagaactcaatgcagagaaacttcctgccagcttcatcaagaactttatccagcattatgtcttgaagagcaacaagagtggtttcaagcatgtcaagtccagcttggtttgcaaaggtgaacactggagatgcatttgtttttacagaacagcacaatattgcatctggatggtgccaaagttgcttcaagattgcatcaccagatgtggactcaacgctaaaaagctctgtgcaggtgtggagactgtagcttttgcagatccatcttgctaangtaagggcctctggtggaccaagaagtgactttggccccaactgtgtactgatcctanagggagcaattgccatancaaccctctgaacagatcgccacacattacgcacatactggcgagccataacag

SEQ ID NO: 6655 - DNA, 878 bp, Glycine max
  misc_feature (812)..(812): n is a, c, g, or t
  misc_feature (827)..(828): n is a, c, g, or t
  misc_feature (850)..(850): n is a, c, g, or t
  Predicted polypeptide sequence is orthologous to G390, G391, G438
agtcataaaatgtgcaatccaagtatttagtgcaaatacagtaaaataccaaccaacaaagctcaagtgtcttgagtaaatctttatctaacactttagattacaataagcactactgtacttagaacaaaatgtcaaacaaaagaccagttcataaacataaagcaaatacaatgagcattctcttcttcattcagcaccttccaagcaacgactctttcgtatgagacaggccgccccatgcttgaaagacaaataccaccctgaagacatgcaaaaccctaccaaacaaggagaaattaatagaaagcatcagttctgttgacagcataccccaattcaaaggggcaaagaaagagaggggaaaaaaaaggaagcaagttcactctctacaaaaataatttatcaagtgaagcataatctgatatgcaatataactaaacagcacatacaagaaatatgtagccatacatttagtaaaaaaataacatccaatagcaagccacatggaagtgtggaatcaatgcttttattacaacaaaatagtagacctgttgaataatctggggaaactctgaaaagagaatttttcgttcatgatcatcaaatattttctccaaaggtatatcttgtaatgcaactagggtggtctccagcatgtcaagcccagcctggttcgagaaagtaaacactggcaatgcctttagagtgcagcataatattgcatctgagtgatgccacaaggacttgagcaaagattcattcccctcgttattagatttaagtagctccacacccaagtagcacctatnactgttgcagatccnnatgagcagggtttgtgcttcangagtacccaatggtgacccgacagcaac

SEQ ID NO: 6656 - DNA, 925 bp, Glycine max
  misc_feature (598)..(598): n is a, c, g, or t
  misc_feature (622)..(622): n is a, c, g, or t
  misc_feature (768)..(768): n is a, c, g, or t
  misc_feature (770)..(770): n is a, c, g, or t
  misc_feature (836)..(836): n is a, c, g, or t
  misc_feature (853)..(853): n is a, c, g, or t
  misc_feature (865)..(865): n is a, c, g, or t
  Predicted polypeptide sequence is orthologous to G390, G391, G438
aggggaggcgcccccccccaccccccccccccgacgcaattacgagcagtccacagggccgcaatcgcgctattaaccctcactaaagggaacaaaagctggagctccaccgcggtggcggccgctctagaactagtggatcccccgggctgcaggaattcggcacgagcggcacgagcagcagtctgcaagacaacgtcgcggtcatggcacgccaatatgtccgcagtgtgatttcctccgtgcagagggttgccatggctatatctccatctggtataaacccatcaattggagctaaactttctcctggttctccagaggctgttacactagctcactggatctgccaaagttatagttactatttagggtccgacttactgagatcagattctcttgttggtgacatgatgctgaaacaactgtggcatcaccaggatgccattctatgctgttcactgaagtcattgccagtgttcatatttgcaaatcaagctggccttgacatgttggaaacaaccctagttgccttacaagatatcacattggataaaatatttgatgaggctggacgcaaggcattgtgtacagactntgccaagttaatggagcagggttntgcttatctgccagctggaatctgcatgtcgacgatggggcgccatgtgtcatatgaccaagccattgcatggaaagttcttactgcggaagacaacactgctcactgcttggctgtctctgtcataaattggtcatttgtatgananatccgattcgtgtgccctgctttttcccacttgaacatacaaatgaaagggtaaaagggagacaangacagcttggcgggaanaaagagtcgtanatgttgtattacacatcaggatcaggttgcatttaatcgatttaattattcttattaggc

SEQ ID NO: 6657 - DNA, 802 bp, Glycine max
  misc_feature (691)..(691): n is a, c, g, or t
  Predicted polypeptide sequence is orthologous to G390, G391, G438
atgtgggcacgcttgaccatgattacgccaagcgcgcaattaaccctcactaaagggaacaaaagctggagctccaccgcggtggcggccgctctagaactagtggatcccccgggctgcaggcagctggggccaaagtcactttctggatcacccgaggcccttaccttagcgcgatggatctgtagaagctacagggttcacactggcacagagctttttaaagctgagtccacagctggtgatgcaatccttaagcaactttggcaccatcccgatgcaatcatatgctgttctgtgaaaacaaatgcatctccagtgttcaccttttcgaaccaggctggtttagacatgcttgaaactactcttgtttcccttcaagatataatgcttgataaagttcttgatgaatctggcaggaagattctctgctccgagttctccaagataatgcaacagggttttgcatctctccctgcaggaatatgtgtatctagtatgaatcggccagtgtcctatgagcaggttgttgcatggaaagtcctcaatgatgatgattctaatcactgcctagccttcatgttcatcaattggtcttttgtatgatggatgaaccatatctagagactactacttattttatctactaatcagatgatactatcacagacagatgtactgatgtcagctnttctttatgccctatgtatgaagtatgctaatgttacttattcgctatatatataaaatatctagtttaaaaaaaaaaaaaaaaaactcgaggggggggcccggtacccca

SEQ ID NO: 6658 - DNA, 954 bp, Glycine max
  misc_feature (622)..(622): n is a, c, g, or t
  misc_feature (646)..(646): n is a, c, g, or t
  misc_feature (648)..(648): n is a, c, g, or t
  misc_feature (721)..(721): n is a, c, g, or t
  misc_feature (723)..(723): n is a, c, g, or t
  misc_feature (728)..(728): n is a, c, g, or t
  misc_feature (784)..(784): n is a, c, g, or t
  misc_feature (838)..(838): n is a, c, g, or t
  misc_feature (954)..(954): n is a, c, g, or t
  Predicted polypeptide sequence is orthologous to G394
ggactgaaatggcggctgtaggacgtctgactatagggaatttggccctcgaggccaagaattcaagcccatgataaaagtgattatatgttttttttattgaattttgtgattaatatttgtttttttgttatttgtgacgcagaacaaagctgaagcagacagaggtggactgcgagttcctaaagaaatgttgtgagacattaacagacgaaaacagacggttacagaaggagcttcaagagcttaaagcactgaaactggctcagcctctgtacatgcctatgcctgcggcaacactcaccatgtgcccctcttgtgagaggctcggcggcggcatcaacggtggcggcggcggttcccctaagacaccattctccatggctcctaagcctcacttcttcaaccccttcgccaacccttctgcagcatgttgattgattgttattataattaggcttttaattagttttcattaaaaaaaaaaaaaacagcaaaaaccaaagaagagttgccccacaacctttgtatttttttggttgagggatacgtcttatgaactacatagctagtgaaaaaaaggttaagggtgtaattaattaactaatatactgtagaaatntgtaactgctgattagaattactntntactcttcctttattaatgttatgtttataaatggttatagaagacatccatctatgaaggaattaatgactntnttcanacaaaagcttattccctttagtgagggtaaatttagcttggcacttgccgtcgttntacaacgtcgtgactgggaaaactctggcgtaccccactttatcgctttgcagncattccccttccgccagctgcgtattgcgaagaggcccgcaccgatcgcctttctacagtgtgcaaactgtatgcgaatgggaacgcccctgtacgcgcatataacacgcggggtn

SEQ ID NO: 6659 - DNA, 793 bp, Glycine max
  misc_feature (1)..(1): n is a, c, g, or t
  misc_feature (566)..(566): n is a, c, g, or t
  misc_feature (585)..(585): n is a, c, g, or t
  misc_feature (715)..(715): n is a, c, g, or t
  misc_feature (756)..(756): n is a, c, g, or t
  misc_feature (775)..(777): n is a, c, g, or t
  misc_feature (781)..(783): n is a, c, g, or t
  misc_feature (785)..(785): n is a, c, g, or t
  misc_feature (787)..(789): n is a, c, g, or t
  misc_feature (791)..(791): n is a, c, g, or t
  misc_feature (793)..(793): n is a, c, g, or t
  Predicted polypeptide sequence is orthologous to G394
nggggtgttgaatcccgccaagcgcgcaattaaccctcactaaagggaacaaaagctggagctccaccgcggtggcggccgctctagaactagtggatcccccgggctgcaggaattcggcacgaggtgagttcttaaagaaatgctgtgaaacattgaaggacgaaaacaggaggttaaagaaggagctgcaagagctgaaggcactgaaactagctcaacccttgtacatgcctatgcctgctgccacactcaccatgtgcccttcttgcgacaggctcggtggcgttaacgataacggttcgaataaaagccccttctccatggctcccaagcctcacttctataaccccttcgccaatccttcagcagcatgttgattattgtggttaggttttcactattcattcggggcgaagaggttaaaaaggcaagagttatttcccacaaccattgtatttttttggttgagggcgatgcgtctagctagctagggaaaattaagctgtaattagctaatactgttgagaatagttactgctgattgaaattatcttttgcttttntcttcatctatttgtttgntatattaacccgttcagaaggtgttcatctatgaaagaatttagatttgtttttcttgtgtcgtcattgataaaaatgctcatggaaagtgttatttatttagatattgatacacatatgttcaatgtgngaaaccatccattatcccccttccatgattgctggaggatngtgatttggtggggctttnnnaaannnanannnanan

SEQ ID NO: 6660 - DNA, 868 bp, Glycine max
  Predicted polypeptide sequence is orthologous to G409
atagtactaattaaccatgttttaatacttgaacaagaaatatacttactttaattttggcagtacaaccattaaccaacacaagacaccattgaccaaattactactagactttatttattaaactcgggttaaggacacttcaactcctcctaggggtccaagccacccaatccaggcgtttactttttcctccctcgcccacatgatacattatacaatattattacgttttcttaattaagcatctaatttcgaaagcactgctgcattaccattttatccaacataatacatattagtccaccaacccaatgtctctccttcctcatggttttggtgctcagtttcagataccacaaacacatccaagtaactcctcccatcatcactcccatcctcctcctccgactgaaccctctcgaccgggcccacacatccaccatagttgtcagctagaatgtatgaatcaacactgtcaacaaccacctgtggactaccctcatccaccaccgcacttccaacactcccactactcaggtggtcctccacccttgtgccgaaaatcggagccatatcttcatctactggaattggatcaactttcttgtcacataatggttcctcaggcacctctttagcttgaacttgaagcttttcatttaaggataccacctcagatttgagtttctcattctccttcataattgaatcataggatgaaagtagggtatcgtatgaagacttgagaacatcataatccctttcaagttgcttggtcttccatcgagccctgcggttctgaaaccacacagccacctgcctggggctgcatcccagcttcttagccaactgggtcttcctctca

SEQ ID NO: 6661 - DNA, 1252 bp, Glycine max
  misc_feature (1)..(3): n is a, c, g, or t
  misc_feature (595)..(595): n is a, c, g, or t
  misc_feature (689)..(689): n is a, c, g, or t
  misc_feature (902)..(939): n is a, c, g, or t
  misc_feature (1190)..(1190): n is a, c, g, or t
  misc_feature (1194)..(1194): n is a, c, g, or t
  misc_feature (1219)..(1219): n is a, c, g, or t
  misc_feature (1227)..(1232): n is a, c, g, or t
  misc_feature (1235)..(1236): n is a, c, g, or t
  misc_feature (1238)..(1243): n is a, c, g, or t
  misc_feature (1247)..(1248): n is a, c, g, or t
  misc_feature (1250)..(1251): n is a, c, g, or t
  Predicted polypeptide sequence is orthologous to G409
nnnggcgagggtgttttttttttttttgtaaggagaaaatgctcacgccaagcgtgcaattaaccctcactaaagggaacaaaagctggagctccaccgcggtggcggccgctctagaactagtggatcccccgggctgcaggctgcatgcaagttttgagaatcttaagtccaactatgacagcctcctcaaggagaaagacaacttaaaagctgaggtggcgagcctcaatgagaaggtgcttgcaagagggaaacaagaggggcacatgaagcagcaggctgaaagtgaagaagaaacaaaaagattattgcatttgcaggaacaggaaccaccccagaggcttttactggaatcagtttcggagggagaaggatccaaagtctcttctgttgtcgggggttgtaaacaggaagatatcagttcagccaggagtgatattttggattcagatagtccacattacaccgatggagttaactccgcactgctagagcatggtgattcttcttatgtgtttgagcatgatcaatcggatatgtcacaagatgaagaagataacctcagcaaaagtctctacccttcgtacctctntcccaaacttgaagaagatgtggattactccgacccgcctgaaagttcttgtaattttggattttctgaaggagatcacgcactttggacctgngcatactaagttttcttcatggtcatgttgtgtgttgtgtcatatgttttttagtaattagtattagtatttgcactttttgtccagctttcaaaatgctatagctttagcttatcaggaaagaaagtttggtttctttggctcatttggtaagactggaaatcaactggtggttcaaagtaataaatatggctcttgttggatgtaaaaaannnnnnnnnnnnnnnnnnnnnnnnnnnnnnnnnnnnnnaaaaaaaaaaaaaatctggggggcccggccccaatccctatggggggttaccgcctctgggccgttttaaaaggggagggaaacctgtgtcccaataacggtgccaacccttttccggggggtaaaaagggccccagccccctccaatggccaaatagaagggcccctgggcataagggggggggggggacggagcaattccccccacccgcctttttccttttttctggcgctcccaaaaaggggcgtgnggantagtgcccccaaaaaaagggggtgngggccccnnnnnnttnntnnnnnntttnntnnc

SEQ ID NO: 6662 - DNA, 888 bp, Glycine max
  misc_feature (5)..(5): n is a, c, g, or t
  Predicted polypeptide sequence is orthologous to G409
ccccntcaccccccgcccccagccgccccgccgcccgcccggatgaacaacatgccagtccccagctaaaattaaccctcactaaagggaataagcttctctgaggatccaaccatggcggctggaactgtcttctgcgctgctgctactgctgcttctaatttgacaacaaccacttttcttcacaaccaaacacctccttccacctcctctcagcctcctctcgattctcttttcctctctgcctcttcccctttcctcggttcaagatctatagtgagttttggagatgttcaaggagggaaggggtgcaatgattcattcttccggccctatgatgagaatggggatgaggacatggacgagtacttccaccagcctgagaagaagcgcaggctctccgcggagcaagtgaagtttctatgagaagagctttgatgaggagaacaagctcgagcccgagaggaagatttggctagccaaggaactcggcttgcagcctaagcaggtggcgattcggtttcagaaccgccgcgcgcgctggaagaccaagcagatggaaaaggactatgattccctgcatgctagttacaatgatctcaaggctaactatgacaaccttctcagggaaaaggataaactcagagctgaggtggtcacttgttgaattcttggtctcgatggccaaattacctatagtgagtcgtattacattcgtaatcatgtcatagctgcatcctgtgtgaaagtgtatccgctcacaattccacacaacatactagccggaagacatacgtgtaaagcctgggtagcctatgagtgagctaactcacattaactgcgttgcgctcactgtccgcattctcagtcggcaaagctgacatgcag

SEQ ID NO: 6663 - DNA, 1136 bp, Glycine max
  Predicted polypeptide sequence is orthologous to G409
ggcacgaggtcacttctcctccaaaacgaaaggctcccttgctcctctgaagtccttgagtctctttgggctcagacctctaaccctgcttccttccaaggttcaaaacccgtggttgattttgagaatgtaagtgggagcaggatgacggataggcctttctttcaagcgttggagaaggaagagaactgtgatgaggattacgaggggtgtttccaccaaccggggaagaaaaggaggctcacaagcgaacaagttcagttccttgaaaggaactttgaggtagagaacaagcttgaacccgaaaggaaagtccaacttgcaaaagagcttggcttgcagccaaggcaagttgctatatggttccaaaaccgaagggcaaggttcaagaccaagcagctagaaaaagactatggcgtgttgaaagctagttatgacagactcaaaagtgactatgaaagtcttgttcaagagaatgacaagttaaaagcagaggtgaattctctggagagcaaattgattcttagagataaagagaaggaggagaattcggatgacaagtcatctcctgatgatgctgtcaattcttcttcaccccacaacaacaaggagcctatggatttattaattatttcaaaaaatgcaacaacaacaacaacatctgaaaatgggaccaaagtgttgtcaccactcccactccctattatggtaacatgctgcaagcaagaagatgccaactcagccaaaagtgatgtccttgattcggatagcccacattgcacttcattcgtggagcctgctgattcctctcatgcctttgaaccagaagaccactcagaagacttctcccaagatgaagaggataaccttagtgaaaaccttttgatgaccttcccttcttcttgttgcttacctaaggttgaagaacactgctatgacggccctcctgaaaactcttgtaattttggcttccaggttgaggatcaaaccttctgtttctggccctattgaaccaaaccaaccaaccaaccgctagcaatgttttaaaaaactttgcagttgtaaccatgtactagaaagcaataaaaatggtattgttacttctaaaaaaaaaaaaaaaaaaaaaaaaaaaaaaa

SEQ ID NO: 6664 - DNA, 853 bp, Glycine max
  misc_feature (825)..(826): n is a, c, g, or t
  Predicted polypeptide sequence is orthologous to G418, G965
aataataataataataataataataataataaagcaacctcctatatatacgtatcattattatcttttatgatcatgtgatgtaatatagggaattgattaagtttaaatgcctccaaagtccctaacggagaacggagttttctccggcatgttcccggcgtggcgaagccctagcgtgagtgacacgtcaccggtggtggtcccaaacctaatcagagtggagccaatgtcagaagcagcagaagcggtcccaaaatccgttgcaacgaggctaccatgcctgcacgattcatcggccaccattgttcggggaagctccgacggtggcgtcacctgagtggcggtgaccgtcatgacggtggtgctggtggtgttatttatctgtgcgagtgaagggtcgctttcggtatcggatctttttccgtttggtggtgtcgttgttgttggtggtggcgctgttgctgtcgatgccgtggttgagggtgttggagtttgtgccaattggtggccactgttgttgctactgctttggttcctctctctatcttcttctgccccttcggcctctttgagttcttgttggtacatgtcttccaccatgggtttccacaaacgaaccctcgcattaatgaaccagtttgatacctgatttctcgatagcccagtctgtcgtgctaacagatgcttatctgcatcgcttgggtacggatgaaggaaatgctcgaaaagccaggctctcaaaatgttgacagatcgttcaggcaagcctctctggggtctccaagcctcctgttccatcatccccatttgatgaaacgctcnntgctgcctcaagctttgttccaacatc

SEQ ID NO: 6665 - DNA, 923 bp, Glycine max
  misc_feature (55)..(55): n is a, c, g, or t
  misc_feature (719)..(719): n is a, c, g, or t
  misc_feature (838)..(838): n is a, c, g, or t
  Predicted polypeptide sequence is orthologous to G418, G965
gggatagggcggcgcgccgcccccccccccccccccccacgccccaggaattcanagcagcagcgcgggcgggtggaggggataacgggaacaaaagctggagctccaccgcggcggcggccgctctagaactattggatcccccgggctgcaggaattcggcacgagcggaattgctggagcagcagcacgccacggcgacgttccgggcggcgaggcaagccggagagtggtacggaaacagacagcagcaacagcaacagatttcaggcattaatgctgactcagcagcagccatgcaactttttctgatgaaccctcaaacgaggtcgccttctcctcctcaaagccacactactccttcttcaactcttcacatgttgcttccaaatccttcttccaattccctccaaggatttactggttcggccgcgggagggtcttttggtcaattcacatgggttcctgagggtgctcaccaacaaggaggcgtggtggaagggcaaggtctttcgttatcgctgtcttcttcgctggaggcagcgaaagccgaggaattgaggatgggcgatagtggttttctatattacatccaccaccaccaccaccatcgcctctgaggtggcgccacccgtgtctcagtgcttcgacgactcagacctgcccgcacacagattaatggcctctgatgacacgtgtcattgcgtcacagcagattntgggaccgcatctgcaagtgctgacattggatccacactcattaggtttgggaccacactcggtgacgtgtcactcactctagggctcgccacgcccgggacatgcccgagaaatcttncttctctgttagagactttggagccatttaaacgtcaatatatatcatatagtactacgtcacatcaatatgatgcacataacaa

SEQ ID NO: 6666 - DNA, 909 bp, Glycine max
  Predicted polypeptide sequence is orthologous to G418, G965
ggatgccaggaggaacgtcatggctggattacgccaagcgcgcaattaaccctcactaaagggaacaaaagctggagctccaccgcggtggcggccgctctagaactagtggatcccccgggctgcaggattcggcacgagtggaaacccatggtggaagacatgtaccaacaagaactcaaagaggccgaaggggcagaagaagagagggaggggaaccaaagcagtagcaacaacagtggccaccaattggcacaaactccaacaccctcaaccacagcatcgacggcaacagcgccaccaccaccaacaacgacaccaccaaccggaaaaagatccgattctgaaagcgacccttcacttgcaccaataaataacaccaccagcactgccgccatgaccgtcaccgcctctgaggtgacgcaactgtcggagctaccccgaacaatggtggccgatgaatcttgtagggatggtagccttgtttgccacggagtttgggaccccttctgctgcttctgaaatggggtccactctgatcaggtttgggaccaccggcggtgacgtgtcactcacgctagggcttccgcacgcctgtaacatgcgggagagtactccgttctcggttaggactgttgcagcagttaatagttaatcaagtcccctatgttacgtcacatgagcataatagatgataatgatacctttaagtggatggtggtagtgttctatgtagtgtgatgtgagggagttgacgtgagtcgtgatgcgacgaaggagagcaatgatcgcgcgtctgcgtgtcgtgatgagatgtgatgtgtcgagcggggtcgtcgtgagaggtactgatggtggtgtgttgcgacgatgaggggatgacgtggagctgatgaagtgatggatgtg

SEQ ID NO: 6667 - DNA, 801 bp, Glycine max
  misc_feature (799)..(799): n is a, c, g, or t
  misc_feature (801)..(801): n is a, c, g, or t
  Predicted polypeptide sequence is orthologous to G419
agatggcctggtatcggcggcctagcgcgcaattaaccctcactaaagggaacaaaagctggagctccaccgcggtggcggccgctctagaactagtggatcccccgggctgcaggaattcggcacgaggccttcccgaacgttccgtttctgttcttcgagcttggctttttgagcactttctccatccgtacccaagcgatgttgataaacatatcctagcccgccaagccggtctctccagacgtcaggtttcgaattggtttattaacgcgagggtgaggctatggaagccgatggtggaggaaatgtatctggaggaagagaaggagcaagaaaacgacgtagcatcatcggatattaatgttcccgaagaggatgagaagccaacgcaggaggctccactccttcgaattgactcagagtgcatgtcgtctatcgtcaacgacgtcacaaagagcggcaaaaccatccaaaacgacaaccaaatggacgcattcgggtcggtggagcttgacttttcgtcctacacgcatgcgcaccattcttccggcgtgtcgttgacgctggggttacagcagcacggtgaaagcggggtaagtttagcgttcctgccagcggcaacacagagctcgatgtttacccacgggatcagattcaagagtgtcaaacagttcagtactctctgttggatgcccgaaggacaaacatgccggttaggaatgtcatggggacacgcttgctttatgatttggtatgatatatcgaaatgtttattgagttcaatcatggaagaccntn

SEQ ID NO: 6668 - DNA, 593 bp, Glycine max
  Predicted polypeptide sequence is orthologous to G427
gcggccgccatgttggagtcgccggcgccggtcacgtcgtcgatgacctcgctgtggttgcggttgaggatcgggcgagcaagccattggccggagtcggaagtggaagtgtgaagattgaggaagttggtgccgttgttggtgttgttgttagcagcgttaacgttgttgttgttgttgttgtcagtgtagtgcgtgcggagaagggcgttgttgagccaatttggcgcgggttgatgaggatcggaggcaggtttggaagcagggtcggagagcaaggagttgtcaacgagaggttggttatggtgttgttgttggtcagtgaaatggtgaagtggaagctcttgggggttatggtggtacgccatataaaacgagagagtggctttgtttgtgttcgtgaaaggtagctactattggttcatggacatggtaaagtgaaggaaagggagggaacagaggcttttgtgagttactaccaacgttgtattaatggttacgaacaagatttcagagatgaggcggttttcagtatccctgacagtggttttccggtcattacttactaattcgggaaactgctcgacagcaac

SEQ ID NO: 6669 - DNA, 946 bp, Glycine max
  misc_feature (1)..(6): n is a, c, g, or t
  misc_feature (22)..(22): n is a, c, g, or t
  misc_feature (30)..(31): n is a, c, g, or t
  misc_feature (39)..(39): n is a, c, g, or t
  misc_feature (43)..(44): n is a, c, g, or t
  misc_feature (946)..(946): n is a, c, g, or t
  Predicted polypeptide sequence is orthologous to G427
nnnnnnaagaaatgaaccaacnaaccggcnncctaaaancaannagcagcgaaacgatcgcacaattaagacacactaacaggaacaaaagctggagctccaccgcggtggcggccgttctagaactagtggatcccccgggctgcaggcaggtatcaactgagcagcctcatatacaacaatactaggtttttctgtaattgaaccaagtaattaattaatccccccaagtaaatgttggtatcacaaattactccttcatcatccatattccaccatttccgttcatgtttttccctctaagctccggtcatatatgaatcgcaccattgttgcataaaatgaagaatagagatatatctattttttttttcagttcaaatcaggtgttcattcacatgaagctctggttacttgttacacctgcaccactcttgcgtttgcttttggagccactagaagacgacggattagtatgccaattcctttttctttgatttatgaaccagttatttatctgctttaattgcagccctgtttcctgcaccaaccttgccttgtcctctgctgctggatatggccatttagaatgtgactgccaccaagctcttaaaagggaagtggtgtcgcctggtagctttcccgctcttctctttcgtaaaatgtcttctcttatgaccacaatcttgtacctgtaaccctgttttacttatgcttcagctactgccttacacgcttcatcaaagatctttcagtttctgttggaacatgaagaccaatcctgagactatagcttccaccatgcttcttctgtacagttgttcgagggggtgccctggttcacaatctccctattgtgagacgttttcccactcttactagtctgtgttatacactttagcatgagaaacctgcggtaaccaactataacattgtaacatatctn

SEQ ID NO: 6670 - DNA, 767 bp, Glycine max
  misc_feature (18)..(18): n is a, c, g, or t
  Predicted polypeptide sequence is orthologous to G427
aatgtagcagcgcgcgtnatacgactcactatagggcgaattgggtaccgggccccccctcgagttttttttttttttttttctacaacaaattactctctacattaccaaataccaattgaaagaccaagaacaaaaacaagagtatgattgtaagggaaaaaaaatgcacagcttattactgtacacccataacccccttcgctaccatatactatatttcacaaagcaataaaacatgaacaaaaatcataattctctgttggtatatgattcttaattgaacttcctaattatgtagcatcacaagtactatatgaactatttgctggcctttaagcataagtaaaccaatattagctccttgatctgctttaaccctggcccatcagaaacaaaatgtggttctttctcattgtctttccatgattgaccaaaggacaaagagttgaatttcatgcaacgatcatcagttatcacctgcattgcttcttttttcaaattaagattggtccaatgttcacaaaaaaaatataagaatcaaataatgctaagtggtacaaagacaaaatgtgtgatttctattatagattcctacattttgtgttgtaccaattactagttttgatgggaataccttttgcgcttgctctttaagcagtagaagttgaaggattgctgtgccaattcctcttcctttgttgataaaccagtattaatctgctttattggaacccagtttttgcacccacctgccttatcctctt

SEQ ID NO: 6671 - DNA, 834 bp, Glycine max
  misc_feature (47)..(50): n is a, c, g, or t
  misc_feature (817)..(818): n is a, c, g, or t
  Predicted polypeptide sequence is orthologous to G428, G1594
cgtattgccatgaaataatgattcagtaacattgatcgattatcacnnnncgtcgcgtatattagctacagttttttacacttgcatatatatatatatatatagctgaaggacctacttagcatacaaatgtaggttcaaaaaattaatatctcgcggaatagaaggtatacacacatcacacgagcagaagatacaagtattgggaatcaacacggtccatctcgagaaataaatcacataggtcctcctaagccactgccacttacaccatccataatggcaaatcgcatgtcctctgttggtttccaatgccgtttcctttgattgatgaaccaattattgatctgcttttgatcaagtccggtcatttctgatagctgcactttctcttcctccgtaggataaggccacctatagtgtgtgttccaccagtccatgagtatcatccttgcatcctttggtagcttaccttttttccttttctttagaaattcctttctcaagctgctaagataaccaccatacttacgaagaagcatttctttaagctcttgatcacctggacgtgggccagaagattcgtcaccatcaactgcttccaccttctcccaacttaattcatcctctgatattcctgcagcctcatctgagcggttgttattcagtggcattgttagcgttcccttacaaagattgctgagttgtgattcgatactgcacaaaaacaaggtcgcttcgttgaatggcttcgacaactcctgcttgtatctatgaagaacttcgcagtatgactccatgaactcgtcaagctcannatcatttcctatctct

SEQ ID NO: 6672 - DNA, 1515 bp, Glycine max
  Predicted polypeptide sequence is orthologous to G431
aataagagaattgtgtgtcgtgtttgtttttgtttggtttgttgtaaggttagctagtgagtattctacacaagggtggtggtagggcaaaaaggataagacagtgaatgtgtgtgtgtgtgtgtgtgtgtgtgtgttgttgacaagcaaaagctatggagggtggtagtagtagctctaatggcacttcttatctgttggcttttggagaaaacaacagtggtgggctatgcccaatgacgatgatgcctttggtgacttcccatcacgctggtcatcatccaataaatcctagtaataataataatgtaaacacaaactgtctcttcattcccaactgcagtaacagtactggaactccttctatcatgctccacaataatcacaacaacaacaaaactgatgatgatgataacaacaacaacactgggttagggtactatttcatggagagtgaccaccaccaccatcaccacggcaacaacaacaacaatggaagctcctcctcctcctcctcttctgctgtcaaggccaagatcatggctcatcctcactatcaccgtctcttggcagcttacgtcaattgtcagaaggttggggccccgcctgaagtggtggcaaggttagaagaagcatgtgcttctgcagcgacaatggctggtggtgatgcagcagctggatcaagctgcataggtgaagatccagctttggatcagttcatggaggcttactgtgagatgctcacaaagtatgagcaagaactctccaaacccttaaaggaagccatgctcttccttcaaaggatcgagtgccagttcaaaaatcttacaatttcttcctccgactttgctagcaatgagggtggtgataggaatggatcgtctgaagaggatgttgatctacacaacatgatagatccccaggcagaggacagggatttaaagggtcagcttttgcgcaagtatagcggatacttgggcagtctgaagcaagaattcatgaagaagaggaagaaaggaaagctacctaaagaagcaaggcaacaattacttgaatggtggaacagacattacaaatggccttacccatccgaatcccagaagctggctcttgcagagtcgacaggtctggatcagaagcaaatcaacaactggtttattaatcaaaggaaacggcactggaagccttcagaggacatgcagtttgtggtgatggatccaagccatccacactattacatggataatgttctaggcaatccatttcccatggatctttcccatcccatgctctagaaaattatccctcgtttgtgggctgctgataatagattcataaactcgtgctgtcacttattaaaaccttacaattattaatattaattaatatgcattctaagaaatcctagattgctatactataatatagtacgcaggtgtatcccttgctagctttttagacggtcctttgtgtggatcatctagttgaaggagttatgaataaataaaattccat

SEQ ID NO: 6673 - DNA, 895 bp, Glycine max
  misc_feature (674)..(674): n is a, c, g, or t
  Predicted polypeptide sequence is orthologous to G440, G864, G1421, G1750
cgtagctcgacttctgctgattacgccaagcgcgcaattaaccctcactaaagggaacaaaagctggagctccaccgcggtggcggccgctctagaactagtggatcccccgggctgcaggaattcggcaccaggtacgacagagccgccgtcaaactcaagggccccaacgccgtcaccaacttccccctcgcgccggaggctacggcgcagtctccaccgctcgccgcggacaacctcagctccgacggcggcgcgtcgtactcggacctagtggcctcgccgacgtccgtcttggcctacgagtgcgactcgacgccgttcgacggtttccgttatctcgacgttgacgcgttcgggttccacatcgacgcgccgttaagtttgccggaagttaacgttaacgttgcgctgacgtgtcatcacgggaagaagcaggaggaggcgtttgatgaattcgatctggacgagttcatgacgtggccttactagtgataaaaatctcagggacagtttggtaaattacaccctgtttgcattgcggaagtgtgagttggaaatcccgaaattgcccccctccccctctcgttgtccaagtttgaaattttgtcgtactcgttggagctttggaagagtgtagagttgttggtacaaaattttatgtagtcgcattntactaccacctgaaacggcgattctttgtgtcgtatttggtagagtttaatttgtagttattatcatgaaaaaaaaaaaaaaaaaaaaaactcgagggggggcccggtaccccatttcgcctatagtgagtcgattacgcgcgctcactggccgtcgtttacaacgtcgtgactggaaaaaccctgcgtaccccacttatcgcctgcagacatcccctttc

SEQ ID NO: 6674 - DNA, 383 bp, Glycine max
  Predicted polypeptide sequence is orthologous to G447
tttttttttttacgtgaagagtattccttatggcttccagaatcgtcatttcatacaacagtaattatgaaacatatataaacttgatagatgtctccttgaaacatatataaacttgatttatttaacgggcaatctagggacagcaacaacaggtgcgttccaagcagcacttgcaaccctcatagcagcaaaagcagcaacagagtgtatacaaacaagaatagaggcttcccttctcctgatggcgcgtctgaacgtgatcatagtatgacatctgctgctgtgctggtgcagaacccgtcatattttgggatttgaagaagatgattaatgcaccagtgttggaccatacatttattttataagctgaagcctcgtgc

SEQ ID NO: 6675 - DNA, 866 bp, Glycine max
  misc_feature (748)..(749): n is a, c, g, or t
  misc_feature (831)..(832): n is a, c, g, or t
  Predicted polypeptide sequence is orthologous to G447
acagtcctctaggctaaaaattactaaggtgcctccaaggatggaagatcgtgaaagcttccgcaaaatctagctgcctatgactttatacattcaaaatcaccgctcaatattaaacctttctttctacaatacatagaattaaatatttctgaccatgccaagaacaattcttttcaacattacaacaacaacaaatctatggcttgaaacacgtctagttttgtccgggtgctccaaacattcgattcagtaccagtttatagtaacttaattgaatttgtagcactaggagcagctcgcttctccaccttcatttggctcttaaaattagcacgtccagaacagagacaaaaattctcctttcaaactgcaaaagatcgctttcaagtccccagtggcataataaccgcctttcggaactaggacaataatgcatctcccagaaataatctgagttaacaatacggaagaatagttagtgtattactgaactccattttaagtattcccaccgtcagagctgctacaggcttgatttggaaggccaccattgccaaaatctccgtccaagctcatctgttgcacttcttgaggagaaagtattttaatacagcgaacacagttcacaaactcctcccaagggtcatctcccaatagtagaacatcactctcatgatccacatagacaagtttccaacctatcctttgccgatcctccagctgtccctctatgccaaacctacgnnctagatcctgtttaagctcctcataacctgaataccgtgttatgtctatggatcttcccacagctccacgtttatatacctnngtatatgtcctcatccgctgaaactgtgctggtg

SEQ ID NO: 6676 - DNA, 864 bp, Glycine max
  Predicted polypeptide sequence is orthologous to G447
gaaaaagaactgaattttctttcatccataataaacttctccatagtttccaccatgaaacatcgtgggcacttgtacaaaagctagaattggcatgtactgttgattcttactgtcactacttggttacctaactttaacaaccacaagatttacagaattgtaagtaaagcgttttctttataataacaatcatatatattatacaccagctgacctatatggctgtaccttgccaaaatgaaagaaaaaagattcctgagcatgcaatagcagccacaagaaaagcagatcccaagatagaatctgcatcattttagtaaaggaatctggttttggtacatctagggatctaacttctctaccattaaaaacgtgttgacattgaaccggatgcagccatgtatcaaccctcttctacactaccccatcaactgcatctcttacaagttgcaatgaatatgtctcctttccactagtgatatatagaagcaccaacaagaaattttaagggttaagttagtcctccatgtctcaaaatatacaagttgactgctccaaaatgacatctttatcgattaaatgaggctgccgagttatcctcatactgtcccctccatgcattgccgttatctgttccactacaagcttgattggggactggaacatgacctaaatccccatccaagctcattttctgtacctcagcagatgacaatatctttatgctctggacacagcttacaaattcttcccaagggtcatcaccaacaagaagaatgtcattttcatgatcgacatatactagtttccactcagtcctttgaggatcttctagctgcccttttcatcccaacatccgag

SEQ ID NO: 6677 - DNA, 944 bp, Glycine max
  misc_feature (906)..(906): n is a, c, g, or t
  Predicted polypeptide sequence is orthologous to G447
gtcaaatactagtaattgatctcctgtacagtcaaataactccaacatttttagtacttacgcttcaagcaaacaatgcaacagtatgcacttgaccttacaacatttgaagtttctctacttcacagtcatattggctaaaaaataataaggtgcctccaaggatggaagatcatgaaagcttccgcaaaatctagctgcctaagactttatacattcaaaattaccgctcaatgttaaaccagagcagcagctcacttctccgccctcatttggctcttcaaatttgcatgtccggaacatagacaaaacttcacctttcaagtcctgatggtggacacagaagtccgcagtggcataataattgcctttcggaattaggacaataatgcatctcccagaaataatctaagttaacaatacggaagaatagttagcgtattactgaacttcatttaagtattgccaccgtcagagctgctacaggcttgattttgaaggccaccattgccaaaatctccgtccaagctcatctgctgcacttcttgaggagaaagtattttaatacagcggacacagttcacaaactcctcccaaggatcatctcccactagaagaacatcactctcatgatctacatagacaagtttccaacctatcctttgccgatcctccagctgtccctctatgccaaacctacgagctagatcctttttaagctcctcataacctgaatatcgtgttatgtctatggaccttcccacagctccgcgtttatataccttggtatatgtcctcatccgctgaaactgtgctggtggcaaaagtggcggtgctggtggtggagcccacggaccactgttcaagaagttactatcatctattgtggaatcaattgaattgaangccatatcagggacaccaaatgtctgtgaaaccattga

SEQ ID NO: 6678 - DNA, 1012 bp, Glycine max
  misc_feature (1)..(1): n is a, c, g, or t
  misc_feature (30)..(30): n is a, c, g, or t
  misc_feature (621)..(621): n is a, c, g, or t
  misc_feature (746)..(746): n is a, c, g, or t
  misc_feature (767)..(767): n is a, c, g, or t
  misc_feature (778)..(779): n is a, c, g, or t
  misc_feature (921)..(922): n is a, c, g, or t
  Predicted polypeptide sequence is orthologous to G447
nccgtgtgttgatccctatttgcagattcngccaagcgcgcatttaaccctcactaaagggaacaaaagctggagctccaccgcggtggcggccgctctagaactagtggatcccccgggctgcaggtactcaccaacaaaaccagcaattaccgcagcccctgccgcctatatctcagcatcaacctcaacaactaggcaataacgcattctcaacagagaagcttctcaacagcaacaacttatcttcatctcttatgcaatcacagaagctttcaatgaaccatccccagaatacacagaaatcacttaccatcactagagctccctctacactaactgagggagatgccccatcatgctcaacctctccatctactaataactgccaggtgactcccccaaacctcctgaaaagaaatcagcaattaccagccacattaaggggaagtttgatagttgagcccactagtaatctgatacaggagcttcacagtaagcctgacacgcagatcaaacaggagtttctcaatgtaaaaggacctgaccagttgaagtataaagggacaattactgatcaactagaagcttcttctggaacatcttactgtcttgatcctnctggtaatgtccagcagaacttgccactgtccaacttctgcatggaaggggatgtccaatcacacccaggaaatagtttaccatttgactccaattctgatggtctaacccctgatactatgctncctaacgggtatgactctcanaagatcttcannatttgtgggctaactatggtggtgctccagagagaatgaaactgagctgtcactgctgacatcaagctacagtcgtttgagtgccaacatgcttttcaagcagttggctaagtatgttgcatcattgatactgggtttaatnnatatatgcttgcggctaacaaactcacgatgcaacaattctagggtccaagcctgtttggttgagaagatgggtacgtccaggattaaac

SEQ ID NO: 6679 - DNA, 953 bp, Glycine max
  misc_feature (1)..(4): n is a, c, g, or t
  misc_feature (859)..(859): n is a, c, g, or t
  Predicted polypeptide sequence is orthologous to G447
nnnnaatgtgagtgatgtgttggggcgaggctgctaatacgactcactatagggaaagctggtacgcctgcaggtaccggtccggaattcccgggtcgacccactcgtccgatttggctcggatgtttggaattgaaggacagctagaagatcctcaaaggaccgagtggaaactagtatatgtggatcatgaaaatgacattcttcttgttggtgatgacccttgggaagaatttgtaagctgtgtccagagcataaagatattgtcatcttctgaggtacagcaaatgagcttggatggggatttaggtcatgttcctgtcccaaatcaagcttgtagtggaacagataatggcaatgcgtggaggggacagtatgatgataattctgcagcctcatttaatcgataaggatgccaagtattgacattttggagcagtcaacttgtatattttgagacatggagaactaacttaacccttaaaatttcttgttggtgcttctatatatatctctagtggaaagaagacatattgattgcagaacttgcaagagatgcagttgatggggtagtgtagaagagggttgatacatagctgcatcctgtttagtggcaagagaagttagatccctagatgtaccaagatccggctcctttactaaaatgatgcagattgcagattctatcttgggatctgcttttctgttggctgtagtgtatgcttacgaaattttcctttctttttgcacgtacagccatatagtcagctgtgtacatatatgattgtctatataaagaaacgtttacttacaattttctgaagtcttgtgtggtaaaatggatgaagtaggtaccagngatgacagaaagaatcacatacatgcaattgtacttttgtcagattcacgtatgctatggcgcaattttttaggttatatgatgatctaatcgt

SEQ ID NO: 6680 - DNA, 878 bp, Glycine max
  misc_feature (4)..(4): n is a, c, g, or t
  misc_feature (758)..(758): n is a, c, g, or t
  misc_feature (785)..(786): n is a, c, g, or t
  misc_feature (858)..(858): n is a, c, g, or t
  Predicted polypeptide sequence is orthologous to G447
gccnaatgatgatcaactgctgccagtcgccagctaaaattaaccctcactaaagggaataagctttttttttttttttttttttttacaagatatgcccattaaaatgatactcgatttgaagtggagatagatatttgaattgcttacaataagaaaataattaaagatagtatcagttaaggtaatgagtgaacacataaatcaatggaagacgaggaaatcttcaagatgaaagctgaactagctaggggtgaagtcttgctacctggcattcctggttgccgggggaactttggcctgaaaaatggaggtggacaaatgtagaaaggagtcaccactggttcaatttcccagattgaaactcttctggggcgttcaccagctgttgattcatcccatccaacctgaatattgcgccactgtgagcttttccaacggacaggatccaagtcactgataccagtgattgtccccatatacccacgcactccagactcctcagtttcaaacatcattctaaatctcattccaagagaaacttgagtgtacatggctttgttatacttggctaacggaacaacaaattcagaggggctagcccttggattgtaaaatatagtgaatgggctattatttgcagcagcatgagcagcagcagcaagaatgccaatatgcatgctgtcactggatatcaccgacgaagagagtgctggttgtgtctatttacacgtcttatacctaaaagaagatgctgntttcatctctgataaaagaacagatcnntcgcaacagtctttagtgctgcaatacactccatccagtagtaatagcttgattcttgcctcgaggccaaanttcctatagtgagtgataaa

SEQ ID NO: 6681 - DNA, 931 bp, Glycine max
  Predicted polypeptide sequence is orthologous to G450, G456
ggtttttgataaaaaaaaaatcaagatgataacccatgatttccttagaacatgcataatattttacgcaaagtttcttggataaggactagttttgaagtaacattgtgatgtgcatatcaagctcctgtcttcttttttctgccttttgtgttccatattctttttcattgaaactattacaaggtcaaattattgcaaccaaaataatttcgatcgggtcatcaagtggagaaaaaaaaaaattactcccatggcacatcaccgacaagcatccagtcgccatccctgtcttcataggtcgggacatagtcggagctgttcagaagatccatcaacttgctctcattcatgaaatccttgaagccttgggattcacaatttccaatggtgaaggagctaaacattttgcccaaggcatcagagagctcagggtaactcttgtacatcttcaagtcaactttgcggaggtaaggtgctccatccatgctaactttgacaaagcttgcattagggctgttcttctcgctttcctctccgccgctgctcttttgggctgcaaacatgttcttccggaaagaccttacaggtggccatcccaccacttgcgccttggcaggaggctttgcgggatcgagaagaggaagattcttctccttcggcgaagtctttggattctcacgtggatctgctccatcagtagtagcagcagcagaagcttccttgggagagaggttaagcatcaaatcaacggaggttgtttcatcggtttcagtttcagagaaccctctcttcctcactcctaattccgcagcagcttcagttgttggcgcggctccatttcagggagtcctagtctcagtccaagcctcagctcagttttctcaaacaccatcttcttctcctttcttcttgtttcactcgacagcaa

SEQ ID NO: 6682 - DNA, 1052 bp, Glycine max
  misc_feature (1)..(2): n is a, c, g, or t
  misc_feature (583)..(583): n is a, c, g, or t
  misc_feature (703)..(703): n is a, c, g, or t
  misc_feature (712)..(712): n is a, c, g, or t
  misc_feature (730)..(730): n is a, c, g, or t
  misc_feature (750)..(750): n is a, c, g, or t
  misc_feature (917)..(918): n is a, c, g, or t
  misc_feature (993)..(993): n is a, c, g, or t
  misc_feature (1005)..(1005): n is a, c, g, or t
  misc_feature (1030)..(1037): n is a, c, g, or t
  misc_feature (1045)..(1045): n is a, c, g, or t
  misc_feature (1047)..(1050): n is a, c, g, or t
  misc_feature (1052)..(1052): n is a, c, g, or t
  Predicted polypeptide sequence is orthologous to G450, G456
nnccgctctattatcattttcggtgcacgcaacccaaccctcactaaagggaacaaaagctggagctccaccgcggtggcggccgctctagaactagtggatcccccgggctgcaggtggatttgaagcttaacctttcctcaacctcaaacagtgcttcttctgacctgactaaagagaagaacatcactgctgctgcacctcctgctaacgacccagcaaagccacctgcaaaggcacaagtggtggggtggccaccagtgaggtctttcagaaagaacattgttcaaaggagtaacaacaatgagggcgaaaaagccgccacaagtagtagcaacaatgtgaacacgggagcagctttcgtgaaggtgagcatggatggtgctccttatttacgcaaggtggatttgaagttgtacaagagctaccaagaggtgtgggatgcgctggctaaaatgttcagttcattcaccattgacaagtgtggatcccaaggcatgaaagacttcatgaacgagagcaaattgattgatcttctcaacggctctgatacgtaccaacctatgaagacaaagatgctganctggatgctcgtggtacgtaccgtgggaaatgtcgtggatcatgcaagcgcctggtataatgaaaggatctgagcatcggctacaccaagacagtgggaaggcaagacagagctaagcanattgtaatncacttcgacacatctgtntattgtgcttttgcgcacgnaagcatatgtattctcagccaaggtgctaatagaaccagtgtcactatgtcgacattctagatatttctgggttggatggattttatagagaaatttattgattagcagaaaaaagagtgtttttgcccccctttgtaccaaccggctgtaaaaaaaaaaaaaaaannaaaaaatgggccgccatcccttttgagtccctcctgcctttaacgaagaaacgtcattactgacacctttctggngtaaagcccacnccccccatgcgcttaggagcgggtnnnnnnnngggtgccntnnnncn

SEQ ID NO: 6683 - DNA, 1240 bp, Glycine max
  misc_feature (625)..(625): n is a, c, g, or t
  misc_feature (690)..(690): n is a, c, g, or t
  misc_feature (717)..(718): n is a, c, g, or t
  misc_feature (774)..(774): n is a, c, g, or t
  misc_feature (1227)..(1227): n is a, c, g, or t
  Predicted polypeptide sequence is orthologous to G450, G456
gggggggtttgataaaataaagtccgaatcacgccacccgcgcaattaaccctcactaaagggaacaaaagctggagctccaccgcggtggcggccgctctagaactagtggatcccccgggctgcaggctttcaccgaagaataacttgactttcccgaactccacctgagaaaaagatacccttaattcgcaggcgcgtcttgtgttggacaacaaccacaagatgattaacttcgaagaaaccgagttgcgactcggcctccctggcaacgactcagcactcaagggaagtgctgccaagagaggcttctctgaaactgcttctgttgatttgaagcttaatctttcttcttgcattaacgactctgcctcggattcaccctcatctgtgtctacagagaagcccaaagagaacaagactaccactgctgaacctcctccagctaatgatccagcaaaaccacctgcaaaggcacaagtggtgggttggccaccagttaggtcatttagaaagaacatagttcaaaggaacagcaatgaagaagaggcagagaagagcacgaagaatgctttcgtgaaggtgagcatggatggtgcaccgtatctacgaaaggtggacatanagttgtacaagagctaccaggagctgtcagatgcgctggctaaagatgtcagttccttcacgatngaaaagtgtgggtcccaagggatgaanngacttatgaatgagaccaaatgctctgactatgtacccacatatgaagacaagacngagaactgatgcttcgcggtgatgtgccctgggagatgttcgtgaatcatgcaagcggttctcaaattgaaagggttcaggcatccggctttggcccaaaccctgggaaaatgcaaaaccgagctgaaaaaggagttctttctctccacggggaccaattggctggcccgaccggtcttattggggaaaaggtaaacaacggggccttgtctcttttggattttttttggggttattggattagaaaaatgtgaaaaaacaaaaaaaaaaaactggggggggccggcccattccctttgggggtatatccgctcatcgtcgttttacgggggagtgaaacctttaaccatataacctgaaactcctttcctgggtataaagaagcccactgcccttccatttgacataggaagggccccctgggctttgcggggggtttcgccagatcatccnacataccttttta

SEQ ID NO: 6684 - DNA, 922 bp, Glycine max
  misc_feature (19)..(19): n is a, c, g, or t
  misc_feature (21)..(21): n is a, c, g, or t
  misc_feature (697)..(697): n is a, c, g, or t
  misc_feature (922)..(922): n is a, c, g, or t
  Predicted polypeptide sequence is orthologous to G450, G456
cagtcccagtgctattcancntcagcgcgcaattaaccctcactaaagggaacaaaagctggagctccaccgcggtggcggccgctctagaactagtggatcccccgggctgcaggaattcggcacgaggggagctatagccataaggagaaaaactttcaaagaggtgaaagcaaaagagttcttcttttccttttttatatatacttgggtgctaagctgtgtgagttcattgacaagcctgaaatggcaactatgctgacaaaggagcatggtctgaacctcaaggagaccgagctttgcctcggtttgcctggtggggaggcggcggcggcggcggcggcggcggcggcggtggtgaggtggaaactccaagggccactgggaagagagggttctctgagactgttgatctgaaacttaatcttcattccaaggaagatctgaatgagaatctgaagaatgtctcaaaggagaagaccctccttaaggatcctgccaagccaccggctaaggctcaagtggttggttggccaccagtgatgtcatacaggaagaacatgatggcagtacaaaaggttagcactgatgatgtggcagagaagacaacaagcagcactgctaatcctgcggcatttgtcaaggtttccatggatggagcaccttacctgcgcaaggtggacctcacaatgtacanaagctacaaagaggtatctgatgccttggcccaaatgatcaacttcttcaccatgggtaactattgggccccaaggatgatagacttcatgaatgatagcgagttgatgaatctcttaacagctctgagtatgagcaagctataagataatgatgtgactgaatgcactgtgtgagtaccatgcgaatgcggttgatgatgctgctgcttcgatatgtatgggan

SEQ ID NO: 6685 - DNA, 869 bp, Glycine max
  misc_feature (641)..(641): n is a, c, g, or t
  Predicted polypeptide sequence is orthologous to G450, G456
ctggttgatcgccttgttgctgattacgccaagcgcgcaattaaccctcactaaagggaacaaaagctggagctccaccgcggtggcggccgctctagaactagtggatcccccgggctgcaggtgaatgagaggaaactgatggagtctggaaatgggattgaatacatgcccacctatgaggacaaagatggtgactggatgttggtcggggatgtaccctggaagatgtttgttgaatcatgcaagaggataagacttatgattagctcagaggccgttggtttaggtccgaggtctacttcttcaaaatgtacgggttccacctagctagctagaagaataattaattagtgcgtaataatgataagctgatagctgataattaagcattccttggacaccttcaacgtttacaagctccggttagaagaagagtgaatttggtacagggaaatatccatgcatggtgcttgatgtacatgtccctttagcacctctggttaattagttacttttgttttgactttaaatgaagaactagaacaaaaaaaaaaaaaaaaaaaaaaactcgagggggggcccggtacccaattcgccctatagtgagtcgtattacgcgcgctcactggccgtcgttntacaacgtcgtgactgggaaaaccctggcgttacccaacttaatcggcttgcagcacatccccctttcgccagctggcgtaatagcgaagaagcccgcaccgatcggcctttccaacagttgggcagcctggatggcgaattggaagcgctcttgtgccgcgcatttaagcgcgggggtgttgtggtatcccccagcggaaccctacacttgccctcgccttgcgccc

SEQ ID NO: 6686 - DNA, 731 bp, Glycine max
  Predicted polypeptide sequence is orthologous to G450, G456
tactaatccgccagctaaagctcaggtggttggttggccaccagtgagatcatacaggaagaacatgatagcagtacagaaggtcagcaatgaggaagtagcggataatactacaatcagcactcttgctaattctggggcgtttgtccaggtttccatggatggagcaccttaccttcgcaaggtggacctcccaatgtacaaaagctacataagacttatctcatgccttggccaaaatgttcagctccttcaccatgggtacctatggggccctaggaatgatatattcatgaatgatagcaaattgatggatcttcctcccagctctgagtatgtgcccccccatcaaaatactgatggtgactggatgctcgtgggtgatgtcccatgggagatgtttgtggtggtcatgcaaccgcctggcgaaattatgaatggatcagaaacgattggtccttgcgtccaaaacattggaaaaatgcaaaagcagaaggggaagctggcccaatacaacgttctacgagagatcccgtacgccactggacctatggaacaaattatatcacccacttcagctacactatggagcggaatgttgttggttgaatgtgtctggtgtttggcgttttgttcgtataaagattgtgtagtgtaaaacaacggtgccttaacctatacggtctggcgtgtttaggatgtgatcgtccaggctgtccggatggtatttg

SEQ ID NO: 6687 - DNA, 1784 bp, Glycine max
  Predicted polypeptide sequence is orthologous to G450, G456
gaaaggttgaagaattatttagaatgataaaagccatgaaaacagtgagttacttaccctcttgtgtgtgaaatgacgaaaccctaggagaaggagagtaataaagaaagaaatatgtggtgtaagcaagcaacatggagtgtccacttccgcttcttccactgaacaatcataggaagatagcatcaccttgtcgtcagcaagggcagcatgcacagaaaagtccagctcacacattcctccacgtgtcacaaacccatttccctctaaaaagacaggacgcaccatgcgtccttgtattatacgtccccttgtcctgcccctgcccctataccatagaacattagtacccccacacacacccctcctctatctttcactattattgccacacaaatcaattaactgaatgcttagagagagaaagaggagaaggagtagtgataaggtgatcatagagcatattataagagagtgaaaactaatggaggttggcctcaagaaggagaacatggggtttgaggaaactgagttaaggcttggactgcctggaaacggaggcactgaagaagtgctcatcaggaagaggggtttctctgagactgaaactggtcatgaagatgagtctgccaccactgtggatttgatgcttaatctttcttctaaggaggccgcaaccactgctgctgctgctgcagatccaactgataagcacaagactttgcctaaggagaagacccttctgccagcagatcctgctaagcctccagccaagacgcaggtggtgggttggccacctgtgcggtccttccggaagaacatgttggctgtgcaaaagagcgttggagaagagagcgagaagaacagcagccctaatgcaagctttgtcaaagttagcatggatggagcaccttaccttcgcaaagtggacttgaagatgtacaagagttaccgagagctctctgattctttaggcaaaatgttcagctccttcacctttggcaattgtgaatcccaaggaatgaaggatttcatgaatgagagcaagctgaatgatctcttgaacagctctgattatgtcccaacctatgaggacaaggatggtgactggatgcttgtcggtgatgtcccatgggagatgtttgttgaatcatgcaagcgtttacgcatcatgaaaggaaaggaggctattggtcttggtcttgcaccaagagccatggcaaaatgcaagaacaggagctagactagtcgcacaattcatgacctgccccatcctttgtaattgtggtgcccagttggcttagtaactaaagtaaggataagctgcagcagacacggatggacattgcagggtgttgaattatagttaatttgtgtatcattatggtttgttataatatttcaaacaaaacaatgagatgcatgtctaattaagtactaattatgaacaggaacataatgactctcaatcatgttgttagacttggctttcttatatatctttgcttgttctgtgtgagtgcttgcttaataataattttaagatgtgtttgtctgttgtagttgtagcgacatgttatcatgctttacatttaaaattgtcttgtaaaggttttccttatcattatgagattccttggtattaatcatttttcatataataacaaaattgtatttattacatttacgttagtttttgttgtgatcatcaagagccgaatatatagtactggaaatgttccctgaacatggtggatgggaaacaagaacatgtgcgtgttcat

SEQ ID NO: 6688 - DNA, 918 bp, Glycine max
  misc_feature (870)..(870): n is a, c, g, or t
  Predicted polypeptide sequence is orthologous to G451
acaattgaaatagcattagcttttcttatattttctttctctttcttttttagaggattacatataatttagaaagcagacctcaaagccgcctctgctgaaattaataaagcaaaaataatggatacatagataatatccatctattttcctaatatatatatatatatatatatatatatatatatatatatatgagttctcataaacaccatgtatttgcttgcacaacacaaagggtatttgtctttgaagacctcatgtgactattttgatttgatttgcttttgcaagttttgttggtcacaaacaacccaacccctttgcttctgatcctttgattattttcagcctcttgcaggaggatacaaacatgttccatggaacatctccaaccagcatccagtcaccatccttgtcttcataagtaggagcgtattcagatccattgtaaccttccctctctgaatattcaccaaatgtgcacttgaacaaattttgcaaggccatgaggagttctgggtagctattgtaaaccttcagatctatcttcctcaagtaaggtgcaccagccatgctcactttcaaatacgttccacttccatcaccctgctgctccaccttcttctgttgttgcagactgttcttcctaaaagatctaattggtggccaccccactacttgtacctttgcaggttggacactgtcttcatcatgatcacttgtggtggtagaatctgaagaaccattagagttgcacctggactcttccacactgggttctggtgaagatctcttgttgcttctaacaacagatccactactggatgaacttttgtcatgagtttcatcacaggcgggtaatcccancctcaactctgtggccttaagattcagctcagtttcaaagctccccat

SEQ ID NO: 6689 - DNA, 924 bp, Glycine max
  misc_feature (1)..(2): n is a, c, g, or t
  Predicted polypeptide sequence is orthologous to G451
nnttcttggaaggaactttagactaggcggcgcgcgcagttgaccctcactaaagggaacaaaagctggagctccaccgcggtggcggccgctctagaactagtgtattccccgggctgcaggaattcggcacgaggttttgattaacttgaaattgttcaacaagaaatggagaattcattgggaaagtacggaaaagagcttaatctcgaggctacagagttgaggttggggttgcctggaagcgatgagcctgagaaacgttctgctgttagaagcaacaagagatcttcaccagaagcaagtgaagaagagtgcataagcaagggcaacatgaattcttctgatggtgtttgatatcacatgtgatgaccaagacaactttgtgccacctgcaaaggcacaagtagtgggatggccaccggttccatcatataggaagaatagtctacaacaaaagaaagaagaacaggctgaatgggctgggatgtacgtgaagttagcatggaaggtgcaccttacttgaggaagatagatctaaaggtttacaagagctacccataactcctcaagggcttggaaaacatgttcaagtgcacatttggtcaatattctgagtagtaacggtataatggatctgaatatgctccaatctatgaagacgatgatggtgatcggatgctcgttggagatgtttatggaacatgtctgtgcatcctgcgggatgcttagatcatgaaaggtcagatatctagggatcggttgctttgtgctaacactctgtatgactatatggatactctttcatactgctagcaaccatatctgtatctctccgcgcgatctctgcgctgtcacgtccagttgacatctgtatgtctcgtctgatgttggtatatgcatgttcttatatgagacttcttt

SEQ ID NO: 6690 - DNA, 909 bp, Glycine max
  misc_feature (581)..(581): n is a, c, g, or t
  misc_feature (613)..(613): n is a, c, g, or t
  misc_feature (903)..(903): n is a, c, g, or t
  misc_feature (906)..(906): n is a, c, g, or t
  Predicted polypeptide sequence is orthologous to G451
gagagggttgatgaacgccttgtatgatcacgcatttaatacgactcactatagggaatttggccctcgaggccaagaattcaagcgttagttggagatgttccatgggacatgtttgtgacttcttgcagaaggctaagaatcatgaaaggatcagaggcaaggggtttgggttgtgctgtatgaggaaccaaatcactaaaaaattactatgagcagagaattaaaagtgttttgggggtgaagggaaaacatgctgaaaagcttgtgttctcggatctgaagggttttgacttttgaatcactctagtgtatgcttttggcatacctttatacgaagttatactctgaagcaggagaagatggaagatacggtgcaggttcttcctcaagtttggcaacttttctggttattttgccatctgtggttggatgctacatgctatgctgttgtttccactgatcctttttgaagtttcatatgagaaatcttagagagatttgaaaatgaaactttgtgtagaagagagatagagaaaaggttatatgtaatattgtttaatccaagtttttatgttgtngtgatacaagaataccgtgtaatataccaagnttttatgttgtgttaatccaagttttatgtttgcgcctgattaaaaaaaaaaaaaaaaacaaacacacaacaacacaataaaacacccccccgcacagggaaaacgcttatcctttaggggggtaatttgacttgacctggcggtttatacagcgtaattggaaaacctggttaacaactatatgcttggacattcccttttccgttggaattacgaaagccggccatgcctttcaacattgcagctgaaggaaggacggccttacgggcttaaaaccgggggtgtgtcncangta

SEQ ID NO: 6691 - DNA, 701 bp, Glycine max
  misc_feature (1)..(1): n is a, c, g, or t
  Predicted polypeptide sequence is orthologous to G451
nagtgttgtaggccggcggctgtagtacgactcactatagggaaagctggtacgcctgcaggtaccggtccggaattttttggtcgacccacgcgtccggttccatggaacatgtttgtgtcatcctgcaagagactgagaattatgaaagcatcagaagcaaaggggttgggttgtttttgaccaaaataacaaaacaaagcaggaccatcatgcatgcccatatccaaaacatggagcaaagcaattttcagtgacgtcatccaagagaatttcttctgtttggaatatgcaagagctaggcacttggcctctgtgaaatggttatatttagcttattaaaaagagagatgcacatacacgattttattttccctttatttgtttatttcaaaagctaggtgactttttagacctgcttaattaagtatactattccaaattctcaatgcctaaaccagaattgaaaactgtaatgatgaaatgagaagaaaataaaaagcaaaaatgctattttaattgtatagactatatatatagaggataaacatatatatgaaaaactactttcatttgtcatgtgtctggtctacgtacaatatattatatatacaaagggatcaagaaagtggaactttcattactcttctcttgcatttaattaaattgatctaatctatctttctacttggctttaagtg

SEQ ID NO: 6692 - DNA, 406 bp, Glycine max
  misc_feature (10)..(10): n is a, c, g, or t
  misc_feature (37)..(37): n is a, c, g, or t
  misc_feature (45)..(45): n is a, c, g, or t
  misc_feature (83)..(83): n is a, c, g, or t
  misc_feature (86)..(86): n is a, c, g, or t
  misc_feature (162)..(162): n is a, c, g, or t
  misc_feature (185)..(185): n is a, c, g, or t
  misc_feature (221)..(221): n is a, c, g, or t
  misc_feature (249)..(249): n is a, c, g, or t
  misc_feature (275)..(275): n is a, c, g, or t
  misc_feature (281)..(281): n is a, c, g, or t
  misc_feature (291)..(291): n is a, c, g, or t
  misc_feature (295)..(295): n is a, c, g, or t
  misc_feature (304)..(304): n is a, c, g, or t
  misc_feature (307)..(307): n is a, c, g, or t
  misc_feature (326)..(326): n is a, c, g, or t
  misc_feature (333)..(333): n is a, c, g, or t
  misc_feature (349)..(349): n is a, c, g, or t
  misc_feature (353)..(353): n is a, c, g, or t
  misc_feature (367)..(367): n is a, c, g, or t
  misc_feature (388)..(389): n is a, c, g, or t
  Predicted polypeptide sequence is orthologous to G456
gcggccttgnatttgtgagaaaatcacgcgttcatgntaaagggnttgctgtggtatcttctggtccatggttgcacccaaanaanttctcaaggttttactccacgtttctcaattcccgatcacatattcagcttgattcccaaggtcggaaaatttcanccgtgttctccgcgcaattctangtgacggttgcccaaatggcggttcttcctgtcganatggtcgcttcttgcacgaatgggcgtntcccgaccatcccattcctcctgaantttccnattggtggtntcanaacaacccnaanccaaccaaaccaaaatctncctgaangtgcgttggcggtgtnattngcctaaaaaatatnctaaagcaccctccacatccnnaaaaaaaaaaaaaaaaa

SEQ ID NO: 6693 - DNA, 784 bp, Glycine max
  misc_feature (1)..(2): n is a, c, g, or t
  misc_feature (47)..(47): n is a, c, g, or t
  misc_feature (477)..(477): n is a, c, g, or t
  misc_feature (519)..(519): n is a, c, g, or t
  Predicted polypeptide sequence is orthologous to G461, G462
nnaatgatgcacttgcactagactgtgttttgtatagtgacttaatnggggataaccggcacctgcaccggggtgggggccggtctagaactattggattccccgggctgcaggcgcgagctatggcgtgattgatgcatggggaaagaagctgttggccttgaaatcactagtgagctaaggttgggccttcccggtggggaattacctgacaagagcgagaagataaataacagggtgttctccgagattcaagctcatgatgatgatgaaaacagttcctccgaacaagaccgcaaaatccaaaccaagaatcaagtggtggggtggcctccggtgtgttcgtaccgcatgaagaacaccgtcaatgaaaccaaaatgtacgtcaaagttagcatggacggtgctcctttcttgcgtaaaattgatttagctatgcacaagggatattccgagctggtcttggcctaggagaanttgttcggttgctatggaattcgcgaagcgttgaatgatgcngagaatgctgaacacgttcccatatgcgacgacaaatatggtgactgtatgctcgttgcagatgtcgcttgggatatgggtattgagtcatgccaaacgtctacgatgattaacagatcacatggagacggcttcgggtctgcaactggggggtcttaacaagatttgttcaagtggtagcaagtggaaatttccaccaatcaataaaatttgtattctaatagttatggagatttcttaaaactctcagtggagtgttcctgga

SEQ ID NO: 6694 - DNA, 1945 bp, Glycine max
  Predicted polypeptide sequence is orthologous to G461, G462
ccgtaacatgatgctcacaaatcacatgcattaatgtgacacggaactaacttgtcgtacataatatatatatatgttccggaacaaaaataaccttatatatcaaattaattccatctttactattgactgaaaatatcatatttattactgtatctgttagctagtactcgtaccgggtaattcctgccgacagaagaaatatgataaatttagctaatttttaatattaaattcatttccttttgattgtacagtatgtatatgatccaattgagtgcgtgggaacatacatgcatagataatacacaaacaagcatacacacaaaaatgatatattattggaaaagcaagctagctagcagaaatgtttaattacaaattgataaaagaagagagtatatataaacctagtgaaacatgggatgataaatgtacataatcatgcatcttattcatgtaacccttcaaacatataattaattgcaaagagctccctcaatgacgcaaatcacatggcatgtttctggtcatctaatcgaacgaccatgatcaaatctcagaaggcagcatgcatgggtcgttggatgtctcccatatcgaacttattattggtggttcggcgaggggacaaactttgtccccacaattgtttctctttctcatgtgaccgaccacttccccttacttgatctgtcattgctcccacttaacctctcttttttttccattcactttctctctctctatatatataaagccctttctattccatattcctaacaattcaattcattcatccttcactactacaccaaattaatagaaattaaagatatatcattccacaacacaaattaaagttagtgagacgtacccttattatggccaaagaaggtcttggacttgaaatcactgagctaaggttgggtctacctgatgcggagcatcaagtaagtgtagtcaataagaaaaatgagaagaagagggcattctcggaaattgatgatggtgttggagatgaaaatagctcctccggcggaggcgaccggaaaatggagacgaataagagtcaagtggtggggtggcctccggtgtgctcttaccggaagaagaacagcatgaacgaaggtgcttcaaagatgtacgtgaaggttagcatggacggtgctcctttcttgcgtaaaattgatttgggtctgcataagggctactcagatttagctttggctttggacaagctctttggttgctatggaatggtggaggcgttgaaaaatgcagacaattctgaacacgttcccatttatgaggacaaagatggtgattggatgcttgttggagatgtcccttgggaaatgtttatggagtcatgcaagaggctgaggattatgaagaaatcagatgcgaagggcttcggtttgcaaccaaaaggatctttaaagggattcatagaaagcgcggcaaagtgaaagattatgttaggcttctaattaatgtcgtgcacattttgcgatcatcaatccaagtttatgtgttatcgttttcttatatttgaggaaaaacatgcatttttagtttgatatatgaattatcagacttttgtttatgtcaagttattaatgaatgacatataggaccctatataaataatagggaaaactcgtcgttttagattaattaatgctttgccataaatgtttgtttatttgcattcagttgcagtacaagttattgtatcagtatactgttttcttactgattccaatttgttaattacttcacctaaactctcctttttttccttttcctttttaaatagttgatatagtaaaccgccatatcaagttattcacgtaaaaagagactaaagtaaagaatttaaataataatgagaaaaatacaagtatgttttattttatttcttataatatatagcattgct

SEQ ID NO: 6695 - DNA, 770 bp, Glycine max
  misc_feature (647)..(649): n is a, c, g, or t
  misc_feature (679)..(681): n is a, c, g, or t
  misc_feature (689)..(691): n is a, c, g, or t
  misc_feature (706)..(708): n is a, c, g, or t
  misc_feature (714)..(716): n is a, c, g, or t
  misc_feature (719)..(719): n is a, c, g, or t
  misc_feature (721)..(723): n is a, c, g, or t
  misc_feature (732)..(732): n is a, c, g, or t
  misc_feature (756)..(759): n is a, c, g, or t
  misc_feature (761)..(762): n is a, c, g, or t
  misc_feature (764)..(766): n is a, c, g, or t
  Predicted polypeptide sequence is orthologous to G468, G2866
gctctatcataataataatttttctttccattcctcgttcctcactctgcgtcagtcttaaaattgaggaaaataagttggaaaagagaaattctaacagttagaagttgagttctagaaagaaaataaatccggtagcccagaatgggtaagaattaatatacaacactattctttttccattatcttgaaagaaagagcagagtgagctatgcatatacatcacctatctgtgcatatacttcactaagatttttctaaattttctgatcagcgacctcattagagtctcactctagaggacaaaatctaaaatcaccggtgaaggaagaggcagtgtcatgttcttcacttaacacccgaatgtgtctacccttgtgatcttcaacctcttcaccgtcgataagaacatctcccaagggacatctccaaccatgaccaaatccccttcttcatcttcataagttagcacatggcatctctctggttgcactccattcatttctgttccccaaagaatggtagtgtcaaacatgtgttcaagagtcctgactaactcatagtagcctccatgagctagtatattgagcttccttccgattggaatcccttccatgtacaccttcacaaagaagctgctatgatcnnngctgcaatcattcacttcagcaggaacttnnnaataaatnnncacaaaagggtggtnnnattgtnnncantnnncccttgaantagaagaggcaaaatgttgagtgnnnnanntnnngagt

SEQ ID NO: 6696 - DNA, 952 bp, Glycine max
  misc_feature (717)..(717): n is a, c, g, or t
  misc_feature (726)..(726): n is a, c, g, or t
  misc_feature (735)..(735): n is a, c, g, or t
  misc_feature (804)..(804): n is a, c, g, or t
  misc_feature (830)..(830): n is a, c, g, or t
  Predicted polypeptide sequence is orthologous to G470
aagtcccgcttgaagatgcccccaatcgcgcaatcaaccctcactaaagggaacaaaagctggagctccaccgcggtggcggccgctctagaactagtggatcccccgggctgcaggcggagcaaaggtttactggtaccattgttggaattgaagatgctgataccaaaaggtggccaaagtccaaatggagaagtcttaaggttagatgggatgaaacatcaaacataccacgtcctgagagagtttcacaatggaagatagagcctgctcttgcacctcctgctctgaatcctctaccaatgcccaggcctaaaaggcctcgatctaatgtggttccatcatccccggattcctctgttcttactcgtgaagcttcatctaaagtcagcgtagatcctttgccaacaagtgggtttcaaagggtcttgcaaggtcaagaactgtcgaccttgagaggtaattttgctgaaagcaacgaatctgatacggtcgagaagtctgctgtgtggccacctgttgcagatgatgaaaagattgatgtttctacctcaagaaggtatgggtcagaacagctgatgtcaatgggaaggcatgaactaacatatccagatctgctttcaggctttgggaacccatgagatcattcatcccatccatccttttgtgatcaaaatggtcctgtagcttatggtggtagaaaacattttgtggatngtgaagcanacataatgntctgagtcctttgttctgagtgccatctagcctgcacttgatcttttgactcaatacaaaagctctgcntcaaagtggatacacttacaaagtcnaggaaattagggtatgatgcatttgtagacccatgctcatggacatagttggcatacattgaaactttgatgcacacacattactcccaatggagctgtcaggaactgtgccaacatttagg

SEQ ID NO: 6697 - DNA, 714 bp, Glycine max
  misc_feature (1)..(4): n is a, c, g, or t
  misc_feature (45)..(45): n is a, c, g, or t
  misc_feature (48)..(48): n is a, c, g, or t
  Predicted polypeptide sequence is orthologous to G470
nnnncccccccccccccgccgtcaattgcattcgttcagcatcanccncaccgcgcaattaaccctcactaaagggaacaaaagctggagctccaccgcggtggcggccgctctagaactagtggatcccccgggctgcaggaattcggcacgagtatgatctgactgcttatattgtggaatgtataaattgaatttatttggcagtagtcacttgtcagtggcattgaatgagttttaatactgaaaccccctcctttggaaagaaagatgaagctgattaacaaattagtcctgttaattctgctgtctcctttatgtgtatgaacaattgtctgaattgttactcttaagaacaagagctagcctgtgtcataggtgttggctaaagtgcaagagtaagatattatctactgtctttagtaggaaactgtattccagaaagaaagaaaaaaatctaagttgggtaggaaacggtgtagtttataattatagtgccttttgaaagtatgagatatatttttcatgtcttctctgctcctttcatttcggcatgtataggttttctaacctaccttggtgaatttgtctttcagaaaatacctgcaaactttaaagatgacaatgcgaaagaatggcaagcggacagccagcagcttgaacggaatgattgttcatatgggagttctattagctattacaggaagtgaatat

SEQ ID NO: 6698 - DNA, 851 bp, Glycine max
  misc_feature (23)..(23): n is a, c, g, or t
  misc_feature (40)..(40): n is a, c, g, or t
  Predicted polypeptide sequence is orthologous to G470
aatatatctactaatgtattacnacatacagggggggganccttactaaagggaacaaaggctggagctccaccgcggtggcggtcgctctagaactagtggatcccccgttctgcagggaaatgtgagtgagcctgctggtcagatgcatcttacagcacaccaacaaagaacatctgaaaatgatgagaagtcagatcactcaaagggatcaagacctgtagatgatctagttgttgatgaccatgacagaccattacagacttctcagtcgcatactaaagacgttcaagccaaacctctcagtggttctgctaggagttgcactaaagttcacaagaagggcattgcacttggtagatcagtggaccttacaaagtacagtggctatgatgaattagttgccgaattggatcagctgtttgaatttgggggtgaatcattgtcaactaaaaaagattggcttatcgtctatactgataatgatggtgatatgatgcttgtaggcgatgatccatggcaggaattctgtgccatggtttgcaaaatttatatctaccctaaagaggagatccagacaatgagcccaggtacactgagctcgaataatgaagagaaccagtcggtgatggctagtgatggtgcagatgcaatagctgttaaatgtcagccacatcaaaagttcaattcataaaatggccttgacgcctaatgattattagaatgatctccatacgctttagattctgggatggcaagtaacgaactgtcatgatgccattcatccagctgggaatcatgaccttgacatgatatcgatggttactgctgctatataagtgtctgcttaa

SEQ ID NO: 6699 - DNA, 835 bp, Glycine max
  misc_feature (620)..(620): n is a, c, g, or t
  misc_feature (688)..(688): n is a, c, g, or t
  Predicted polypeptide sequence is orthologous to G477
acaataccccatgcaggattaatgattaataattcagtacgacaaaaagtcattaccaaagttgtcactaacttaatcgagcgtcaattctagtaaacaattgccctgatttgaagtgtttatgccatgaagaacacattttgatacatctaaggctcttttgtttattacatccagatggatatattaacacagagagggacaattgtgtcccaacaaatatcatagatatagcctggcgtgtttagatcagttattctgcagacaagttgttcttgaaccgaatcagcacaagcaagctaatgtaaatagttagcaacagaatggcaccatttgaagtttctattcccctgtggcctacattgtcttaagatgattggcataggcgtgtctttcacatgcttcacaactagtttcctcttccaaaagcactttatgtaatccgcagagtgcaagaagaatcattctcttgcttcacctgcaaggattgcctctcatgctcaactcgctgaagctgtgatgacaattgtagcaagtcaatggttgcaccatcttcatcggaaagacgatctttcacattcaagtaatctgaaacttggaagataccatctgccatatcnaagtttataatatcattattgcctgatattaatacaggactgagatggcttcccatcgcatgatttanttctggtggaaaactatctgaaactcggcttgaagaaatctgtgagcttattcctatcttgtcagagacctgactcatgttgtagtgatggctatgactgcttggaatacccaagagtgacccagggaattctgatgattggcttga

SEQ ID NO: 6700 - DNA, 681 bp, Glycine max
  misc_feature (1)..(1): n is a, c, g, or t
  misc_feature (26)..(26): n is a, c, g, or t
  misc_feature (32)..(32): n is a, c, g, or t
  misc_feature (501)..(501): n is a, c, g, or t
  misc_feature (505)..(506): n is a, c, g, or t
  misc_feature (509)..(509): n is a, c, g, or t
  misc_feature (511)..(511): n is a, c, g, or t
  misc_feature (516)..(519): n is a, c, g, or t
  misc_feature (521)..(523): n is a, c, g, or t
  Predicted polypeptide sequence is orthologous to G477
nttgccagacaaatttgtacctaaanctatgnacctccatttttccagacgcgcaattaaccctcactaaagggaacaaaagctggtactccaccgcggtggcggccgctctagaactagtggatcccccgggctgcagggaaatgcatccactagagctgctaaatgacaagtcacacatcaagaaattaccaatatcaaaaattgcagttggacaataaaatagaagttttaaaagttgaactttgaatgataactgtcttatctaatgccaatgaagactatcagaatgcatttttcataccttgatatgactgaagaatcttgtgttgtttaccagtcatgtaatcaaattggggtttccttcggcgttcattgtgtcctgctagacgcctgcgacaactgcgcttaccatcatcgaactcgacaagcaaatggaacctaatttaataacaaaacaaatggtgtaattcaatacataagtaataatcaggttcactntgcnnaananaaaannnnannnaaaaaaaaaaaaaaaaaaaaaaaaaactcgagggggggcccggtacccaattcgccctatagtgagtcgtattacgcgcgctcactggccgtcgttttacaacgtcgtgactgggaaaaccctggcgttacccaacttaatcgccttgcagcacatca

SEQ ID NO: 6701 - DNA, 810 bp, Glycine max
  misc_feature (1)..(4): n is a, c, g, or t
  misc_feature (767)..(767): n is a, c, g, or t
  Predicted polypeptide sequence is orthologous to G478
nnnnttggcatcaacatgattatcatcggagtgcgcagtgaaccctcactaaagggaacaaaagctggagctccaccgcggtggcggccgctctatttcttgtggatcccccgggctgcaggaattcggcacgagggcaggaagagattggcagatcataatcgccgcagaagaaaaacacagcaaccaactcaagaaattcagaaatctcagtcttctttggagaatgttgcaagatctccaccggactccggagctcagtcttcctcgtcggtgactgtggcagtgtcgccgccagactatttccggcagaggccataccaaagcacgaacccttcatctactacttcaagctcattgttattctcaagcgggtagagtgcatgttggagcagtttaatttgcatggataattaatatttgcaagacattaacggaggagcgtcaacaataattatattatagtgaactactacttccacttgtaactcccaatttaatgtcaaactcttaatctcgtgttattaatttgtacgaatcgtgatttaaagcatctatgttaatcctggtatccccccttaaaaaagatataaaaatactcgagggggggccccgttcccaattcgccctatagtgagaggtattacgcgcgctcactgtctgtagttcacaacgtagtgacgtgggaaaccatggggagacccacttaatcggcttgcgacacatctccctatcgccagctggcgcatgacgagagagcctgaccngacgcctgtcaacagtgcacagctgatagtgagtggacgcgcc

SEQ ID NO: 6702 - DNA, 826 bp, Glycine max
  misc_feature (793)..(793): n is a, c, g, or t
  Predicted polypeptide sequence is orthologous to G483
caaaccaaacctctctttctcagtttctctctcttagggttttctcctcccccattgacccaccgtccatcgcaaaggaagtcgcgcccaatttccatggactcagcagcaacatcagcatgggatgggcgttgccacaggtgctagccaaatggcctattcttctcactacccgactgctcccatggtggcttctggcacgcctgctgtagctgttccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccacagtcttcctcttgctcggataaaaaagataatgaaagctgatgaagatgtccggatgatttctgcagaagctccagtcatatttgcaaaagcatgtgaaatgttcatattagagttgacgttgagatcttggatccacacagaagagaacaagaggagaactctacaaaagaatgatatagcagctgctatttcgagaaacgatgtttttgatttcttgggttgatattatcccaagagatgagttgaaagaaggaaggacttggaataaccaaggctactattccattggtgaaatcttcagctgatatgccatattactatgtcccttcacagcatctgtggaggactctgggatgacatgggcaacccgtggtgtgacaacaacgttgatctcacagagctnactccatgggtatgcatggcctcaaaccagaca

SEQ ID NO: 6703 - DNA, 938 bp, Glycine max
  misc_feature (1)..(2): n is a, c, g, or t
  misc_feature (681)..(681): n is a, c, g, or t
  misc_feature (753)..(753): n is a, c, g, or t
  misc_feature (771)..(771): n is a, c, g, or t
  misc_feature (782)..(782): n is a, c, g, or t
  misc_feature (789)..(789): n is a, c, g, or t
  misc_feature (804)..(805): n is a, c, g, or t
  misc_feature (839)..(839): n is a, c, g, or t
  misc_feature (855)..(855): n is a, c, g, or t
  misc_feature (865)..(865): n is a, c, g, or t
  misc_feature (877)..(877): n is a, c, g, or t
  misc_feature (879)..(879): n is a, c, g, or t
  misc_feature (912)..(912): n is a, c, g, or t
  misc_feature (931)..(931): n is a, c, g, or t
  misc_feature (938)..(938): n is a, c, g, or t
  Predicted polypeptide sequence is orthologous to G484, G2631
nnaatgtgaatgatcgatggtagtagccccgcgctctaatacgactcactatagggaaagctggtacgcctgcaggtaccggtccggaattcccgggtcgaccctgcgtccgctctctctcttgttcttatccatcgcattgaaaagcagcaccatcaccacccccacctcttaccccttctttcataaatatgcgtctctgcaacaacatgttcaccaccacctccttgttcttcacatcatcctcatcatcttcttcaatcagttgactcttcgttcctccctctattctttcggatggagcccatggacatcgttgggaaggccaaggaagacgcttctcttcctaaagcgacaatgacgaaaattattaaagagatgttgcccccggacgtgcgtgtcgccagagatgcacaggatttattgatcgagtgttgtgtcgagtttataaaccttgtctcgtcagagtccaatgaagtctgtaacaaagaagaaagaaggacgattgcaccggagcacgtgttaaaggctttaggggttcttggatttggcgagtacattgaggaagtttatgcagcatatgaacaacacaagttggaaacaatgcaagattctttaaaaggtgcaaagtggagcaacagagctgagatgactgaggaagaagcattggctgaacagcanaggatgtttgcagaggcacgtgcaagaatgaatggaggagccattcaatccaaggagccagatgctgaccancagttagagagctaactntatacgacacntttattntcttttgaagcatanngcagcagcatctcttactcttccctatgcgttgntaaattagctcgattntgacataccnccattcactagntngctgggctacgtgaatgtactcgcccattgtgntcttttagtaatccatatntgtagan

SEQ ID NO: 6704 - DNA, 912 bp, Glycine max
  misc_feature (1)..(1): n is a, c, g, or t
  misc_feature (548)..(548): n is a, c, g, or t
  misc_feature (799)..(799): n is a, c, g, or t
  Predicted polypeptide sequence is orthologous to G484, G2631
nagtgagtgacggcttacttgattccgccaagcgcgcaattaaccctcactaaagggaacaaaagctggagctccaccgcggtggcggccgctctagaactagtggatcccccgggctgcaggaattcggcacgaggtcttcttcgctcttgcacctcctcttccttccacaactacgatcttcgatagtgctttctcagattcttccttcgtggtaaccggtcgaatcatggagcccatggacattgttggcaagtcaaaggaagacgcttcgcttcctaaagcaacaatgacaaaaattattaaagagatgttacccccagatgtacgtgttgcaagagatgcccaagatctattgattgagtgttgtgtagagtttataaaccttgtctcgtcagaatccaatgaagtttgtaacagagaggataaacggacaattgcacctgagcatgtattgaaggctctacaggttcttggatttggggaggatgtggaggaagtttatgcagcatatgaacagcacaagctggagaccatgcaggactctntaaggggtggtggtaaatggagcaatggagctgagatgactgaggaagaagcattagcagagcagcaaaggatgtttgcagaggcgcgtgctaggatgaacggtggagccattgctttcaagcaggcagatgctgaccaaagtttagatagctaactttagatcttcattgagcatagacaaacaccaccctgactcctgctgtgcttccatgagctcgatgtgtacaaaaaccattcactgtttgctggncccaggtgagtgctcatttgattctttcataatccatatttgtaggcaatgtattagtgaggatcatgaaacccttcggttaaccattacttgaataatttaatttccgtttg

SEQ ID NO: 6705 - DNA, 854 bp, Glycine max
  misc_feature (854)..(854): n is a, c, g, or t
  Predicted polypeptide sequence is orthologous to G489, G714
ttttcttctccccgtcgctcccccccccccccccccccccccgatgggctcagcgcactcagtatgcagccgccgagcgcgcaattaaccctcactaaagggaacaaaagctggagctccaccgcggtggcggccgctctagaactagtggatcccccgggctgcaggaattcggcacgaggcttttgttctcgcacttcgctgtctgaggttctggattctcagtgtttgcgaagcgctgcatcatcctttggggaagaatggatcatcaagggcatagccagaacccatctatgggggtggttggtagtggagctcaattagcatatggttctaacccatatcagccaggccaaataactgggccaccggggtctgttgagacatcagttggtaccattcaatccacacctgctggagctcagctaggacagcatcaacttgcttatcagcatattcatcagcaacaacaacaccagcttcagcaacagctccaacaattttggtcaaaccagtaccaataaattgagaaggttactgatttcttgaaccacagtcttcccctggcaaggatcaagaagattatgaaggctgacgaggatgttaggatgatatcagccgaagcaccagtcatctttgcaagggcatgtgatatgttcatattagagttgactctgcgttctttgcttcacactgaagagaacaaatggcgaacactccagataaatggatatgctgctgcaatgacaatgactgacatcgttcatttctcgtgtgacattgtgccttctgatgaccttgaagatgataggcttgcttcatcccaagtagaacacagcctggtgaagggactn

SEQ ID NO: 6706 - DNA, 895 bp, Glycine max
  Predicted polypeptide sequence is orthologous to G502, G519
ggaataatcgtctacacgaaccagcacggacacactcacggatcttcactcagtctcgtgcttccgtgcaaatggtgcagtggagcagctactgcaaaaatgcataatgcatacacacaacacagaacgacgtcgtctcgtcgtggtggtggtgcgtgttaattgcagaaggacttggagaggtacatgaaaatatcctgcagcggcgacatctgattattcccgagagtggcatccacgtaattatatgcaaactcgttgttgttgttgctgcccctcttcggctcgctctgcacctcgctcgcaaactccgccgacaccacctgctcggagcagctcgagtccgtcgtgtgcagccggggcaccgagtcggaagcctcgaagtacaggcaatccgccaccgtcgccgccgtatacggcggatctggcggcagaatctccggcttctcgtcctccatttcggaacattcaattttgcggaccccactcggtggtggtagttgttgcttttcaattgcacctttcttgttgtaaattcggcacagcacccagtcatccagccttaagctgttctttttgcgaacggaacgatccacgtctgcaagacgatactcgtgcatgatccagttagttttctctcccttgggcgcttttccagcgtaaaaaaccaacgctttcttgatcccaaccggtttcggtttaccaactggtttatccgctccggttgccttccagtacccggttcccgcggaccggttcggccgcgaaccgttcgggtacttgcggtccctcggcgtgaaaaaataccactctttctctccgtacaaagccattcctggaaagtcccaagggtcgtacttgtacagatcaatttcggcgattatgggaaccgcga

SEQ ID NO: 6707 - DNA, 928 bp, Glycine max
  misc_feature (6)..(7): n is a, c, g, or t
  misc_feature (661)..(661): n is a, c, g, or t
  misc_feature (743)..(743): n is a, c, g, or t
  misc_feature (746)..(746): n is a, c, g, or t
  misc_feature (748)..(748): n is a, c, g, or t
  misc_feature (750)..(750): n is a, c, g, or t
  misc_feature (752)..(756): n is a, c, g, or t
  misc_feature (759)..(762): n is a, c, g, or t
  misc_feature (765)..(765): n is a, c, g, or t
  misc_feature (767)..(767): n is a, c, g, or t
  misc_feature (769)..(769): n is a, c, g, or t
  misc_feature (775)..(775): n is a, c, g, or t
  misc_feature (785)..(787): n is a, c, g, or t
  misc_feature (789)..(789): n is a, c, g, or t
  misc_feature (793)..(793): n is a, c, g, or t
  misc_feature (795)..(795): n is a, c, g, or t
  misc_feature (797)..(798): n is a, c, g, or t
  misc_feature (803)..(803): n is a, c, g, or t
  misc_feature (807)..(808): n is a, c, g, or t
  misc_feature (819)..(820): n is a, c, g, or t
  misc_feature (823)..(825): n is a, c, g, or t
  misc_feature (827)..(829): n is a, c, g, or t
  misc_feature (834)..(834): n is a, c, g, or t
  misc_feature (839)..(839): n is a, c, g, or t
  misc_feature (843)..(843): n is a, c, g, or t
  misc_feature (849)..(850): n is a, c, g, or t
  misc_feature (928)..(928): n is a, c, g, or t
  Predicted polypeptide sequence is orthologous to G502
cccccnnaagcgtggatagaaatgtctatcgtgatcacgcccagcgcgcaattaaccctcactaaagggaacaaaagctggagctccaccgcggtggcggccgctctagaactagtgtatcccccgggctgcaggaattcggcacgagcagagcgaccccaagtggaacgatgatctggacctaaagctagaaaacgcgtttgattttcagtttaattacttggacgataataacctttccgtggatgattacctttttggcactgttcagtatcaaatgggccagctctcgcccttgcaggacatgttcatgtacctacagaagatgtgaaaactgaaaacgaaacgttttgagcaacatgggacccgcaaatatctttgttttattatttttttaaaaggaaaagtcagcatttgtatgcaattgcattgcacctaacatgtgatgtgggctaggccaagcttagcaactattcttattctttgttctagagagatgagggaatgttgaattcggctgaaatgggctatttggattggttcttggtgtaaagaaaaaatgagagaaggagattaggtgctgcagtaagtaaaaagtaagtgagcaaattgatgataggttaattggagggttaatggtggtggtgtaggactcacttangaaaattcttgttccattgctattccagcatatgattttttcatatattttgtaatatacaactttctacttttccattcanaanananannnnnaannnnaanananacaaanacaaaaaaannnanaaananannaatanaaannaaaaaaaaaannaannnannnaaaanaaaanaaanaaaaannattcttggggggcccccctaccattctcctattaggtttaattcaccgctctctgcgcttttaaaccgtgaggggaan

SEQ ID NO: 6708 - DNA, 826 bp, Glycine max
  misc_feature (1)..(1): n is a, c, g, or t
  misc_feature (13)..(13): n is a, c, g, or t
  Predicted polypeptide sequence is orthologous to G502
nctgtgttgacangcttgattggatgacgcatttaatacgactcactatagggaatttggccctcgaggccaagaattcaagcagggcaacagcgagttttcgtataattacatggatgccactctcgggaataatcagatgtcgccgctccaggatatcttcatgtacctctccaggcccttctgaaatcaacacgcacgagacggcacgacgtcgttctttgctttgtgtgtgcatgatgcatttttgacgtgcctgctgcattgcatggaagcacgagactgagtgaatgtccgtgagtgtgtccgtgctggtgcgcgtagatgattattattataaaaaaacaaaaaaacaaaaaagagaagcattcatatatgaacatgatgaatccaactgtttacatgatctagtcgcaattaatagtttgatattaagcttattccctttagtgagggttaattttagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgggtgggttacgcgcagcgtgaccgctacacttgccagcgccctagcgcccgctcctttcgctttcttcccttcctttctcggcacgttcgaccggctttccccgtccagctctaaaatcgggggctcccttagggttccgattagtgcttaccgcacctt

SEQ ID NO: 6709 - DNA, 578 bp, Glycine max
  misc_feature (45)..(46): n is a, c, g, or t
  misc_feature (510)..(511): n is a, c, g, or t
  misc_feature (524)..(524): n is a, c, g, or t
  misc_feature (566)..(566): n is a, c, g, or t
  Predicted polypeptide sequence is orthologous to G509
cacaggtggaaatctacgctgggttatcaagtatggatatttcgnngatgtaaaactatatcacagaaaatttgtaagtggcatcaatatttcatgcccttctgcttctcagactgctacattttctaaattcgcacaatatcagcccaaagtacaggttgcttcaaaaaatttaatttaatataatattacatcttcattctgaccgtgtacaaatcattagtcagaaatcacaagttggcttctgcaacacgagaagaatcttcaatttcaaaagttgagacttgtccacgagatgaagcatttcctaactgatcaattgtgtttggcttggtcttttctacattcttcatagctgtatttacatcattagcttgtaaacttggattttcatgttcttcacccctggatgctaccttgcattctgttaatttggtcttccactttataccaactttctttgcctgatcagcaaacagaccttctgataagggtgaaccacatatttcnntgtaagtatcacnattggcagcacatgtatttccaccttccaaaagttttgacantggatgcaaaac

SEQ ID NO: 6710 - DNA, 764 bp, Glycine max
  misc_feature (1)..(5): n is a, c, g, or t
  misc_feature (33)..(33): n is a, c, g, or t
  misc_feature (46)..(46): n is a, c, g, or t
  Predicted polypeptide sequence is orthologous to G521, G2887
nnnnnccccccaggtgaggatgattgaccgtgnatcgtactgcccngctctaatacgactcactatagggaaagctggtacgcctgcaggtaccggtccggaattcccgggtctaccttcgcgtccgcatgaatttagacttgatgacaaggtgctggctgacgaagccgtatcacaggatgcctatgtgatttgtagggtgtaccaaaaggaaggtcctggtcctaggaatggtgcacagtatggtaaaccatatgatgagaaggagtgggaaacagatgaggaaattgattctgtacaatctgcccctgttgctgctgtttgtgcacctgttcctatacaacctagtgaaagccatatttctgttgctaattacacccatccctctacaagtggatgtgctggattgacctctgtatcatgtgtatcagaattgatgccctcatgctcgacacatccttctgcactaaacaatccggttgactctgtatcatgtgtatcagaattgattccctcttgctcggcacacccttcagcaccaaacagtcaagttggctctttatcatgtgtatcagaattgatgccctctttctcgccgccttcaacaccaaaaaatccagtttactctgtatcatgtgtatcagaattgatgcactcttgcttggcacatgctttggcatcaaacaatcaagttgactctgttccatgtgtatcaaaattcatgccctcttgctcagcacatacttcaagaccaaacagttaag

SEQ ID NO: 6711 - DNA, 657 bp, Glycine max
  Predicted polypeptide sequence is orthologous to G521, G2887
tccaaaatcgccaaagcttgaaatctgattgcggcgtctcgcgcttccttcttccaccttccccgggtttcactgtgccgatgacttttcttctgagaaagagatcgtcatccatcgcgtgccttcgttttcccttcatgaaccggggcaggctttggcgttcttggaacttcttcttccgccactggacttgaccctacccccccccaattagggttatctatttcttccattttttttccttagaaaaaaaaaacccgtttcttcttctctcgctgccgacgagtcttctttctcttcgaatctttctggctgctacattctgaagcacttcatatttcggtttttcattttcatttttattttttttttattatctggatggccaaaccaaaaatgccagggtttcggtttcaacccactgacgttgagctgattgagtattttctgaagaggaaggttcggggtaagaaattcccttccgaaataattgctgaacttgacttgtacaagtttgctccgtgggacctcccagatatgtctttgctcaagaatggggatttgaattggtacttcttttgccctcggggaaagaagtattcgactggtgggaggttgaatcgggccacggaggctgggtattggaagactactggg

SEQ ID NO: 6712 - DNA, 813 bp, Glycine max
  misc_feature (813)..(813): n is a, c, g, or t
  Predicted polypeptide sequence is orthologous to G525
atgaaacccaatttggaaaaatctactcgcttagggaaagctggtacgcctgcaggtaccggtccggaattcccgggtcgacccacgcgtccgctaactctcttctaaaacttaccaacacaacagaatcgagtttccaataaagagttttgttgaaatggaaaacgttccggcggtgtgtaaggaagatgatcagatggatttgcctcccggatttcgattccacccgacggatgaagagctcataagccattacctctacaagaaggtcattgacaccaagttcttgcgccagggcaattggaaaagtggaccttaacaaattccagccttggggatttccctggaaacccaaatgggaaaaaaagagtggtcctttttctgggtgagagacaaaaaattccccactgggctgtaaaaccaccgggccccataagctgggttcttggagggcacacggaaaggacaagaggatttcagaggaaaatttctgcgtggaatggagataactctgggtttctacagaggtcgcgcacccacacgagagaaaagcatttgggtctgcactattcctcctcggggaaaatcttggtgcaatcttccataattgcgagaacgagtgggatgtgctcgttgtaagaaacttgtctgcgagaattctcttcttcggcgtatgaatgtgactgtcagtgaataatgttgtctttacgttgcaacacttcaactcactcggctttgtctccagccaacgctctttgaccggctctaggctctgctgccaactgacttgcgtcttaatgccgcttgtacgtn

SEQ ID NO: 6713 - DNA, 719 bp, Glycine max
  misc_feature (490)..(492): n is a, c, g, or t
  misc_feature (577)..(578): n is a, c, g, or t
  misc_feature (598)..(598): n is a, c, g, or t
  misc_feature (647)..(648): n is a, c, g, or t
  misc_feature (652)..(655): n is a, c, g, or t
  misc_feature (666)..(668): n is a, c, g, or t
  misc_feature (670)..(670): n is a, c, g, or t
  misc_feature (682)..(686): n is a, c, g, or t
  misc_feature (705)..(705): n is a, c, g, or t
  misc_feature (709)..(709): n is a, c, g, or t
  misc_feature (711)..(711): n is a, c, g, or t
  misc_feature (713)..(716): n is a, c, g, or t
  Predicted polypeptide sequence is orthologous to G525
ctttgtaggataacattagcttaaaagcaatttatttacatgtataataatatttaatccctaaagtttctctgattttaatctgcatataatttccttcaacctttaaaatccccataggccactagaatacacatgtcctacagaaggtgatgaatattcctggttcccaaatgatctttgaaacatttcattgttgttgtacatcaccgaggacatgtcagcatcaaagtctttattattatcctgagctttctgagttctttggccagtacttgatccatggttttcaatcaacatccccaacatggactgttcctgatgaagcatgaagtaatctgagcagtgtgagtttccaacttggagtgattggtgggacacagtaggggcagatttggaaaaagtccatgagtcaggggaaacatcagaggggtttgaagaatatgaagatgccaacatgatgatttcatagctttcagctatgttttcnnnttctgtttttttatcctcactttggtttggatcagagaagcaggttgcatgtgatgactcccccaaaacaggttttgattcactnntgttgttgttgtttggaganaaatccatcaatgaaggtatgtcctttgcaaaagtgctgaacctcaacnncctnnnnatgggcatttnnntnccacaattactnnnnnggaaaatcctgcagatggnccantnannnntgg

SEQ ID NO: 6714 - DNA, 1235 bp, Glycine max
  Predicted polypeptide sequence is orthologous to G525
cgggtgaaaattgaaatcgcaaccgcaatttaaaaccttggtgtatgttcttatattgaaattgaaattcttggctagggaagcaaaagggtagtaattggttttagagtaagtgagaatggaaaacgtttcggttcttttgtgtaataaggaaaaggatcagatggatttgcctcctgggtttaggtttcacccaacagatgaagagcttattagtcattacctttacagaaaggtcactgacaccaacttctcagctagagccattggagaggtggacttgaacaggtctgagccttgggatttgccatggaaggccaaaatgggagagaaagagtggtactttttctgtgtgagggacagaaaatacccaactggtttgaggactaatagagccactgaatcaggatactggaaggctacagggaaagacaaagagattttcagagggaaatctcttgtgggtatgaagaaaactttggttttctacaaaggaagggctcccaagggagagaaaactgattgggtcatgcatgagtataggcttgatggtaaattctcttttcacaccctccccaaaactgcaaagaatgagtgggtgatttgcagggtttttcagaagagttcaggtgtgaaaaggactcatatttctgggatgatgatgttggactcttatggaaacgaaatggtttattcttcttctgctttgccacctctcactgattcctcaccttccattggcaacaacaccaaagcactgagtgtgactgattctgcttacgtgccctgcttctccaatccaattgatgttcctagaggaatctttgattccttgaacaacatcaatatcagcatcaacagcaacaccctttatggagtttcttcaaaccattcattttacaatactcagggggttcaacttcaggctccaccaactttgccattacctagttcttcaaaccattaccttagagcctttcttgaaaaccaaggaaatggatcgaacatgagcaacaatggttttgagccagagagggaaatggtcagtgtctcacagaaaacaagtctttctactgatgtgaaggctgaaatctcttcattgggtaaaaggcactttgagaatcaaaacaacccaattgcttcagcagctgcagttgcaccaatggaccttgctaccttgtggaactactgatctcaaataaagaattgccattggaaaaaaaaaaaaaaaaaaa

SEQ ID NO: 6715 - DNA, 1018 bp, Glycine max
  misc_feature (821)..(821): n is a, c, g, or t
  Predicted polypeptide sequence is orthologous to G536
aacacaagaaagattgcaacagataataattaattggatatcccattatacagtatcctttccaataccatatgacacacaaaaaaaagaagcctggtctctgttcatacaacattatatcacagattgccaatcattttataaactagggcgattcttaattagcacaaataaatgacattcaaagcccacctccatgagaggaagaataccacccatcaacctataagggatatcagggctcatctagctggtcctgaacatcagaagtccaaagggtgaggttgtctcttaaaagctgcattatgagcgtgctgtctttgtaagattcttctcccaaggtgtccagctcagcaattgcttcctcaaaagcctgtttagccatggcacacgctttatcagactggttgaggatttcatagtagaagacggagaagttgagagcaagacccaatctgatggggtgagtagggggaagatccgcagaagcaatatcctgggcagccttgtaagacaacatggtatcctcagtagcggtttttctttcgtccccaaccttaaactcggcgagatagcggtggtaatcgcccttcatcttcaagtagaagaccttggactcgctggcggaggcggagggtacgaggttggagtcgaggaggctgaggatgctggcgcaaacctgagtgagctcgttctcgaccttggatctgtagtgcttgacgagggagacgtggtcgtcgttcttgcggccctcctccttctgctcgatggaggagacgatgcgccacgcggcacgcagcgagccgatgacgttcttgtangccaccgagaggaggttgcgctcctccaccgtgagctccgacgccggcgtcgaccccaccaccaccttctgcatgaactcccacatctcctcgtaccgctccgcctgctccgacagcttcgccaagtacacgtactgctctctgtttagcccctctgctgctgccattctcttcttctgatttgcttgcgagttgaa

SEQ ID NO: 6716 - DNA, 1049 bp, Glycine max
  misc_feature (1)..(2): n is a, c, g, or t
  misc_feature (7)..(7): n is a, c, g, or t
  misc_feature (695)..(695): n is a, c, g, or t
  misc_feature (710)..(710): n is a, c, g, or t
  misc_feature (1049)..(1049): n is a, c, g, or t
  Predicted polypeptide sequence is orthologous to G536
nnggggnctgccactgaggagcgtcttgtaaacgtcaagcgcgcaattaaccctcactaaagggaacaaaagctggagctccaccgcggtggcggccgctctagaactagtggatcccccgggctgcagggttcactttctctctctaaatccctaaaccagatctcgcactcgcgctttctctctctaggattcgacaatggcggccgctccctcgcctcgcgaagagaacgtgtacatggcgaagctcgccgagcaggccgagcgctacgaagagatggtggagttcatggagaaggtctccgccgccgccgacaacgaggagctcaccgtcgaggagaggaacctcctctccgtcgcgtacaagaacgtgatcggagcgcgccgcgcctcgtggcgcatcatctcctcgatcgagcagaaggaggagagccgcggcaacgaggaccacgtctccgtcatccgcgactaccgatccaagatcgagtccgagctctccaacatctgcgacggtattctcaagctcctcgactctcgcctcattccctccgcttcctccggcgattccaaggtcttctacctcaagatgaagggagattaccacaggtacctcgccgagttcaagaccggcgccgagcgtaaggaggctgccgagagcactctctctgcatacaaagccgctcatgacattgcanatgccgaactgcctncaactcatccaattaggcttggcctgcactgaactctctgatttactacgaaatcttactctccgtcgtgctgcacctgcaaacagctttgatgagctatgctgaatgatcactggagagagtctcaggatgcacttgactgcactctcggatacctacctttgaccttgatgcagagatgacaatgaataagagcgaccgacggagaccagaatattatgctatgatgactctctcttctttgaaggaaagggtggcatccctggctgattagcatagttgtagatggtgaccgccgtgtgtgcttattaggttgcaaggcataaagccccgattttn

SEQ ID NO: 6717 - DNA, 1220 bp, Glycine max
  misc_feature (32)..(34): n is a, c, g, or t
  misc_feature (908)..(908): n is a, c, g, or t
  Predicted polypeptide sequence is orthologous to G536
gggagtactacgattcattggccaactgaacnnnactgtacaatccatcgctgcagctaaccctcactaaagggaacaaaagctggagctccaccgcggtggcggccgttctagtaattagtggatcccccgggctgcaggccactttcttctccttttagggtttcctttctgtttctcctttccagatctgcatcttccattttttaggattaagcggtgagattcgtgaatctgagaaatgtcggattcttctcgggaggagaatgtttacatggcgaaattggcggagcaggccgagcgttacgaggagatggttgagttcatggagaaggtagcaaagactgtggaggttgaggagttgacggtggaggagagaaatcttctctctgtggcttacaagaacgtgattggtgcgaggagggcttcgtggaggatcatatcctccattgagcagaaggaggagagcaggggcaatgaggaccatgtggccattataaaggagtacaggggcaaaattgaggctgaactcagcaagatctgtgacgggattgtgaacctccttgagtccaacctcatcctatccgccgcatcttccgagagtaaagtgttgtaccttaaattgaatggtgattaccacaggtaccttgacgagttcacgactggagcagagaggaaagacgcagcagagagtactttgcttgcttacaaatctgctcacgatattgctcatgcctactcggcctcgatcaccccattaggcttggactagctctcaactcttctggcttcaatatgaatacttaactcgcagatctgacttgaactctgcctaccagctttgcataggcatctcctgactgtatcttttctgaaagtacctcatcatatgcttctacatctatatnttccggaactctatcttttgtcttctactcatcgcttctatgtgcaacattataatattctaatccactctatatcaccgctcgtgcgtgcttatctgacttctatctcatcctatctcctcctaatcacagcatattctctgctacacgttcgtctcgtactcactatgactatttatcataactctacgtctatcctactctctacattcatcgctctgtcacatatactctacgtcttctgtcttttctctctcttgtccgtcaatcaattcattcaccactatctatatataactcactatctcattc

SEQ ID NO: 6718 - DNA, 1073 bp, Glycine max
  Predicted polypeptide sequence is orthologous to G536
ccctgttaaattttgagtccacaaagctaataattctactcgtaccaggttccacttccatgtcctttcagcaacatcgtttttttcctaaaaaattaaagactggttttggaaagctgcgtcggaaaagggcttgacgtcgtcgtttccgggatcgaacatggaggcgatccacttgaagtcgtcgaaattcgccgccatgatgctggcgggggcgccaccccacttggactccatgtcaccggaaaatgagaaagaggaggagagtagaaggagagagaaaaggggcaatgaggaccacgtggccattataaaggagtacaggggcaaaattgaggctgaactcagcaagatctgtgatgggattttgaacctccttgagtccaacctcattccttccgctgcatctcccgagagcaaagtcctttaccttaaaatgaagggtgattaccacaggtaccttgctgagttcaagactggggcagagaggaaagaggctgcagagagtactttgcttgcttacaaatccgctcaggatattgctctggctgacttggcccccactcaccccattaggctgggacttgctctcaacttttctgtgttctattatgaaatccttaactcgccagatcgtgcttgtaatcttgccaagcaggcatttgatgaggcaatttccgagcttgacacattgggtgaagagtcatacaaagatagtacattgatcatgcaacttctccgtgacaatctgactttgtggacatcagacatcacggacgatgctggagatgagatcaaggaaacatttaagcaacaaccaggcgaataggcgatggcagtagcgatgtggtagttgattggatatgtattaccgataatatggatccaatgtggcttgccatagtgggattattgtattaatgaattttatgatttcaagtgcgcgttgcgcttgggatttacaatgtttcagtggattgtttaatgtgttttatggatgagaagaatgtggtttagtgatttataaattttttattgttgcccaaaaaaaaaaaaaaaaaaaaaaaaaaaaa

SEQ ID NO: 6719 - DNA, 1286 bp, Glycine max
  Predicted polypeptide sequence is orthologous to G536
tttcacttcacttgtggttcctcactctctctctctccacaccacactgaggagggagacagtggaaggaaggaacactcaaatcactgaaccagccatggctaccttctccaaggaacgcgagaactttgtatacgttgccaagttagctgaacaagctgaacgctatgatgaaatggtggatgccatgaagaaggtggcgaagctggacgttgagttgagtgtggaagagaggaacctgttctctgttgggtacaagaatgtggtggggtcacggagagcttcatggagaatcttgtcatcgatagagcagaaagaggattccaaagggaatgagttgcatgttaagcatatcagggattacaggaacaaggtggagttggagctgtccaacatttgcagtgacattatgataattttagatgagcatcttattccatccactaatattgcggagtccacagtgttttattataagatgaaaggagactattaccggtatttggcagaatttaaagctggcaatgaaaagaaagaggtggcagatcagtcacttaaagcatatcagacagcttctaccactgctgagagtgaactacaacctacacatcctattcgtttgggtctggctctaaatttctcagtgttttattatgagatattaaattcacctgaaagggcctgccatcttgcaaagcaagcctttgatgatgctgtctcggagctggataccctgaatgaggattcttacaaggacagtaccttgattatgcagctgttgagggataaccttactttatggacttctgatatccccgaagagggtgaggacctaaaaatggaaagcgcagccagggttgatcaaggagaagatgagttaggccgctaacccatcattctgtcatatgtctaagatttgatgcattaatttttctcaatcatattttctccattgtagtgaagcctctatctgaatggtgcactgcacctcatcaactttgagtcattcttatttttgagtgatggcctatttgagtcatctacttcatttttatgctattgttgagtagttttattcatgtgtttgtgacacaaaaacaccattggtttgcaatgcataatttccctatttgtatcctgttatggttaagatctgttcttgggttggcctttcaagaactgatcacatgtgagccactgtaatattgcaatatttagacttttgttaagtctcattttattaagacagacaaattaggttaaaaaaaaaaaaaaaaaaaaaaaaa

SEQ ID NO: 6720 - DNA, 445 bp, Glycine max
  Predicted polypeptide sequence is orthologous to G536
cgaactcgtcagatcgggcttgtaatcttgccaaacaggcatttgatgaggcaatttccgagcttgacacattgggtgaagagtcatacaaggatagtacgttgatcatgcaacttctccgtgacaatctgactttgtggacatcagacatcacggacgatgctggagatgagatcaaggaaacatctaagcaacaaccaggtgaataggcgatggcagtagttgatgggatatgtattaccgataatatacatccaatgtggcttgccatagtggaactgtgtattaatgagtttcgtgatttcaattgcgggttgccgcttgagatttacaatgtttcagtcgtgtatgtgttttattgacgagaacaatgtggcttggtggtttagtgatttataaatttttattgttgctatgtagttgcctctttttattgacgagttcg

SEQ ID NO: 6721 - DNA, 1157 bp, Glycine max
  Predicted polypeptide sequence is orthologous to G536
gaaagatcggcgatgactgcctccaaggatcgcgagaacttcgtctacatcgccaaactcgccgagcaggccgagcgttacgaagagatggtggaatcaatgaagaacgttgcgaatctcgacgttgaactgacggtggaggagcggaatttgctttctgttgggtacaagaatgtgattggtgctcgcagagcgtcctggaggatcctgtcttccattgagcagaaggaagaaacaaaagggaacgagttgaatgcgaagcggattaaggagtacagacagaaggttgaattggagctatcgaacatctgtaatgatgttatgagagtgattgatgagcaccttatcccttcggctgcagctggtgaatccactgtgttttactataagatgaaaggagattattatcgttatcttgctgaatttaagtcaggcaatgagaagaaggaagctgctgatcagtctatgaaagcatatgagtctgctaccgctgcagcagaggctgatttacctcccacacatcccatccgattgggtctagctttaaatttctctgttttctattatgagatcttgaactcccctgaaagagcctgtcatcttgcgaagcaagcttttgatgaagctatttctgagcttgacaccttgaatgaggagtcatacaaagatagcaccttaatcatgcaacttctcagggacaacctaactttgtggacttctgacatcccagaagatggagaagatgcccagaaagtgaatggcactgccaagcttggtggaggtgaggatgcagagtgagtccgatggatgatggaatcttccataggattcgatgcatgcgtttgggaatgaaacatgagggccgattacttatctgtgtattagctagagacagggattctattgtttcctctttgtttcctgttggattgcccaatacttcccgataggggcaaagagatactccatttgtgctatatttatggtatgtttttatttgtgtggtgtctggaaatggcctatttcattcccttaccgtttcctccagtctctgggggatttgattgatgagaattgcttatggtgggtgtatttccttttccaatgaaatgctacaacatttactgcaaaaaaaaaaaaaaaaaaaaaaaaaaaaa

SEQ ID NO: 6722 - DNA, 1118 bp, Glycine max
  Predicted polypeptide sequence is orthologous to G536
gcagatcctccatggcctccaccaaggaacgtgaaaacttcgtctacgtcgccaagctcgccgaacaagccgaacgctatgaagaaatggtggaagcaatgaagaatgtggcgaacctaaacgtggaattgacggtagaggagcggaaccttctgtcggttgggtacaagaacgtggtgggtgctcgtagggcttcgtggaggattctttcctcgattgaacagaaagaagaagctaaagggaacgatgtgagcgtgaagaggataaaggagtataggctgaaggtggagtctgagttgtccaatatctgcagtgatatcatgactgttattgatgaataccttattccctctagctcatctggtgaacctagtgtctttttctacaaaatgaagggggactattaccggtacctcgcagagttcaagtccggtgatgagagaaaagaggctgctgatcattccatgaaagcgtatcagttggcttccactactgccgaggctgagttagcatccacacatcccatccgtttgggcctggctttgaacttctctgtcttttattatgaaattttgaactctcctgaaagggcctgtcaccttgctaagcaggcatttgatgaagcaatctctgagttggatactctgagcgaggagtcttacaaagacagcaccctaattatgcagcttctgagggacaatctcaccctgtggacttctgacatccctgaagatggagaggaacaaaaggtggattctgcccgagctgatggaggtgacgatgcataggtattggccaaggaatttgtggagtgcatacgagaaggctagtctctctcttgatagtttaccattaggatgttgtaatagaacatggaattggtctctagaaaatcaccataaggctttgtgagccttttattctatgcgtgtgctttctgttactggagactggagttgagatttgcatggtgtttggctctaatttagtgaatttcttcattttgactttctttctaagaggatgctaccttgcattcttttatcagtttacatagataatatttatttcaaattatgcgaatcattgtttctaaacaaaaaaaaaaaaaaaaaaaa

SEQ ID NO: 6723 - DNA, 914 bp, Glycine max
  misc_feature (914)..(914): n is a, c, g, or t
  Predicted polypeptide sequence is orthologous to G545
ccccccccccccagttgagtgaacggcggatcgtaactacccccagcgcgcaattaaccctcactaaagggaacaaaagctggagctccaccgcggtggcggccgctctagaactagtggatcccccgggctgcaggaattcggcacgagcctcctcctcccacgcgttccgtgggtttgacctgaaccttccggctccgctgacggagttctggtcgccggcggggtttgatttcggaaagaagaaggttggcgttgaacaagaggtggaaagcccgttgccggtaaccgccaagaggccgcgtttgttttcgggggaagataatgaagaggcgtagatttgttcacagaatgtttattttaatttgattgaaattgaatttgttggtacggtgaatatgaattcacaccagttaatttaattttcattttatgttttttttttgtttgtttttagtatatatataggtgggatcgggattaggttcggattttgtttctgctcctctgtacagacaaaatttgttcattgcttttggattcttgtttgccattgattgaatctaacaattgttttcatcaaaaaaaaaaaaaaaaaaactcgagggggggcccggtacccaattcgccctatagtgagtcgtattacgcgcgctcactggccggtcgtttacaacgtcgtgaatgggaaaaccctggcgttacccaacttaatcgcttggagcacatccacctttcccagctggcgtaatagcgaagaaggccggaccgatcggcctccccacaagtgcgcagcctgatgctaatgggaccgccctgtgcggcgcattaacccggcgggtgtgggttaaccgcagggaacgttcacttgcagcgacttacgccgttcttttacttttttcttctttttgctn

SEQ ID NO: 6724 - DNA, 1006 bp, Glycine max
  misc_feature (1)..(2): n is a, c, g, or t
  misc_feature (14)..(14): n is a, c, g, or t
  misc_feature (656)..(656): n is a, c, g, or t
  misc_feature (686)..(686): n is a, c, g, or t
  misc_feature (698)..(698): n is a, c, g, or t
  misc_feature (738)..(738): n is a, c, g, or t
  misc_feature (767)..(768): n is a, c, g, or t
  misc_feature (774)..(774): n is a, c, g, or t
  misc_feature (781)..(781): n is a, c, g, or t
  Predicted polypeptide sequence is orthologous to G550
nnccaacggtcacngacggctgacaattgcctatagggcgaattgggtaccgggccccccctcgagttttttttttttttttttttttttttgaaggagaataacttggatgcctctaaaagtaggcatcgcgtgatgcccttattgtgaagtgattatacttacaatgtacacactgaatcacacccaaaaaaaaactaataataataataacaggctccgaacgccacgtaaaaaagcaagcatacggacccttcattaatgacaaacctgaacaagggctcggtggatatctgatctgattcagtacagattacgcagagattttgaatgtaatgaccagccagctgaggacattttgaggcatagaacagcagctgaaccaaaaccaaggatattcaaattattcctgaacagaacacttgttttcactcaccttgtagccaaacacctttagcaaatgaacacattttaataaattttcccaagtaaaatgtctttcagtcgttgaaagacatgctgaagatggtgacatgattgcagatagcaacatggcccacaaagactatcatcacggaagagctcatggagtccacctggaccctctggccaccatgttggaaataaatcacaactttgttcctgtaaggaagctntcaaagaatatgtcccagctaatgtggcantcttagtcattngaaagggatagatgatgaatgatctcagaaatcagtgcantgacaccttagaccaacatgaatctactnncaaccnatatcgnacccccgaaaaggccagagtttaacatcaccagtcaaatttcaagatcattgccaaatgagtatgcacacaatttgaaggtaggatcttctacagtttttcattgtggctgctgacttaaaaagaagatctgaaacatggtggtatttttggaacttagcatcattcgttcaaagaaaatgcaagatatttgcacccttgaatttggcttcaaagtcatttaaac

SEQ ID NO: 6725 - DNA, 726 bp, Glycine max
  misc_feature (1)..(1): n is a, c, g, or t
  misc_feature (726)..(726): n is a, c, g, or t
  Predicted polypeptide sequence is orthologous to G550
ncggtgcgggtagcataggccaggcgcgcaattaaccctcactaaagggaacaaaagctggagctccaccgcggtggcggccgttctagaactagtggatcccccgggctgcaggaattcggcacgaggatgacatctgttttgaaccttgctgataaagcagtgaacaattccacaacaaatggatttaatggctctgaagaactagaaattcctgttacttatgttggtggagagaaagtgaatgatgattccaataaatcttctgacacgtcaacgaagccaatgaaaggtgaaaccaccaataggtcccaagaacaagtcatagagaattgtcatcccttcccacctcatgttccctactttcctggtgccccttggcctttcccttggaatccagcaccgtggaactccccggtaccattaccacctccttttttcccacaaggatttaccatgcctctctatcctgcagcagcttattggagtcttactataccgggtgcacggagcatcccatggctagcgcaaccatcattactgaatagtacagtgtctaactctggtcctaactcactaaccttgggcaaacattcaagggaagaaaacatgcataaatcaaatggggtagcagttgaggatgaacatagcaaggaaaataataaagaaaagtgtctatgggttccgaaaacattgatgattgatgacctaggagaagcagcaaan

SEQ ID NO: 6726 - DNA, 1262 bp, Glycine max
  Predicted polypeptide sequence is orthologous to G557
ggtttttgagaagaaagatggaacgaagtggcggaatggtaactgggtcgcatgaaaggaacgaacttgttagagttagacacggctctgatagtaggtctaaacccttgaagaatttgaatggtcagagttgtcaaatatgtggtgataccattggattaacggctactggtgatgtctttgtcgcttgtcatgagtgtggcttcccactttgtcattcttgttacgagtatgagctgaaacatatgagccagtcttgtccccagtgcaagactgcattcacaagtcaccaagagggtgctgaagtggaggagattgatatgatgaccgatgcttatctagataatgagatcaactatggccaaggaaacagttccaaggcggggatgctatgggaagaagatgctgacctctcttcatcttctggacatgattctcaaataccaaacccccatctagcaaacgggcaaccgatgtctggtgagtttccatgtgctacttctgatgctcaatctatgcaaactacatctataggtcaatccgaaaaggttcactcactttcatatgctgatccaaagcaaccaggtcctgagagtgatgaagagataagaagagtgccagagattggaggtgaaagtgccggaacttcggcctctcagccagatgccggttcaaatgctggtacagagcgtgttcaggggacaggggagggtcagaagaagagagggagaagcccagctgataaagaaagtaaacggctaaagaggctactgaggaaccgagtttcagctcagcaagcaagggagaggaagaaggcatacttgattgatttggaaacaagagtcaaagacttagagaagaagaactcagagctcaaagaaagactttccactttgcagaatgagaaccaaatgcttagacaaatattgaagaacacaacagcaagcaggagagggagcaataatggtaccaataatgctgagtgaacataatgtcaaaagatggcagagaaaacttatagatggaatagatttagaaagagagaatacattagccagaaagagaaaaaaaaattggacattagttgatgattctttctaggtgtgcgtttggaatacaatgaagtaaaggatgaaccttaagacatgctttatcctaaaatagtgtgatctgatattccattgttaatgagtaatgtaattatcatacaaacaatttgtagtctcattttaattaataattattaaactacttgattactt

SEQ ID NO: 6727 - DNA, 829 bp, Glycine max
  misc_feature (728)..(730): n is a, c, g, or t
  Predicted polypeptide sequence is orthologous to G558, G578, G629, G1198, G1806
ttaaaaacttgtacagatcaacaagatgcagtaagtagcaacttccagagaagattatatcatggaaaacaagtattgttctcggtgtggctggcacctagtactctctaggacacgctaaccataatgaattaagagctctaagccgtgaaacgtaatcatttatcacaagtagcgcacgagcagcttggaaagtggtcaaaattcgacgcatctgttgcagagtttgttgcctcaataggtcagcctgatgaaggaaattctctagtgtggccagcttgcccagtgcaattgccatttggcccatgtactcagcaacatttccagaaccagagggccctaaagaggaggaagaaagtgtctctgaaagagactgctgcaatgcatccatgccttgtgataatgcatcctcagcctgctgggaagactgctgcagattgtaaatgcccatcaactgctgttcggttaacggctcaagctggtttctaactatcttgagaagttccgaagatcgaaaaccaccgagccatatgaagcatctttctgcaggtgtcttccacatcccagaaagtatgtgaaatacatcagcctttgcccctatgctcttcaacctaaataattcatcataatgtgccatcactccatctacaagaaggtgcagttcattctcatccatttgagaatttatagctgatcttatatcattgatcagccgttgatgctcatcnnnccaacgggcatagtccatgtcaaatgctagggcaccatttccaacagcagaatgactgcgatccccctggtttccagttgcaataaatgcaccctgctg

SEQ ID NO: 6728 - DNA, 873 bp, Glycine max
  Predicted polypeptide sequence is orthologous to G558, G578, G629, G1198, G1806
agttagtaatgtctttctaatataccaaaagagaacgtataaatacatacaccatggagccttatgtgcaaccaaccacaaaccattaagcaggaaatgaaactaaagagaggtaaataccccctcaaataaaagctgatttctgaaatacaatgaacagctataacctaaaaatacagatacactatttctacatttttcccttcaacagcttctatctatcatacacctatataatcaaattattgagactattttaaaaccacaaaagcttaaagaaaaatgttgcaccacaccagcagttggcagagtagaaaaatcatagcatttaatgtttatagcatcacaactaggcttcaagaggaattcattgtcaaaagacaccagcttccattgaactcattcagagcacaagattcaatgatcatcggtgtttaagggagtcaggcatgaaagaagtccactaatggggctgtgaaatgcttcactcccttggcctggcaagccacaaagaactcagcgctctcagccgtgagaaataatcactgatggcaagaagagcacgagccgattgcctggtcgttaatattcgaagcatttgttgtaatgtctgctgccgcagattgtcagcctggtgaagaaacccctcaagtgtaccaagctttcccatggccatagccatttgccccatgtaatttgccacatttcccgaggagcctgatgagctgggcgaaccattagccaatgtctcagatagtgattgctgcaatgcatccatcccttgggaaagagcatcttcagtctgctgggatgattgctgcaagttgtaaatgcccatcaattgttgctcggctaaaggctccaactgactta

SEQ ID NO: 6729 - DNA, 968 bp, Glycine max
  misc_feature (864)..(864): n is a, c, g, or t
  Predicted polypeptide sequence is orthologous to G558, G578, G629, G1198, G1806
ccccccccccccccccccccccggccgtggggcttgatgatcgcctggtaggatcgccgcgcgcaattagtcctcactaaacggaacaaaagctggagctccaccgcggtggcggccgctctagaactagtggatcctccgggctgcagggaaaacacctgctgagaggtgttttttgcggcttggtggctttcgctcatctgaactcctcaagctgctggttagtcaattggagcctctcacagagcagcagctgatgggtattaccaacttgcagcaatcctcccaacaagcagaagatgcattatctcagggcatggaagcattgcaacagtcccttgcagagacattgtccaccggagcacctgcctcatctggttcatcagggaatgtggcaaattacatggctcatatggccatggccatgcgtaagctagggacacttgaaggcttcattcaacaggctgacaatcttcgccaacaaactcttcaacaaatgcaccgtatactgacaactcgccaatcagctcgtgcactccttgctatacatgactacttttcgcgtctgcgtgctctcagttcactctggctagctcgccctagagattgatggacgcgctaaatagtatggcaaattaattatcatggatccatcactagcaatacttgctcatcataactcttgacatgtcttcttgttgttttgctgtcctctctgcatcactgacggtagtgcttcattgagtcagtctatatacgaaatcgatgacatgatgtatgaatattactactaatattgttcattgtaatgatgaaaacaaatagaaacactcgatgtgggcccggtacccacttcgcctatgntgagcgtatacgcgcgctgactggtcgcgctctacacgacggattgcacttccctgcgtacccaacttatcgctgctctcatcctcttcctcatgctgcgaatt

SEQ ID NO: 6730 - DNA, 793 bp, Glycine max
  misc_feature (1)..(2): n is a, c, g, or t
  Predicted polypeptide sequence is orthologous to G558, G578, G629, G1198, G1806
nnaagtgaagtagcacctggacatgcttccgccaagcgcgcaattaaccctcactaaagggaacaaaagctggagctccaccgcggtggcggccgctctagaactagtggatcccccgggctgcaggaattcggcacgaggaagctctcactcaaggtcttgaacagcttcagcagtctcttgttgacaccatcgccggcagtcccgtcgccgacggtgttcaacagatggtggcagccatgggtaagcttggcaaccttgaaggatttgttagtcaggctgataatttgaggcaaataacccttcaccaattatgtcgattgctgacagtccgtcaagcagcacggtgttttcttgtgattggagagtattatggccgtcttagagcccttagttctctttgggcatcaagaccacgagagacattgataagtgatgataactcatgccaaacaaccacggaattgcaaatggttcaatcttctcaaaatcatttctcaagtttctgaaatacatatatatatattgtgtagtaattgaaacccggtgcaagtggatttctttgggctgctttagaaggaatggaaagagtgtcagcgtcatcaaagaattaatatctttttttttttcctttcaatcttctgctcttgtgtctcttatgttttgtataattaaatggaattcgggttttatgtgaatgaccaggaagcttctactttagcctaaaggagtagagaaaattaatgttaaacgaacaatatgacctgccagatgtagatttttttgtacccta

SEQ ID NO: 6731 - DNA, 1774 bp, Glycine max
  Predicted polypeptide sequence is orthologous to G558, G578, G629, G1198, G1806
cgttcttctgcagttctgatagctagccatgttggcatgaagatttaagcgggaaaataataagacaacgtatataacgttttcacaaagtggcttttttttttattatcacaaggagtatgtgttgaatgattattgagttgcagcactgatcagttcttagaacatgaattcagcatccccgcagtttgtttccccgagaagtatgagtgtgtacgacccgatccaccagattagtatgtggggagaaggcttcaaaagtaatggaaatttaagtgcagccatgcctttaattgatgaggcagacatgaagtttgatagtcagtcagaggatgcttctcatggtatactgggagaacctaataagtatgaccaagaagctagcaaacctactgataagatacaaagacgtcttgcacaaaatcgagaggctgctcgtaagagccgattgaggaaaaaggcctatgtgcagcagttagaatcaagtcgtttgaagttgatgcagttggagcaagaacttgaacgtgcaagacagcagggaatgtatataggtggtgggttggattctaatcatctgggttttgctggatcagtaaattcaggaattacaacctttgagatggagtatggacactgggtgaatgagcaaaatagacaaatcacagaactgagaaatgctttaaatgctcatattggtgacgtagagctcaggattttagtagatggtatgatgagccactatgccgaaatgtttcgcatgaaatctgctgctgcaaaagcagatgttttctatgttatgtccggtatgtggaaaacaacagctgaaagattttccctgtggattggaggctttcacccctcggagcttctaaaggttcttggtcccctgattgaacccctgacggagcaacagcgtttgaatatctataaccttggacaatcatgtcagcaagcagaagatgccctttcacaaggtatggacaaactccgccaaacacttgctgatagtgtagcagctgggcagttcatggaaggaacgtatattccacagatgacttctgcaatggagaagttggaagatctggtgagctttgtgaaacaggctgaccatcttcggcaagaaaccttggagcaaatgtctcgaatacttacaatccgtcaggcggctcgatgcttgcttgctttgggggaatatttccaacgcctgagggctttgagctcactgtggtctaatagaccccgggaacctgcttagtctcacaacaagattacaagagcgcaaactcataacatgaacgtgatgtgatgatgaatatgggtcagtttctttggcaaagagcatcaaaaccatgtgtcatgagaggtccaggttgctcacatttttcctgcagttttgcgttatggagaagttgtaaatatgactgctagctcattttatgcatacgggcttgtaaataaattgattttggacgcatggtgtatatcggattgttgcaaaaaatgaaatatttagaatctgccatgagtctgtgtggaagttggtcatgtaaaattcatataatgttatgttgggtgttttggaaaatgaatcaactctagactctcttagtggacgtaatttattttttgtgattgctaagagtagtttattaaaaatatcagttgttattagtttgttagaaagttgttaactctaataggctctatatttagagcattcatacagtcttattgtatctttattcaatcaactacaaaatgattttcttatgat

SEQ ID NO: 6732 - DNA, 817 bp, Glycine max
  Predicted polypeptide sequence is orthologous to G559
cacactcttttagctgcacaacagtttcaacagctacaaattcaccctcaaaagcagcagcagcagcagcagcagcaacaacatcagcatcagtttcagcagcaacatcagcatcagcatcagcagcaccaacaatcaagtgacttgaaaatgagagaaacttcacctactccatgccccaaagacaatacttcgtcagatgtaaatccttctggagccaaggattgttgagagttgagactgctcacattgtcttctctatttgcttcgtagattttcctttgtcttgtgtcttagtgtgtttagcctttgttatattttttcattcttaaacagtacaaatggtcctagttagagattgagaataatacatttgcatctttggtattgtgtaatattaaagttgtttaatactctagttaatttctatggatatataggggtaggttcatgtgtgtttagtttgccttaaaagcagggagatataggtgaaggaaatcgtagaggctgcaaaggaaaagggggttggtatgcccactgtcttcttggatagcaggtcccctaaatgctatagcaggggggggggggcatatcagataaaaatcatgatgttttgggtgggttttgcggtttcagcccaggattgggtcttgggcctggggttggagatagtttgcggaaaggctggtgctaagccccccggggctttcatacttatttatggacagtttgggttgatgcttccgaaggttcagttaggagtgacttatgccctaacggtgggcccttgaaatccaagcttcttgaagaaaaattt

SEQ ID NO: 6733 - DNA, 936 bp, Glycine max
  misc_feature (901)..(901): n is a, c, g, or t
  misc_feature (916)..(916): n is a, c, g, or t
  Predicted polypeptide sequence is orthologous to G559
catttaaactcaaactcatatcactttcatttaaattcaaacacaaactcctgtatatgggaaacagaaaaaatagaaaataaatcctaataacaagaaacaaatcctaataagtaataatagtaaatcctaataaatgatagaatcctcattttaatagaagaaacaaaatttaaaaaaaattaaacaaatcttaataaaatcaatcataaatcctaatgaaatctatctcaaatcaccattagatttacaaataataactaaaaaacttaggcaataaaatcaacaattctacactttattttgagtcttcatataatcatatccttgggcttgcacaagtcgaactacaaccttattagataagaattgccttcacatgaactccttttgcctcttgtatcttttgaacttttcttttgttaacaggtcatcacttggaatcgagtcttttttttccttgagcttggccatgcaatatcctattctgattcatatcacaaacattgagtatacatggtagtagaatacttatgtacaatcaatgtaatcagtaagcagtagctttgccattgtggcgctgagactgagtctgtgtctgctcctgggaatgggtattgtgcacttgaacatgtctaagctggttagggtgctgctgttcctttaactgaaacacttgttggctaatagcaagctgttgagccatgcgacttgagagaagagactctccaccaagttctgaccgtgcatcttaaacgccgcacttcagcatccaaggtctcattcagagcatctttcagttgggactgctgttccaaggcttgaatccttaatttgtactcattattctcacttttaagctctgaattattcatctgtaatttggtaaactgagtagacnatgtggttgtctcantctgaagtgtttgaacttga

SEQ ID NO: 6734 - DNA, 955 bp, Glycine max
  misc_feature (1)..(1): n is a, c, g, or t
  misc_feature (558)..(558): n is a, c, g, or t
  Predicted polypeptide sequence is orthologous to G561, G562
nccgggtgggagattaactactggaagattccgccaagcgcgcaattaaccctcactaaagggaacaaaagctggagctccaccgcggtggcggccgctctagaactagtggatcccccgggctgcaggcactgcaggggctaatcaaacaaaaaggaaaagatgccgagagggaacactgaccactgatggagaagggaaaactgagctacaaaatggtccggcttccaaagagacttcatcttccaaaaagattgtgtcagctactccagctagtgttgccggaacattagttggacctgtagtttcttcagttatggccacaacactggaactgaggaacccttcgactgttgattctaaggcaaattccacaagtgccccacaaccttgtgcaattgtgcctaatgaaacttgcttacagaatgagcgtgagctgaaacgggagaggagaaaacaatctaaccgtgaatctgctagaaggtccaggctgaggaagcaggccgagactgaagaattggcacgaaaagttgatatgttaactgctgagaatgtgtncctgaagtcagaaataattcaactgactgaaggttctgagcagatgaggatggaaaattctgcattgagggaaaactgagaatactcaactggacaaagggagagataatttgagtagcatcgagagtagaaggctgcacctgtagtacagaaacctgtatcagaagtataatttagtctatgacagactacaggaatgagaatgatctggagaacaaccattttgtgcaagctgatactattggatcaatccaaacaaatgctggcagtggttgaccggactggctgggtgattgaatttgaattcaacccaaattcagttgggcaacctttcaaggagagacgaataaattaatcatttgaaacccaatatttttggtgtgtttagaaaaacttt

SEQ ID NO: 6735 - DNA, 928 bp, Glycine max
  misc_feature (19)..(19): n is a, c, g, or t
  misc_feature (26)..(26): n is a, c, g, or t
  misc_feature (96)..(96): n is a, c, g, or t
  misc_feature (101)..(101): n is a, c, g, or t
  misc_feature (788)..(788): n is a, c, g, or t
  Predicted polypeptide sequence is orthologous to G561, G562
cgggggatatatgggaacngaatagnagggacatgtgcgttagtaaacctccctagggaacaaaagctggagctccaccgcggtggctgccgctcnagtcnattggatcccccgggctgcaggaagggggcacgtgtaacaatgcaggctgggactcctttgagcatagagacaccacccaaatcatctggaaatactgatcagggtttaatgaagaaattgaaagagtttgatggacttgcaatgtcaattggcaatggccatgctgaaagtgcagagcgtggaggtgaaaacaggctctcacagagatggagaagggaaaactgagatacaaggcagtccaatttccaaagagactgcagcttctaataagatgttgggagttgtccctgccagtgttgcaggaacaatagttggacatgtagtttcttcaggtatgaccactgcactggagctgagaaatccttccagtgttcattctaaaacaagtgccccacaaccttgtccagtattgcctgcagaagcttgggtacagaatgagcgtgagctgaaacgggagaggcggaaacagtcaaatcgagaatctgctagaaggtccagactaaggaagcaggctgaaactgaagaactggcacgacaagttgaatccttgaatgctgagaatgcaacactgcaatcagatattaatcgactgactgatagttctgataaaatgagggtgtaaatgctacattaatggtattgttcaccatactatttctcattacacatgcattacgttggtactntgtactgctgagtgtcatattgtttttgactcatggaaacacttaacaatgctcaactgggacatactccagagataactttggagattattgacagccagaggcctacactcgtagttcagaaaatttattatatagat

SEQ ID NO: 6736 - DNA, 1626 bp, Glycine max
  Predicted polypeptide sequence is orthologous to G561, G562
gggaaacagtgaggaagagaaatctgttaaaactggaagtccttcttcttcacctgcaacaactgagcagaccaaccaacctaatattcacgtctatcctgattgggctgccatgcagtattatgggccaagagtcaacattccaccatacttcaactcagctgtggcttctggtcatgctccacacccatacatgtgggggccgccacagcctatgatgcaaccttatgggccaccttatgcagcattttattcgcatggaggggtttatactcaccctgcagttgctattgggccacactcacatggtcaaggagttccatcttcacctgctgctgggactccttcaagcgtagaatcaccaaccaaattctctggaaatactaatcagggtttagtgaagaaattgaaagggtttgatgagcttgcaatgtcaataggcaattgcaatgctgagagtgctgagcgaggagctgaaaacaggctgtcacagagtgtggatactgagggttccagcgacggaagtgatggcaacactgcaggggctaatcaaacaaaaaggaaaagaagccgagaaggaacaccgatcactgatgcagaagggaaaactgagctacaaaatggtccggcttccaaagagactgcatcttccaaaaagattgtgtcagctaccccagctagtgttgcaggaacattagttggacctgtagtttcttcaggtatggccacagcactggagctgaggaacccttcgactgttcattctaaggcaaattccacaagtgccgcacaaccttgtgcagttgtgcgtaatgaaacttggttacagaatgagcgtgagctgaaacgggagaggagaaaacaatctaaccgtgaatctgctagaaggtccaggctgaggaagcaggccgagactgaagaattggcacgaaaagttgagatgttaactgctgagaatgtgtctctgaagtcagaaataactcgactgactgaaggttctgagcagatgaggatggaaaattctgcattgagggaaaaactgataaatactcaactgggcccaagggaagagataactttgagcagcattgacagcaagagggctgcacctgtaagtacagaaaacttgttatcaagagttaacaattccggagctaatgatagacctgcagagaatgagaatgatatctgcgagaccaaaccaaattctggtgcaaagctgcatcaactactggatacaaatcctagagctaatgctgtagcagctggttgaaaccagtaactgcactggctaattatgtaattttggcatattacaagcccaaaattacagcttggtgctaacagttttcagagggatggatcagctgaattttacaatctaattccatctatatagaccagaactaattctttgcttgtgagtttcttagggcataaactctgtattttactagatttcacagaattgaatgacaactttaaaagtttgtaaattgaagagtattagggatttagtttagactttaagagaggcttgtcggccgctgtataattggttgtgtattaactatattggtgtgatcttcctaatggtatcttagtcaaggcattctgactttgggt

SEQ ID NO: 6737 - DNA, 1086 bp, Glycine max
  misc_feature (1)..(2): n is a, c, g, or t
  misc_feature (589)..(589): n is a, c, g, or t
  misc_feature (595)..(595): n is a, c, g, or t
  misc_feature (598)..(598): n is a, c, g, or t
  misc_feature (619)..(619): n is a, c, g, or t
  misc_feature (711)..(711): n is a, c, g, or t
  misc_feature (989)..(990): n is a, c, g, or t
  misc_feature (1001)..(1001): n is a, c, g, or t
  misc_feature (1037)..(1037): n is a, c, g, or t
  misc_feature (1046)..(1046): n is a, c, g, or t
  misc_feature (1049)..(1049): n is a, c, g, or t
  misc_feature (1079)..(1079): n is a, c, g, or t
  misc_feature (1082)..(1084): n is a, c, g, or t
  misc_feature (1086)..(1086): n is a, c, g, or t
  Predicted polypeptide sequence is orthologous to G584, G1136
nnccgattaacgtcgatttcaatgcattacgcaagcgcgcaattaaccctcactaaagggaacaaaagctggagctccaccgcggtggcggccgctctagaactagtggatcccccgggctgcaggaattcggcacgaggtttctcggagcagcattgacgatggaatgctttccttcacttccctgccggctgcaaatataaaatcagttaacggtgcttgtgtcggtgccggtgattcggatcactcggatctggaagcttccgtggcgaaacaggtggtggagcccgagaaacggccccggaagagagggcgaaagccggctaacggaagagaggaaccactaaatcatgtggaagccgagagacagaggagagaaaagctgaaccaaagattctatgctctacgagctgtagttccaaatgtatccaagatggacaaggcatcgctgttgggggacgccatattgtacattaacgagttgaaatcgaagctcaacgtgctggattcagagaaaacggaattggagaagcaattggattcaaccaagaaggaactcgagctcgcaactaaaaaccctcctcaccgncaccgncgncaccaccaccaggaaccgctncatctaatagcgtagaaccaaagaagacccacagcaagctcgctgatttggagttagaggtgagatcattggtggggatgcatggtagaatncatgcagcaagaagaacaccctgcaggcaggtgatggcgcatttgaagatctgccttgaatgcataccccagcgtgctgtgtgatggattatatcaccagcccgtgacatggaacagtttaccgcagaccgctctgcgacttaatcaaagtgcagacctcgtgttcttcgccttatggagatactgacttcttgaatggtcttatttgtagccttgggccgccaaaaaattatggaatggttggagcagccaccggtggttttttgaacaaaaaaaanncaaaaaaaaanagaaaagataaagaaagtaaaaatctgggcgccccnctttttggntgngccgcctggtttagggggaacctccaattngannncn

SEQ ID NO: 6738 - DNA, 939 bp, Glycine max
  misc_feature (76)..(76): n is a, c, g, or t
  misc_feature (597)..(597): n is a, c, g, or t
  Predicted polypeptide sequence is orthologous to G584, G1136
cgccaaggggctgacgcactgcgcggcgcatttgattcctcactacagggaacaaaagctggagctccaccgcggnggcggccgctctagaactagtggattccccgggctgcaggaattcggcacgaggagaagctgaaccagaggttctacgcgcttcgtgctgtggttcccaacgtgtcaaagatggacaaagcgtcactcctgggcgacgccatatcttacatcacggagctgaagtccaagcttcagaccctcgaatcagataaagatggaatgcagaagcagctggaaggtgtgaagaaggagctcgagaaaacaaccgagaacggttcttctaatcacgcgggtaatagtagtagttgtaacaacaacaacaagttgtcgaatcagaagttaattgacgtgttggagatggacgtgaagatacttgggtgggacgcgatgataaggatccattgcagcaagaagaaccaccccggggcgaggttgttgacggcattgatggagttggacttggacgtgcaccacgccaacgtagatttggtcaacgatatgaccatgctacaagcaacggtgaagatgggaagtaggttntacacgcacgagcagctacgtgcagctcttgcagctaaggatggcgatgcacgatgatgttagctctgcactatgacggcacagatagagattatgtgtgtgattgtgtcagtgtattagctagctagctcattgtacgttggctgctctggcatatttcaagcactccgggtagctgatctagcaaaatatacgctatattgcttgatgggtgacgtagtaatgaatatgagtgatcacgatggcagctccatgagtagtacactagctaggtaactatcataccatactgtggtgaatgacatagcaccagccttattggaaatcgcgtcatctatcgct

SEQ ID NO: 6739 - DNA, 884 bp, Glycine max
  misc_feature (35)..(35): n is a, c, g, or t
  misc_feature (792)..(794): n is a, c, g, or t
  Predicted polypeptide sequence is orthologous to G591, G793
tctttacaaggtaactaaccatattttaattcaanttgtattaaagttttctcccgatacatcatgcgtacccatcctttccttttaaatggtcccacttcccactgactaaaaataaaaaaactttggaaagagcttccactacaaatattttggtcttccaccaccaaccccacctacagatatttggaagaaaaaacatcaattaggccattgaaaatattgatcttcaccatgaaaaaagacatttgctgggctcctccgattttacttaataggaataacaattactccttgtttgacaaaacttgagaagagtgaaccagctgcaccgactagatccttctccctccaatcaggaaaattatacaagaaagtagaatacccttgtcataaaggatgaagaaatttaattatgtaatgtctgtcatgatactttaattttgtttcggttctatcactaatatcagtgactgttagattcaggtttgatgcctgttgatgcttccgattgaggcatgcggaaaatggatgaggctagagatattggcatgatacaaagtgccttggactgaagaaattgcatagctgctccaacatcttcttccataagcttagccacctgttgttctgtgccatcattggaccacttgtcccaggcttgctcattggatacaccttctatgtcctgatccccctccactgcagaaaggggaacatcagcaacaagctgagcaactgcaccagctcctcccagtctactcatgctcaggaccttaacctggagccttnnnaacttcacatagtcaacaatttcatcaagcatcgccgctctgtccgtcttattgatgctgggaactaattcctgcaatgccttcattctt

SEQ ID NO: 6740 - DNA, 902 bp, Glycine max
  misc_feature (1)..(1): n is a, c, g, or t
  misc_feature (626)..(626): n is a, c, g, or t
  misc_feature (644)..(644): n is a, c, g, or t
  misc_feature (673)..(673): n is a, c, g, or t
  misc_feature (696)..(696): n is a, c, g, or t
  misc_feature (698)..(698): n is a, c, g, or t
  misc_feature (736)..(738): n is a, c, g, or t
  misc_feature (776)..(776): n is a, c, g, or t
  misc_feature (797)..(797): n is a, c, g, or t
  misc_feature (822)..(822): n is a, c, g, or t
  misc_feature (831)..(831): n is a, c, g, or t
  Predicted polypeptide sequence is orthologous to G591, G793
nggtggacaggcggatcgtgattaccccaatatgcacccattgctcactacagggaacaaaagctggagctccaccgcggtggcggccgctctagaactagtggatcccccgggctgcagggttttgagcatgagtagattgggtggagctggtgcagtggcaccactggtaactgatatcccattatcgtcagtcgaggaagaaggcggtgagggaagaaaccagccagcctgggagaagtggtcaaatgatggcacagaaagacaggtagccaagcttatggaagaaaatgtgggtgctgccatgcagtttcttcaatcaaaagcactctgcatcatgcccgtctcactagcttcagcaatataccagtcacaaccctcaggcacttctagtatagttaagcctgaaactaatcctccttcataatcatagtcagaactctggcacagatgcaccatccagtggtcccatcaagggctcacctaacactgctaggacccacgtgtaatttgcctgtttcaaacccccttaaccttagtcattggttcgcatcaagttgcattcaaggttggatgccatagtctttcctttttgcgttctttcaactttttgtctagacagggtntgtgtcaatgcccttcanaacacaagcaaaccccatcttgataaatntcatgtaaagggaaagaaatagngntaggtacttgatatgctctttccctttgtatcaattannngggggggtttaggacgtgatgaagcgctttttaatagnggggggcttggggttatgagnggcagtggacccttcttaaagggtnatggggggnggggtgataatttattaaaaagtgactctttaagggaattgaaattggcgagctggaaatgggatatggat

SEQ ID NO: 6741 - DNA, 777 bp, Glycine max
  misc_feature (32)..(34): n is a, c, g, or t
  misc_feature (720)..(722): n is a, c, g, or t
  misc_feature (727)..(729): n is a, c, g, or t
  Predicted polypeptide sequence is orthologous to G592
tgggaagtctttgataagtttaggagcacggnnnaaaataagctaaaattaattcattagaatttttgtatacaaaattatgatttattgtctgtgtggctggaactcccgttaactcaaaatacacaatgtggcatgaagagttaaaagctggcattctgcatattaactttgttctattgatttttcagcacgtcaaaatataaaacccgggtcctattcatgtttggcgtagttcctttttattacctgtacaaaagaaactcaagcaacttgatctgcttctgacttctgcatgtttatacatttgcatttagcccgtttatcgttcagagtcttgaattctttctgaagatcttttatgtagtctacagccaagtccaacatctctgctgtgctagtttgcttgtccatgtttggaacaagctcttgcaattttcttattcgttcactgatccgacttcttctcaccctttcggcaatgcttcgaggatgtgtagcaaagcctctcttagctctgattttacaaggaacagaatctgaaaactgaagcaaactatccatagcaaacatatccgacgacgttcttggcaaactcaaatgatgcgaaagtgtttgaacttgatttcctagttctccatcctgagaatcagaaagtaactcatcattactacttcgctgtcttttgtggtgtgaaggctcattccaagaagcataggnnnatccnnngccaaaatatcgagcatcaccattgctccctccctgcctcccatcctc

SEQ ID NO: 6742 - DNA, 931 bp, Glycine max
  misc_feature (888)..(888): n is a, c, g, or t
  misc_feature (916)..(916): n is a, c, g, or t
  misc_feature (920)..(920): n is a, c, g, or t
  Predicted polypeptide sequence is orthologous to G592
agtaaaaattttaaatttttattattgttataaatagtttctttgcacgattgaattatttcttttaactatccttagcactcatccaaatatgtaaagagaactttctctactttctctcctatttctatcaatccaaaatccaaataacacatcttcctcaccttatttctactctatttctcatcctcctatttctggtaatagcatcctatattagcatctttctttctacttgttcagcattaaagttaaaagcacccgatccaagccatctttgctatgtatcgctcataaagaaaggtggtcaagcaatttgatttgtatctgccttttgcatgcttgtacactcgcattttgcccgtttttcacttagagtcttgaattgtttctgaagatctttaatgtattcaacagccaagtccaacatgtctgctgtgttggtttgcttgtccatgtttgggacaagctcttgtaattttctcattctttcactgatccgagttcttctcaccctctcagcaatgcttcgaggatgagtagcacagcctcgctttgctctgattttacaaggaacagaatcagggaactgaagcaacttcttcatagtaatcatctctgctgaagtttttggtaaactcaagtggtgtgataacatattaacttggtttcctagctctccattctgaatttcatcagaaaacatcttttcattgctacttcttcctcttttcaagccactgagattttctgagagttgtggagtatcattccaagaaccataggggaatccagggccatattgttgagtatcattaccttcatgccttgtatcatcatcaggactagttgcctcaatgtcttcattccctatttcggagatctgcngacacattccgagcgaagaagcatttcntggntgagaagctac

SEQ ID NO: 6743 - DNA, 965 bp, Glycine max
  Predicted polypeptide sequence is orthologous to G592
aaaaccaacaaattcggtcccccatgtttcccatgtcattgaatgtgaaaccaaacccaataacccatacataacatccttttttaaaacgttattgttgaacattgaagaagcaaaaatgaaaatttccattttccacctcaccccatcctccatccccgaaaatgggggcccctaaagattaaaggcaaatagacttgtaatatatcagaaaattttgtacaccatgctttgaatatgtggcatcaaattttgattttgatgatatataaagtcaacttttataagctgattttcccacaaccactcccaaacaaccgctgaagatgtggctacataattatcggaaaggtgcactagtttctagaccaaattattactaagctgtacacgtaatgacgcgggtatcctcctccttttgcgttattgctgcttcttgtgtgaacacgtacactttgcccgattgtccgaaagagtctgaacttggttttgaaggtctttaatgtactcaacagccaagtccaacatgtcagctgtgtttgtttgcttatccatgttgggaacgagatcttgtagcttcctcattcgctcactaattttagttcttctaaccctctctgcaatgcttcttgggtgagtggcacagccccgtttggcacgaattttgcaaggaacagaatctgagagctgcagaaacttctcaatggctgccatttctgcagaagtatttggcaaactcaattgatgagccaaagcagaagaagaaggttgttggcctccagtttcattctgactttcaggtgcatttaaaccaccagaaaatggtttcacatcttcatctctaaatctcttcagacctgtcacgttgtcagacatgattgcagaatcattccacggaccaacggggaaacctgcagggataaactcattgccctggctttcagcaaacccctcattttctgcat

SEQ ID NO: 6744 - DNA, 985 bp, Glycine max
  misc_feature (8)..(8): n is a, c, g, or t
  misc_feature (17)..(17): n is a, c, g, or t
  misc_feature (79)..(79): n is a, c, g, or t
  misc_feature (146)..(146): n is a, c, g, or t
  misc_feature (674)..(674): n is a, c, g, or t
  misc_feature (852)..(852): n is a, c, g, or t
  misc_feature (985)..(985): n is a, c, g, or t
  Predicted polypeptide sequence is orthologous to G592
cacccccnccccacccncccccccggacacaaacaaattaggatcaactcatacaggcgacgggcgcgaataattgtgnctacccgcaacaaaagcttgacctccaccgccgaggcggacgctctagaactagtggttttttcgcnctgcaggctcggaatggatccgtgggacaacaattccatcgccttttctgcaacttcaaccaagcgctccaaaaccaacaccaatgatcctgacattttacattccctgaattcggcctcggaatcacaggtcaatcttccacatacaagtctggaaatgtcaaccgtggacaagctattgcacattcctgaagattctgtcccttgtaaaatccgcgctaagcgaggatgtgctactcatccccgtagcattgcccgaggggagagaagaacaaggaaccagggccaacctcaagaaataacaggaccttgtacccaatatggataagcaaacaagctatgcacacatgctcgatttggccgttcaacacattaaaggtcttcaaactcaggctcagaagcttcacacagaaatggagaatcgcactcgcggatgcaaacaaagcaaataacctctttgttttacgagattctatagcaacgcgcatagaactcaaggacttgatggcacagattgaaaactgactntgcaccgatctacttagatgaataatgacggaactgaaactttgtaagctgtccatgctacaactgtacagcgcatgtcggcatatcgtacgctcagagaatctcctcgcttccttcagcactcggcgttcacaaacaagacacaatactcgagggggggctcggtactcatttcggnctatagtgacgtcgattacgcgcgctcgactgccgctgtctacacgtcgggactgtgaaactctgccgtacccaactaatcgccttgcgtcatcctcctttctcagttgggtataacgagaggccgcaccgcn

SEQ ID NO: 6745 - DNA, 819 bp, Glycine max
  misc_feature (1)..(2): n is a, c, g, or t
  misc_feature (609)..(609): n is a, c, g, or t
  misc_feature (626)..(626): n is a, c, g, or t
  misc_feature (634)..(634): n is a, c, g, or t
  misc_feature (644)..(644): n is a, c, g, or t
  misc_feature (816)..(816): n is a, c, g, or t
  misc_feature (819)..(819): n is a, c, g, or t
  Predicted polypeptide sequence is orthologous to G592
nnaaggatgacgtctgatgcatcacgccaagcgcgcaattaaccctcactaaagggaacaaaagctggagctccaccgcggtggcggccgctctagaactagtggatcccccgggctgcaggaattcggcacgaggaactactctgcttctcataatttctaccaaagctcctcctccaaacctcccttgccgaaccagaacccgaaccttccctcagctatggagcaaggatcgttttcaatgggactcaggcatagtggaaataattctaaccttaccaggcatagtagctctcccgcaggactattttcccaaattaacattgaaaatgtgtatgctggtgtgagaggcatggggagtttgggagctgttaacaacagtatcgaagatgcgaaattttctagttcgaggaggttgaagaatcaaccgaactattcttcgtcggggagaatgtcgtccattgctgaaattggggacaaagggtatagagaaagtagtccagacagtgaagcttttgctgatggtaacgattttatggccggtttccaagttggtcattgggatgatactgcaatgatgtctgacaacgttggtggtctcaaaagatntagtgaagaagattcanaaccattntctggcttanatgcggttgagactcagaatgaaacgggacagactcatgctcctttggcccatccagtgagttgcccaatacttcagctgaaatggtggcatttgaaaggttctgcagtttcagattctggtcgtgcaaaatcgggccaaactggctgtgccctcaccccaaaaccttgccnaan

SEQ ID NO: 6746 - DNA, 793 bp, Glycine max
  misc_feature (3)..(5): n is a, c, g, or t
  misc_feature (23)..(25): n is a, c, g, or t
  misc_feature (729)..(731): n is a, c, g, or t
  misc_feature (734)..(736): n is a, c, g, or t
  misc_feature (743)..(745): n is a, c, g, or t
  misc_feature (753)..(755): n is a, c, g, or t
  misc_feature (779)..(781): n is a, c, g, or t
  Predicted polypeptide sequence is orthologous to G592
ttnnncctctttattacattgtnnnacttaaatcaagcaaaggaaagaaagaaaaaacaaatgagggaaaatgaaaaacaaaactgaagagactcacacggacctggacctaaattcttagatactagcaaatatcagcgctactctacataatcacactgaccaaaaattttggtacaccaaaggataaatacatgaaaagaaaaaaaaatgctccttctttttgttatctacaaggatatataaatcagtgcttctgattgcttgtacaagtgcattttgccctagtatctctgagaatcttaacttgtttctgcaagtctttaatgtactcaactgccaaatccaacatatctgcagtgcttgtttgcttgtctgattttgggaaaaggtcttgcaatttcttgattcttgcgctaattcgtgttctcctttccctttcagcaatacttctcgggtgagtggcaaaacctctcttggcacgaattttacatggaacagatccttgaatttgataaagcttctccattgtagccatcctactggaagagccaggcagactcaaatggtgggtcaaaccaactttttggtatccaaaatcttcatcctgaatatccatagcctttgaagtggaaaatgagatttcacctctgttactagctgttctggaggcactgaatgcagaaccatcccagaagtcagtggtgaaactaggcatgtaacatttannngtnnngatattnnnatttctcnnntttctactttcaacacaatttgcnnncacatcttcatt

SEQ ID NO: 6747 - DNA, 975 bp, Glycine max
  misc_feature (1)..(2): n is a, c, g, or t
  misc_feature (440)..(440): n is a, c, g, or t
  misc_feature (671)..(671): n is a, c, g, or t
  misc_feature (717)..(717): n is a, c, g, or t
  misc_feature (730)..(730): n is a, c, g, or t
  misc_feature (738)..(738): n is a, c, g, or t
  misc_feature (759)..(760): n is a, c, g, or t
  misc_feature (766)..(767): n is a, c, g, or t
  misc_feature (770)..(770): n is a, c, g, or t
  misc_feature (811)..(811): n is a, c, g, or t
  misc_feature (829)..(829): n is a, c, g, or t
  misc_feature (841)..(841): n is a, c, g, or t
  misc_feature (845)..(859): n is a, c, g, or t
  misc_feature (896)..(896): n is a, c, g, or t
  misc_feature (975)..(975): n is a, c, g, or t
  Predicted polypeptide sequence is orthologous to G597
nngggagccctagggatctgctgcatcttctaccttcactattgggaacaaaagctggagctccaccgcggtggcggccgctctagaactagtggatcccccgggctgcaggaattcggcaccaggtgtccttgtcagggccagatggccgtgtcttgggcggtggagttgcaggtcttttggtagctgcttcccctgttcagattgttttggcaagctttgtttctgatgtacgcaagcacttcaagcatgcaaagcagatgcagaatgcaaaggtttccatagcagcaggccaaagcagctcaccatcaagaggcactctcagtgagtcttcaggtggggttgggagtgggagcccactaaaccaaagcacaggagcctgcaacaacaccatgaacaactgtaccaccccaacacaaagctttcaaggcatgccctgnaagtagaacttgactcacctcacatgtttgtgtagtaggtttggtgtggtgaaagacacatcaggctctacttgttatgctattactttgtgtcttttatcctttaagcattgaggatgcacacctgttatattagctttatgtaatattagttggaggaacaacatttcagggataaagtacttggtctcgtagcttagtttggttagatatttgtgtcacttgggtganttcagaggttctggcagaagaccggttgtgttctaggagcatgcangatcattatgatngagaggcngtgactttgtcattcgttagnntgtatnntgntggtgtcatgtgccgaaactttctctttgtacccagttgtntgtgtaaaaaaaaaaaanaaaaaaaaaaanaaannnnnnnnnnnnnnnaaaaaaaaaaaaaaaattaggggggcggttcccatcncctattgtatgattacgcgcttatgccgggtttacagttggactggaaaactgcttaccaattaatcctgtggcaatcn

SEQ ID NO: 6748 - DNA, 839 bp, Glycine max
  misc_feature (65)..(65): n is a, c, g, or t
  misc_feature (70)..(70): n is a, c, g, or t
  misc_feature (80)..(81): n is a, c, g, or t
  Predicted polypeptide sequence is orthologous to G597
gggggaaggggaggggggttgcgtctgtccctcgcgggtgggggggggggggggggggggaaaanccccnaacttgggcnnacatctcattctggggaccgtcacgtgagggaacaaaagctggagctccaccgcagaggcggccgctctagaactagtggatcccccaggctgcaggagttcggcacgagggtgaagcgcaggggcagacctggtggttctgtcaacaaaaataagaagaatgatacctctaactcctctaagtattctgggccaggatcttggtttactccgcatgtcattaccgtgaacgctggagaggatttgtcagcaagaattatgacaatttcccagagtagttcaagaaatatttgcatcttaacagcaaatggagccatatctaatgtgacacttcgacaacctgcctcatctggtggaactgtgacttatgaggggcgattcgagatcctatcacttggaggttctttttttcttgctggaactgaaagagctggggggctgagtgtgtccttgtcagggccagatggccgtgtgttgggcggcggagttgcaggtcttctgatagctgcttcccctgttgagattgtgttggcgagctttgtttctgatgttcgcaagcacttgaagcgtgcaaagaagacggagaatgaaaaggttgcgacagcacgacgccaaagcagctcaccatcaagacgcactctcagcgagtcctcaagtggtgctcggagtgggagccactttactaatctccagactggctacatcgtcatgataatctggctcccctcacatacactttcccgctcgcctgggagagg

SEQ ID NO: 6749 - DNA, 963 bp, Glycine max
  misc_feature (17)..(17): n is a, c, g, or t
  misc_feature (782)..(782): n is a, c, g, or t
  misc_feature (852)..(857): n is a, c, g, or t
  misc_feature (859)..(859): n is a, c, g, or t
  Predicted polypeptide sequence is orthologous to G602
agactacctagtttcgnctgcacgcacttaaccctcactaaagggaacaaaagctggagctccaccgcggtggcggccgctctagaactagtggatcccccgggctgcaggtctcaattcaactttccatcaaggcaacggcaatggcagagctgcaatcgaagtctgaaactgcccctgctccggctccggttgtggctgaggtgccatcgaacgacgccgttgcaaagaaagcttctgaaacaggggaatccaaagctattgtttctgtatccgagaagacaccagttcctgcaaacaagcaaagctcaagaggatccattgatagagatatcgctctggctgaagtagagaaagagaaaaagttgtcctatgtgaaggcatgggaagaaagtgagaaggccaaagcagagaacagagctcaaaaacatctctcagctatcgctgcttgggaaaacagcaaaaaggcagctcttgaagctgagcttaaaaaattggaggaacaactggagaaaaagaaagcagaatatggtgaaaaaatgaagaacaaggtggccttagttcacaaggaagcagaggagaagagggcaatgattgaagcccagcgtggtgaagagattctgcagacagaggaaatggctgcaaaataccgagcaacaggaaccactccaaagaagactataggatgcttttgattttttttgcatttggggtctgagtccaaaataatttctaattgcccaattttgtaatgtgtttctccctgtttgttcctaaatgtntgtggctatggcaaaaatagtccaataaaaacatattttttaaaaaaaaaaaaaaaaaaaaaaaaaaaannnnnntnccactaggaggcgtccaatcccccctttaagagtcatccccctccatgggcgcgttttaaagcggaatggaaaaactgcgtaccaataatgcttgagaaatcct

SEQ ID NO: 6750 - DNA, 805 bp, Glycine max
  misc_feature (585)..(585): n is a, c, g, or t
  misc_feature (631)..(632): n is a, c, g, or t
  misc_feature (644)..(644): n is a, c, g, or t
  misc_feature (652)..(652): n is a, c, g, or t
  misc_feature (678)..(678): n is a, c, g, or t
  misc_feature (805)..(805): n is a, c, g, or t
  Predicted polypeptide sequence is orthologous to G602
cgacttgatacgccaagctctaatacgactcactatagggaaagctggtacgcctgcaggtaccggtccggaattcccgggtcgacccacgcgtccgaaacaaaattgctgcaatccacaaggaagctgaagaaagaagagcaataattgaggcaaagaaaggggaagatcttcttaaggcagaggaacaagctgcaaagtatagagcaactggaacagctccaaagaaactccttggttgtttctaatgcttcaaatctcaagcattgtggggaaagaaaaagttattttttattgtgtatctttggttattaaatatcattaataccaagtgtggttttagtttacatgttggagatttagcccatgttcatttattatgtgtgcaaacctgacacattggcgtgtatataccaactactttgtggataaagaaattaaattattcaatctgtgcattagttacttgttgcctgaagtcattgaccaacttcagtctctctgaactagttagaaataaataaataactgaatattagagagagagagaaaaaaaagaggaaaaaagaaagaaaaagggggggnggaagaaaagaaacaagagaaggacgcgggcgagggaggggagagnngggggagggggnacaaaaanaagggcgcggccgcggagcacaacgncgggaccgggacagcgcggcaaacgacaggtatgggagagcggaaacacacagccgcgcgcgcgagagaggaagaggcggaacggaccgccaaacaacagtcgcgcgcgggaagacaaagggacggn

SEQ ID NO: 6751 - DNA, 857 bp, Glycine max
  misc_feature (309)..(309): n is a, c, g, or t
  misc_feature (616)..(616): n is a, c, g, or t
  misc_feature (732)..(732): n is a, c, g, or t
  misc_feature (752)..(753): n is a, c, g, or t
  misc_feature (832)..(832): n is a, c, g, or t
  Predicted polypeptide sequence is orthologous to G605, G1944
atacattacgccagcgtcaattaaccctactaaagggaacaaaagctggagctccaccgcggtggcggccgctctagaactagtggatcccccgggctgcaggatccggtggcatgagtgtatctttggcaagccctgatggacgtgttgtaggtggtggagtagctggtctgttggtggctgcaagtcctgtgcaggtagtggtaggaagttttctggcaggaaaccagcatgagcagaagccaagaaaacagagacatgaggttataacaagtgtgataccagctgcagttgttccaatctctaccnttgatcccagtgccaattctatcagccagcgtcttccatccgaaacgataatttggtcttgctattgccagcagaggcgcaagaataagccagctgactttaaaccgtgttcgttctgtcggggtaatttatatattagatcttaatttcatctggattttactttacatggtgcaccatgtaatgtgaatgggtaccctaaatgtggcttgttttcccctggttgggggggggcggaaaatggtggactttctaaccggcccaaatgttttcaaaaggtttacccactctgctcttgttgaaaatnagggtgggggtaaaagaatcgttttatgccgggtggttgtgagcatgacaaaactcttgtggggtatgttttctttgaaaatccttctttcctttggggggttaaaaaaaaaaaanaaaaaaaaaaaaaaaaatanntctcgggggggcgccccccccctatttcccccttaaggatgtgtttcacccgcctctccttgggcgggttttaaaactntgtgaattggaaacaaccttgtttc

SEQ ID NO: 6752 - DNA, 788 bp, Glycine max
  misc_feature (3)..(3): n is a, c, g, or t
  misc_feature (45)..(45): n is a, c, g, or t
  misc_feature (547)..(547): n is a, c, g, or t
  Predicted polypeptide sequence is orthologous to G605, G1944
canaccccccccccccccccccccccccccccccccccggtgtgnaatcagacggctgacactcatcacgccaagctctaatacgactcactatagggaaagctggtacgcctgcaggtaccggtccggaattcccgggtgggtcagtcactatggcattgtcaccaatgccaatttcgtcgtcggctccgccttctaatgacttttcctccgggaagcgggggaaaatgcgggggatggactataagccatcaaaaaaagttggtttggattatctaggtgacttgaatgcatgctctgatggtacaaattttatgccgcatatcatcactgtcaatgctggcgaggacatcacgatgaaggtgatatccttttctcaacaaggaccacgagctatatgtatcttatctgctaatggtgtgatttcaaatgttacacttcgtcagcctgattcttctgggggtactttaacttatgagggccgttttgagatactttccttgtctggatcattcatgcctactgataaccaaggaacaagaagcangactggtggaatgtcggtctcgttggctagccctgatggccgtgttgtaggtggcggagttgctggtcttcttgtagctgccagccactgtgcagtggtggtggggagcttattaccatgccgccagcaagaacatacaatagaagatgcaagatctagcgagagtgcgcaggcacatcaactacacacattgcagtgcttcatcactcgcgcctgcaaccaatgcggagactacgatgtg

SEQ ID NO: 6753 - DNA, 776 bp, Glycine max
  misc_feature (7)..(7): n is a, c, g, or t
  misc_feature (741)..(741): n is a, c, g, or t
  Predicted polypeptide sequence is orthologous to G605, G1944
gagtggngttgattgcctgtcgaagattacgccaagctctaatacgactcactatagggaaagctggtacgcctgcaggtaccggtccggaattcccgggtcgatccacgcgtccggggaactgaaaagaaatcttaatacaagattacaccttcagaagagtcttgctgaagtgtgtgcatggacaggtcatgatctttgtattctgaacagtattcagagtttgatgttgattgtgtagacttaggagtgaatagtttgatatatgcatggaaggaagagaagggataagttctggggttacagtgataggagcagaagctccatcagcctatcacatggcaccaaggagtgaagctccaagccaagttcctccacctgttcctgaagcaacagctggagctattggtgtctcaccagcgagtgtgggattggatggaacagcagctaagaagaaaaggggtagaccaaggaaatatgggccagatgggttgaactctatggcattgtcacccattccaatctcatcttcagctccatttgctaatgaattctcatccgggaagcagcgggggaaaccgcgagcgatggagtacaagctgccgaagaaagttggagtggatcttttggtgattctgttgtacaaactttatgccccatatcattgcggtcaatactggcgaggacattacaatgaaagttatatctttttcccaaacaggaccccgtgctatatgcatnctatctgcttatggtggtatttcgaatgttacact

SEQ ID NO: 6754 - DNA, 622 bp, Glycine max
  misc_feature (9)..(9): n is a, c, g, or t
  misc_feature (52)..(52): n is a, c, g, or t
  Predicted polypeptide sequence is orthologous to G605, G1944
cagctctgnaccatgcatacgccaagcgcgcaattaaccctcactatagggnaacaaaagctggagctccaccgcggtggcggccgctctagaactagtggatcccccgggctgcaggaattcggcacgaggaagtggtggactcactgttgttcctgacgatgctcctcctactagtgcttttgcttattcggcacgaaacaacaacaacgttgctcctccacctcctgttagggtggtgaaggttgaaggtcagagtggtatggagcttcagcttgctcctcctcctggatgggaaaaattaactgctggaggtggagctgttaaaatcaaattggagcctgtagctagctagggtcttaatctcttatcaagggtccagtagttttagtactctgtttaattgttattcatagggtcagattcaatcttcaattgtgtttatggaccacttatacggtctatagtgcttaattaattgggtcttgtcttcattgttcgccttctctcgttgaataaatactggattttatcttcgaaaaaaaaaaaaaaaaaactcgagggggggcccggtacccaattcgccctatagggagtcgtattacgcgccctcactggccgg

SEQ ID NO: 6755 - DNA, 794 bp, Glycine max
  Predicted polypeptide sequence is orthologous to G611
cagggatgcatttcaattttattttacacactaacagaaaagatctgacaaggaaaaagaaacggtgaaagcaaccaataatggtttactaagctataccaaccgaagtatataatcttctgattctataaattgtcttttctcctcttcatcgtccatagtttcctcttcactgtcactgcaaataagtgcttctccaccattctgatcataataaattcgtctccggcctacaactgactgatcctcggtcattctttgatttctgtccaaaaaaatccatgtagtgtaaggaggcaatttttttacttcaggtaacttgataggacgaacagcattctttacagcaacattagaccctagaagaactgctgtggaaccatggctatcgtcatgatagccattgctctccacatcaccattactcgcatgaacaccgttgtgcatatcaattgcatctttttgccactttgtaagtaggtccagacttctattcgtatcagtaatgctgaagttccttctctccattgacattgtgcagacatggttagtgacaccaaccagcttctgtctgttttcctctattcttttctgatatccaaatgcacatcatgaggggaaaaaaaagtccaataaaaataaaaaacgaactacagccataagttcatctattacacctttacagaaacaacccgttctgcagcaacttgtttcttcaaagaatcaataaccagtaacacatctttaccagcgggacttggatcctccactttatttgaggagagatcaacgag

SEQ ID NO: 6756 - DNA, 880 bp, Glycine max
  Predicted polypeptide sequence is orthologous to G611
agaaaacaaaataacctaattgcatattcaaaaaccaaggaacttaattaagtatttaaattaaactaagaaaccaaattgaataccaagccatttaataataacttggatgtctcacaatcacataatgaagagcaaaaccaagtttgaacagaacaagttcgccgaaatgtcacgcctagcatccgaaacgaactgctaggtttgtttctactagcttgttgccgctaacattaatttgcttcatgcctgcttctcttgcctatttaaaggcacattagcatcagcaaaccactaattatctccttttgtgaccgttgatcttgaatctatcccatgggatatcacaaatttgtttatgcataggatatataatgtagaagccaaaaatttgtatgcgctagactttggcccaggctcatcaatgagactggtgtttcttagccctgccttgaggagctgttgattcgtctctcttagaaccctcaggtttacgtgcccatggtggtgcttgatcgggaccataacgataatcatagaagagctcctcactagcatcgatgtgttccttggcaaatatgcctactcggtgatctccagcaaccagcatcacctttgcatagcaattggggtttgatgagtggtttgcaaatttcaacttgtctcctttgcgataagcatcaagaacgtactgatcattcaagtcaaaaagaaaagatgagttggcgcgatcgtatattttcccacgcttatcggcttctcggtgggagatcagttctcctgtgtactctcctaagtaatcatttttgttaaccgggttcttcaagaaggctccccatcctgcaacatcagactttgccaagagaatcccgacagcaac

SEQ ID NO: 6757 - DNA, 857 bp, Glycine max
  misc_feature (1)..(2): n is a, c, g, or t
  misc_feature (20)..(20): n is a, c, g, or t
  Predicted polypeptide sequence is orthologous to G611
nntttagtgcaaaaacttanagcatcttctctcgcggtggagcgtactaaagggaacaaaagctggagctccaccgcggtggcggccgctctagaactagtggatctcccgggctgcaggaattcggcacgagcctgcgtgggctcggaagccagaggcatctggatcaaaaaaagaggatggggctccttcaagtggtcgtgcaaagaagcttgcttaatgggtgtttgttcttcaaaaatcaattcttttaagttattctttaacacgtaggggaagcaatctcattggtagcggaaagaagtattgttttaagttatttgttcgtaacaaggccgtgcaatttgttgctgcataggtaactaactacatttagacaattcattttaatattaatcgactggctattcaccattccaaacggaaaatacaagcttaatcaatattccatgcaattctttcccggagggaaatgggcaaatgctaggtaaaatacgatagatctcataataaatattagaaccttaatcgcggggggggccggatcaaaattctcctgttcgcgtttgtatccgcttcatcgtacttgtttaaatgcgttattgagaacatctgagtcaccgacttttgcgttactggacagcattagtcggtcgttatatgatagttgaaccagtgagctttcatcattgtaatctatatgtatgggatcgctgctagtattattgctagtggtgtgatgggacttagcaacccttatggaaatcttaatgaggtgattctgatgtgattgatcgacgctgagggccttgctagtgactataggtcgatggagcttgtgtgaggatctacgacta

SEQ ID NO: 6758 - DNA, 791 bp, Glycine max
  misc_feature (725)..(725): n is a, c, g, or t
  misc_feature (727)..(729): n is a, c, g, or t
  misc_feature (740)..(740): n is a, c, g, or t
  misc_feature (752)..(754): n is a, c, g, or t
  Predicted polypeptide sequence is orthologous to G616
ttatccaaatactgaatgtaattgaatgacttaaaatattccaacaagaaataccaacacttgatgacaacgccatctcatcccttttggcaaaagcaagctttaagtccaggaggaaaatggagcaatccaaaagtcagttcttggctttccccttctggtcagaatggccatagtaaagttgcaagcggctgccatcaaaaacagaagagaactgatgctggtgatggttgttgttgttgttgttctccatggcaggagcagcaactgcagcagcagaagaagcagctccaatgaagaaaggtacagtggatccgtctataggcgaaaacctctgcgagtgaggcagcagagacggagaattggactgaagggtccccctattgtaaccagcgaggcccgaagacatggtggagttcagattgtaatcgttcccgctgggctgatgatgatgatgatgatgagaagaagcagcagaagaagtaaccacagctgacataagatgatccggtatcaatgacaagtgttgctgctgcagatgaggatctgatgatgagtggttgtggttatcaccactcacattgttgttgaatgctgaaacatgattcattgcctcaggaagagaatgtcctagttggatttgtgccaatgagaacccactagaagaagaagaagaatattgatgatgatgaaggtgattgtgattgtgtgtcgttgttctagangnnnaaagccccagnaagtagtccatnnntgttgttgatgaacaccattgcagtctacctgctgct

SEQ ID NO: 6759 - DNA, 661 bp, Glycine max
  misc_feature (572)..(572): n is a, c, g, or t
  misc_feature (584)..(584): n is a, c, g, or t
  Predicted polypeptide sequence is orthologous to G618, G2057
ccggatttagggcaccaagatctgcggctctcgttgcagtcctttcaggaccctattatgcttcaccaccagcctcatagccaccaccaaccggttccggctggtcagagcacctgcaccagcaccagcaacagaaccaccactcggaggaacagcgattgctctatgctggtggtaacagtggccacggcggtgggtttgtgttcaacacgccggcgccggtgcaggtgccggcgtttggccagtttttttctcagaggggaccccttcagtccagtaacaccccttcgattcgtgcttggatagacccttcggtcgatcaccaccaccaccaccatcactacctatcacagttgatccaccaaggatccgtcgccggtggcggcggattctccggcttccgcattcctgcacgaattcagggtgaagaggaacacgacggcgtgtcccgacagccgtcctctgctttctctgattctcgccattgatttgaaaaacacacattcaaaacccccactttgttctcccctagggttttgtgggtttgattggagattggtcaattggtgganagaaacatattnttggagatcatgattgatggatttcaagcctacacggggaattgagaagatctgaaggggatattcagggttcccat

SEQ ID NO: 6760 - DNA, 797 bp, Glycine max
  Predicted polypeptide sequence is orthologous to G620, G1821
gggctacctcgtcacgtgtacgccacgcgcgcaattaaccctcactaaagggaacaaaagctggagctccaccgcggtggcggccgctctagaactagtggatcccccgggctgcaggaattcggcacgaggatcacacacacacctaccttaatagctatggaaactggaggctttcacggctaccgcaagctccccaacaccaccgctgggttgaagctgtcagtgtcagacatgaacatgaggcagcaggtagcatcatcagatcacagtgcagccacaggagaggagaacgaatgcacggtgagggagcaagacaggttcatgccaatcgccaacgtgattaggatcatgcgcaagattctccctccacacgcaaaaatctcggacgatgcaaaagaaacaatccaagagtgcgtgtctgagtacatcagcttcatcacaggtgaggcgaacgagcgttgccagagggagcagcggaagaccataaccgcagaggacgtgctttgggccatgagcaagcttggattcgacgactacatcgaaccgttgaccatgtaccttcaccgctaccgtgaacttgaggtgaccgcacctctatgaagggtgaccactccggaagaggactgtggaaacccccacccttggtgttctactgcttttatcgttcaccctatcatcacaccaatggtaccttgtactggccttcccatggggaactacgttaagaaccgccaccaatccaacttcctgccattacacgaccacaccaccaccacaatctcatgaatctcaat

SEQ ID NO: 6761 - DNA, 270 bp, Glycine max
  Predicted polypeptide sequence is orthologous to G620, G1821
agggaacaggaccagtacatgccgatagcgaacgtgataaggatcatgcgtcggattctgccagcgcacgcgaagatctcagacgacgcgaaggagacgatccaggagtgcgtgtctgagtacatcagtttcatcacggcggaggcgaacgagcggtgccagcgggagcagcggaagacggtgaccgcagaggatgtgttgtgggcgatggagaagcttggctttgacaactacgctcaccctctctctctttaccttcaccgctaccgc

SEQ ID NO: 6762 - DNA, 895 bp, Glycine max
  misc_feature (1)..(1): n is a, c, g, or t
  misc_feature (565)..(565): n is a, c, g, or t
  misc_feature (603)..(603): n is a, c, g, or t
  misc_feature (646)..(646): n is a, c, g, or t
  misc_feature (655)..(655): n is a, c, g, or t
  misc_feature (693)..(694): n is a, c, g, or t
  misc_feature (864)..(864): n is a, c, g, or t
  Predicted polypeptide sequence is orthologous to G624
nggatgaccgcctgatatgatcacgccaagcgcgcaattaaccctcactaaagggaacaaaagctggagctccaccgcggtggcggccgctctagaactagtggatcccccgggctgcaggaattcggcacgaggtttgcattcagcctcccagtggaaagggccccaagcataagcagacatgcacatgtaatgtatgcttaacagtgaagcgacgattccgtacccttatgttacggcgtgagaagaaacaatcagaaaaagaagcagagacaactcgtaaaaagcaacagcaacaacatcctctaccattaccttcatctgaaattttgcttgatgaagattccttgccctgtagtaacacaggtgatagtagcccaaaccagaacaaagagggtaatgatggttctgatgatgatcctagccgaataaaatcatctgcttcgccgttcaaaggcaaaattgacctcaatatccaaccagagcgagaagaagaattatcacctggttcggattctggcggcatgatgaagttgctccatgatgctactgagcgatatctcanacagcagactgtgaactctggtactggagattcatcangcagtcagtcacagctggtaggagatgcaatgagggaagatanacttagcantgtgttgccccatgcagtagtagtcataatactgatanngacatgcccatcttttgctatgatggtgaaatatattgcgctagccatattgatacgtctgcaagctataatgagtggggagatttgtgacatttatcactttcgctcttgcttttcttgttgacataagagataggaaaatgtagaaccatttattcgtattagtgggntttttaaggttgtagaacctgaaagccatta

SEQ ID NO: 6763 - DNA, 826 bp, Glycine max
  misc_feature (531)..(531): n is a, c, g, or t
  misc_feature (583)..(583): n is a, c, g, or t
  Predicted polypeptide sequence is orthologous to G635
atcggcgtgaccatgattacgccaagcgcgcaattaaccctcactaaagggaacaaaagctggagctccaccgcggtggcggccgctctagaactagtggatcccccgggctgcaggaattcggcacgaggctcaaaaattgttggctgatgggatctgcagaagtcctggacagtgcaaatctctgtggacatctttggtagtcaaatatgaggggatcaagaatgaggataggaagaaaagttggccatacatagaggacatggaaaggataatgtctgataaagaagcccctgcaaaatgattggaaatatggtggacactggacaggataagaaatattttggagaaccatctacattaaaattgttgataagtttgagtgtggtgaccgggaagataatccatgacttgcatgacattgaagatccctagtgttttttagggctgagggatagacagcataaaggggttggctttcatactggcacgggaatgtctgagtttatgggacgatttattctccacctncaatgcctgtccccgtttttttattacatttgtgtcataatttataatattntgtggtggcacatattgggtgccctaagcaaccatggaaatgtctacctttttttcagacattgaacactgaaaagaaagttttcatacttttaaaaaaaaaaaaaaaaacttgagggggggccccggcccccaatccccttaattagattatttaccgcgctcccctgggcccggttttacacattggactgggaaaccctgttcttaccccatttattgcctttagaacaatccccttttt

SEQ ID NO: 6764 - DNA, 531 bp, Glycine max
  misc_feature (446)..(446): n is a, c, g, or t
  Predicted polypeptide sequence is orthologous to G636
ggtcgtttatgggtctacattatcacgggatttaatctcaactatagttacatagctttctttgatttaaaaaaatcgggaaaattttcctgccatttcttcattcttcttgataatatgcatgttttctctgagattatgtttgacttgcttttcttagctatacagaaagacaatcttcttgatggattaattatgaaggacaattggagattgagaaactgcacaaactgcttcttgatggattacgtttgcagaacctctcaaacctgttccatttatcttgtccttgttcacttgtgatgttttgtgaagtcacatgttggagctgatgaggaccattgcttggtgagggctgtggtggttcaggaatattattaatgttggtttgtgaggatgatgatgtttgttgaggtgagggttgtggaggaggatctagttgtacnagttcaatagttatgctttgtgcttgtgaggaattttgttgtcgtctatatgttggcaaagccgttttttccttattgctgatta

SEQ ID NO: 6765 - DNA, 663 bp, Glycine max
  Predicted polypeptide sequence is orthologous to G636
cgccaagcgcgcaattaaccctcactaaagggaacaaaagctggagctccaccgcggtggcggccgctctagaactagtggatcccccgggctgcaggaattcggcacgaggcgagttttttttttttttttttttcactaaatacgtagaagaaagttacatctctctaaatagaaacaaaaaaaaacatttacacttcttcttataattaagaggagtacctattttattgaaagagactatgaatatataactaactggggaagcttgtattcatagacccgaattccatgtgctgcacatgcaccgaaacgcatgtgactaagcttcattctaattctgcctgcaaacacaaacgtagatctgttctcacaatgagacaccaaattgaagtaaaataaaaaaaggtaaaaaaaaagaaaaagataaagataaatggacacacacaattctattaataattgtagacacttgtgccatatacacccatgggtggaagaaatcgtgttttcgacgtgagaaaaaaaacggaagtgaaaataaagagtgcttcaacgtgatcgatttggcaccaccggacccgaactccaaacacacctttacctgttccacaaaatgggaacgccaataacaaccgtcccggagcaagaacatgcctttca

SEQ ID NO: 6766 - DNA, 767 bp, Glycine max
  Predicted polypeptide sequence is orthologous to G636
gcaccaccggttgttggtggtggtgctgctgcatcaggaggagcacatgaaggcggtgccaacggcggcggcggatcaaattcaggggatgatagagttgaggaaggtgacaagagctttggtgggaacaggtggccaagacaagagactttggctttgttgaagatacggtcggatatggacgtggcttttagagacgcaagtgtaaagggtcccttgtgggaagaggtttctaggaaactggcagagcttggctaccacagaaatgccaagaagtgcaaagagaagtttgagaacgtttacaagtaccacaagagaaccaaagaaggtcgaagtgggaaatcagaaggcaaaacttatcgcttctttgatcaattacaagcccttgaaaacaacccttcaatccatgctatgcaatccccaacaccaacaccttcaaagccaccacaaacaacagcactacttgcaacaccagtgtcaatagtggtaacaacaactactacaccatcaacattagtgtctaataatgccactgttccatccacaaatacaccccctttgcctcaagccattctcaacataacaccaccatcaacactaaacatcacaaccccttcttttccatcatcaaaccctacaacatacttcccaacacaaacaccaaaccctacaaccaacaacaaccctccaaacaccatcaccccagcttccttccccaacttctccgcagatctcttgtcgaattcgagtttttcatcgacttcgtc

SEQ ID NO: 6767 - DNA, 1279 bp, Glycine max
  Predicted polypeptide sequence is orthologous to G636
ggaggaaacaacgacgatggggggagggggaatgaggcgcaagaggaagaggaagtggaaggacttctttgagaggctgatgaaggaggtgatagagaagcaggaggggctgcaaaggaggttcttggaggccattgagaaaagagaacaagagcgtgtggtgagagaggaagcgtggagaatgcaagagatgcaaaggatcaacagggaaagggagattctagcacaggagaggtccattgctgcagcaaaagatgctgctgttatgacatttttgcaaaagatagccgaacatcagcaacaagaaatcaatcttgagccagcattgaataacaacaacaacagcatcactgtcgttccacagcaaccagtgccacaaacaactacaacaccaacaccaacaccacaacaagcacaaacaacaatagttcctgaggccccacaaccacaacaacaaatagtggtgagtaatgttgaaaacaataaagctgacaataacggtgagaatttgacgatgggagcgagctcttcaaggtggccaaaaatggaggtacaggcactgataaacctaagaacaagcctggaaacaaagtaccaggaaaatggaccaaaagggccactgtgggaggagatctcagcgttgatgaggaaaatggggtacaaccggaatgccaaaaggtgcaaagagaagtgggagaacatcaacaagtacttcaagaaggtcaaggaaagcagcaagaagaggccagaagattccaagacttgtccctattttcaccagttggaggctctatacagggagaagaacaagagagaggggcagatgaagccggatagcatgatggcgccgctcatggtgcagcctgagcaacaatggcctcctcaaacgcacgtggtgccgccagaagtgaccatgggagacgcccagaatgaccccatggaccggcggcacgaggaagttgaggaggacgaagccgacaaggaaattggagatgaagacgaggacgaggacgacgaaggaagtgataattatgagatagtagctagcaaaccagcttctggagagtgagagaaacaaatatcaacgaaaaagtgcattaattagagaatggtgggttaatttgggttcaggattgtcggaaaatggtggtgtgggagtgaaatgtgataggggtggtggtggtggatggtgatggggttgtattgaagattttggaaatgcacttacttcagaattaaaaaaaaaaaaaaaaaaaaaaaaaaaaaaaaaaaaaaaaaa

SEQ ID NO: 6768 - DNA, 658 bp, Glycine max
  misc_feature (578)..(579): n is a, c, g, or t
  Predicted polypeptide sequence is orthologous to G638
atgaacattatcggaagatgcgacatgtgaagtaatataactgcaaattccatttgcacgcataaaagaaatcagctaatggagaaattcacctgaattagtgtcatactcacaccccaacaattcagtgatatttgccaatgtgtagtctccctcattaaacttacgtacgtgacttgaacacattatttttcaccttgattccataaatataataagattgagcaccttatcatcatcagtctctatacataaacgaccctcatcagttagctcttgcttacataatgtgagatcatctgagataaaaggctgcgaaattttcttgcctcttacaagtgtcaaccatataatttcactctcatcactggttttggcttgctttattaacctttaagctatagttctcccacaaatttccactctcagtcatcaagaacggaaagcagttatcaaccacaactgtatttcctacatttgaattggaaggtgaagagccatcatttgtttgcagcctcccagtcttgtgcctttgatcgatgatatcacaataggcacctccttggttatacagagannattggtcactgttatcgaagtaaaaacaacttcttgagtcttccttgcgcttcttgcttccatccttgacactccttgc

SEQ ID NO: 6769 - DNA, 807 bp, Glycine max
  Predicted polypeptide sequence is orthologous to G643
cccaggatgaggccgttgcatgatcgcacgtggcactccccctcctaaagggaacaaaagctggagctccaccgcggtggcggccgctctagaactagtggatcccccgggctgcaggaattcggcacgagcggactgctccgtcgcgctctccttgtaccagcagtggaacatcatcgccgagaactgcgccgccctcgacgtgccgcggagcctcccgcagtgccgccgaaagtggcgcgcgctgctcgcggcctacgacggcgccaggggagcgaggggcgcgatgccgccgccgggcttcgaccgcgagctgtttgaggccatcgaacgcgttgtgagggcgcgtgaggagcgggggatggtggatcctgggagcgatgatgaagatgggaacgaggcgcgcgacgcaaccgtggaaattgggtccaaaagaaaacggcaacgaagtaaatcgagatgccaagttcaaaagcctaagaaatttcatgaacaaaggcctgaggacagctatgaagaagggctcgaggatgataatttagaggacgagtatttgaaagacttcctagaatcaagacctaagttgaaaggtactgcagaaagacctccaaagcacttggtgatgccaccaaagagtccgggcagagtagagctgaatgaaaaccaccatatcaaaaggcccaagccgattggcacagaaaatataacatttaacaaggtagaaaatgaggaaacattgactctgaaattgcagtggttgctgtggaaatcggacaattgctagtgatcagcagcagactatgaagg

SEQ ID NO: 6770 - DNA, 737 bp, Glycine max
  misc_feature (18)..(18): n is a, c, g, or t
  Predicted polypeptide sequence is orthologous to G651
cccaggagtgtgcactcnattgaactgatcacgccaagcgcgcaattaaccctcactaaagggaacaaaagctggagctccaccgcggtggcggccgctctagaactagtggatcccccgggctgcaggaattcggcacgaggtttgggtctggtcaagcacttggtggccacaagagatctcacctcatgccttcttcttccacaaccgctaataatgattctgttagattgaaagagagcttcatagatctcaacttgccagctccgcccgaagatgacgaccttagtgttgtttctgatgcctgataattacttgttcttctctgcagcaattgggtaaagtccttttctttttttatagtaggtaacgatatttcattgcggttcattgttagatcagatgcttttgatgctacaatcatagcttataatttatgctctattgtgcctagattctcaactaaattgttactctaggtaacatcgtaatcaattaatataagattattttattttaaaaaaaaaaaaaaaaaactcgagggggggcccggtacccaattcgccctatagtgagtcgtattacgcgcgctcactggccgtcggtttacaacgtcgtgactggggaaacgctggcgttacccaacttaatcgccttgcagcacatccgcctgtggccagctggcgtaatagcgaagaggcccgcaccgatcgcccttgccaacagttgcgcagcct

SEQ ID NO: 6771 - DNA, 815 bp, Glycine max
  Predicted polypeptide sequence is orthologous to G652, G1335
aagggtttaaagatatagacaaaacatataaaaccacagatgtgacaatcagaatcccaatagcaggatggccaggcagatacagatattttgaaggattaatacagcgtttaggcgaattagtaaattgattaaatcaagcattaattaagccgtccgttgcgcttcaatcttcatattcaagaggaggaacaagcataatgaatcacactttgttgaaaagaagcgcattagataaaacaattagcaaagccctggaaaaacatatttggaaggaaggaaggaaatgccaatggctagaaacaaaaataacagaatccatttaaccaaccccaactaacagtaacagactcaattcaatagaagaaaccataacacattctcactcatttccttttccaacattcggacattccctcgcaaaatgcccttcctccccacagttaaaacaccctcctcctcctccaccaccaccgccgcgtctccgattcctaccatcatcaccaccaccaccaccctgtccatggtaacaatcccttgccaagtgacctattcttccacagttataacactcagggcctcctcctctccgaccgaaccctctgccacggccttccccgcccccgtagcgtcctcctcctctgcccctcccaccgccgccgccgcgaaatcctccgggaagacgagatctaacggctgaggtgacgtcgacggccatggtgcggccgtcgtcgccgtaatcgaggagaaactcaacggactgaccgtcggacaaagaacggtagccgtcggatcggatggaagtgaagtgcacg

SEQ ID NO: 6772 - DNA, 368 bp, Glycine max
  Predicted polypeptide sequence is orthologous to G652, G1335
cctcgtgccgaattcggcacgaggggtacgttggtggtggaggcggcggcggcggcggaggaagctgctacagctgtggagagtctgggcattttgccagagattgcccatcaagtgctcgttgaatttactgttagggttgtttatgttttgcggattgttttaagtttttactttaatatgtcttagggattttaatggtttctgtccaaactatgggttcttatgagtagatgtgtgggatttttcttttttggttatttaaatgaagggtttctgtgttatcgttacaatctgcaaactaaaatctgtttgaacttacattttgctataatgaatcgtatgattgctatcaaaaaaaaaaaaaa

SEQ ID NO: 6773 - DNA, 525 bp, Glycine max
  misc_feature (81)..(81): n is a, c, g, or t
  Predicted polypeptide sequence is orthologous to G653
tttttttttttttttttttttttttttttttttttttttttttttttttggcaaatcacactattattactgaatgtgcantggtcaaatacatcacacacggtaaatggcacactagcgacacccacatataaagtgaacaagaaggaaactggtcatggtaagtagaatcaaaatgaaaaaaacacaaacacttattccaaagatgataataacaacaaaagacaacaccatgactcaagctggtggaacagagttggcttcccgttggattgatgcagatttaataagatgattatagctccctttctccttaaaaagctgggaaaaatggtgcttgcaatacaaaacgccctccagggctgcatagttggatggagttatgggacagctgccatgtgaacatttgaaacaagatttgtgataggcctgaccttccactgttaccttctccaaaggataagcagtttggccacatgtagcacacttttctggggtcccagaaaacatgctagcagctttact

SEQ ID NO: 6774 - DNA, 875 bp, Glycine max
  Predicted polypeptide sequence is orthologous to G653
gcaaatcacgctctcattagtctcgtctttactaaatgtccattatatgaataaaccacacaagatttgcacgccacgcatgtgtaagtaaaaatatcagaaatgatcaaagtcacgagagaacaatcaaaaaccaaaaaggccacacatacaaacacctgcttcacaaaccaaaatgtatttgaaaaagaaaaggcaattgaaggaaccaacattcaagattctggaacagaggcagctgttgttgctgctgctgtggctgcggctgcccgtttgactgatgcagacttagtaagatgattatagctccctttctccttaaaaagctgggagaagtggtgcttgcaatacaaaatgccctcaagggctgcataattcgatggcgttatgggacatccaccatgtgaacacttgaaacatgatttgtgataggcctgcccttccactgttaccttctctaatggataagcagttttgccacatgtggcacacttttcttgtgtgccagaaaacatgctcgcagctttactaggagaccttgtcagctcaggagttgtcttatcagctagctttgcaggtgactggaagttcttgctgaaggagccactctccttgaagagctgctcatagtgaggcttacagtaaagaacaccttccattgaggaatagttactcagctttaatgttcctttgcagtgagagcatctgaagcaagctttgtgataagcagtaccatcagcagaaagctgatcaacgggataaaccgttttctcacaagccttgcacttttgctgggtaccgataaaagacattgctatggcttttagatctaaattcaccacccattccaaatcggttgctgtcgcgacagcaac

SEQ ID NO: 6775 - DNA, 933 bp, Glycine max
  misc_feature (1)..(1): n is a, c, g, or t
  misc_feature (12)..(12): n is a, c, g, or t
  misc_feature (63)..(63): n is a, c, g, or t
  misc_feature (70)..(70): n is a, c, g, or t
  misc_feature (105)..(105): n is a, c, g, or t
  misc_feature (882)..(882): n is a, c, g, or t
  misc_feature (894)..(894): n is a, c, g, or t
  Predicted polypeptide sequence is orthologous to G669
naatgtgcaacnttcaggacctaacctaccctaatacgatctactatagggaaagctggtccncctgcangtaccggtccggaattcccgggtcgacccacatantcggtagacgaccctgctgccccaaagagatcaacaaaggtgcttggtctcgagaggaagatgaaaccctctccaaatatgtttccatccatggagaaggaaaatggcagaaggttgcccaaaatgcaggtttaaagagatgcggaaaaagttgcagacaaagatggttgaattatctcaagcccggcataaaaagaggccacatctctgttgatgaagaggatatgattataagacttcatcgtcttcttggtaacagatgggcattgattgcaaagaggctacctggacgaacagacaatgaaatcaagaactactggaacactaatctgtcaaggaagttacagaaacatcctacatcatcagtttcttcacttcaacacaaacgtcatgaaaaggaaaagaccaaacaaatgcatgtagcacccgaagctccacggcgtaggagggttaatgcagttgaatacagtaaaaatttggagaatggtgggtgtggaaataggcctagtacaactcccagtccctcacatatagaagagggtagtagtgaagacgcttcttttagtgactttctcatggatatcgatcaaattgatgattcagactcatacgtcccacagaatgtagaggatcaccacctacactaggtagagctaataaccaacacagttctagctcttcatgactttctgatcatcgtcaccatctcttggcagcagacatttgacccttctgagaccttactggatgtggagcttcagacgatggcttcctttncttgagctcganacggatgatcagagttctacgtattgctgccgcgcaaag

SEQ ID NO: 6776 - DNA, 127 bp, Glycine max
  Predicted polypeptide sequence is orthologous to G669
ttgaattatctcaagccagatatcaagagaggaaacatttcttcggatgaagaagatctcatcatcaggctacatagcctcctagggaataggtggtctcttattgcaggacgattacccgggcgaa

SEQ ID NO: 6777 - DNA, 781 bp, Glycine max
  misc_feature (1)..(1): n is a, c, g, or t
  misc_feature (671)..(671): n is a, c, g, or t
  misc_feature (781)..(781): n is a, c, g, or t
  Predicted polypeptide sequence is orthologous to G670
nggggactgacatctccgccagctctaatacgactcactatagggaaagctggtacgcctgcaggtaccggtccggaattcccgggtcgacccacgcgtccgcaattgcccccaaagcctatgagatggaaggctcttgcagctccaagattaacaacaccaaaaacgacaccaacttgatgtccaattgttccaacaaagacatgttcctagacagctacaccactagttgccaaccctcagatttgatgggaaattaccctcttcatatcactgacactctccaaccaattcaaactcttgccattggttcagccaaactgcaagaccctttgatataaactcaaactctgagtttacaattacttccaatgttatgtccattcttccacctacaacaacctcattcctcccaagtacttctttttgctacaagccatcacttggtgtcccttcagaagatatttcagcaccctcttttggattgaatggtcccagttactgggaagcaagtgcctccaacaacagcaatggaagcaacaacacgagtgatggcagcagagagttgacaactacaagtagcaagaacagtgtgctctcttcttgggaattgacagaagaagcaaagtggtctgagtacctccacaacccaatgttaatgctggcagctnctgaatcattgtgcaaccaaattaggccagccacacatttgatacctgataacactttaggggctataatattgcctgatttcaagaatcaaacaacaccacaaacacan

SEQ ID NO: 6778 - DNA, 628 bp, Glycine max
  misc_feature (15)..(21): n is a, c, g, or t
  misc_feature (572)..(575): n is a, c, g, or t
  misc_feature (582)..(583): n is a, c, g, or t
  misc_feature (592)..(592): n is a, c, g, or t
  misc_feature (613)..(617): n is a, c, g, or t
  misc_feature (620)..(621): n is a, c, g, or t
  misc_feature (624)..(626): n is a, c, g, or t
  Predicted polypeptide sequence is orthologous to G670
atatgtttgattaannnnnnngtgggtggaataagaagctggaattaatcacaaatattacactgtaacaaaatatacaatatggaaagaaagaaagaaagtattttttttaacggcacacacctgtggtcagaactcacgagagaaaattctgacctggatcatcatattggaaaattaagtcggcaacatctttgtctctttcgttgaattgaattttccacatatattacgtacacacacgttacagggtttgtccgaaagtcactgaaaatctctgcagatccttgctatatatatcggaaagttgaaaagctggtgtctgattctgataatggtgccatgtagcacatgactcgtctgttatgaaacctgtttctggtttaacctcactatagatagattgagaggtatgaatttgatgattctgcgctgtgttgtttcccagaataaacggggtattaagatactcagaccatttcagatcttcttgttctgcttgtagaggcatttgatcagcatctttgttgatgttaacaaccttcatagactctcccaccccccacgtgttnnnnatgaagnntgtgcagcnttgtaactgcatactcccatnnnnnttnnttnnnct

SEQ ID NO: 6779 - DNA, 764 bp, Glycine max
  misc_feature (764)..(764): n is a, c, g, or t
  Predicted polypeptide sequence is orthologous to G715, G1646
cgagcgcatgagagggcgcaggctctaatacgactcactatagggaaagctggtacgcctgcaggtaccggtccggaattcccgggtcgtcccacgcgtccgatccgctcctggctccacgccgaggagaacaagcgccgcaccctccagaagaacgacatcgccgccgccatcacccgcaccgacattttcgacttcctcgttgatattgtcccccgcgacgagatcaaggacgacgctgctcttgtgggggccaccgccagtggggtgccttactactacccgcccattggacagcctgccgggatgatgattggccgccccgccgtcgatcccgccaccggggtttatgtccagccgccctcccaggcatggcagtccgtctggcagtccgctgccgaggacgcttcctatggcaccggcggggccggtgcccagcggagccttgatggccagagttgagtgacatcgatgccgatgatggacagtcaggagttatgaagattctgaacttgctgcaatttagaaatggttttgggtactaaatttttatgggatgacactgtgaacctgttaactcgatgaacagcatgatttagctacttgtgtacaagaaatgaaaactaaacactgatccttgtgtgtgaaacatgtatgagcatctgcccatactagatatgtgctcataataagaagagcagtgtagaagatatgagcgagaaggtgaggtagagggagggggggatgctgggtgagcggtgcgn

SEQ ID NO: 6780 - DNA, 497 bp, Glycine max
  Predicted polypeptide sequence is orthologous to G715, G1646
gaacgacatcgccgccgccatcactcgcaccgacattttcgacttcctcgtcgacatcgtcccccgcgacgagatcaaggacgacgccgcgctcgtcggggcaacggccagtggggtgccttactactacccgcccattggccagcctgccgggatgatgattggccgccccgccgtcgatcccgccaccggagtttatgtccagccgccctcccaggcctggcagtccgtctggcagtccgccgccgaggacacgccctacggcaccggtgcccaggggaaccttgatggccagagctgagcgacaaccatgccgaaacggactgtcaggagttatgaagattctgaacttgcttggaattttgattgcttgcaatttggaaatggttttgttaactaaatttttatgggatgacactatgaacctgttaactcgatgaacagcatgatttaactacttctgtacaaaaatttaaaactaaacaatgatccttctg

SEQ ID NO: 6781 - DNA, 920 bp, Glycine max
  misc_feature (1)..(3): n is a, c, g, or t
  misc_feature (664)..(664): n is a, c, g, or t
  misc_feature (746)..(746): n is a, c, g, or t
  misc_feature (750)..(750): n is a, c, g, or t
  misc_feature (774)..(774): n is a, c, g, or t
  Predicted polypeptide sequence is orthologous to G720
nnnaagacgcatggcattagactattacgtgcagcgcgcaattaaccctcactaaagggaacaaaagctggagctccaccgcggtggcggccgctctagaactagtggatcccccgggctgcaggaattcggcacgaggaaagggtgtgatgtgaatgatatggagggtatgccatgattggtctttgcatataatagttcctttgcattgcatccccttgattatgccatttccgatcttcttctctgggtgcactttgtctcttgtgtattctatatttctgaagatggcttgccacattgtgccttgtcaaaccttccactttcattatctccaatattctagaaggaatggcttgatcaatacctagttgttcgacagcctttacaaattttttatgcagctcaggtgtccagtctactttcaccttcttccgattagctttaatctcacatgaatcattaagtacacccgttttatttggagatgtattaccatcggcattgctgagaaactttttattatgtggattcagtgaaacagcgctctcacccttggaaacattggcaaaatcatcttcctccctaatcagagtcttatcaggttcccttggctgaggagaacttttcgcattcaaattcccacatgaagcttcgacagatntacattccctatcatgttccctggtgccgaattcggcacgagtccacattcattggaaactcgacctcgattcaagagatgntcangacggtgagttgagcagtcacggnccatcgttaagagaaggtttcttacttaatctatgtgatgcgtaagtgtgttgctctgctctcaactgaggaagattgtattacaatagtgattgaccgttgcgggataaacttgatgagctgtgtgagaatgaaaaaaatagggt

SEQ ID NO: 6782 - DNA, 822 bp, Glycine max
  Predicted polypeptide sequence is orthologous to G729, G730, G1040
cccacgcgtccggtggatttgaatccgcatcatcatcaagtacaaggtgttccaagaagcttcaatcaccaccaccacctccttcaacctcacatctatggccgcgatttcaaacgaagcgcaagagtagttaatggggtcaaaagaagcgttagagctcctaggatgagatggaccacaaccctccatgcccattttgttcacgcggttcaacttcttggcggccatgaaagagcaactccgaagtctgtgttagagttaatgaatgttaaggatctaaccctagcacacgtcaagagtcacttgcagatgtatagaacagtgaagagcactgacaaaggcatcagtactgcaggtcatgggcagacagatattggattgaacccaaggctagggattaatgttcatctgcatgcaccttcacctatttgtgacacaccgaatttaccagacccaattcaaaattcacagaggacaccgtggcaatcatcaatagagacaaaaacagacaacagtagacaagaagaacccgaaatcggtttgacgtattctcacctcaagggaaataataataataatgaaaccatggtggatgggcacaacaattctggagggttggattcttcccctttgtcacgttcctccgaggcaatgcttgaccttgaattcacccttggaaggcccaattggcaaaaagaccaccccgaatcatcaagagagttaactcttctcaagtgttagaatcaaattaagggtgttgttaattattattcttaaagatattagttaaaggaccaaaaaaaaataaaagggcggccgctc

SEQ ID NO: 6783 - DNA, 785 bp, Glycine max
  Predicted polypeptide sequence is orthologous to G729
ggatgactgtagaaactgccagcgcgcaattaaccctcactaaagggaacaaaagctggagctccaccgcggtggcggccgctctagaactagtggatcccccgggctgcaggaattcggcacgagagaagatgacatgtctccaatgggaagcagtggtggaatgcgtcaattttcagaccaaagaagcctttctgatcgaccactgcaacaagatatggactactcttcaggcaacaacactctatggagtaactcttcaagtagagaaacatggcaacaaaataactctaatgacgtagatggttttcagacccccaatcttccagtcacaacaaatatcaggagggcatcaaattcaggagtgtgattcaacccaactcaagaacagtttgtcaggatcaaatttagagtgcaagaacccaagtttggagttcacattagggagaccagattggaatggcaaaggacaagcctaattttcattggttcccttattgtctctagctagtttgcttaattagtttaattacaacccacggtaacatgtgacaaacttcgtaatctttcctgaaatagagaggtgttgtactatatatatatatatatatatatatatatatatatatatatatatatatgtatacaatcagacaaataaaattaaaggcctatgtagtctataaagttgatcttgtttggaagtttacgagttccgcaacgagtgagctaggcttggcttgcgataattattaatgatgggtggaagatgcgccatggtagaa

SEQ ID NO: 6784 - DNA, 761 bp, Glycine max
  Predicted polypeptide sequence is orthologous to G729
cggaatgactgctacgctaagcagcgcgcgtaatacgactcactatagggcgaattgggtaccgggccccccctcgagttttttttttttttttttgttcatcaagccttgttaattgctacatcttaatttccctccttctcatcctcacaaataaataaaaacaaaataaaatataaacaaaactgttcataaactcaaaaacacttttcgaaagctagctaagtagaactacgcacggagggtcttttcttcctctcctagacaccaatttatatttatctaaataattagctctacatttcataagatgacgaagttgtcaccatggtttataaataaattgcaaaattaaaagaaattaagcaagggaaccaattatcaaaattattagctaggcttgttctttgccatcccaatctggtcttcctaatgtgaattccaagcttgggatcttgcactccaaattagaacctggcatgttgctcttgagttggattgaatcacactcctgaatttgatgccctcctgatattgtttgtgaatggaggataggtgatctgagaccatctatgtcgttagaactaggtcttagccgtgactccccacaacttgaagaataactccatagagtaatggtggtggaagagtagaccatgttttgttgtgccgccccactccgccgccctcttggtgtggaaatatgcagagaccaccacaatcttggtgccaattcttcagcccgggggaccactagttct

SEQ ID NO: 6785 - DNA, 740 bp, Glycine max
  misc_feature (7)..(8): n is a, c, g, or t
  misc_feature (421)..(423): n is a, c, g, or t
  misc_feature (495)..(497): n is a, c, g, or t
  misc_feature (634)..(638): n is a, c, g, or t
  misc_feature (646)..(648): n is a, c, g, or t
  misc_feature (701)..(704): n is a, c, g, or t
  misc_feature (721)..(723): n is a, c, g, or t
  misc_feature (725)..(725): n is a, c, g, or t
  misc_feature (727)..(729): n is a, c, g, or t
  misc_feature (731)..(731): n is a, c, g, or t
  Predicted polypeptide sequence is orthologous to G729
cctaaannaagttatgtatacggacaaatatgtaggaacctctagggaaaagtagagaaaaagaaggaaaagaattaaaaaggagggaacaaaggccttattatacatctggttccttcttttcttcaacttttactttaactacaacatttatataatgactaacacaacctataataagctttggcccaaaaagaatatacagagatgcttttagatttgtggaaaagtgcagacatctttgtcttgacaaaagcactacctatatattaatttatatacctgtgcatattaatcttttctattaatttggctagtaataaagtgatcatatatgtaaaccaattaaaattaggcatgttcactgttgtgccaatttgatctccctaaggtgaactccaagcttggattttgatccttnnngaagattcttgtttgtatatagctgctaccctcagaaagtttcccagtatgctgagatgataagatttcttnnngactaagctcatccaaatctcttgagttagcttgtatccgtgctcctctagcgctcgaagaagaattaacccatagattgcttgaagtgtagcccatatcattatctatagatgcatttgaagttcctctctgattnnnnnaaaaactnnnattttgatcatttggtactgttaaggacatgaaatcttcatccccatctgaannnnctgcaggtttgtcagtnnncntnnnantccgataca

SEQ ID NO: 6786 - DNA, 1235 bp, Glycine max
  Predicted polypeptide sequence is orthologous to G732
ctctaaccaagtagaagtgcaataattaaatgtccaacatcttcttgttgttgatgtttgagattcatgtatccgattctcagtgaaatcttcttttccgggtgtatgatcaattccactgctaggcgcaggacccatttagttcaatccttctcagttgccttcctctattggttgtactacgtttcatgatttctaacccttccttagcttaataatcatctatctaaaatatcataatatcttctactagctagttttatttttattatcacaataaaatctatctgcaatatattgttatttttattttctgagaaatttgtgtctagttataagtgtctgggtcctggtcctgcctattgtgtcaattaaattgagaagggttgtattgcatagaatcatatatcgtatcatataaacatggcttgttcaagtggaacatcttcagggtcattatctctgcttcagaactctggttctgaggaagatttgcaggcgatgatggaagatcagagaaagaggaagagaatgatatcaaaccgcgaatctgcacgccgatctcgcatgaggaagcagaagcacttggacgatcttgtttcccaagtggctcagctcagaaaagagaaccaacaaatactcacaagcgtcaacatcaccacgcaacagtacttaagcgttgaggctgagaactcggtgcttagggctcaggtgggtgagttgagtcacaggttggagtctctgaacgagatcgttgacgtgttgaatgccaccaccactgtggcgggttttggagcagcagcatcgagcaccttcgttgagccaatgaataataataataatagcttcttcaacttcaacccgttgaatatggggtatctgaaccagcctattatggcttctgcagacatattgcagtattgattgagatgcttcatctctgagatttgatgaggatttcttcttcttcttcttctgggtttgagtctgtcgagaaattgtaatcactaccatatgatggtgataaggaataatattaataatgaatgtgtatcataaaaacgggtgggattgttaatgttaggtgctggttccgtaaatggggcatggggcatgggccattactgtaatttgtcaccctcctttcctatataataataataataataataataatactgccctctctatgttattattctccccaaaaaaaaaaaaaaaaaaaaaaaaaaaaa

SEQ ID NO: 6787 - DNA, 961 bp, Glycine max
  misc_feature (1)..(1): n is a, c, g, or t
  misc_feature (23)..(23): n is a, c, g, or t
  misc_feature (794)..(794): n is a, c, g, or t
  misc_feature (869)..(869): n is a, c, g, or t
  misc_feature (932)..(932): n is a, c, g, or t
  misc_feature (961)..(961): n is a, c, g, or t
  Predicted polypeptide sequence is orthologous to G735
naaacaacgctaaaccgggatgnagttgcttatagggcgaattgggtaccgggccccccctcgagtttttttttttttttttttttttttttttaaaaaaagaataataggattatccagcagaatatgctcaataagattcacatacatcaataagaatttgctcttacttacaactagcagaaacaagagttttagaatagtttcctcataaaaagcataatgtaaatttaactactatgttattgttctccattagaaggaggtccacgtgaatctgcaccaccacgaatcctcttctgaagatgttccaagctagccactctatgcagggaagttgttctccccgttttgttgccacctaccactgctgcaacattctgctgcacagtttcaattgaagaaatgcctcccaacccattattagaagtgggttgacaacggtgatgatttgggtcttcttgcacagaaacagcagcatcagctgatgtctcagaaggactttcatcaaacgatggcattgccattgatgacatctcagttatggcatgaagcattgggttcaacccagtaattcttttcactgtctcttcagccatcttcacctttgttcttaatgtttcaacatcagctttcagtactctgttgtcaactgcagcattattggatttctggctcacatccgtgaatcgctttacaacgaagaatttcacttcgtaatgggagactgtgctccagctagttaatgagcctgcttctccttcttgagcgctgctgctccctatagaaagctnctgaagacaattgtaggcttaattacaaggcgattgtccagactgactgacaaatgatgcttctataaggaatangaagattgttagagaacataatcaattcttgctgctaccatacccaaatttaactggcacttnctctattgatgtgattggtcagtgctaan

SEQ ID NO: 6788 - DNA, 872 bp, Glycine max
  misc_feature (736)..(737): n is a, c, g, or t
  misc_feature (819)..(819): n is a, c, g, or t
  misc_feature (832)..(832): n is a, c, g, or t
  misc_feature (835)..(835): n is a, c, g, or t
  misc_feature (872)..(872): n is a, c, g, or t
  Predicted polypeptide sequence is orthologous to G735
attagactcctctggtacccgcagcgcgcatttaaccctcactaaagggaacaaaagctggagctccaccgcggtggcggccgctctagaactatttgtatcccccgggctgcaggaattcggcacgagctccgtcttcttcctccgccgccgacgtcgtattcgtcgagatcgaagatcaacctaaacccgcccctccccctccgacaaacggcgccgttctccccaatgcccctggtcccgtcccccttgactccgacgaataccaggccttcctcaagagcaagctcaacctcgcatgcgccgccgtcgccatgactaggggatctttggctaaatctcaagacccgtcccctttttctgaaggtggatcacagccgactaatccttctctagttgaatctcagactacttctaaaggatctattccttctgaaaatgatccatctaagttacaagataaagataccaatgtaccagttgggattccttccatacctgccatgcaaaagaaacctgctgttgcaattaggccatctacaagtggatcatcaagagaacagtcagatgatgaggacattgagggagagacatctatgaatgacaacacggaccctgctgatgtaaaacgagtaaggaggatgctatccaatagggagtcagcccgacgctctagaagaagaaagcaggctcatttaactgacctagaaacacaggttctcaattaagaggtgannaattctaccttgtaaagcgccttactgatgtagtcagaaatacagcgacctctgctgtgacaacagagtttaaaagctgcgntgaacattagaancanagtgagatgggcgaagagaccgtcaaagaattactgn

SEQ ID NO: 6789 - DNA, 1372 bp, Glycine max
  Predicted polypeptide sequence is orthologous to G735
cctcttccgaatgggctttccagcgcttcctccaagaagccaccgccgccggtacctccacttcatctccccctcagccacctacaatgacggcgtcttcctcgtcatcttcgcaccaaaacgacgtcgtggagatcaaggatgagaatctttctattcctaatttaaatcccagtacggcgttgaattcgaagccggcgtcgtcgtttggcctcgcacctccgccgaatattgccgttgattccgaagagtatcaagcattcctcaaaagccaactccatttggcttgcgccgccgttgctttgactcgcggcaagagtttaaaccctcaggattcaggctctacagctcacgacaaaggatcagagactgctagtgcagctcaatcaggatctcacgtctccactttaggatctggtcaggaagtggcaaaaattcaagataaggatgctggtggaccagttggaattccctccttgcccccggtgcaaaagaaacctgtggtgcaggtgaggtcaacaaccagtggttcatctagagagcaatctgatgatgatgaagctgaaggagaagcagaaacaactcaaggcatggatccagctgatgcaaaacgtgtaaggagaatgctttcaaatagagaatcagccagacgttcaaggagaagaaagcaggcccatctgacagaactcgagacacaggtttctcaactcagagtagaaaactcctctctactgaaacgtctgactgacataagccagaaatacaatgaagcagcggttgataatcgagtcttgaaagcagatgttgagacattaagaaccaaggtaaagatggctgaagaaactgttaaaagagttactgggttaaatccgttattccaagctatgtcagagatttcctcaatggtaatgccatcctactctggtagtccttcagacacatcggcagacgctgctgtacctgtgcaagatgatccaaaacatcactactaccaacagccgccaaataatcttatgccaacccatgatcctagaatccaaaatggtatggtagatgttcctccaatagaaaatgtagagcagaatcctgcaacggcagcagttggggggaacaagatgggtagaacaacttcaatgcagcgggttgctagcttggagcatctgcagaagcgcatccgtggtgaagtgagttcctgtggaactcaaggcaggggagagcaataaacacggttaaagccaccagctgcaccgaagattttgcacagcatgttgataaaatcatactgttccaattccaaccgtggcaggaattgcccattctttgtatgacaatgccttcttggatgagactaatgcattgacatctcttttct

SEQ ID NO: 6790 - DNA, 973 bp, Glycine max
  misc_feature (894)..(894): n is a, c, g, or t
  misc_feature (920)..(920): n is a, c, g, or t
  misc_feature (954)..(954): n is a, c, g, or t
  Predicted polypeptide sequence is orthologous to G748, G1900
cgttccccccccccccccccccccccccccggggcgcaggttgatcggcgcgtgaaactaccccaagcgcgcatttaaccctcactaaagggaacaaaagctggagctccaccgcggcggcggccgctctagaactagtggatcccccgggctgcaggccagtcccaattctccaactttggggaagcactcgcgggacagtgacatgattaagcaagactctttgcacaaagaagaagcttcaacgccaagaaacgggagtgttttggtcccaaaaacgttgagaattgatgatccaagtgaggctgcaaagagttctatatgggcaactctaggaattaagaatgagtcagtgagtgggggagctatgtctaaggccttccaatcgaacacggcccccaaccctcatgcccccccctctccacctcgttgatggctaaccctgcagctttatctagatccctcaattttcatgaaaactcctgaattagtggcactggtgaaaagtccttacagcaaagttagtcacttcttgagttatttgtctagctagcaagagacggtgaccatctttgagtgacattgaccttgtatagaagaagcgaaagggtggtagtctctgatttcctcagcacaagtgagacgacgaggactaattctgtctctaatttcattcgacgatattaaaatagagtatataggctctatttcatgagcatagatggatgagtgagctcatgtatatgcacatatatagaaatatgtcagatactgatccttagcctagagagaccggaaagaatctttacgtctcttgtagtataaagtcaaaatcctgactgtagaaaagggaataatctctttgagtacttgtatgtctaactacgcgcgccnacccgccgccgatccccactcgccgnctacactacgtcacaacgaacacgtaggctatgnacgcttcgtagtctgaatg

SEQ ID NO: 6791 - DNA, 927 bp, Glycine max
  misc_feature (18)..(18): n is a, c, g, or t
  misc_feature (927)..(927): n is a, c, g, or t
  Predicted polypeptide sequence is orthologous to G748, G1900
cccaaaggaacccttggnaccggagctaaatcgcgcaattaaccctcactcaacggaacaaaagctggagctccaccgcggtggcggccgctctagaactagtgtattccccgggctgcaggaattcggcaccagaaaatgacaaggctgactcagttcctgggggaacactctttaaagccttcccttcaaagcatgatgacaaaaaccattcaatgcaatcctcgcgggtcttgctggccaatccagcagcattgtctaggtcacttaactttcatgagacctcataatcatgtagcttataaatttgtaattgtgttttaggtgcagcaaactgatttggcagtgttcaaccggtcctgagggaaacacaagttgtaaagtcacattggatcactagctttgtttgtaagaagagttagttctgttgtcagtcaactgaagaaagagctggatggttcttcatgcatttccttctaaggtgaaggagcattcttgtgtttgctgagtatctcccttgtcttaggtgtcatctaggcaattttacccacttccctttcattcagatggttttcttagttcatgtacataaatatatataagttcatagtgagacatagtgagtttgttttcctagacctcgtatgtatataaataagactaagaatggaagttcatatcgaacttctttcgtctggtttacaaaaatcaaaaaaaataacaaactcgaggggcgccggcacccattcgcctatagtgagcgtatacgcgcctcactgccgtcgtttacacgtcggactggaaaacctgcgttacaactaatgctttgaacatctcttcgcagtgcgataggaaagccagacgatcgctccacagtgtcatctatgcgatggacgctgatcgcatacgtcgcggttgtgtaccccn

SEQ ID NO: 6792 - DNA, 907 bp, Glycine max
  Predicted polypeptide sequence is orthologous to G760
gcactctaacgaggactatacaatcaagacaaaaacccgatgacttgttcttataccaagtgaatcaaattacatatggaacctaataaataatggacagcctctatcagtcagaactttgcatctattactattgaaagtatgaactaataatatatattacgcgaatcttatcgaagacagtatttgctattactctatctgtaggcaccctaaaaatgttgtatattttacgatgaagaatgtatagatcagattgactaaggtaccataaaaatatctacaaagtcacgggatcctactcattcaatgagtaccaccaaacactaaattatacttaactgactgctccttattctctagtagccgtcaaccttatttgtagtcatttaccagtatacatgatgcttccgatcttgcaactcagtgaaagaataagaacagagaaaccagtcaggaaaatccagccatgcgacaacacaaatgcagtcttgccagaaacaggtatcaaagcatccgaattaacatccggttgacaaaacccagtggatattacagtgctaaaccctccatttttgcccatcgtccaatccatcgcattgcctcttaaagtaatgtctgttatgctgatcatacctgtagttatatgagctggatgggaagactgagctacaggatgaagcccaagagcaatctccttagcaggaaactccatagcatgtgcaggcgcagcagggatgccggctaaccaaccataggcctgcttaacaagtggatttgtacttcctggtgcaaactttgcctcatgtgtattctgcactgaagaagcctcatttctggtttgtgattcagaaattatgatactaaccacagctttatcagcagtttctccctcacattctgccga

SEQ ID NO: 6793 - DNA, 773 bp, Glycine max
  Predicted polypeptide sequence is orthologous to G772, G776
ccctccccccccccccccccgggtgatgacgactggtggcacgatcacgccaagcgcgcaattaaccctcactaaagggaacaaaagctggagctccaccgcggtggcggccgctctagaactagtggatcccccgggctgcaggaattcggcacgagggaaggatgcgtatgttttgtgtagagtgtttcacaaaaataacataggacctccaaatgggcaacggtatgcgcccttcattgaagaagagtgggatgacgcatcaggaatggttccaggggcagaccatgtggataaccgctcttttgcccaccaaccacgtgttgaaggcaatggtggtgttttatgcgctgaagggagaaatggtgttgtacaggacactcaatctttcaacaaagctccatttgatgtgaacaagcttcctatagaaactcaaaatcttctagctgtgtgcaagagggaaagcatggctgagtatccatcacctgaaaaggatgataataattgtaagcacatggatgactacccttcacctcaaacagataatccaaagcctttctctcaaatatacaaacgaaggcgtcataacttgaactccaacaactctaatgtttctggagattcagtccgaaccagccaggatccgtgctcctttacaataactaccgctgcaactgcactctcaaccgcaactgttgctggcacagtcaccaacactgcaccgtaaaaacattttctgtctgcactggtggagttttccctgtagaatccat

SEQ ID NO: 6794 - DNA, 923 bp, Glycine max
  misc_feature (67)..(67): n is a, c, g, or t
  Predicted polypeptide sequence is orthologous to G773, G1412
ctcctcccaccccccccccccccccccccccccccccccccccccccccccccccccgccaggtacngtcaagtagatagatacggcgcgcgcgccattaaccctcactaaagggaacaaatgctggagctccaccgcggaggcggtcgttctagaactagtggatcctccggtctgcaggagtcggcacgagggttcattcttccttgcaccttcttctttgaagatcgaaattgtgtttttgaaaaaatgggagttccagagaaagaccctctttcccaattgagtttgcctcctggttttcggttttaccccaccgacgaggagctcctcgttcagtatctatgccgcaaggtcgctggccaccatttctctcttccaatcattgctgaaattgatttgtacaagttcgacccatgggttcttccaagtaaggcgattttcggtgagaaagagtggtactttttcagccctagagacaggaaataccctaacgggtcccgacccaacagagtagccgggtcgggttattggaaagccaccggaaccgacaagatcatcaccaccgaaggtagaaaagttggcatataaaaagccctcgttttctacattggcaaagcccccaaaggcaccaaaaccaattggatcatgcacgagtatcgcctcctcgactcttcccgaaagaacacctgcaccaagcttgatgactgagttgtgtgtcgtatgtacatgaggaactcgagtgcacagcaggcggggcatcacggcgtcgcatcaagcataggacgacgctcatacggtaacggatgctgcttctggtttgaatacagaatcgatacatgcgggtttggcgttctgagactggtgaatggatatgagagtactgcttacgaggatccgtgagttgcgctggtcgatgagag

SEQ ID NO: 6795 - DNA, 959 bp, Glycine max
  misc_feature (1)..(3): n is a, c, g, or t
  misc_feature (12)..(13): n is a, c, g, or t
  misc_feature (26)..(26): n is a, c, g, or t
  misc_feature (65)..(66): n is a, c, g, or t
  misc_feature (70)..(70): n is a, c, g, or t
  misc_feature (758)..(758): n is a, c, g, or t
  misc_feature (898)..(898): n is a, c, g, or t
  misc_feature (959)..(959): n is a, c, g, or t
  Predicted polypeptide sequence is orthologous to G782
nnnaattccacnnaattccaaggccntacatatacacatagtaagaaaactaccacggaacaaannctgnacctccaccgcggtggcggactgttctagaactagttatcccccggactgtaggaattcgggacgaggtttaattgggaaacattttagaccctgataggcccaaaaatgacaaagcatccattctgtgtgatacaattcaattgctgaaggacctaatttttcaagttagtaaactcaaagatgaatatgctatgctaaatgaagaatctcgtgagttgactctagagaaaactgatctcagggaagagaaggtttttcttaaatcaaatattgaccacttgaataatcagtatcagcagcagctcaggaccatgtttccatggactgcaatggagcattcagttatgatggctccatcatcgtatccatatccagtgccaatggcagtacctcctggtccaattcccatgcagccataccccttctttgctaatcaacatcctgcagtcatctacaacccctgttcaacttatgttccttatttagcccccaataccattgttgaacaacaatccaccctgtacgtatcctctccacttcatgcaggtgctcggcgcaatgtgtcaggagaacaagagtccaagagcaagtcatccagagagagcatggctgagaagatgaggtatctaatgatgtcactacagaccttgagatgaagactactgtgtcttctgcagatcaggatntatcatcctgacatagaatatctagctagttgtcagggagtgaaagcagctgcactgaatggagttcactacgtacgtgttcttcttgtagcgttcagactagtcattaagcaacgtaggtgctgaccagaacgcagacngactgacaaagcttactaagataatcaacgtcttgcgtcttgaagccgctgaagctttttn

SEQ ID NO: 6796 - DNA, 668 bp, Glycine max
  misc_feature (35)..(35): n is a, c, g, or t
  Predicted polypeptide sequence is orthologous to G789, G1494
cgcccgagagtgtcaatagaacttccgtatgactncaattaatacgactcactatagggaatttggccctcgaggccaagaattcagcactatatgtttcaaatgggtatgggaatggctacaccgcctttccctcctattcacaatccgatgcaattaccgagactgccgcttgatcagtctgtatctgcgtctcagacaccaaaccagacattaatgagccaaaatcctattttgggtgcctttaattaccacaatcagatgcaaaatccagctctttcagagcaatatgcgcgttacatgggctatcatcttatgcaaaatgcctctcagccaatgaatgtattcagatatggtccccagggggtacggcatagtcaaacaatgattacacccagcaacagcagtggaaacatgagtggagcagcaaatattgatgaggctgtgagtggcaaaatgggttaattagtttcaaagcatgcttttgagtacctatggcgtaactaacaagataattgcaagatgatagaagcccttgtaaggcttgtatgctttcacaatatgtctgcctgttcatacagtggctgatctacaggtatgtgagggtctagggtcagcacttgtacttccttatctgtttaatagattattaaatttggtaatcaaat

SEQ ID NO: 6797 - DNA, 964 bp, Glycine max
  misc_feature (853)..(853): n is a, c, g, or t
  Predicted polypeptide sequence is orthologous to G791
acatgcaaataccagccattacttcataatagtatcagatgccaaatacagtcaaagccaccactgaatccagttacttggaacacttagaagataataactaaaaagctataggaaaatgattacaacttttgagccaaaatggaagcccaaataattgtacaatgccaacttaggcaaccggtggacggagtacatgatcctgtgaggtatccacggcggccggaggcataaattgccacatggcaactcccggatagctgatgaaaggcaccaacttgttgccaggggcttggccttgtggagcaaatgcagcagggattgcaggagggggtggcaagaaagcaggttgagcattcattgattttacctgcacctccaacttctctttctctgccttaagcctctgtttctcatcacgaagttcattcttctcagcctttaactctttaatcttctcttgaagactcgtatttgagtctttcaacttcagggcttcatcccgcagctgtgtcaccattcgggcagcatcaatcagaatggaagccttgtctgttttgggaggccttccgggctccaagatggagcccaattcaacaaacttgtcattaagcctatccctcctcaacttctcccgacacgctttggagctagaagcagtacttgaatcagatttagtccttttcttcaaagcaggattttttaggccatcagaatccccaagcgaagcatcaatttcgacactgacattggcgggaggtgggggccaggagaaggtggaagcggagacggcgaaggaggagtcgccgacgggaataacgtcgtcgtcgatcaacgggtaatcgaacagccnattgctgttttccggggaaccatggcgcgagctcttgggatttttgggggaaattctcaagttgagtgtgtgttattgtaattgagagtgtgatttgggagagaaatgaga

SEQ ID NO: 6798 - DNA, 952 bp, Glycine max
  misc_feature (1)..(1): n is a, c, g, or t
  misc_feature (30)..(32): n is a, c, g, or t
  misc_feature (34)..(34): n is a, c, g, or t
  misc_feature (37)..(37): n is a, c, g, or t
  misc_feature (41)..(43): n is a, c, g, or t
  misc_feature (45)..(45): n is a, c, g, or t
  misc_feature (48)..(49): n is a, c, g, or t
  misc_feature (908)..(908): n is a, c, g, or t
  Predicted polypeptide sequence is orthologous to G791
naacaagcagcagaaccgatagtgcagtannncnccncccnnncnccnncagcgagctgaatcagtgaagagaccgctgcgcgctataaccctcactaaagggaacaaaagctggagctccaccgcggtggcggccgctctataactatgtggatcccccgggctgcaggaattcggcacgagaaaacgtgcaagcaaaccccacacccccacgcaacaacagtccccatttgttccccagcaaaacaaaaacaccgcgtcttccccgtgcgggaaaaaaaaaagaatcctcaattttccgggaaaacccttcagaatggtttcccgggaaaataccaattggctcttcgattacggcttgatcgacgatattcccgttccggatgccacctttggcgtcaattcctccgccttcacatggccccctaacgccctcgacgctccttccaatgtcggtgttgacattgatggctcattgggggattctgacggtctcaaagagtctggctcaaagaaaagagttaggtctgaatcatgtgctgcttctagctccaaggcatgtcgagagaagttgcgaagagataggcttaatgacaagtttgttgaattgggctccattttggagcctggaaggcctgccaaaacggacaagactgctatcctgattgatgctgtccgaatggtgacccaattaaggggtgaagcccagaagttgaaagacactaatcatggtcttcaagacaagattacagatgtgaaggctgagaagactgaacttcgcgatcagagacagaggctcaaggcagagaatgagaagctggagcagcagctgaaatcatctgatggactagctagttcatgcctcccctgctgcattcctgctgcattgcgtgcaaggctagccacgncaacaagtgtacctttattactatcaggagtgatgtggcaatca

SEQ ID NO: 6799 - DNA, 791 bp, Glycine max
  misc_feature (1)..(1): n is a, c, g, or t
  misc_feature (565)..(565): n is a, c, g, or t
  misc_feature (791)..(791): n is a, c, g, or t
  Predicted polypeptide sequence is orthologous to G791
ngggatggaggagtacgccaagcgcgcaattaaccctcactaaagggaacaaaagctggagctccaccgcggtggcggccgctctagaactagtggatcccccgggctgcaggaattcggcacgaggagtaattgggtgttggattatgattatctagacaacattcctctcaccacccttgaaccacccaatttctcttggtcttcctcctctcctcctcctacactcagtgtggagctagatgactcatttggaattttggatggtctcaaggaaaacaggtcaagaaaacgtttgaggccatctgattctaaagcatgtagagagaaaattgcgaagggatcgactaatgacaggcatctctactctatttcatttatcctctttttatctatctttttcttttctctgtttttgatctaatctactagctctctctcacgtgacttgttctaaacattgttttaaaggtttatggaactggggtctatcttggaccctagaaagcctctcaaaatggacaaggctgttatattaagtgatgcagttcgagttgtttctcanttacgagaagaaactcaaaagctgagggagttcactgagaatctcaagacaaatcaatgcttgaagatgagaaaatgagcttcgcgatgagaagcagcgactaaaagtagagaaagaaacctttagcagaagttaagctttgagttaccacctaactttctgctgcagcaggccagttgtgcgacacctgggcatttatgggctacccaggatttgccatgtgcan

SEQ ID NO: 6800 - DNA, 898 bp, Glycine max
  misc_feature (853)..(853): n is a, c, g, or t
  misc_feature (855)..(855): n is a, c, g, or t
  misc_feature (895)..(895): n is a, c, g, or t
  misc_feature (898)..(898): n is a, c, g, or t
  Predicted polypeptide sequence is orthologous to G801
aggacctacatgatcacatggagcgttgtaggctgactaaagggaacaaaagctggagctccaccgcggtggcggccgctctagaacttgtggatcccccgggctgcaggaattcggcacgagctttacttcactttacatgtcgaactccgacgccaccactaacggcgtcagtaacggcgccatcattgatgcgcagagacagcaggccttagccgttaagaagccgccgtctaaggaccgtcacagcaaggtggacggccgagggcgccgcataaggatgccaatcatatgcgccgcacgtgtgttccagctcacgcgcgagcttggccacaagtccgacggtcaaaccatcgagtggctcctccgccaggccgagccctccatcatcgccgccaccggctccggaaccacccccgccagcttctcctccactttcacgctccttgatggtgttttattcgttttcagaggtgactggtgtgtgaaagatgaaaaaaaaaaagaagaaagctctggttgtactctgtatgacttctgctctgagatttttatcttcaattcttagccatttcttagattgatcagcgtgagaataatgttttcttgtatgtaagtggattgtttcgggtgccagaataaaaacccgtctgtttctttctttaaaaaaaaaaaaaaaaaactcgaggggggcccggtacccacttcgccctatagtgagtcgtattacgcgcgctcactggccgtcgtttacacgtcgtgactgggaaaccctggcgtactcaacttaaatcgcttgcagacatccccctttcgcagctgcgtaatagcgagagggccgacgatcgccttncnacagtgcgcagctgaatgcgaatggacgcgcctgtacggncan

SEQ ID NO: 6801 - DNA, 596 bp, Glycine max
  misc_feature (567)..(567): n is a, c, g, or t
  misc_feature (571)..(571): n is a, c, g, or t
  Predicted polypeptide sequence is orthologous to G802
ctccaaatgaagctaaagaaaaatgcacttcttcgaaagagaagaagtacaaaaaaacagtgactagagcaacatctaattagaaactcaactcaagtactgtggtgagctaactagcatgcatccatagatatttcaaaagcactcactaatcacaaattcattcaactcaacttccaaccaaataaagttcattgggagctattaggatcatcttctccactctcacttggttgagattgatgctgatgttgatgatgatcggaattaacattcaaactagcccttgtgtaagcattaagtgctgccaacatgcccaagttggagtcggacatggcgaggcccagatgctgttgctgcggcattgacatggaccccaactgaagcgaacccgcacgtgcgccttggaattcaagtgcacccggaaccggaaggttgaaccttggcatgaaaccactcacactttgaggaaacggccacatctgagtctccgaggaagcagaagacgaagcccccgcggtaacgggaagcatccaaattgtgctaccagggggcccactggcgggngagngtgccacggcccacatcgctgttgc

SEQ ID NO: 6802 - DNA, 512 bp, Glycine max
  Predicted polypeptide sequence is orthologous to G805
tttttaattttttttttaccaaagcaatcaaacttgcgcttcttgcatatttttgcaaatggacataacatatatattacgtatttaatatatattatgcaaatcactaattagtagtagagctaatagtagtaataatagcactaggaataatatagtaattaaaagaaaaattaagaagctagcatcagatcatacacttgtgattattttgaccctcaggaatgttgactggtggaatcacgtccatcgtctccgctgtgatgttgcccggcactgcccggaggctccgagacgccgttcgccggaatctgcctgtaggcattaagggctgcaagcatgcctaagttactttcacttagaagttgagcaccgccgttgccaccaccgccgccaccgccaccaacgataccggaacctagttgacctccgggcataaggttcatcggagaagcgaaattcatgaaatgaatgccacctggagcagacatagctcctctatacacaccact

SEQ ID NO: 6803 - DNA, 1009 bp, Glycine max
  misc_feature (1)..(1): n is a, c, g, or t
  misc_feature (439)..(439): n is a, c, g, or t
  misc_feature (737)..(737): n is a, c, g, or t
  misc_feature (743)..(743): n is a, c, g, or t
  misc_feature (784)..(784): n is a, c, g, or t
  misc_feature (798)..(798): n is a, c, g, or t
  misc_feature (837)..(837): n is a, c, g, or t
  misc_feature (841)..(841): n is a, c, g, or t
  misc_feature (850)..(850): n is a, c, g, or t
  misc_feature (935)..(935): n is a, c, g, or t
  misc_feature (953)..(953): n is a, c, g, or t
  misc_feature (977)..(977): n is a, c, g, or t
  misc_feature (979)..(979): n is a, c, g, or t
  misc_feature (1005)..(1005): n is a, c, g, or t
  misc_feature (1009)..(1009): n is a, c, g, or t
  Predicted polypeptide sequence is orthologous to G805
ntggagctggagtacgcaggcgcgcaattaaccctcactaaagggaacaaaagctggagctccaccgcggtggcggccgctctagaactagtggatcccccgggctgcaggaattcggcacgagcggcacgagaattcaacaagcgaaacaagagcttcgggaagaatccggcgggggcggcggtcttgaatcggtggcttctgattccgatggaagcttagggagaaagagaaggccagagcaagaactatcacaaatgggaagctatttgatacaatcaagcacagggtcgcttccggcgagccacgcttccaatacggcggcgttttggatggtggcgggtcacggcaaccaagccatgagtggtggtggcagcggcggcggtggcaacaatggtagcagcgataattatcccatttgggcaattccctctgttgngaatagtggtgtgtatagaggagctatgtctgctccaggtggcattcatttcatgaatttcgcttctccgatgaaccttatgcccggaggtcaactaggttccggtatcgttggtggcggtggcggcggtggtggcaacggcggtgctcaacttctaagtgaaagtaacttaggcatgcttgcagcccttaatgcctacaggcacattccggcgaacggcgtctcggagcctcctggcagtgccgggcaacatcacggcggagacgatcgacgtgattccaccagtcaacattcctgnggtcanaactatcacaagtgtatgatctgatgctagcttcttaattntcttttattactantatattctagtgctatcatactactattagctctactanctantagtgattngcataatatatattaaatacgtaaatgatatatgtatgtccatttgcaaaaatatgccagaagcgcaagtttgattggctttgtnatattgagtcaagatgcnggtttgtttgaaccttagttgatntngctgagttgtctatgtaggtttattngaan

SEQ ID NO: 6804 - DNA, 991 bp, Glycine max
  Predicted polypeptide sequence is orthologous to G831, G1202
ccaatcaatttacatgctttcccactatattaaaatttgatgaaaagctgcctcaaatattccagggcccataattttacaaagaatttttcacttttaccactaacaagaatgagagtttgaaagaattgactcatgagaaaattcacaataaaagaaaaacagaatcctgaagcatatcaaactaagtgctagctgtgttggtttctctctggtggtggggatgtccagtactcttttactgctaccagaatcttctgtctctcataaggcccttcttcatggtctgtaattctggcatcccattgcatttcatctgcaatgatcttcaccttcgtcaacacatccacatcatctctcaaaatgacactgccttgtggccgcaaaatccggtccatctcgagaagaatgtccaccatatcacatctgttctggtagaggctaaaaaccgaatcaccatgtatgaagtcataagttcgcgggtaagtggacatggcttcacaccagttctgataggttccaatcaatccacgttcatacacaacaccaagggtgttgatttcagcctcaacagggacaatgttcatgacccacacaggatcatcaactagtgcagctgcaaagcctcccaagtaagcattcatatcaagcagatttctgtatctcccacgctccgctagttgatgatccagtttcttgtagtatgccaatctctttttccataacttggtattttctgtgaacatctcagccgttattccttccaaactctcacttctaatccttgggggaattgaagttagtctattaagccagttagccaatcccccaccgccactaacttctttgatgttctttacctcaggaagtggggtcaagcatgtatccagcttagtgtaccatgctgtgtctggatcctgtgcctcaccacataagggtctactaccactcttgaagatctttcgcttgagttttgcatgtgcatgaatgg

SEQ ID NO: 6805 - DNA, 454 bp, Glycine max
  misc_feature (309)..(311): n is a, c, g, or t
  Predicted polypeptide sequence is orthologous to G831, G1202
tcagtttagaggtttctgtgtttatttttgatcaggagatggtgcagtccaatactgcttaactgcaaacaaaatcttttctctctggtggggccccttttcatggtctgcaattctagattcccattgcattgcatctgtgaaactcttcaccttcaacaacacatccacatcatctcgcaagattacacttccttctggcctcaaaattcgatccatctcaagaagaatgtcctccactttacacctgttctggtagaggctaaaaactgagtcaccatgtatgaagtcataagttcgagggtaagnnnacatggcttcacaccaattcatataggttccaatcaatccacgttcatatatggcaccaagtgtgttgacctcagcctcaacaggaacagtgttcatcacccacacaggatcatcaatcactgcagctgccaagcctcccaag

SEQ ID NO: 6806 - DNA, 773 bp, Glycine max
  misc_feature (19)..(19): n is a, c, g, or t
  misc_feature (21)..(21): n is a, c, g, or t
  misc_feature (23)..(23): n is a, c, g, or t
  misc_feature (25)..(25): n is a, c, g, or t
  Predicted polypeptide sequence is orthologous to G839, G1196
gcgatgaaacccctgcagnangncncgcgcgtaatacgactcactatagggcgaattgggtaccgggccccccctcgagttttttttttttttttttatgaaaatattttcaaaatacatgagcaagttgattacaaaaggtactataacatcaactttcctgctttcacaattttacagatgagttggtaggcttcacctttcaaatttgcactatatataatatgtatgtcaaaataaaaaacgctatgtatgcttttattattacactttcctagccttgtaatgtacaacagaatctctgagggatgatgaggatgatgaagatgaaatcccagagcggctaaactcggccttgtccatgttgaaagccttgtggacgtcatctttaagctccatgaaacgtgtccttttgattctctgctcttcattagtacccttttcaaggtaaaacaagtcaggcaagtcatcctccatgaacttatccaacacttccgagcaatgcgggaagtagcgccgccccatctccactgttttcataagggcttccattctagaaaaaagtcttttactttgaactataggagtttcattgagatcaacctcccttaagtttccatttgaaccttttgagtttgatgcagaaagaccagcaaactcagatgttgtctcagcatgtgcaatgtccatggctagtttggcttctgaaaggaagaaaagtcttgcaaatgccactctgttctcaaggtatagtagtttcatggtgagatcat

SEQ ID NO: 6807 - DNA, 955 bp, Glycine max
  misc_feature (812)..(812): n is a, c, g, or t
  Predicted polypeptide sequence is orthologous to G843
aaaatactataatatattcatttatttttctccacatcacatgggtctttatctagttatttttcttaatgggggaaaaggagaagatttttttttttttttttacaaaaatggccttgtaatcattgcatagcattttattatgtttgcacaactccttttgtcacaagcatatcgtaaactctatcaaccttgcttggctctaccttaaacagtgcatgtgcatcggatttcttggtcacactgccctttgaaatctctaatgacaaggtctgcagcatgttgagatagtgtgagggtagtattctgatctcatcacaaagctttttctcagattcagatagtaattcagcccctgcaaatccactaatatcccactcttctagcgaccttgtgaagacttgtatggcaggaggtgaatccttggcaccagcaaataaagctgcagtccccttttgaagaccctgcgggctactatcaacttctcctttgagagaatttggcctctgtaatgtcttagcacttgttccaatctgaccactttctttacaggcacttggttcagcttcctttgtcctcttttgttcaataaatcgataagcatcagcagcagttacacagcccgcaattcgagcttcctgtaaatcttgtattcttttgacaagcctgtgttcttcaataatattttttagcaaatcttgatgctcttcttttgagtgaaaccgcatgaagaccttgtaacgctgacatatttgaagctcttcaggtaagagagatttctcaaaaggatcaggataaagtaaatctctttncagtataaaattctttctgcgcttccgttcatctaacctttttgagtagatatggagcacctgcagtttcatttcatattcagcttcagtatcagtgtccttaaattcatatcagccacacttgctctgcatcgttgtcgtat

SEQ ID NO: 6808 - DNA, 790 bp, Glycine max
  misc_feature (718)..(719): n is a, c, g, or t
  Predicted polypeptide sequence is orthologous to G849
atcatgagcaaagataatttttacattttgcatgtcatcatcactttttacatggttgataaacagagaggcttcataaatgttttattgaaagcaaaaaaggaaaagacactaataacaaaagtcagaaaccaaggcaccctcatcatccacatggccacttgctgctgacaacccctgaccctggcccttattattattaaaaggagaagacagtttcagtttctggatggtgcttgtgctgtgacttagtctgttgctgggaccaatatgcgtgggccactagaaccctgtccaaaagttcttggggaacaggttcacccctcctttgctgaggggatattcttgccgtgtgcaccagtgttttcaatttatccttcaaatccacatatgtccgatgatttgcattatcaaaagcacaaagcttaacatcacgccaccttccagttcctagtttttcaactgcttgaaccagtgcttctacttcatctacagaaaaaggcctgcgtattcgacgctggacgatctcagatcgctttggcttctggtgtacaggtaccatagctagttcctcatccatttcaggaacagtaaccagttctttggaatctttcatatttttgtcaacagacacattgacaggagaaggtgctgaatcatggtcactttcaaaatgtctacctaaactggttacttgatgctcaggtaacatgtcagnnttgccttgaatcctctgatgaattacagctggactggagggataccttattacaggctcagttatgtcagc

SEQ ID NO: 6809 - DNA, 848 bp, Glycine max
  misc_feature (20)..(20): n is a, c, g, or t
  misc_feature (567)..(567): n is a, c, g, or t
  misc_feature (650)..(650): n is a, c, g, or t
  misc_feature (656)..(656): n is a, c, g, or t
  misc_feature (674)..(674): n is a, c, g, or t
  misc_feature (681)..(681): n is a, c, g, or t
  misc_feature (730)..(730): n is a, c, g, or t
  Predicted polypeptide sequence is orthologous to G849
cgtggatcccctcgtgtgancccgcccagcgcgcaattaaccctcactaaagggaacaaaagctggagctccaccgcggtggcggccgctctagaactagtggatcccccgggctgcaggaattcggcacgagaaaaggattattgcatttgcaggaacaggaaccaccccagaggcttttactgcaatcagtttcggagggagaaggatccaaagtctcttctgtcgttgggggttgtaaacaggaagatatcagttcagcaaggagtgacattttggattcagatagtccacattacaccgatggagttcactctgcgctgctagagcatggtgattcttcttatgtgtttgagcctgatcaatcagatatgtcacaagatgaagaagataacctcagcaagagtctctacccttcgtacctctttcccaaacttgaagaagatgtggattactccgacccacctgaaagttcttgtaattttggatttcctgaggaagatcatgtcctttggacctgggcttactactaagtttttttctttcatgtgtgtgtttgtatcatgntgttagtatttagtatttgcactttttttttcaaggctttaaaaatgagcaataagtcagagcaatggctatagctatagctntagctntattaggaaagaaatggngggcttntttgcctcatttgttattgtaatgaacctgtggtttcgatgaattaaanaaaaaaaaaaaaaaaactcggggggggcggtacccaattcgccctattatagtgataccgcgctcactgggccgcgtttacacgtctgaatgaaaaaccctgcgtaccaactaatgcc

SEQ ID NO: 6810 - DNA, 765 bp, Glycine max
  misc_feature (18)..(18): n is a, c, g, or t
  misc_feature (295)..(295): n is a, c, g, or t
  misc_feature (765)..(765): n is a, c, g, or t
  Predicted polypeptide sequence is orthologous to G849
cggacttgacactgtagnagcgcgcgtaatacgactcactatagggcgaattgggtaccgggccccccctcaaatttagctgataagtgtagtttggagggccacttagaattgtatgtatctcctgcactaattgactcaaaaagtaataagaaatctccatttcataggaaatcttttcccagtgcttccttttccaggaatgggaatggtattaagttaggttttagagatgatgacgaaaactttttaaggtgcaaaaagttttgcacgaagccaaaggcttttaggtctncacgacgcattgcacaccgaagaatcaggaatttgatgtcttccaaatactggaagacagctccaaagttgaaggactctgaactttctagatctgaatttgcagatctaggagtacctcgttatcataagaggaagacttgttacggttttgaaagatctcagcacaatgccattgttaaaaagaggaaattcgttgaccgggtttcaggagtaacttctgatggaggattcagtagtgagagtgtgtccaattcaccacagaaagggatggatggagacaagcctagctcatctgcaaaattgcatgtacctaaggctaaggattctcatgtaaagtttagcatacagtcaataaggattccagagctttatattgagggtcctgaaacttcaactgttggttcacctaagaagactatcgtggaggcagtgatggctatactttgaggtggtgcacatgttggtgtn

SEQ ID NO: 6811 - DNA, 960 bp, Glycine max
  misc_feature (817)..(817): n is a, c, g, or t
  misc_feature (839)..(839): n is a, c, g, or t
  Predicted polypeptide sequence is orthologous to G852, G2633
gaagcatagctacgaaaagccactctcctaatattctaatttctaggaaatcactttccccagccactgagccaaacattcagggaccagaaaagattttgaaatgaaagattaatattgctgataacgaaaagctacctacagtttcaattgaaattcttgaaacacagaaaatggacaattagattggatttaatgttgagacctttgtcattaacttgtacatagtaatggaacagaaaaagaagagggatgttatgccttattgcagaactttcatttccaagcgcaagaagcaaccaaatctctattcatccaacccagataaagagctccatctctctcttgaagtctatatctatcactgtagttctcgagcaacttcttgatggtaccattcaccaatgaacttaaagggtaaggagtgaaaccggccattgcaaatcttgacctccacttgccgagcacctcatgtcgttccaccctctcgaccccttcacaagctatgatgttaaccaagtctcttgccaaacaatgttgctcaacattgattctctctttatgctctctggaaagagtcacatctattgactcaaacattgctgtgtaatagtccagagtttcaaggaaacgtggaaagaatgcagcagtgttggtgttagattcttgctcaacaagtgtgaccacctttggtgataggctcctaaccaacctcaacagcctatccctgtgattctgagtactcacactttcatccggcatgtgatgtagcatgaacgcaaagtttacagccagagcttcccctggtcgtactccnaggttatgtagttgaacatcancacctgagatagctgcagcatgaaaatcaaatggcaccttaaaatgctcaacaagctttgataacctccttcccactatgtgtagtccgcccacgcgggcatatgctgatgttgaatcatc

SEQ ID NO: 6812 - DNA, 875 bp, Glycine max
  Predicted polypeptide sequence is orthologous to G852, G2633
ggtagatgctccattgactttcatccacgttaaacacatgaaagtttgtattagcataagttgcacgttagtatacatctgagtctgaaccaagcgtaaacataacagatacagactaaacaagcaaacaaatactatactacatcaacactacgatgagtctcatgcaacaaaagaatttgtattggtcacttccatgctgaagcaacaattaagtttttgtcttcccacccaaaatgaagaccccccatttcctcctttatcttgaacttgtcacagtattgcttaataatgagattcctaattgcttctctcacatttgtgctcattggagatggagtgaagccagccatcgacaacctcgccctccattttccggcgacttcataccgttctattctttcctcgccctcacatgcaacaatgttgacaatgtcctttgccaggcattgcctttcgacattcatcctgtcctggctctcccttgggagagttgcatcaagtgtgtcaaacacagcagagtagtaattgtaggtttcaatgaatcttgggagaaaaggggaggtgttggtgttcatgtcctgctccacaactgtcacaatttttggattcaagctcttaaccatgcgaagaagttggtctctctcgttcacggtcgatacagtttcatcgcgcatgtggtgaagctggaatgcaaagttcaccacaagtgcttcccctggacgacagttgagcattgatggtgagacaattgacgtccttgacgccacagctcgaaactcaaatggcaatctgagttcctctgccagcttttcaagtctttgtcctatgatgtttatgccaccgatggaacgctgcacagactcaggatcgtc

SEQ ID NO: 6813 - DNA, 942 bp, Glycine max
  misc_feature (7)..(8): n is a, c, g, or t
  misc_feature (74)..(74): n is a, c, g, or t
  misc_feature (800)..(800): n is a, c, g, or t
  misc_feature (901)..(901): n is a, c, g, or t
  Predicted polypeptide sequence is orthologous to G852, G2633
ccccccnnccccccccccccccgccgtgaggggatgagctgcataagtaatcgcgcagcgcgcaattatccctnactaaagggaacaaaagctggagctccaccgcggtggcggccgctctagaacttttgttcccccgggctgcaggaattcggcaccaggtgaacttccccttgcaactccatcacacagctgatgagagtgttcatgtgagcaacccaagggatggacttttgagattggtaaggtcactttctcccaaggtgaccacattggtggagcaggaatcaaacacaaacacaacccctttcttcaacaggttcattgaaaccttggattactacttggcaatctttgagtccattgatgtcaccctcccaagagacagcaaggagaggattaatgtggagcaacattgtctggccagggatattgtcaatatcattgcttgtgaaggcaaggaaagggttgagagacatgaactgttcggcaagtggaagtcaaggttaaagatggccggcttccagcaatgtcctttgagttcttatgtgaattctgtgataagaagccttctgaggtgctattcagaacactatacactggtggagaaggatggagccatgttgttagggtggaaggacagacatctgatatcagcttcagcctggcattgtaacacatagactgtgtagtagtagaaatattatgatgatgggggaagctgatcacggtttatgattcattgccagtgctatctcatctcatgtactagtgtagtagtacattgatgctgttatacnatgtcacgtatgctaactgatcttggtctatgaatacttcgatcttgcgcctgatccctatgaactatgggaatcacaagattttcgactgactgcctcantaaaaacattctgtaggcgtagacttcgtgcactcttattt

SEQ ID NO: 6814 - DNA, 800 bp, Glycine max
  misc_feature (1)..(1): n is a, c, g, or t
  misc_feature (36)..(36): n is a, c, g, or t
  misc_feature (800)..(800): n is a, c, g, or t
  Predicted polypeptide sequence is orthologous to G852, G2633
nagcacttattaccatgattacgccaagcgcgcaanttaaccctcactaaagggaacaaaagctggagctccaccgcggtggcggccgctctagaactagtggatcccccgggctgcaggaattcggcacgaggagacaatgaagtactacttggctgtttttgaatcgattgatactgttcttccaagggagcacaaagagaggattaatgtggagcagcattgtttggctcgcgaagttgtcaacttaatagcatgtgaaggagaagaaagagttgaacgccacgagcttctgaataagtggaaaatgcgtttcacaaaggctggatttacaccttatccattgagctccgttattaactcttcaatcaaggatcttctgcagagctaccatggacactacactctagaagagagagatggtgcactatttcttggttggatgaatcaagttcttattgcatcttgtgcttggagctaacagttcattttttgttactccaggcttctagttaggttatgtatcatccttaacttctttatacaatttctcctcacttcatagtcaaattactgttttgtaagagaacttccttaatcattatgtcagcagtgcaagtaatatcaagaaagactatatatcctgacatttctgaggtgtatttagaacatgaatgcttgcaaagatcagaatgatggcaatttataacatcaagtatgtagatgaaatctatagcggaagcatgagtttgaaactggcacttcttgttcttactccttagcttcttttttagcttaan

SEQ ID NO: 6815 - DNA, 653 bp, Glycine max
  misc_feature (8)..(8): n is a, c, g, or t
  misc_feature (14)..(14): n is a, c, g, or t
  misc_feature (21)..(21): n is a, c, g, or t
  misc_feature (32)..(32): n is a, c, g, or t
  misc_feature (181)..(181): n is a, c, g, or t
  Predicted polypeptide sequence is orthologous to G852
ttgataanctatgnaccatgnttacttccaancgcgcaattaaccctcacttaaagggaacaaaagctgttgctccaccgcggtggcggccgctctagaactagtggatcccccgggctgcaggaattcggcacgagggaactagtctcagtttttttttttttttttttttttttatagntcttaagctattcattgtcacttaaaggagagctcttacattatacccttagaaagctattcatgttagatcgattcagggaatacatatataaactcaaaaaactgaagggaaaatttaaggtttacctatataattgaaaaaaataaaaggaaatccaaacatgcattcacaaacaaaatgattattcaaacccgtggtaaccgtggaatatcttgtaactgaagaatctttctcacagtcttcatgatccatgcaaattgcgagaggagaattgagacatactttgtattttgtgtatcagttggaagggaaatcttggtctttgtgggaggggcttttgctgctgttgggtgaatgaagaggtttatgagtcatcatagccaagctgaaagaatgattgagataattcgccaatggattttgagaacctgaactcaacatctgatagtggttgatttgtctcggatcc

SEQ ID NO: 6816 - DNA, 831 bp, Glycine max
  misc_feature (32)..(32): n is a, c, g, or t
  misc_feature (218)..(218): n is a, c, g, or t
  Predicted polypeptide sequence is orthologous to G852, G2633
aaaaagtatgaaataacaaaaatgaaccagtnagtcattgaatcatcacctccaagcacaagaggtaataagaacttgattcatccaaccaagacatagagccccatctctctcttctagagtgtaatgtccttggtagctttgctgaagattttttattgaacaagtaacaaaggagttcaatggatatggtgtgaatccggccatagtgaaacgtngatctccacttcttcagaagctcatggcgttccactctttctgccccttcacatgctattaagttgacgacttctcgagccaaacaatgctgctccacattaatcctttctttgtgctccctcggcagagcaacatcaattgattcaaaaatagccaagtagtagttcattgtctcaacgaaacgggggaagaatgggaggttgttggtatgtgattcttgctcaacaagtgtcacaatcttaggagacaagcactttgccaatctcaccaaccggtcacgatggtttcgactatccacacattcatctggaacatggtgcaacatcatggcaaagttcacagcaatagcttcaccaggttgaagtgcaagatctttgagttcaacctcagtgggagcagctcgtatagcatggaactcaaagggtacattatatgattgtgcaagccttgataaccttgctccaacaatttcaaggcctccttccctggcataagctgaagtggagtcatcaaaacctgttattctaatcttgggggggtgctccaggtctgccagcaacagcttgggattaggcttacccactgaattccctggttaatctgaaaatcaat

SEQ ID NO: 6817 - DNA, 700 bp, Glycine max
  misc_feature (303)..(303): n is a, c, g, or t
  Predicted polypeptide sequence is orthologous to G861, G1140
tttttttttaggtaagaataatttttttatgatgacaaagtatagaaagtaagaaacggccaaagcatgaccattaactcgggcatatataacacttcctatgaatcaatctacgaaaagaaaatagaatacgaattcaagtacatgcaattctgcctgcagaacctcatccctaggatttacttactttgcaggagtagtttttaaacagcaaacatcactggagctcaactggttttgagtgaaacacttaaaacatatataaaggaagcgaacccggtcacttctaataatctacatttngttgaatacttaaggtaaccccaacttgagagatgtgtcgctaccaccatcttcaggaaggttagatgaattgctaagaatggattccgatgattgcctatgtacatggataaggctcggtaccacctgtttcagtctttggttttcctccattagttccactccctttctcttaagcgtgctgatctcttgcataagtttttcatcctttacttttgaaacattgatcaaacctcttttaaggtgttcctctagtttatgcagttctggtaatgtcaatccttgcagatcttccccattcatctgcctcagctcacggttcttatcttctactttcttgcgcaggatttcattggagtcattctcaatctgcagctcaattgaggggcgatccagt

SEQ ID NO: 6818 - DNA, 722 bp, Glycine max
  Predicted polypeptide sequence is orthologous to G861, G1140
tttttttttattttttttaaagacaaataatatttatttatttttcaaaaaataaaaatataccaaacactgggttatcacatctgacataatggcaactgcaatgttctgtttagtttagcaaataagttgctccagctgtgaattttttcccgtggtaaaatctagcattacatgcactccactcaccagcaaatggttaaatacgaaaaaacaacattgatcttggctgagacagaaatagaaccaaatgcgttaacttctcactatagtcttctgaaccaacatttttgtttcattcaaataaagacaaccccagcttgagagatgtgtcagaattaccacagtctggaggaaattcagatgaactgcaggtaaatgactcgtatggttgcctttgttctcgtacgaagctctgcttcaatttctggttctcttccataagtttggcttccttggttttaaggtgattgatctcttgtataattttttcatccttaatttttgaaatagtggtccaacgtctttgaagaagttcctccactttctgcaattcttttattgtcaatccttggatctcttccccattcaactgactcatttcattagtcttatgttctatttcctttcgcaggatgccaagggagtcacttccaagctgttgaccaatagatggattaactaatccttgaatccctgaatgccgatcacgcctttcaagt

SEQ ID NO: 6819 - DNA, 742 bp, Glycine max
  misc_feature (1)..(1): n is a, c, g, or t
  Predicted polypeptide sequence is orthologous to G861, G1140
nggagtatcacagaaacaccagagggggctaatgaaagcgaaggaggctggagctccaccgcggtggcggccgctctataactagtggatcccccgggctgcaggaattcggcaccagtggagaagaactgcaaggattgaccctaagggaacttcagaaattagaagaacgacttgactcatccttgaaccgtgtttataaagcgaaggttgaaaattttataaaagagatcggtattcttaaggaaaagggaaaaaaactcatggaagataacatgctgataaaccagatgataaaattaccgaggaatgaaatatgttcggtccagagacatgagcatgaacaaggccagctctttgacacctccctcacgttggggctaccttttcctgctggctcaaagtagagtttctgagcaatgaggggaccatgatgctgcgttttaattagtgtgaaaactgaaaaggaagagtgaatcaccaaggataaaatggttcacgtatgttcaagtataatagattctagtaattcatgtttgttattagtgggaccgtaatggatatggtttagctatgatattatttcaaaagcatatgtttagactgattgctatgtatcatttataggtgtaagagttaattatgtacatgataaccctattgaacacccttgacatttagaagtcatgatgtgcactagatatgcatgattgttgcatgagtgtatgcagaatagatgctg

SEQ ID NO: 6820 - DNA, 594 bp, Glycine max
  Predicted polypeptide sequence is orthologous to G861, G1140
ctttccttcattggtggctttcaacccaaagctgaaatcatctaaacatggcaaaccaaaccgaaccaaaaaccaacattcctaatatcaacgccttcccccaataaggaaagtaaaaatcaacaagtacatccttactcagctctctctttcaacaacatcccaccacacactaacaccaactccaactccaactccaagtcttcccctaactaacaccactaacaacaatcactaaaaaaagaaagaaaatttaccctgatcgcaggatctccgaacaaagctttgatttcacaaaagctaaatttagataaacacctgcatattaaatttttctgctctatacatgcatcacatgtccctcacactaaacaaaagaaaaacaccaccaccctttgcttttgcttttctataagtagtcaacggctcagccttaatttctttgctttttttaggttaaggtacatggtcagggagaagattcagattaagaagatcgacaacgccacggcgaggcaggtcacgttcttccagcgtcgcagagggctcttcaagaaagctgaggagctttccggtatgtgtgatgctgatgtt

SEQ ID NO: 6821 - DNA, 484 bp, Glycine max
  Predicted polypeptide sequence is orthologous to G861, G1140
tgaaaggcatcatttgcactcaaagaatctagcaaggatggagcaaccatctctcgagttgcagctagttgaaaacagcaactgctccagattgagcaaggaagttgccgaaaagagccatcaactaaggcagctgagaggagaggatcttcaaggcttaaacatagaagaattgcaacaattggagatgtcacttgaaactggattgggccgtataatagaaaagaagggagagaagattatgagtgagatcgctgatctccaaagaaaggggatgctattgatggaagagaacgagcgactcaaacgtcacgtggcggggataattaatggtcaaaggcatggtggtgccgaatctgagaactttgttatggatgaaggtcagtcttcggagtctgtcacgtacgtttgcaattccactggactcccccaagactatgaaagctcagatacttcgctcaaattggggctaccatactccgcc

SEQ ID NO: 6822 - DNA, 855 bp, Glycine max
  misc_feature (811)..(811): n is a, c, g, or t
  Predicted polypeptide sequence is orthologous to G866, G883
gaaataaacaacttgagattccatttttcacctctctgtgagtcatatgacaactaaaatataacaataaaaaataaaaacaaatttacaaagcagctattgcttttgttcccactacactctccaaaaattataatatatttttagaaaaagtcctccacttccaattttttattggaccctctctctctttctctctacgttgactcgaacaccaaccccaccaccccggctgcgttctcctgcatcgcggcctgaacggcgtgcctgtgctccccctcgtacgtcactatcagcatcgccggatcgtctggtgcgcgctccacgtgcttcctcgctgggcaccctctcaccgtgctgcacttgtagtaaccccttgggtatggggaacccttgatcggtttctgaccgtactttctccacgagtactcgtcgggtggaatatcggcgatttttgaactaatcgccggcactctcactgtgttcttcaccctatttttccttcgcttaacgcagtggcacttgctgttgccggagacgtcgccggagtgttcgcggtgttcgtggcaccgcttcttgaacgctggaggttttcgggcggaggtcgccggcggcgccaggaagatcttcccgttggagacgctgccatcgccggtgatcgcggaggacatgaaggacgagttcgatgaaacgctgaaggtctccttcgagaactcgagctcaacagatttcgcgttggagctcagaagcgcgttgtgcggcttcgtgaaatcgagcgtcaccggcgcgtggtgaacggccaccggcgaangagaaggaactgcaccggcgcgggaatattagggttttgcggcg

SEQ ID NO: 6823 - DNA, 789 bp, Glycine max
  Predicted polypeptide sequence is orthologous to G866, G883
aatataataacagcacaataatattttctttcaataaggtcagatttacattgcaaccaccaccttaattcaattttcctattcacctcttttttttttcctactacaaaaaaaaagccccccaacagttcccctttctttaattccacactcacgttgactcgaataccaaacccactcccccggaaatgttctcctgcatcgcggtctgaatcgagtgtcggtgctccccctcgtacgttacaatcaacatcgtcggatcgtccgaagcacgctccacgtgtttcctcgccgggcaccctctcacggtactgcacttgtaataccccctcgggtacggtgatcccttgatcggcttctgtccgtacttcctccacgagtactcatccggcggaatatcggcgaccttcgaactaatcgccggaactctaaccgttttcttcacacgattcttccttctcttgatgcagtggcacttgctggagccggagagtttcccggagatgtcgtcggagtgctcgcggtggtcgtggcacctcttcttgatcggagcaaacgagagaggaggttttccggcggagactggcggaggagtgaggaagagggaggatcctagtttgccattggagacgctaccgtcgccggtgatagcggaggacatgaaggaggagttggaggagacgctgaaggtttctttagagaactcgaggtccatggatttggcgttggtggtgttgaacatgttacgttttgagaaatcgagggttagactctgtgaccgacagcaac

SEQ ID NO: 6824 - DNA, 806 bp, Glycine max
  misc_feature (637)..(637): n is a, c, g, or t
  Predicted polypeptide sequence is orthologous to G866, G883
aggttgggttaaccccccccccccccccccccccccccgcgggtgagcgcgtgcgtatgcgtccgcgaagcgcgcaattaaccctcactaaagggaacaaaagctggagctccaccgcggtggcggccgctctattactagtggatcccccgggctgcaggaattcggcacgaggcacgttgagcgagcccaggatgaccccaacatgctcatcgttacctacgagggagagcaccgtcatccgcaaccgcgtctgccggaaactgctgccggcgccggcgggacttttgccgctcatcctgtttaagcgacggtggatatcgggaaagtatggcaccgacagagatgagtgataaccgccgtttgcaattaacgggggggaagttgtaaccgtatattgtaacagtgggaggaaaagaaaaaaaaaaaaaaaagaagggaacttattgcaagcgagggaaagaaaagaaaaagaagcaaagtcaacttttgctatgtttggtttggctgggacctttgtggaccaaaagaatcgtctactagatggatagggaccttttctgtaaatttgacacaaaaaaaaaaaactatgaaatagtagtactatacttactttgtttttagaaaaagaaaggangggggtgcgggtgtgtggtgaaatggttatctcgtcacgcggtgagggtgtatctcttctgtctctatatgttaattatcttgtggggtgcggcgtcggacaatttctcctttgataggtggtattaacgcgcgttcggtgccgttgtttaacagcgggattggtggaa

SEQ ID NO: 6825 - DNA, 653 bp, Glycine max
  Predicted polypeptide sequence is orthologous to G878, G884
atctgctcttccttcaatcttagacgttgccacaggtcgctgctcattgccagtaacacccctgctgctggaactatgtttcacgtcgggtatggcaaacttttgtgcttttacctgggatgcactattgttggcaagtgtgtggctattagtcttagctgcaggcacatcatgattgtgttttccttcgtatgttgttatgacagctttaggatccattgaagccctctcaacatgcttccgaactttgcaaccttgggtcgtgcatttgtaatagctcctacatataataaaaacatgaatcactttcttttccaaagacaagccaaaggtaacaaaacagaatagtggagaaataagtgaaaataggcatggcaattctccccgcaactcggggatcctcatagggattgtcctattcgggaaaaaatttcccgcggggacagggatgaggatgaaaaacccccctgtgcagttaatttagggaggaagacgagaattatgctccccgccccataggatcctcgtatcccccacgtatataaaattttacttatatatcctcgtaacttataatatgtctaacataaatataaaggttaatatagtattttactagtaaaaaaaatacaaaataaaattatcatatatat

SEQ ID NO: 6826 - DNA, 898 bp, Glycine max
  misc_feature (884)..(884): n is a, c, g, or t
  Predicted polypeptide sequence is orthologous to G878, G884
gcggccgctcgcattttttttattttttttgcccttacaacttacaaggagtatttataaattatattatataataatgttcgtacattagttgaaatgatattcatacctgtaaacaacatcttatacaaccaattccataatttagatgtacaaaaagaaggtgttacatacaaaagaaactagaaaacaatagacattgccaactatgactagtgactacaccttcatattatattatccatttcatcttctagacaacttcattctgtactaggacgtggaataagtgagcttggcaccagacttttatactatgatttgctcttctttcaaacgcaaatgtacaggtctttggtcagtacttccaaaatccatatccttgagcaaaggatgtttctccggcaccacattatgtggttttaatggcattgaattgctactagctgtgttgtggctgctgtttctagcagcaggcacatcatgattatgtttaccctcatacgtggttatgacagctttggggtccattgaagctctctcaacatgcttgcgcacgttgcatcctgcactagtgcatttgtaataactccttggatgagggtttccctttaccactttctgaccatattttcgccacctgtagccatcatccaaaagatcaacttcacttcttgtttgcacgatgattttgggttctgtgacagtcttctgagacagaggtacttcagaaaccccaacatcagtattccttctcttagggtttggctcgccatcatctgcctcttccctattatctacatcacccacttcctcactctcacttgacccaggtagtagttgcctaggaggagcccccttgatggaggtctggtcacttttancaactgaagaatca

SEQ ID NO: 6827 - DNA, 662 bp, Glycine max
  misc_feature (483)..(483): n is a, c, g, or t
  misc_feature (490)..(490): n is a, c, g, or t
  Predicted polypeptide sequence is orthologous to G878, G884
atatcttttgcacctccagtgctccacgtccagctcgcaattaaccctcactaaagggaacaaaagctggagctccaccgcggtggcggccgctctagaactagtggatcccccgggctgcaggaattcggcacgaggtttttttttttttttttttttttaacattaagttgcaaagtttagagaccaatttatcattaaattgtcgcattaatttatcacacttttttttgtacattcaagaattaaatttaaaattttcatcttttaaggactaatttgtcaacccatcacactttcaaagacgaatttggctatttacgcctaaagttatgaactaagaaagctatgtgatctgctcttccttcaatcttagacttgccacaggtcgctgctcattgccagtaacacccctgctgctggaactatgtttcacgtcgggtatggcaaacttttgtgcttttagctgggatgcactattgnttggcangtgtgtggctattagtcttagctgcaggcacatcaatgattggttttccctttcgatgttttatgacagcttttagatccattgaagccctctcaacatgcttccgaactttgcaacccttgggtcgtgcatttgaataacttcttggaaaatggttgctttgaccactttt

SEQ ID NO: 6828 - DNA, 949 bp, Glycine max
  misc_feature (1)..(4): n is a, c, g, or t
  misc_feature (572)..(572): n is a, c, g, or t
  misc_feature (622)..(622): n is a, c, g, or t
  misc_feature (719)..(719): n is a, c, g, or t
  misc_feature (800)..(800): n is a, c, g, or t
  misc_feature (818)..(818): n is a, c, g, or t
  Predicted polypeptide sequence is orthologous to G878, G884
nnnnaaggagagtgataaatgcctctgccacctcaataaccctattaaagggaataaccttttttttttttttgatgaaatgatgaacaactatattagacaacattatttacacttttaatgtacacaaaaggtacaaatagtacaacatcatcaaaaacctgtgttcactgggcaaacctgtttaaaccttttgcccttgcctcttgcatcagtgttgaactatttgtttattaggatttgcactgataggccctgatcaaaacttaggccttagactaaaaaagaatacgataacatcaaaataaagatgacaagtgaggtgagaaaaattcttcctcactggatgtttctttcagaaaactaagtgatctgctcttccttcaaccgaagccgtgcaaccggctgttgttcatttcctcccatacctctgctgccaaaattatgcttctcaggattggtattatgcgattttaactgtgatgcagtattgctggccatagtgtggctgttattcttagctgctggcacatcatgattgtgttttccttcatatgttgttatgacagctntaggatctgttgaagccctctccacgtgcttccgcacattgcaaccttgngttgtacatttgtaatagctcctaggataagggttgcctttgacaactttctgcccatattttcgccatctatacccatcatccaagagatcaactncacttgttgtttgcacaatgattcgaggctcagtgacagtcctatgtgaagaagctgcatctgactgcgagactgctgctnttctcctctttgggtcangctcaacatttctctcatccacttcgtttcatgatcgactacttcttgctttacttgtactgataatgatcagctgtgctgacttgttctgatcatcttaaacatcattcgagtggccttgatatgaacta

SEQ ID NO: 6829 - DNA, 824 bp, Glycine max
  misc_feature (700)..(702): n is a, c, g, or t
  misc_feature (763)..(764): n is a, c, g, or t
  Predicted polypeptide sequence is orthologous to G881
ctcctacttgatggtatctctatactggtggtacctgtacctgcgactgcacttgacttaaatgactcattacagagtcagtgattaacatgatccgcggaaaaactgaacaaacaaatcaatcgaaattagaggatcatatcatctcacggtcacttcaatttcagatccaattgagacagatagaaaacactaaataaagcagattatccaagccaatcagtatactataaatcaaactgaagaaagtcaagtcagatctaatattaataatgtttcaacatgatttgaactttagaaatcaattgcaacgctaattcgattggaaaaagaagaaagcatgtgtggctgaccttgttcactgggcagcttggggcatatgaacacttgaagtaagccctaggagaagggttatctctggtgacttttttaccatattttctccactgatatctgtccctcacatacttcaacacccaaaaacaaattaaggaacctcagttagtacttagcatcggcaaatacttacacaaaacagtctaaaaagttatataattaagcacatgctattgattgagtaatgggaccaagtaaattaattttacacataaaaatctgtgatggcatatatataatttccttgcaaggatctaattaagtaaataactctagttcatacttacatatatagaactactcnnncaataacagcagcaaatagatagatcttaaaaaatcaaatactagatgacttgatattgannatcaaacttactaagccagtatcaaatgagtacaggacacaaattaaagtctactgtata

SEQ ID NO: 6830 - DNA, 824 bp, Glycine max
  misc_feature (1)..(3): n is a, c, g, or t
  misc_feature (824)..(824): n is a, c, g, or t
  Predicted polypeptide sequence is orthologous to G881
nnnttgggaagcaagcgcgcgctttaccctctacattaaggggaacaaaagctggagctccaccgcgggggcggccgttctagaactagtggatcccccgggctgcaggaacaagggcatgagttcaaatcaaatagggtcagtaacagtaccacctatgtttgatacaaacaagagaccgagactagagcttcccacagcaaaaaagccattacaaatctttgtcagaacacaccccaaggatgatagtttgatagtaaaagatggctatcagtggaggaagtatgggcagaaggttaccaaagacaatgcttcaccaagagcttatttcaggtgctccatggctcccatgtgcccagtcaaaaagaaggtgcaaagatgcttacattataagtcaatcgttgttgcaacttatgatggagagcacaaccatgcggccattcatgagtcatcttcatccacatctaaaggctcatcaccagtggttaataacttacctctgatgacaagcatattaaatgacaaagaacccatgaacattggcttggctctttcaaggtggtctcaaacagatcataggagacattgtgaagatgccatgcaacagaataataataatggtggtagcaacatcacaattgaagaatatgtaagttctctaatagaaaatcctgactttctcatgtcattagctggaggcaggtgggcgcacaatcgctggccagcaagagcgacacgatgtataccgttaatttgcatctttcgtgagagtgagatcgatcattcgttacctacgagcaagtagtgatgatgtaatgatgagn

SEQ ID NO: 6831 - DNA, 976 bp, Glycine max
  misc_feature (1)..(1): n is a, c, g, or t
  misc_feature (362)..(362): n is a, c, g, or t
  misc_feature (576)..(576): n is a, c, g, or t
  misc_feature (695)..(695): n is a, c, g, or t
  misc_feature (744)..(744): n is a, c, g, or t
  misc_feature (840)..(840): n is a, c, g, or t
  misc_feature (842)..(842): n is a, c, g, or t
  misc_feature (844)..(844): n is a, c, g, or t
  misc_feature (850)..(850): n is a, c, g, or t
  Predicted polypeptide sequence is orthologous to G896
naacgtgctttttagttcccccttgcgcgcaatctaaccctcactaaagggaacaaaagctggagctccaccgcggtggcggccgctctagaactagtggatcccccgggctgcaggaattcggcacgagagaaggtcaaacccatcttcgaatcaaattctaggaaagtaccaacgcgtcgctccttttggctttcagaaacaaaaagcttttgcgttcgatttgtttcttcctaaagactaatattctcattctccccaaaacctctgctagtttttggttttgcttcaacaccctcgtcctccttcttcttcacactcccccagaaatcccaattttgcccctaccctcttccccaatntacctacgatgtacagcaacatgctggtcaactgctccaactgccgcacccctctgcagctgccacctggcgcgggatccatccgctgcgccctctgccgcgctgtcactctcatcggcgatccacgcgccctcccttcgcagccaccggcctccacccacgcgcctcctcctccgtcctctccctacagccacgcgccgcccccgcccaaccnccacggccgcaagaaggccgcatcgtcggcatctcctaccgcttctcgcgacacgagctcaaaggatgcatcaacgacggcaagtgccatgagtacctctcatcaacaagtcagcttcncagaatcttcatcatcatgctccacgcagaaagagatcccatggcccanatttccacgaagcacaacattcaggatgggcatgtatgcttgcacacaagatgcacctgagatattccctgtttattaatctggccatgtacaganangnaccacntttgggtataactgatgatatataacctcttgtccctgattgacaacccagggatgatttgagatggataataggcacttgaactatccctaggctaactcaatgccattgtgcgctgcctaaggc

SEQ ID NO: 6832 - DNA, 837 bp, Glycine max
  misc_feature (689)..(691): n is a, c, g, or t
  misc_feature (697)..(698): n is a, c, g, or t
  misc_feature (716)..(717): n is a, c, g, or t
  misc_feature (773)..(775): n is a, c, g, or t
  misc_feature (782)..(782): n is a, c, g, or t
  misc_feature (785)..(786): n is a, c, g, or t
  misc_feature (788)..(788): n is a, c, g, or t
  misc_feature (795)..(796): n is a, c, g, or t
  misc_feature (798)..(798): n is a, c, g, or t
  misc_feature (805)..(805): n is a, c, g, or t
  misc_feature (811)..(814): n is a, c, g, or t
  misc_feature (819)..(819): n is a, c, g, or t
  misc_feature (826)..(830): n is a, c, g, or t
  Predicted polypeptide sequence is orthologous to G896
aattataatttataccttttatcaaatcaattcctaagatttgttgttccaaaaacatactatacaagtaattacatcaaatttatgcacatgatgtatgatcagtacgagaccatcactttcaagtcattattgacacttttcacgaagtaaaattggggtcacacgcacacctcctaatttatccagggttaagatgctcacctcttatgtggaattcaaatctgagtcgaatcagcattttcatccaaggattgcagcagcaaccaaagtcattattacaagagcatgtcacattctcaagggcagacataaattcatccaaacacatcctcagtgatttacgaaaaaagaatcctctctactttataatatattaatcattgtaatcaatgtagtcgtatacaggggcagagcctaggaaaacaaattgcagaataaagaatattgagtatcataatgaaaaaggttttctatgcacatcaaatgcttcgcaagctgttaactgtggttcctgtcccagtccaccgacaccgctgagactccctccagtcaaaagcatggagagaagggatgttaccacatcaccacccccggtaccgccgccgccgccgccaacatttctgatggaagtgcgcattgcagtaagaatgctgccataggtagccccatggccacgctctatggcnnngatganncaaaatgtcattgccccnntcgatgtaatttttgatagagcagatgtatcagctgaagtttgatgatcgtcgcannnactgaancanntnacttctnnancactagntccctnnnntacancggatcnnnnncgatggt

SEQ ID NO: 6833 - DNA, 986 bp, Glycine max
  misc_feature (1)..(5): n is a, c, g, or t
  misc_feature (678)..(678): n is a, c, g, or t
  misc_feature (901)..(901): n is a, c, g, or t
  misc_feature (916)..(916): n is a, c, g, or t
  Predicted polypeptide sequence is orthologous to G898
nnnnnccgacctgtatcgtcagcgcgcaattaactctgactaaagggaacaaaagctggagctccaccgcggtggcggccgctctagaactagtggatcccccggtctgcaggctcgagtttttttttttttttggtatataccaaatgtcatcatgtattaatatgataaattaagagaaacagctacccaacaacagactaagcatcagctatgagggaacatattagaaacaacacagccattcagtattgtccaaagtacaatgacgtttcttccaatccctgttctcctctttacagcttccacggaaagcctctaactagtcgatgggagatacacccttataagatctttcgcaacaaccttttttctacaggtagggcatttaccctgagcacttatagcagctttgatgcaatccttgcaaaaaatatgaccacatcttgtcgacatttcatgtaccatagggcccatacatattggacagttgaagacaagctcctttggaggttcaggtggctttttaaaactttgctccatggaactgctaccgccttccaaatttatatacttatcacaattaataatcagatttggcaattctcttcgcgtttggtgcgcctagtctgatctctgatcacataactatagtctctacgactcttctgaatgttntagctagcaaagccctgggtcattcacacatatcatcatgcttcacgcatcaatcgagtgagagctctgctgtgtcacttgactctgagcacgactggtcgagtctctgctacgattaccagtgttacggtaaggcagtccagtgctctctcgatacttgaagagtctgctgcggagcatatgccctatcaatcacaatcacgtgaagcaccacggagggggnggggggggaggcgtnctaaggtcccgtattgcctttaagttgatgaaacgtcataagctagaaccttctcctgttttaaagccct

SEQ ID NO: 6834 - DNA, 876 bp, Glycine max
  misc_feature (28)..(28): n is a, c, g, or t
  Predicted polypeptide sequence is orthologous to G898
cccccctgcgctagtatggtctgactangattacgccaggcgcgcaattaaccctcactaaagggaacaaatgctggagctccaccgcggtggcggtcgttctagaactagtggatcccccggtctgcaggggatagctctcaggaggacgactattgttgatttggactcagaagatgggaccggaggagttctcaaaaccaaacaatcatcaatggcgatctttatgtaaattgggccaacaacagcagttctgcgagtgaaaatgctaagaagacacctgaacctcccaaggagcctgaagctcctaaggagcctgtttttaattgcccaatatgtatgtcccctttggttgaagaaatgtcaacaaggtgtggtcatattttttgcaagaattgcatcagggctgctatatctgcacaggctaaatgccctacctgtagataaaaggttacaaagaactcactaataagggtgtttcttcctgcaactagttaaaggatctctatacaatcattaattgaggagaatcaggatttaggaatgtgagaagaagcttcattgtactctgcagaatgctgactggctctgttgttgctgacatgtctgttgtagcagatgcttatttatttacaaggagctgattctcctgattaattcgtcatgtaatacatatggatgctgtgtagcttatgtaaatggttcatagacctcagttgtgttacttctcatatgtatctgtcactgaaatattgtatgaaccaagaaaaaaaaaaacgaacttcagggggggccccgtacccatttcccctatgtgtggagtatttacacgcgcttactggccgatcggataaaacgagtagatgggaagagctg

SEQ ID NO: 6835 - DNA, 1205 bp, Glycine max
  Predicted polypeptide sequence is orthologous to G912, G2107, G2513
ctcactctatctcttttctccagcagcaccaaaaccacccaacactcgaactcaatatccattattaccaaaaaaaaagaaaaaaggatatcaaacacccttttcatcattaaaactctcagttccctctttccctatcaaaaccctttcccacaacactactcactccagtacaagaaaccctttttcaatttggtttcaacagcacacacacacacacatatatatatatatagcatgtttaccttgaatcattcttctgatttgtaccatgtttcccctgagctctcatcttccttggacacatcctcgccggcttcggagggctctcgtggcgtggcattttccgacgaggaggtgcggctggcggtgaggcacccgaagaagcgggcaggtcggaagaagttccgggagacgcgccacccggtgtaccggggggtgaggaggaggaactcggataagtgggtgtgtgaggtgagggagcccaacaagaagaccaggatttggctggggactttccccacgccggagatggcggctcgggcgcacgacgtggcggcaatggccctgaggggccggtatgcctgtctaaactttgctgactcggcctggcggttacctgttcccgccacggccgaggcaaaggatatacagaaggcagcagcagaagctgcccaggctttcagaccagatcaaaccttaaaaaatgctaatacaaggcaggagtgtgtggaggcggtggcggtggcggtggcggagacaacaacggcgacggcacaaggggtgttttatatggaggaagaagagcaggtgttggatatgcctgagttgcttaggaatatggtgctcatgtccccaacacattgcttagggtatgagtatgaagatgctgacttggatgcccaagatgctgaggtgtcactatggaatttctcaatttaataatgtgttttggtttggtttttgttgttagttttttggagtgaacagtgtctgtactggttttttattagtagtacggatactagttataggtggaaagattgcgagggaccaaaaggaattttcttttgaacccttttttgtcaatgtaatcaatatcacgtatatcatgaagtgaatcccttcaagtttatgtataaattaaataaaagaaaaatctagttttggttatgaatctttgttaaagtaaaaaaaaaaaaaaa

SEQ ID NO: 6836 - DNA, 872 bp, Glycine max
  misc_feature (1)..(2): n is a, c, g, or t
  misc_feature (781)..(781): n is a, c, g, or t
  misc_feature (797)..(798): n is a, c, g, or t
  misc_feature (840)..(840): n is a, c, g, or t
  misc_feature (852)..(852): n is a, c, g, or t
  misc_feature (872)..(872): n is a, c, g, or t
  Predicted polypeptide sequence is orthologous to G912, G2107, G2513
nnaaggatttatctctctgatacgcccgcgcgcaattaaccctcactaaagggaacaaaagctggagctccaccgcggtggcggccgctctagaactagtggatcccccgggctgcaggaattcggcacgagatgagaattacaaaaacaactgaatgagaaaatttgcaatgtcttacagttttatgatcctccctatatagctagctccttatatcgtctcggtcttggtacattttcgtactcctccgttcctaattatgtacaaaaaccaaaaacgaaagaagacaaagaacaaactaaacgcactaaattgtgaagctccacaaggatacctcagcatcatccttcacaaagttccagacatccctaacattaacatatgttacaaaagtaggcgatcttaaaggctcatccgccatactctgaagccactcacgcatgtcctcaaaaaccggtgcatctgccattgtaatttcatccaaatcacaaaaaactctcaaacctttgttgctattggaatcttcatcaaagctgacgtcacttctgctaacttcacaatcatcagcaacggcatcattcacaatactattctgtaactgctcgccgcagctgtcttccgccgcaatcgctacagcagccgccgccgccactcgccgtatctccttcgcatttgtcgacgccggcaatggcagccgccacgccgagtcggcgagttgaggcaagccgacttgccccgaagcgcgagcgcccgcgacgcgtggccacgtgcggccatctnaggcacttggatcgtnncagccaaaatcctggtgggacctgtcgtgggacacgaacctngagacccaattngtgtgtccttctcggactcn

SEQ ID NO: 6837 - DNA, 886 bp, Glycine max
  misc_feature (588)..(588): n is a, c, g, or t
  misc_feature (603)..(603): n is a, c, g, or t
  misc_feature (623)..(623): n is a, c, g, or t
  misc_feature (689)..(689): n is a, c, g, or t
  misc_feature (700)..(700): n is a, c, g, or t
  misc_feature (750)..(750): n is a, c, g, or t
  misc_feature (758)..(758): n is a, c, g, or t
  misc_feature (764)..(765): n is a, c, g, or t
  misc_feature (798)..(798): n is a, c, g, or t
  misc_feature (805)..(805): n is a, c, g, or t
  misc_feature (834)..(834): n is a, c, g, or t
  misc_feature (860)..(860): n is a, c, g, or t
  Predicted polypeptide sequence is orthologous to G921
acatgtcgaatgatcattacgccaagcgcgcaattaaccctcactaaagggaacaaaagctggagctccaccgcggtggcggccgctctagaactagtggatcccccgggctgcaggaattcggcacgagattccaagagcacaaagcctaaaggagattcacctaaagtacctcaggttttggtggaacagatggctacttctttgaccacggatcctaattttagagcagcacttgttgctgccatctcaggaagattgttgcacaataattaaatggaattttggtgaagtgttgctaatttagtgtcaattgtttaagtattccataaaatagagatcattctttagagcaaggggtctctctatgtaaatacaacatggaaggctgggacatatttgatcctttaaagtggaaataaagttccactaaggatgacatgttgagctgattaaacaacagaaaatcaagctctgcaccaccctctgcctcatcatgatggtaaagatttagcaagtcttttttggctaatatatctaggatacctcaaattaaatttcatagtaggttgtagcacacattctcgngaagatctttcatanagtgcatctctacggcaatntaatttctcccttttcttctctcactactctctctggcaagccaactctatatctagtcctagttntagaattgcantcagaaatatattatacattgatcagtattatagtgatggatgtactcanacatgganaatgannaaaaggtcgcatgaataagttcgatcatgattngtatttngagtgggtcgtataatgaattgaatgtanatgggatagtttatagcggtatatanaaaaaaacaaaaactcgagggggccg

SEQ ID NO: 6838 - DNA, 945 bp, Glycine max
  misc_feature (1)..(2): n is a, c, g, or t
  misc_feature (727)..(727): n is a, c, g, or t
  Predicted polypeptide sequence is orthologous to G921
nntttgccaggaggttaggcaggtgcatgcgcgcatttgaccctcactacagggaacaaaagctggagctccaccgcggtggcggccgctctagaactattgtatcccccgggctgcaggaattcggcaccaggagaattacaacactttgcgaggcaatttgatggaatacatgaggaagaatccggataaggagcacagctcatcaaagaaaaggaagtctgaaagcaacaacaatagtattccaatgggagtcaacggaacctctgaaagcagctcaactgatgaagaatcctgcaagaaacaaaaggaagacatcaagactaaaattcaagagtttatatgaggacagaagcatctgataaaagccttattgtgaaagatggatatcaatggaggaaatatggacaaaaggtgaccagggataacccttctccaagagcatatttcaagtgctcttttgctccaagctgcccggtcaaaaagaaggtgcaaagaagtgtggatgatcaatctgttctggttgcaacttatgaaggagagcacaatcatcctcacccttctcaaatggaggtaacaacaggctccaaccgttgtatgactcttggttcagtaccatgttcagcgtctcttagctcttccccaccaacagctacccttgactggacaaaatccaagtccagcagtgagtctaagaatactaagtccataaccgaatcaccagaangtccgcaggttatgttagagcagatggctacttgcttgaccaagatcctatttcagagcagcacttagtgctgccatctcaggaaaaatgttgcacaataaataaagtagaaatgagtgagtgtattcacctattcattagtgatcttgttagagcatagatctctatgaaatacacataggacattgctactattaattctcaatttattcaatcct

SEQ ID NO: 6839 - DNA, 582 bp, Glycine max
  Predicted polypeptide sequence is orthologous to G922
gggatctgaacgaaaggaaagacatgaaaagctggaaaagtggttccagagatttgatctagctgggtttggcaacgtgcctttgagctactttggtatggtgcaagcaaggaggttcctgcagagctatggttgtgaaggatacagaatgagggatgaaaatggttgtgtgttaatttgctgggaggatcggccaatgtattcaatatcagcttggagatctaggaagtaagagaattagagggatatattgatgttttttcttttcttttctttctttctttttatttgtatgagtgttttattcttatggtaatgactgttcttcaagatagttttttagagatactctttattcattgcctggtaaaactccatcaagtaagaaatttgggaagacaaaaaaagggtagaaggacggaagaagtagaagtcttaatcggggttctgtttatggttcattttttgcagctgatcattttattttttatgaatatgagctcctgtaccctacctggacctagtatattacataatataatgggtttggttattaaaaaaaaaaaaaaaaaaaaaaaaaaa

SEQ ID NO: 6840 - DNA, 873 bp, Glycine max
  misc_feature (845)..(845): n is a, c, g, or t
  Predicted polypeptide sequence is orthologous to G922
aaacaaaaacacattatattatgtaatatactaggtacaagttagggtacaggagttcataattcataaaaaataaaatgattagctgtaaaaaatgaaaccataaacagaaccccgattgaaacttctacttcttctgtccttctaccctttttttgtcttctcaatttccttacttggtggggattttaccaggcaatgaatagagtatctctaaaaaaacgatcttgaagaatagtcattaccataaggataaaacactctcatacaaataaaaagaaagaaagaaaaaaaaacatcaatatatccctttaattctcttacttcctagatctccaagctgatattgaatacattggccgatcctcccagcaaattaagacacaaccattttcatccctcattctgtatccttcacaaccatagctttgcaggaacctccttgcttgcaacataccaaagtagctcaaaggcacgttaccaaacccagctagatcaaatctctggaaccacttttccagcttttcatgtctctcctttcgttcagatccctcacatgcaatgatgttcttgatttcctccccaaaaagcatcttctccacccttaatctctccaatgatgttcttgagacagtggattccaaacaatcaaacaatgctgcaaaagaatatagagcttcaagtagcctatccatcagagttggaccattgtgattacagtcttgttctgtcacaaccatgacctttggtgataatccccacaaggcattaagaaagctctccatattcattgaattggaagtagttaaagatgccggtgaagatgaggttgagtcaggacttanagtgtacccattaaccatatctttctca

SEQ ID NO: 6841 - DNA, 776 bp, Glycine max
  misc_feature (619)..(620): n is a, c, g, or t
  misc_feature (632)..(632): n is a, c, g, or t
  misc_feature (707)..(711): n is a, c, g, or t
  Predicted polypeptide sequence is orthologous to G937
aaagctaaaccttaaaaaaaaactacaactgcctcttatcgttgaccctcttttttatgtatcatgtagtattattcttatgtagtggtaaaactcctcccatgtatacttttatctgcaaaattcatggtggagagtagtatcctatacatcaacttttcctggtttgttcatatgacttttccaactataactctcggatcttgcatcttcatcatcttctatgctgtcaccttcagtaggagatgtccctccccgggaccctgcagccaaatgaagaggactttgaggagaacctgaccctgaactgctaacttttgaagagtcattgtactgatcttgagacatccacaaacctccaagaaccacaactggctgattagaacttgcagcaggaactctccgcgtatgaagtcggtatttttgtaaatggctcttcacttcatcgttagttaggccatcaacctgcataagctctctaatttgctttggtgtagctgcttgagaacctccaagcttctgcaaggcattaacgaatcgtctgtgcaactcaggggaccagcacctcctctgtttcctagcagtctgctgaagcgaagtcgcacgcaaacccggctgnnccgtgggagganaagaagaaacagccctgttagaactgctccttgatccccttgaaccacacccttctttcacagaaggcgtcagannnnnaagcctattcctaacactctcttccttctcttctttggatgcagcccccagccccactgttgtca

SEQ ID NO: 6842 - DNA, 946 bp, Glycine max
  misc_feature (1)..(1): n is a, c, g, or t
  misc_feature (16)..(16): n is a, c, g, or t
  misc_feature (534)..(534): n is a, c, g, or t
  misc_feature (599)..(599): n is a, c, g, or t
  Predicted polypeptide sequence is orthologous to G938
naaggcaaggtaaggnatggtcgtgctgtattcgactactatagggaaagctggtacgcctgcaggtaccggtccggaattcccgggtcgacccactcgtccgcttcaagataagatgacagccaaggaaagtgcaacctggcttgcaataatcaatcaagaggaggccttggcgcgtgagctttacccggattattgccctccattagcagcctcttctggaggtagtggatctatggtaatcaatgattgcaatgagtatgatgttgaagggggtgacgatgagccaaactttgacgtcgaagatcgcaaacctgagaatcttcatgcaccgaatcttgggatggacagaatgatgggaagactgccttctttcccaatcaagggagaggctgttacaaatttggatttcattcggaagaggaagatctctggtgacttcaacatgataatggatcagaaaatttacacatgcgaacaacctcagtgcccttacagtgaaattcaccatggttttgctgacagaaattctanggacaaccatcgattgagttgtccttatagaggcagtgcttcaacagattatggaggttcatatnttcatgttaatgaggcaaagccggtcatattcccccaacagtcctttgttcaaccaaaacctactactactccgtctgttgtaactttgttccatctgtattgatctacacgacgtcgagtacagtagaatgcacgatatgatcactgacctatgtaatctatgatcaatgttcaagcacgacaatctagtgcagtaacatgttctgctaaaatcaaccttctcagcagcttcgcgcacatgccactcgtcgcatcatgattatatgaagaaactctgagagcgactgccacaaatgacaatttgcagggagcggaggtactgttgactttaggcacctggacatct

SEQ ID NO: 6843 - DNA, 934 bp, Glycine max
  misc_feature (1)..(1): n is a, c, g, or t
  misc_feature (12)..(12): n is a, c, g, or t
  misc_feature (51)..(51): n is a, c, g, or t
  misc_feature (665)..(665): n is a, c, g, or t
  misc_feature (693)..(693): n is a, c, g, or t
  misc_feature (712)..(712): n is a, c, g, or t
  misc_feature (738)..(738): n is a, c, g, or t
  misc_feature (774)..(774): n is a, c, g, or t
  misc_feature (804)..(804): n is a, c, g, or t
  misc_feature (931)..(931): n is a, c, g, or t
  misc_feature (933)..(934): n is a, c, g, or t
  Predicted polypeptide sequence is orthologous to G938
naaagagtgggnaagggggtcaacgcattatgctagcgcgcatttaccctnactaacggaacaaaagctggagctccaccgcggtggcggccgctctagaactagttgatcccccgggctgcaggaattcggcaccagtagggacaatcatcaattgaattgtgcatacagaaacagttctgcagattatggtggtggtcccaatttccatgctactgaggataagccagtcatattcccccagtcctttgttcaacccaacactacaacacagtctgcaagtttggttgcaccttcatttgatctaactggtcttggagttccggaggatggacagaaaatgattagtgaccttatgacaatctatgatacgaatgttgtaggaaacaagaacttaagttcctccaactgtgtagctgtagaaaatcataacctttctcaggccagcttacaacaacaagaaagttatttccctggtcaaggaatggtgttggaagggaacttctttgcacgagaggaaggtcaatttgaccggttcaaggccaccatgaacatgaacactcataccccttttgataccaaccatagcaacaataataatatccatttgatgtttaattccccttgtgatttgtcatcctttgatttcaaggaggatatacaangaggagtaggaatggatgctcttcacanacagcaagatgtttcaatntggtaccagtgaaaatgacaagaagngatactcgtgtatcacgggcttctatcgtgtcattnaaaggggacatgtgaaagcccttgactcanaaggcagctcatgcatcgtgctcccatgtaatcagttagactttagaattgtatgctttgcacgtctgggctggtgtatatattatggtttataaattatggtgtcccataatgtacccttttatgntnn

SEQ ID NO: 6844 - DNA, 945 bp, Glycine max
  Predicted polypeptide sequence is orthologous to G938
tgcgagttgacggctgatgtgatcacgccaagcgcgcaattaaccctcactaaagggaacaaaagctggagctccaccgcggtggcggccgctctagaactagtgtatcccccgggctgcaggcagttattaagcacatgtctcctgatattgcaaagattcgcaagcttgtgaggcagtccaaatgtcttcaagataagatgacagcaaaggaaagtgcaacctggcttgcaatcatcaatcaagaggaggccttagcaagagagctataccctgattatatccccccattagcctcagctggaggtagtggatctttggtgatcaatgatagcaatgagtatgatgttgaagggggtgaggatgaacctaactttgacgtggaagactgcaaacatgagaatcttcacacatccaatcttgggatggaaagagtgagggtaactctgccagttcaacagccctctttttcaataaagggagagactgttacaaatttggatttcattcggaagaggaaggtttctaatgacttcaacatgatggatctgaaaatttacacatgtgaacaccctcagtgcccttacagtcaagttcgccttggtttccctgaccgaatatcaagggacaaccatcagttgatttgtgcttatagaggtacttcagattattggggtccaagatttcctgttaatgagataaagccagtcgtacaccccccgtcctttgttcacccacatctactgctcagcctgttagatgttccacctgttatgatctagctgaactgagattagataatgccagaaatgatactgacttatgactactatgacacaatgtcgaggccacagaagacagtcctgtatacttactgagaaattcgacttgctacatgcatgcgagcacagacacttcattcggcaggatcatgcgagcacattt

SEQ ID NO: 6845 - DNA, 799 bp, Glycine max
  misc_feature (627)..(627): n is a, c, g, or t
  Predicted polypeptide sequence is orthologous to G938
agtgacagctttttgggtgattccgccaagcgcgcaattaaccctcactaaagggaacaaaagctggagctccaccgcggtggcggccgctctagatctagtggatcccccgggctgcaggaattcggcacgaggctgtgatccccctcagaggcggtttccgttggagaagggcgtttgtccaccatggtggcctactgggaatgaagagtggtggccccaaataggtttgccgaaagatcaaggtcctcctccttacaagaaacctcatgacttgaagaaggcatggaaaggtgggtgttctgactgcagttatcaagcacatgtctcctgatatcgccaaaatttgcaagctcgtgaggcagtccaaatgccttcaagataagatgacagccaaggaaagtgcaacctggcttgcaatcatcaatcaagaggaggacttggcacgcgagctttaccctgattattgcccctcattaactacttctggaggaagtggatctatggtcatcaatgattgcaatgaatacgatgttgaagggggtgatgatgagccaaactttgatgtggaagaccggaaacctgagaatcttcatgcatctaatctttggatggacagaatgaggngaagactgccagttcacagcctactttccaatcaagggagagggttttacaaattgtgattcattcgcagaagaagatctcttgtgactcttacatgatactgcatcagaagatttacacttgtgaaccatctgatagctctttacagtaaaacttgtccattgttttgctg

SEQ ID NO: 6846 - DNA, 588 bp, Glycine max
  Predicted polypeptide sequence is orthologous to G957, G961, G2535
cataattccagtagagatgggcacggacaatgaagggacattcacaacgcaccaggtgagtggtggtgacccaaacaacaacaacaacaacagcaacattgttcatccattggaggtaggatcaggtggtggaggcctcaccaactgggctgcgctggaccgtttagttgcatctcaactcaatggccaaaccgatgcctcttttttctaggatgtgctttcaacgaccccaccatgtattgcaccagcgtcgaccatcatgatcttcatcatcaaatccccaccctccgatcctcatcaacgtccgctaacacacgaccttcccctgcacccgcattcatcaaccccccaacacaggacttcaccagcgagattgacctttggaacttctcccgatccacgtcctcactgttggcatcctccgaaccactgtgccacgtgtccaacacgtcagtgtagcgagatcaataaaataataatataaaaaaaaatatctcaagtcccccttttcctccatgttcgattgttaaatatagaaataattagcccctacttcatcacatatcatgtttaatatttaatattagt

SEQ ID NO: 6847 - DNA, 511 bp, Glycine max
  Predicted polypeptide sequence is orthologous to G958
gaagcgtaatagcaaatactgaatttcctcaattattatcgtcaagataataaatacgcataagatattattacgtgaatacaaaaattttagctgtttcgtgcaggtgaatatttagaagtagtgcaatcccacggctattactaactaaactatatataatatatgaaactgacacgaaaacttccaattagaacacgagaactcagaagcctgacactaggattgaatagcatattcaaaatctgtaagaactacatccaaaagagttaattcaaaataaacaaggtttataacagatatttgcttgcttcagcagttcagcactgactacaaatatctccctagttataaggcttggcctaggtcttacacacacaccacataaattatgcagatgaacaagctgagaaagatttagattgggttggcagttctaaatactctttttataaataaaaaaacgcaaaagaatatcggaaattaaaccacaatttaaggcgacagcaac

SEQ ID NO: 6848 - DNA, 666 bp, Glycine max
  misc_feature (504)..(504): n is a, c, g, or t
  misc_feature (527)..(529): n is a, c, g, or t
  misc_feature (580)..(586): n is a, c, g, or t
  misc_feature (610)..(610): n is a, c, g, or t
  misc_feature (647)..(648): n is a, c, g, or t
  misc_feature (654)..(654): n is a, c, g, or t
  misc_feature (656)..(658): n is a, c, g, or t
  misc_feature (660)..(665): n is a, c, g, or t
  Predicted polypeptide sequence is orthologous to G958
ctgacttggacagagtacatcaggataccttttgcacaaagcagcaaactccacgaacatatagttcaacttaattacacaatctcactcgttttctttcataataatgctctccggcacaggcaagtgggtcaattttgcctctgaaactgttgattctgtaaagacaacaccatccatgttgcaaaaggaatctttgaccgcaaagggtgtccttgttgaagctgccacatcaaagctggttggggagacagaaaggtatgtagtagataaaccattaaataattcgtctttcttaggacaatcaataagctctttgttactagataactccagaccattcgatttatcttgggagctgatatcattatgcaataaatacagggaatcaccattaaacttttcccctgtctcaaaatttatgtccatatgtccaacttgtttgctcaaatgatcaatttgatcgtcatgatgagcattttcctggttattgataccattaantggtggcagatcatgatgagctnnntccactacatggaagtgtgatgtattttcaacagcgcccgtggatatgtcnnnnnnncttttgacattctgcacactattngatgtcttaattgcaacatctaatgatccatgaaaannatttgnannngnnnnnnt

SEQ ID NO: 6849 - DNA, 746 bp, Glycine max
  misc_feature (1)..(1): n is a, c, g, or t
  misc_feature (433)..(433): n is a, c, g, or t
  misc_feature (619)..(619): n is a, c, g, or t
  misc_feature (739)..(739): n is a, c, g, or t
  Predicted polypeptide sequence is orthologous to G962
nagcgcagtcgttcagtatgactgccagcgctcagttaaccctcactaaagggaacaaaagctggagctccaccgcggtggcggccgctctagaactagtggatcccccgggctgcaggaattcggcacgagcttttttttttttttttaatctacatactatccatctctctaccttatctctccattttctcttatcaatattaaaagactaaaacacacacacacacacacaaaataaacaaataccccatggtactctgcttctgcttgaacccctgactttgtctgtagtccagtccactttctcttcactttctaagttccactactgactccaccaaaacccctcaacacacccttcttctcatgttgaatgatcaaacaccttccacaagccatggcacagagcaacaccacattgacagtgcanaaaacgaaccacaaatcagagaaatctacgccttaactccccccccaagaagagaaccaaactttgaaacacacacacacagccacagccacctctcatcttctgtgtccatagaaggtggttccacccaaaatttcagcatgaatagaaaatgcagtactcttattctagcaagctcaaccatcnaccacaacatcaccaccccaagtcaaataagcttggacatgatgatacatagcgattaaagaaagttttatagcaacaacactgacaataacaataactacaacaacgttgggaagattnaagaaat

SEQ ID NO: 6850 - DNA, 777 bp, Glycine max
  misc_feature (704)..(704): n is a, c, g, or t
  Predicted polypeptide sequence is orthologous to G963
gaataataaacagttgcttcttattagaaaatttatgagcccatacacaaaacaaacttccatatacacagatcatgactagaaggatatataaagattttttttttactgcctacggggcttcacaattaatttcttacactattgaaggttttgagcaacttgtaatctaactaattaggaagcttcactggtagcaggagagggaggaccagtcacagtgccattctccattgtgaaatcaatgacaatgggtgtctcatccatagcttcttcctcactgctgctgctgctagaggtctccccttcagacctttttgccttctttccctttcttccttccttcttcgtcttgaatatgcgatacacagccatagctgacaccatggaaggatgcgatttcgagacgaggcgaaattcatgcatcacccaattcgatttggcaaaaccattgcccttggcttcccagaaagccaaaacgttctttcttgcaacaacctgttctttagagagctcaaaatcttgagctttctctattgttctccattgaccgttcccggcttctcacttgttgaggttttcgaacacacgggtcctcaaatcatggaagaaaaacctctgccaattcaaattcttactaccacctcctggcagctcccaaggcactgtttggtaaacatcacagtcttgaatgaagtcattangggatggttgggccatgatcctcttcctgagatagtaaccagcaagaatttcatcacttggatcgacagcaac

SEQ ID NO: 6851 - DNA, 648 bp, Glycine max
  misc_feature (12)..(12): n is a, c, g, or t
  misc_feature (18)..(18): n is a, c, g, or t
  misc_feature (28)..(28): n is a, c, g, or t
  misc_feature (52)..(52): n is a, c, g, or t
  Predicted polypeptide sequence is orthologous to G964
ttactactttgnacctgnatacgccaancgcgcaattaaccctcactaaagngaacaaaagctggagctccaccgcggtggcggccgctctagaactagtggatcccccgggctgcaggaattcggcacgaggcaatctcccattattattagagatgacggttgaaaaggaagatttgggtttgagtctaagcttgagcttccctcagaaccccccaactcatcttcatctcaatctcgtttcctcttctccttccagccacaaccctcagaaaccctcttggaacgaccctttcacttcttcaggtgtgtgttaagattctcaatctctcgtttgtttccagatctggtccaatttctttacgcacttcccttttctcttttactttaaccaggcacctactagctcgcttatttctcaaaaaaacaaacgcaccttagcggattaaccttttaattacccccttttttctctttccgttcttgcttttcatttccacaacttttgcagtttaacaatcattttcacttcttttcacgcctttcaagctcattcaaagcttcctaattttccccatccccctctttttacttcatactttagtatccaacatttttttaatcaaaaaaaaaaaaaaaaaaaaaaaa

SEQ ID NO: 6852 - DNA, 947 bp, Glycine max
  misc_feature (165)..(165): n is a, c, g, or t
  misc_feature (170)..(170): n is a, c, g, or t
  misc_feature (900)..(900): n is a, c, g, or t
  Predicted polypeptide sequence is orthologous to G971
caaaccccccccccccccccccccccccccaccaagggaacctagcatcgcagcagaacgactggttatagagattctccccctcgaggccaaaaattcaagctctcaatctgaagctaggagaaaacttttaaagaagcagggcaagaagggaaagaggggaanatagngagaaacgtttgctaacaatacttttgggtggtcaagaggttgctcaagggtggttgatgaccatcctgctctttaggatgtaattaatttctgttgaactagatgaggatcaatcgtatgacgaaaagggatcgtgtctgcagttattaaaaggatgaattactaatatttgtagttcatttattgtttgtaagatgttgttatttttaatttccaatgactaaagtccaatccgcaaagaatgtggttaaaattgcaaagtatccttgtgtctgtgtatttgtataagaaaaaaagcttattccctttagtgagggttaattttagcttggcactggccgtcgttttacaacgtcgtgactgggaaaaccctggcgttacccaacttaatcgccttgcagcacatccccctttcgccagctggcgtaatagcgaagaggcccgcaccgatcgctcttcacaacagttgcgcagcctgaatggcgaatgggacgcgccctgtagcggcgcattaagcgcggcgggtgtggtggtacgcgcagcgtgaccgctacacttgccagcgctctagcgcccgctcctttcgttatctcccttccttctcgcaacgtcgcggcattcccgtaagctctaaatcgcgagctcctgtaggttcgattagtgcttacagcactcgacaccacaactagataggtgatggtcacgagtgggcatcgactgaagacggtntcgccttgacttgagtcacgtttatagggctctggtcaactgacaca

SEQ ID NO: 6853 - DNA, 583 bp, Glycine max
  misc_feature (1)..(1): n is a, c, g, or t
  misc_feature (390)..(390): n is a, c, g, or t
  Predicted polypeptide sequence is orthologous to G971
ngggagagtagccaggggatgatgatcacgccaagcgcgcaattaaccctcactaaagggaacaaaagctggagctccaccgcggtggcggccgctctagaactagtggatcccccgggctgcaggaattcggcacgaggcgaacattggctatttggattttggaggctgagtggagcggctgttaggtcctttatgtgctgacttcacagatctatgagtattccttttcaacagaaaatgctcgaaaaatggtgtcttttcaggtttcttaatatatattgaaacatcactttatccaaatctagctagaggcaataaagaccacacataatacagagagagaaattaatatttggatgttaggttgctgagtggggttcatgttgnctatattattatagtaatttgttttatttagatcattagtttttaaaaaaaaaaaaaaaaaaaaaaacttcgggggggggcccggtccccatttcgccttatagtaagtctttttacccccgctaattggccggtggttttacaacgtcgtgattgggaaaaaccttgggggttcaccaaaacttatatcgct

SEQ ID NO: 6854 - DNA, 622 bp, Glycine max
  Predicted polypeptide sequence is orthologous to G977
taaattttttttttttttgaagtggaaactgtagtctttgatgttacttactaatggtatctataatgtagtccacatcatacatgcatgcgtgtttttgtaagattgattacattctggttccacatgcttgaccattaattgaaactcatggtgaaattctcctatcctatggtactaaggtctaaagctcactatatattttattacatggcgcattagtaaatagtgccatccctctccctgaaaaggggtctgcattgttaatttataataaagagcttaggctgagtgaacaaaactaatctccattgagccataatcaagaagctcctgtatcatctgttcaatgtgatcatcttgaagaactggctgaaattgttgctgttgttctagcagttcaacttgtccttcctcttctggccatctaaactgggtgttatctgaacttgttcccgcaatggaattgcctgagtcgttggatgatccttgatgaggctctgtctgagattgtttctgcttgctcatttgaagggaaagagaggccatgtgacacttgtgtagcttcgcagtcagagtagcagagaggagcttcgatgaagatgactgtggctcattggga

SEQ ID NO: 6855 - DNA, 801 bp, Glycine max
  misc_feature (1)..(3): n is a, c, g, or t
  misc_feature (40)..(40): n is a, c, g, or t
  misc_feature (48)..(48): n is a, c, g, or t
  misc_feature (50)..(57): n is a, c, g, or t
  misc_feature (61)..(61): n is a, c, g, or t
  misc_feature (63)..(65): n is a, c, g, or t
  misc_feature (67)..(72): n is a, c, g, or t
  misc_feature (74)..(74): n is a, c, g, or t
  misc_feature (76)..(80): n is a, c, g, or t
  Predicted polypeptide sequence is orthologous to G989
nnnaaggaggtggggggtggagggtggataggtggggggngggggggncnnnnnnnntggngnnncnnnnnncncnnnnntttggacagctatgaccatgattacgccaagcgcgcaattaaccctcactaaagggaacaaaagctggagctccaccgcggtggcggccgctctagaactagtggatcccccgggctgcaggaattcggcacgaggtttgatatttcaaaaggttaaaattgctaaaaattaatttagttcttaaaatgtttttttacttagacttggtctggttcacttggtcttttagatggtctcgccttattctttttacatggtcttgggtggttttagaaacactttttttccctttataaatatcaatatttctgaaccctcatcttaagagttcttgctcccatgtctttttccttttccgagttcccaagccattacttgaaaagtctcctagttctgtcgcaccaactattgctgggaagagagtatctcttctccatctcacggcactttgcacggatgtgcacagtctgcccttgccgaccatgcgaatgcattctctgcttgtctcctaccctgctcacctactccacccctactgagctctcgccctttggtccattcttcgactcactacctctcctccacacccgacatccttcgtcggttgttctctcatcatatatgtacgcaccgcgcgcgtccgcgtccctcttttctcctctctctcgttatatctcgtgctcctacctctgtgctgtcgtgccgttcttgtgcggttgg

SEQ ID NO: 6856 - DNA, 726 bp, Glycine max
  misc_feature (277)..(277): n is a, c, g, or t
  misc_feature (339)..(339): n is a, c, g, or t
  misc_feature (387)..(387): n is a, c, g, or t
  misc_feature (413)..(413): n is a, c, g, or t
  misc_feature (432)..(432): n is a, c, g, or t
  misc_feature (444)..(444): n is a, c, g, or t
  misc_feature (478)..(478): n is a, c, g, or t
  misc_feature (550)..(550): n is a, c, g, or t
  Predicted polypeptide sequence is orthologous to G1013
aggtgggaatgcagctctacgataggccgactttaatacgactcactatagggaatttggccctcgagtttttttttttttttttttaaacacaatatcattgccaaatactatttattccaaacaaagatacaagttattgattcagccccccagcgacaacacctttcaaagaagcacaacttatttattcatctgtcacaaattacattaataaacacatcatactccaccggcaccagcggcaccagctcgtgccgaattcccgactacatantcagggatccgtcttaattaaacggccgcaagcttattccctttagtgagggttaattttancttggcactggccgtcattttacaacatcatgactgggaaaaccctgncgttacccaacttaatcaccttgcancacatccccctttcaccanctggcataatancaaaaaggcccacaccaatcacccttcccaacanttacacagcctaaatggcaaatggaacacaccctatagcagcacattaagcacagaagatgtgataattacncacaaggtaaccactacacttaccagcaccctagccccccctccttttactttcttcccttgctttctcaccacgttcgccagctttccccatcaagctctaaaatcaaaactccctttaaagttccgatttagtactgttacacgcctcgaccccgagaaaattaaattaaatga

SEQ ID NO: 6857 - DNA, 343 bp, Glycine max
  Predicted polypeptide sequence is orthologous to G1017
ttaatattacaatattagttgatcatgataatagcatcattattatttgtacactaataaccaacaatgccaaccttgataaaatacttggtttttagtaaacaatgtgtaacaaccatgataaaagattcagttcatgttcagtctttgcagaggtaaatagagttaagactgtccttcaactactcagatctcaacaatgtctcaaatgctatctatagcatattttaagcaaatatgctcagagggcctgtttggtttgatggatctagtccatgttcaccattacgaattcctgtaataaaggccctgcaaaaaacagatttgggaggaaagctcgtgc

SEQ ID NO: 6858 - DNA, 951 bp, Glycine max
  Predicted polypeptide sequence is orthologous to G1017, G2567
gggttaattaataattaatattagaatagcaattgtccattatacaggaaaaatcattattttctacacatgggcatcgaaaacaaggacgccaatattgtttgaattttcagttcatattagcatctctaacaacagagtaataactgtgtccttcaacatctcatatctaaaaacaatatctcagatgccatgacatgccacaccatattaagcaaatataccaagaggacctgtcttatttgatgcagtatccaatccatgttcagcatttcgaattcctgtgatccaaacccttctactatctttgttgtttgaatccgtcagaattgtcaatctttttgctgtcttcatgaactcactgaagggttcctctccagtttgcttaagagcaccagctgcgtcacggtagagaacatgactcaacatctcagacctttctattccaaacatgttagccagtctcatgtacaactcttcatatgaaccaagacaggacaagtcaagggtccgtcccacatcctctgactctatgaaaaccttgcaatgactggtatccgaaccaacttgccaagagaactcggtggtagaagatgactttccgggtgaaactgaagactgggagtcactaagaaatcccttctccttcttctccttattctcatcatccgtcacagtaaaattttgagacaacacatcactagaagatctagagatttgttgctcggtgagtatcggttgaccgaaaagcaaaaattggtgtctcttcacatgatcagatttctccaaactcttgttagaatttcccatggtcagcaagcatgatagactttctttactcttaccatggttggtgatgttgccattacaaatcccagtgtgcaaattaagctggtggacgttagtcggaagcaaccccaactgcagcttattgttaggtggagatctgat

SEQ ID NO: 6859 - DNA, 934 bp, Glycine max
  Predicted polypeptide sequence is orthologous to G1020
aattcaaactttccgtgttaatttcattgaaccaaattatggctgcaaccaaaaaacattacaccgtagtaaaatatcaatcaaaacgaaagaaaaaccggatgagcgcttcgtgatttaagaaaaaacagcatgaaactggtggttcctctgtcgcaaaaaaatagagacaatcataccgactacgtattcacatagtatttctttaccttcccttcccttccttccttatcgaacgctgctactttctctactttaaaaaacaaaattagaagaagaaaaactcaaggcatgagtcagattctggatcaagcgatctcatgtggaggaggatggttaaggtcgagatcgaacattctagaaccgttccccttaacaacgccttcgttatgattcagatcgataacggaggacgagtccgagtcgctcgtcgtcgcgtggtactcactcgccgcgacgggatgaggattgtagccaaacgcgaagccacgtggaccggccatgccggcgcgtaggacggcgtcgaagtacataacctggttcgccgccggcaccgcgccggggaaaaccgggaactggttccggaaggggaatcgagcggaggagacggcgacgggggcgaggttgaggtcgagcggagaggaatcggcggcgacgtcgcggtcgcggctggaggactccaccgtgctgctttggctagggctcgcgttcttaaaattttccgaagggagagggaagtttgtcttcgccttagggccgcgaaactcccgcgcggcggcgtcgtaagcacgggccgcctcctccgcggtgtcgaaggttccgagccagacgtcggtcttcttggcgggatctctgatctcggcggcgaacctccccccaggtctcttcctgactccacgaaaatgcaggtccttcaccccggcgttaccgctag

SEQ ID NO: 6860 - DNA, 891 bp, Glycine max
  misc_feature (508)..(508): n is a, c, g, or t
  misc_feature (615)..(615): n is a, c, g, or t
  Predicted polypeptide sequence is orthologous to G1020
ccccggcggtgatgatcgcctgtccgtgacaccgccagctctaatacgactcactatagggaaagctggtacgcctgcaggtaccggtccggaattcccgggtcgacccacgcgtccggaaaaataacgctaatggctccaagagacagccgagccaccgcgctcattgggcccggcccaagcctatcaccggcccacaaagagatccgctacagaggcgtcaggaaacgcccctggggccgctacgccgccgagatccgcgatcccggcaagaaaacccgcgtctggctcggcactttcgacaccgccgaggaagccgcgcgcgcctacgacaccgccgcgcgtgagtttcgtggcgccaaggccaagaccaatttcccgacaccctcgggactcatccttaacaataacaacataaacgctcgtagtcccagccagaccagcaccctcgactcatcctctcccccgccaccgccaccgctagaccttaccctcacccctctctccntcgctgtcttcccggtggcgcgtcctgttctattcttcgacgcattcgcgcgtgcggacaccatgggcgccgctcgcgccgcgagacctgcggcttcgaacgccccngccgcgatttccgccgcggcgactccgactctgattataaccgccgcatactcctgatcttgaccctgacggcctcctctcgccgagctgcctgattcatgcaaggagtctggttctcgcaaataatgtattttggtttttaacaatctgcactactactacgcattttccgataacgggccctgagtaacagcataggagcgacgatgaacgaggtctggattgtgaccatgcgagatgtgcagaatacaaccgacgtctgtacggcatgttagg

SEQ ID NO: 6861 - DNA, 815 bp, Glycine max
  misc_feature (13)..(13): n is a, c, g, or t
  misc_feature (815)..(815): n is a, c, g, or t
  Predicted polypeptide sequence is orthologous to G1020
ctaggcatagganatagcgagcgcgcaattaaccctcactaaagggaacaaaagctggagctccaccgcggtggcggccgctctagaactagtgtatcccccgggctgcaggaattcggcacgagaatagatccaacgttgttgttgttgccggagtatccaacccgacccataaagagatccgttaccgcggcgtgaggaagcggccgtggggccgctacgccgccgagatccgcgacccaggcaagaagacacgcgtgtggctaggaacgtttgacacggcggaggaggcggcgcgtgcgtatgacacggcggcgcgtgagttccgcgggacgaaagcgaagaccaatttccccacccacgcggcggtggcgcgtagtcccagtcagagcagcacgctggactcctcgtctccgccgccgctggaccttactcttgccgccccactcaccgccgcgggcgcgttggttttcccggtggcgcgtcccgtggtgttcttcgacgcttttgcgcgtgccgaggtgcgcgcgtcgttcgatcttcccgtggcggtgttcagcgactcggactcgttctcggtcgtgtactacgagcgggtcccacatcggaaagatgtggatcttgaccttaatgttcctcctccgcccgaggttgtctgaaccggtcaatagatctactctaacgccgcatcgattttttctctctatctgagattggagatgtttcaaattctaattgtagtttggtcatcgttgctttaaaaaaaggggggtttttcttattaatattgggcgcgcccccccccctcaccaccn

SEQ ID NO: 6862 - DNA, 906 bp, Glycine max
  misc_feature (1)..(4): n is a, c, g, or t
  misc_feature (342)..(342): n is a, c, g, or t
  misc_feature (562)..(562): n is a, c, g, or t
  misc_feature (710)..(710): n is a, c, g, or t
  misc_feature (760)..(760): n is a, c, g, or t
  misc_feature (828)..(828): n is a, c, g, or t
  misc_feature (896)..(897): n is a, c, g, or t
  Predicted polypeptide sequence is orthologous to G1020
nnnnaaggaatgactggtggtcgctgcttaccgccagcgcgcaattaaccctcactaaagggaacaaaagctggagctccaccgcggtggcggccgctctagaactagtggatcccccgggctgcaggaattcggcacgagatttcttcattccaccatcaccatggtcaaggagaagaagaacgtggtggtcaagaacaagaagccaaacaacaatgccgacgagcttcacttccgcggcgtccggaagcgaccatggggccgctacgccgccgagatccgtgaccccggcaagaagacccgcgtctggctcggcaccttcgacaccggcgaggacgccgnccgcgcctatgacgccgccgcccgcaacttccgcggccccaaagccaaaaccaacttccccgtgccccccgacgacaacaacaacaacaacgttaacgtgaacaaaaacaagagtgttaacgttaaatctcacagtcccagccagagcagcaccgtggagtccgccaccccggagcgtgaagccacgcgccgctccacctccgccgcaatcgaccgtttnccgtttctacccatccagcagcaaatcctcatgacccaccccgtcgcagcacccatgcgcccggtttctttctcgaccgggccacttcatgacccagtctttcccgcttcggtcgaaccggtccgtccagagcgactcgacttctctnccgcgcggcgatggcagcccaaagagactcaatctgatcttaactggctncggctatgaatataaacctttttttatctcttatttttcataaaaaaggaagcagaaggaaggactanggagattttttctttcttttttttttgaagatatcttccattaagagttattagtacatccttgatgnnaataggtga

SEQ ID NO: 6863 - DNA, 806 bp, Glycine max
  misc_feature (26)..(26): n is a, c, g, or t
  Predicted polypeptide sequence is orthologous to G1020
tggtggggcgattgatgaacgcctcngtgctaactacgccaagctctaatacgactcactatagggaaagctggtacgcctgcaggtaccggtccggaattcccgggtcgacccacgcgtccgctactctctgatcagttttttcttggtctccgaatcacaaactcttcgaaaaaactaacattaatggctccgagggatatcaatagatctaacgttgttgttgccggaggatccaacccgacccgtaaagagatccgataccgcggcgtgaggaagcggccgtggggccgctacgccgccgagatccgcgatcccggcaagaagacgcgcgtctggctaggaacgttcgacaccgcggaggaggcggcgcgtgcgtacgatgcggcggcgcgtgagttccgcggcgcaaaggctaagaccaatttccccacccacgcggagctgacgcacgcggcggcgcgtagccccagccagagcagcacgttggattcgtcctctcccccgacgccgccgttggacctcactcttgccgccccactcgccgccggtggcgcgttggtgttcccagtggcgcggcccgtggtcttcttcgacgcgttcgagcgtgccgaggtgcgcgcgtcgttcgatcttcccgtggcggcgttcagcgactcggactcgtgcacggtcatggattacgagccgggctcacgtcggagagtgtaggatcttgaccttaatgtgcctgcttcgccccgaggtgcctgaatccggaaaaagaatccggtttttgcgcactcggttagtctctctctatctgg

SEQ ID NO: 6864 - DNA, 825 bp, Glycine max
  Predicted polypeptide sequence is orthologous to G1033
aatgaacaaagtagtttttgctcgagcactactacttgtatatatatgcagatagctacaaagaaattaacaagtttttttctgcccaagctacggataacatgatgtaaacatatcatctaactaacctaaagctaaggccttgggtccagtctcttaggttggcaggtagatgctttaaatgagttcatctctaagcctcatccaattactttgggtctcctttcttcttaagttcttttacatttaaacagcaaccaaagctgcgtgttccaggatatgtctttacaaggccacgtataaaaacaacaacatttgcatcaacaagaccccaccctttttttctgctcaaacttcaactctcaagggttcctcaatcatgccttaacaagctctcatcatcattgacttcaaactttaacttgtcagactcgtattcctctggattcttcccctccaatttcttattgtaagccaaaatagttttcttatactcttgtttcttctttttggccatagcaacgaagggactttttcatgaaacattaaattaatgcaaactaggttacaaaaatgtggatatcatcaataaattaggatgctccttcttgaactgctctctgaactcggacatgaaaatgaaaaaaacgcttggaggtctctttcgcttgttaggaaccttagcagctttcttcgattgtttccttccagcagcaccagtgcccttgcgcttcaaccacaaagttgctgattcccgacagcatgcgtcgttgaggccgatttcagcgacggtgcagatcttatggttgtttggtgccagtgcgc

SEQ ID NO: 6865 - DNA, 1003 bp, Glycine max
  misc_feature (1)..(1): n is a, c, g, or t
  misc_feature (675)..(675): n is a, c, g, or t
  misc_feature (685)..(685): n is a, c, g, or t
  misc_feature (687)..(687): n is a, c, g, or t
  misc_feature (689)..(689): n is a, c, g, or t
  misc_feature (706)..(706): n is a, c, g, or t
  misc_feature (722)..(722): n is a, c, g, or t
  misc_feature (770)..(770): n is a, c, g, or t
  misc_feature (793)..(793): n is a, c, g, or t
  misc_feature (935)..(943): n is a, c, g, or t
  misc_feature (945)..(945): n is a, c, g, or t
  misc_feature (947)..(953): n is a, c, g, or t
  misc_feature (955)..(956): n is a, c, g, or t
  misc_feature (958)..(964): n is a, c, g, or t
  misc_feature (966)..(968): n is a, c, g, or t
  misc_feature (970)..(972): n is a, c, g, or t
  misc_feature (974)..(978): n is a, c, g, or t
  misc_feature (980)..(981): n is a, c, g, or t
  misc_feature (983)..(1001): n is a, c, g, or t
  misc_feature (1003)..(1003): n is a, c, g, or t
  Predicted polypeptide sequence is orthologous to G1033
naagtcggggcgcgttcttttttgaaatcccgcctgcgcgcattaaccctcactaaagggaacaaaagctggagctccaccgcggtggcggccgctctagaactagtggatcccccgggctgcaggtgctagtggtactgtcttagctttgattctctgttctctgttttgttctgtttcgcgtattgtcttcatacaggaacttgaacaatgaagaatgcaaagggcaagggagcagcaagggcctcaaaagaatcactgaagcccgttgatgaccgaaaggttggaaagcggaaggcttccggtaagcctgggagaagtagtgcaccaaagaaggagaagaaggccaagaaagaccccaacaagcctaaaagaccacccagtgctttctttgtgttccttgaggagttcaggaagacctttaaggctgagaatcctaatgtgaaggctgtatcagttgttgggaaagctggaggagagaaatggaaatccttgtccagtgctgagaaagctccatatgaagccaaggctgcgaaaaggaaagctgagtatgaaaaacttatcaaagcttatgataagaagcaggcaagcttcgcagatgatgaagaatcagacaagtccaaatctgaagtgaatgatgaagatgattgtccagtgagagaggggaggaagagngagatgtagnangnagaaagcgagagatatngacttgagaatgtgtncaaaaactttggttatgatggtttgttgggaagagggctatatatatntgattggcatactagctactttntaattttgtgctggtgaaaggaattcttcttttgtggcatgattacctaccaactcttgacttccttacttactttcgacctgatcacttttggcatggacccttaaatggtggcttagtaattattcttctggcacaacannnnnnnnnanannnnnnnanncnnnnnnnannnannnannnnncnntnnnnnnnnnnnnnnnnnnncn

SEQ ID NO: 6866 - DNA, 965 bp, Glycine max
  misc_feature (1)..(3): n is a, c, g, or t
  misc_feature (188)..(188): n is a, c, g, or t
  misc_feature (198)..(198): n is a, c, g, or t
  misc_feature (209)..(209): n is a, c, g, or t
  misc_feature (758)..(758): n is a, c, g, or t
  misc_feature (768)..(768): n is a, c, g, or t
  misc_feature (798)..(798): n is a, c, g, or t
  Predicted polypeptide sequence is orthologous to G1033
nnnggggatagaacgacgtaggagcagagatgcacaattcaccctcactaatgggaacaaaagctggagctccaccgcggtggcggccgctctagaactagtggatcccccgggctgcaggaattcggcaccagctagtctcgcgtttttttttttttttttttacagcagaaaagcgaatgataagnccaattatanttgatacaaancttaaccagatttcaacaagaaaactctaaatcaaactaaaagctctacaagagataaacaccccttaactaaacagttggatttagaagtacaaataaagaactcccttctttaaactattcacgttttggaaagacaaccaatttacggagggagcagggaaatattttttggaagcaagaaatatgtttatcaggaaatgaccagaccacctacaacagatgatcaaaatcatcagaacctacataaatgcaattatcagtccattctctaatcgtcatcctcttcctcgccactgccttcctcatcatcatcttcatcattcacctcagatacagacttctcagattcttcttcatccccaccagtaggaccttccgcctgtttcttgttataggctctcatgttcttctcgtactccactttccttttctcagactttgccacataaggtgctttttcagcatcagacatggtctccattttgctcagcagctttgccacagcagacactggcttgttttcagatgttctttgtggataccttnctgaactctncatgaaaacgaagaaagcacttgaagcctnttttgcttggtaggtcttcgctgccttcccttgcccgcggttcctaaacttgtgcggctccttctattaccagaagagttgatcgtctctaagatcgccttgacttctcctcatacgaaacaaaggggacaggtcgcctcagttaccttaacgtgtatttcactgtt

SEQ ID NO: 6867 - DNA, 909 bp, Glycine max
  misc_feature (1)..(1): n is a, c, g, or t
  misc_feature (10)..(10): n is a, c, g, or t
  misc_feature (812)..(812): n is a, c, g, or t
  misc_feature (909)..(909): n is a, c, g, or t
  Predicted polypeptide sequence is orthologous to G1033
nttttttatntttttcttccctcccccccccccccccccccccctgcgatgaaaagtagacgatacgatatcgtcaagctctaatacgactcactatagggaaagctggtacgcctgcaggtaccggtccggaattcccgggtcgacccacgcgtccggcaaagtctgagaaaaggaaagtggagtacgagaagaacatgagagcttataacaagaaacaggcggaaggtcctactggtggggatgaagaagaatctgagaagtctgtatctgaggtgaatgatgaggatgatgacgaggaaggcagtggcgaggaggaggatgacgattagagaatggactgatgataatagcatttatgtaggttctgatgattttgatcatccgtgtaggtggtctggtcatttccttataaacatatttctctttccaaaaaatatttccctgctcctccttccgtaaattgctcgtctttccaaaacgtgaatagtttaaagaagggagttctctttatttgtatttctaaatccaactgtttagttaagggatggttatctcttgtagagcttttagtttgatttagagttttcttgttgaaatctggttaagtttgtatcaatataattgacttatcatcaaaaaaaaaaaaaaagggcggccgctctagaggatccaagcttacgtacgcgtgcatgcgacgtcatagctcttctatagtgtcacctaaattcaattcactggccgtcgttttacaacgtcgtgactgggaaaactctggcgttacccaacttaatcgccttgcagcacatacnccttcgcagctgcgtatagcgagaggccgcacgatcgcctttccacagtgcgcagctgatggcgatgggagcgcctgtacgcgcataagcgcgcggn

SEQ ID NO: 6868 - DNA, 914 bp, Glycine max
  misc_feature (332)..(332): n is a, c, g, or t
  misc_feature (351)..(351): n is a, c, g, or t
  misc_feature (579)..(579): n is a, c, g, or t
  misc_feature (657)..(657): n is a, c, g, or t
  misc_feature (666)..(666): n is a, c, g, or t
  misc_feature (683)..(683): n is a, c, g, or t
  misc_feature (694)..(694): n is a, c, g, or t
  misc_feature (728)..(728): n is a, c, g, or t
  misc_feature (738)..(738): n is a, c, g, or t
  misc_feature (743)..(743): n is a, c, g, or t
  misc_feature (811)..(811): n is a, c, g, or t
  misc_feature (879)..(879): n is a, c, g, or t
  misc_feature (914)..(914): n is a, c, g, or t
  Predicted polypeptide sequence is orthologous to G1033
tgatccatggtaggatccgccaagcgcgcaattaaccctcactaaagggaacaaaagctggagctccaccgcggtggcggccgctctagaactagtggatcccccgggctgcaggaattcggcacgaggcgcactctctctttttctctctgttttttgttctctcttcgcttaaaccctatcgttcttctcgttttcgccgattctcgccatgccgaaagctaaatccgacgccaaagccgccgatagcaggttgaagcggaagggcgctggtgctgggaggaagcaatcgaggaaagctgctaaggaccctaacaagccgaagagacctncaagcgcttttcttcgttntcatgtccgagttcagagagcagttcaagaaggagcatcctaacaacaaatccgtcgctgttgtcggcaaagctggtggtgaaaaatggaaatcgctatctgatgctgaaaaggcccctttcgttgctactgctgagaagaagaaacaggagtatgagaaaactatttcggcttacaataagcaattggagggaaagaattcagaggaagacgagtctgacaagtcanagtctgaagtcaatgatgacgaggaagatgatgaggaggatgatgatgagtaaagatgtgatacatgatggagcgtangtggatgcngggaaaagaaaatgttntgcatagttgntggtttagaattcataggatgtccctaccacatnctttctgatnatagnttctgaattttatttgtcttactcagtagttagataggcacatcgtaaataggttatatcatgactgnactaagtcaagtattatcgtctatctatctcaaaaaaaaaaaaaaactgaaggggccgtcccaatcgnctttaagtatcatagcccttctgtgcggtttaaan

SEQ ID NO: 6869 - DNA, 988 bp, Glycine max
  misc_feature (47)..(47): n is a, c, g, or t
  misc_feature (50)..(51): n is a, c, g, or t
  Predicted polypeptide sequence is orthologous to G1033
cgtttatcatcaaccgcccccaccttccgctgcccacctgtcggtgngcnncccccgcagtccatctaaaatacatgaacatacatatacacaggagcggcgcgttgtgcctcatgtatggggacatcccctgcagctcccccgcggtggcggccgctctacaactatatgatcccccgggctgcaggaattcggcgcgaggttttcatgtccattcagagagcagcttaagaaggagcatcctaacaacaaattcgtcgctgttgtcggtaaagctggtggtgacaaatggaaatcgctgtctgatgctgaaaaggcccccttcgttgccacggccgaaaagaagaaacaagagtatgagaaaactatcttggcttacaataagaaattggaggggaagaactccacagaacacgagcctgccaagtcaaagtctgaagtcaatgacgatgaggaagatgaggaggaggaggatgatgatgacgacgagtgaagatggtgacacaagatgaagcgtaggaggatgtgggaaaagaaaagtgtttcgcatatgtcactgatgggtgtagaatgtcataagacgagtcccaacccacatccgtctatgagaatgtggatttgcgtcaccactgagaaatgactccaaacatgctgagagagctgtccagcagacagcttgcgatatccacttgcgacactgcattcgtcatcactcgcactcgtctcacgtccactttctcgagaactaccactccgctccacaccatgtatcgtgtatgatgcgtccgcaccaaaccggcctaaacagatgtgaaataccatcactacttgcctctattcccacgacatctctcggaacacctcgcattcccaacttatcgccttgcgtactaccactctccccagcggcggtgtagcgagaaggtccagccggatcgcctcgcaccaacgcgccgctgatagtggaagcgaccgacgcttcacgccc

SEQ ID NO: 6870 - DNA, 966 bp, Glycine max
  Predicted polypeptide sequence is orthologous to G1037
aatattgaatgtgtaattttaatagacaacatttccaagcataaaagggggaattcgtgtttattgtcattcaacttaatcactataatcttgtttatggatccctaacatttaaatttgcaatccctgatctctctcaagctgccacacctacaccaagcatcaaggcatgaaaaagacacagggttcaagtggatcccatttgtgtgatgggctccaccaggaccttgtgtctctctcctcgctgcaagtgtggctgtgacagaagatctaggtccaatttgaaggccaacatatctaaggagattaaacaaagtgatcaataacactccatattgcattgctggactcaaggcaaggacaacaatgcatttgtttaaaaaatagaaagcccttagtggaacaaacctagagaacaaagtaatctggagaagctaaatcctatagtaactacgagaagacaaaagctaaagcccttaaaacacgatgaaaactacaaaaaaattcatcagcgaggatgcatgatattctggaatgtgctgctaaacctgctatcacatcgagataacccaccagagtaattattgcaaatgaggtttccatccaataatttcatcttatcattttcctgtttcatcattgaactgaccaagtcttccagtgaaccaagattattagagaaatgactttgttgagatttcggtaggttcatgatattcccctgatgttgtttcgataaggcctcgtcagttaactccacaaatccctcatgcttcatttgtaagggatcacaataattaaagtccaagtttctgtgtaaggctgagttcattgctgcatggccagctggaacagcagcaccattgactggagtcagtgagtttattgacaaaatatttgaatggtgagtagcatcctgaattatgtcatgccacccttgatatggcacattactgcttatatgcc

SEQ ID NO: 6871 - DNA, 811 bp, Glycine max
  misc_feature (789)..(789): n is a, c, g, or t
  Predicted polypeptide sequence is orthologous to G1037
gcattcataaagggaagaccccgagtttattgccactaaaattattttattcttgcttatggaccactaacaaattgctagaaaagcatgtctgcacaaaactaaacatggttaactccataatgcactaaagggccccatccataaaacaacgcattttcacaaattgagaaagcccttgctgaaagtaaataataccctagacctagaaaataccaccaagaagacaaaactgggaagagtggtaaaccaagacttgtcacgctacaaaattcatcaacaaagcatgacatgatgcgcaaatatactgccaaagttcatatcacatggatgttccgtcagggtaattattgttgcataaatatgatccgtccaagaatttcaccttgtcttgtttctgtttcatcatcgaactgacaaagtcttccaatgaaccaatattattaggggcgcgactgttttgagacttctgctggttcatgatgtacctgtgttgttgtttcaatgagttttcgtcactcaatcccataattccatcatgcttcatttgtaagggatcacagaaattgaagtccaagtttctgttgtaggttgagttaatagaagtatgaccttctggatcaatcagagagtctattgagttaccaataacatttgaatggtaactactatcatgattatggtcatcccacccgagaaatggcacattattgctaatttgtcctgaattatttgtaaaaatgagtccttgagagtgcatatccgtctgtgaatcatgggattgattanacagtgaagtaattgatgaagc

SEQ ID NO: 6872 - DNA, 766 bp, Glycine max
  misc_feature (1)..(1): n is a, c, g, or t
  misc_feature (574)..(574): n is a, c, g, or t
  misc_feature (599)..(644): n is a, c, g, or t
  misc_feature (666)..(668): n is a, c, g, or t
  misc_feature (766)..(766): n is a, c, g, or t
  Predicted polypeptide sequence is orthologous to G1037
naagagtatgtcgctagtatgatcggccaagcgcgctattaaccctcactaaagggaacaaaagctggagctccaccgcggtggcggccgctctagaattagtggatcccccgggctgcaggaattcggcaccaggacattcgactgaagccaaatgaagcctacattttggagcaaatgaagtcccaagatggatttatgcagaatacttttgggaccttggatgacataatgggtgtaatggtcaaaagggagcaaaatgagtcgacattgttggatggagaaatgggatttgatgcctaccctgttggatcatgcaactgatttcttcttaaccagaacgaatccaggagcaataaaatcgtgaaacttgctccagtctctgaaaccgattaatgtacacctatttttatgttctgctactaaatttattttcttggccaacattttgttgtttcacttatggacttttgttagccatctgatctgttccatctttttttcctttcaatctgtagtgtatccccataaaaattgtctttggtttagataaaataattgtaatatgaatgtntcttggtgctcaaaaaaaaaaaaannnnnnnnnnnnnnnnnnnnnnnnnnnnnnnnnnnnnnnnnnnnnnaaaaaaaaaaaaaaaaaaaccnnngggggggcccgtccccattccccttatgggaatttataacccgcctaattggcggttttttacaactgtggactgggaaaccctggtttcccaatttn

SEQ ID NO: 6873 - DNA, 886 bp, Glycine max
  misc_feature (716)..(716): n is a, c, g, or t
  misc_feature (719)..(720): n is a, c, g, or t
  misc_feature (778)..(778): n is a, c, g, or t
  misc_feature (786)..(786): n is a, c, g, or t
  misc_feature (790)..(790): n is a, c, g, or t
  misc_feature (803)..(804): n is a, c, g, or t
  misc_feature (835)..(835): n is a, c, g, or t
  misc_feature (876)..(876): n is a, c, g, or t
  misc_feature (886)..(886): n is a, c, g, or t
  Predicted polypeptide sequence is orthologous to G1043
ctgttgacctgctggctgattacgcccagcgcgcaattaaccctcactaaagggaacaaaagctggagctccaccgcggtggcggccgctctagaactagtggatcccccgggctgcaggaattcggcacgagggggatcaaaacattcctagattggaatatggcaaaacttggttgttctagtcgtaggaaagcaattgaggagctccttagagggcgtgattgtgccaaacaacttaggagtgtcatcaatgggagttgtgaagatggatcatcaacaaccccatcatttgctgaacaacttgtgaaggaggtgctcatgtccttcaccaactccctctcgttcttgaagaacaaccccacttctgaatcccatgatgtttccaatgttcaagtttgtgaatctcccaagtctgaggactcccaagagagcaattgcaagagctccatcattaaggaacgtagagggtgctacatagaagaagaactgaacaaacatgggagaaggaatctgaagctccaattgatgacggccatcagtggagaaagtatggccaaaaggagatcctgagtgccaaattcccaaggaactactatagatgcactcacaaatttgaccaaggttgccaagcaacaaaacaggtgcaaagagttcaagaggaaccaatcctatacaagaccacctactatggcctccacactttgcagaacttgncannaccctggatcatacttgaccctatgtccccttcatcctcatccaaagtccttagcttntgacactncttncccaacccatcannagcagagtgcccctttctctcatcttctaanttgccatcatcagtgaaaagggagtgcaagggagagtcctnccctcacctn

SEQ ID NO: 6874 - DNA, 893 bp, Glycine max
  misc_feature (651)..(651): n is a, c, g, or t
  misc_feature (671)..(671): n is a, c, g, or t
  misc_feature (677)..(677): n is a, c, g, or t
  misc_feature (694)..(694): n is a, c, g, or t
  misc_feature (706)..(706): n is a, c, g, or t
  misc_feature (711)..(711): n is a, c, g, or t
  misc_feature (722)..(722): n is a, c, g, or t
  misc_feature (724)..(724): n is a, c, g, or t
  misc_feature (730)..(730): n is a, c, g, or t
  misc_feature (736)..(736): n is a, c, g, or t
  misc_feature (781)..(781): n is a, c, g, or t
  misc_feature (783)..(783): n is a, c, g, or t
  misc_feature (805)..(805): n is a, c, g, or t
  misc_feature (815)..(815): n is a, c, g, or t
  misc_feature (817)..(817): n is a, c, g, or t
  misc_feature (819)..(819): n is a, c, g, or t
  misc_feature (821)..(821): n is a, c, g, or t
  misc_feature (834)..(834): n is a, c, g, or t
  misc_feature (871)..(871): n is a, c, g, or t
  misc_feature (890)..(890): n is a, c, g, or t
  Predicted polypeptide sequence is orthologous to G1047, G1808
ttcggcacgagctctgctcccttaattaattagccaccatgctctccgccctcactccttccgaccccttctctcccttctcccccttctccgccggcttcacgccgtgggatgacaacgacgattcccacgccctcttctcccccaaaccggtctctgcttctagctccgcctctgactataaatccgaaccgaacccaaccgaacacgtatgcgcctcgtcctcggtgatgatggacgagcggaaacggcgccgcatgatatcgaaccgggaatcggcccgcaggtccaggatgcggaaacagagacacctggagaatcttcggaaaccagttgaacaagtgcagggtcgaaaaccgggaaactcggtaaccggttgcagttcttcctgcaccacctgaaccgcctccgaaccgaaaacgaatggctccgctccgagcgaacctgctacgccaaaaagtcgccaatttaacacaaattttgattttccaacaattccaaaccaccttctcccctgctgcatggaacacatgcaccaacaacaacaccacctcgctcatgaaaattaatcaagtttaattaattaaataatatatatatatatatatatatatatatatatatatatatatatatatatatataaaatanggtcttggtaaaaatctaanaggccnagggtgtcctatgttantatcattaaaantttanataaagaaatntnttctanatggtnagggtgggattttggaaaaatattaggctggttttgggaaaatantnatttcattttttccaaaccatnggggtttttntntntnaccgaatataatnttttgttttaaaaaatacttttctttttttgtttccnaaaaaaaaaaaaaaaaaantcg

SEQ ID NO: 6875 - DNA, 875 bp, Glycine max
  misc_feature (603)..(603): n is a, c, g, or t
  misc_feature (611)..(611): n is a, c, g, or t
  misc_feature (808)..(808): n is a, c, g, or t
  misc_feature (822)..(822): n is a, c, g, or t
  misc_feature (833)..(833): n is a, c, g, or t
  Predicted polypeptide sequence is orthologous to G1048
cgagtgacaaggtaggactactgctagaatacgccaagctctaatacgactcactatagggaaagctggtacgcctgcaggtaccggtccggaattcccgggtcgacccacgcgtccggctttgcggctttgcttgcaattgcgtggtacatatggtgcttcaatgaccatgcaggagtctgctgtgctcttgttggaacctctgctgttgggttccctgctgtggtgcatgggcatcatatgccatctcagtctgcctctaatgctgtgggttgcagcagtacttccaagagaaaacatcgagcagaagggcctaagaagggtaactcaaaaaggatcagaaagtaagatctctgagtgtttccagatgcaatcatttttaaagagtagaaaaagccgagcttcaagaacaaagatgaaattcaattttatagtgttctaatgttctataacttctgaagtgggggctctaaggttttctattcatctcttctttctttcgttcgttttctcttttgttttattggatttataaatacggtcgaacttgttagaggttctgtgatatgcttttttaggtgctgttcttgtaacttatattgngaccatanacatgtgcgttcttatctttaacatagacgtcgttttgagttaaaaaaaaaaaaaaaagggcggcccgctctagagatccaaagctacgtacgcgtcattgcgagtcatagctctttctatgtgcacctaaatcaaatcacttggccgtcgtttacaacgtgtgactgggaaaacccctgcgtacccaacttatcgncttgcacacatccncctttcgccgncttggcgaataagcagaggccggaccgtcgcctttcccacgt

SEQ ID NO: 6876 - DNA, 885 bp, Glycine max
  misc_feature (24)..(24): n is a, c, g, or t
  misc_feature (596)..(596): n is a, c, g, or t
  misc_feature (632)..(632): n is a, c, g, or t
  misc_feature (765)..(765): n is a, c, g, or t
  Predicted polypeptide sequence is orthologous to G1050
aaaatagataacgttaaattaccncagcgcgcaattaaccctcactaaagggaacaaaagctggagctccaccgcggtggcggccgctctagaactagtggatcccccgggctgcaggaattcggcacgaggcgcttactgctgaggttcaaagactaaagcttgccacagctgaactaagtggcgattcgcatggttctggctgtttgattcctcaacattctgtcaatcctctgatgttccagcaacagcagcagcctcctactgcatcccaacaaaacattcatcttcaacagcagcaacagcagcagcatcagaatggtaatgccaactcaaattccgacttaaaaacaatagtttgggaaggagttcctgcagctgcatggttggctcactgcagtcagtttcgcatatttacaaaaaggttttccttagttgttatggtctcaagtttgatttgcattattacctgtccagctcagacagaaagtccatatacaagttctaattcctgtcttttatctaaattattatagagcatatttaatttcagtatatatattaaattgtaagcattatttggacatgatttgttntatgatggcattttagagaaactgttcaatctttcnttttgtaaagaatgaccattctgttgttgtgatcaaaaaaaaaaaaaaaaaaaaaaaaaaaaaaaaaaaaaaaaaaaaaactcgagggggggccggacccaattcgccctatatgagtgatacgcgcgctccntggccgtgttttacactcgtgactgaaaaaccctgcgtacaacttaatcgctgcacacattccctttcgcagcctgcgaattacaaagcccggacgacgccttcccacgtgccaacctga

SEQ ID NO: 6877 - DNA, 796 bp, Glycine max
  Predicted polypeptide sequence is orthologous to G1062
ttcagaaatgtccctgaactaattgaactcgaagtagtagcatcaagattcggttcgacatgagcaagtgaaaggtaccaaatagtaactgccgctgcagggggtaaaattcatgtgaaaatttcttctacctcaactttaactcaagttaccagagctagtatcgtacacttgaattgtgaacataacaaagtaaaaactgattctgatttaacttgccaaattgactgtgaaatagcagctaccagtttgtttcttgtcaaaactagttacatcatgccattgtagccagctgaatccaagagtactgctttgatttgctccggatggacatcctgaccttctttgcattgctcggctcgaaaaatatccatagcaaatccattgaagcagctgataacagcctgctgaatgtctaatccaaggttatccaaagccctcatggttgagagcaacagactaggcttgcgggcacaaaacatgtggatgttaacagcccttccttcgcgcagccgaacctcaaccctagcaggttggccattggggctgggcaatgagctggggcacagttcttccttgattcggcttggcagcgtaggaggagtaggcgtcaaaggatggaaacttgagacaggagtgagtgaagaacccactggtgtcgattccaactcgttatgcagatcattgatcctttgcagaagctccttcagatactcaattgcatccccaagaattgaagccctgtccattttgctaatcttgggaacaacggacctcaacatgtagagtctatcat

SEQ ID NO: 6878 - DNA, 897 bp, Glycine max
  misc_feature (817)..(817): n is a, c, g, or t
  misc_feature (834)..(834): n is a, c, g, or t
  misc_feature (841)..(842): n is a, c, g, or t
  Predicted polypeptide sequence is orthologous to G1062
cgcgaacaaaacaatttattccataacaattaacaatataagtttgctgaaattcaggaaaataaaggagctaattcctcccaatgcagatattggctaacccttcttgatcttagcctagacacagctttacagactagaataagcaatggcatttacaaactgcatgctacagcaactacagttagtgcgtctattgggatagcatttgtcaagaactactctcacatcattccatggaaacctgctgtgtccaacaatacttctttaatttgctctggaaggacatcctggccttctcggcattgctcagctctaaacacatctaaagaaaaaccattgaaacaactgattacggcctgctgaacatccaatccaaggctatccattgccctcatggtagaaagtaaaagacctggtctgtgggcacaaaacatatggatattgacagctcccccttcccttaccgtaacctccacctttgctgattggtttttaggacttggcagagagataggacatatttcttccttcacccggcagggaagggtaggcagagtgggtgtcacagggtgaaagcttgcagcaggtggaagggatgagccaggcgggcctgactctagttcatgattaagatcagtaattcgcacttgtaactcccttaagtagtcaatggcatcccctagtattgaggccctatccatcttgctaatattaggcacaacagaccttaacatgtacaacttatcattgagcttcttcctccgcctcctctccgccatgagattcttcgccggcatcttcttcctcttcttcntcttccccttctggtcntcaccanncacaccaccatttccattcccattatcaccatcaccatcatcatccgacagcaac

SEQ ID NO: 6879 - DNA, 785 bp, Glycine max
  misc_feature (11)..(11): n is a, c, g, or t
  misc_feature (14)..(14): n is a, c, g, or t
  Predicted polypeptide sequence is orthologous to G1062
ggccccaagcnctncaggcgaatacgtgtcactatagggaatttggccctcgagttttttttttttttttttttaagaaacgaaaagaatgataacgatttattacatctgttaataataaagacaacagcataagttcgctttcgtcagaagcagaattgaacaaaatatcaaagctaactcctaaaactacagatttaactaacctatttgatctgggcctaaacagttcaaaggagaagaagaagcaatgcatttacaaactgcaagctacagcaactacggttggctcctctatcagggggaagcatttatcaagcattccaatcacatgataccatggaagccagcagaatccgagagcaccgctttaatttgctcagggaggacatcctggccttctctgcattgctcagctttgaacacatctaaagcaaagccattaaaacagctaataacagcctgctgtacatccaatccgaggttatccaaagccttcatggtagaaagcaaaagacctggtcggcgggtgcagaacatatgaatgttgacaggtctcccttgcgttactctaacctcagccgttgcagcttggtgtgtagagcttggcaaagtgccaggataacagtgctgcttgacccgacagggaagggttggcagggtgggtgtttaaggctgacagcttgtagaagaggaagtgtctacgacgagccatgtggagaggactgcagctcgggatggtgatcatatatgcgcgtgcacaacttcttcacagatgcacttgt

SEQ ID NO: 6880 - DNA, 740 bp, Glycine max
  misc_feature (1)..(4): n is a, c, g, or t
  misc_feature (740)..(740): n is a, c, g, or t
  Predicted polypeptide sequence is orthologous to G1063, G2143
nnnnaagtgagctggtcgatgtaccggcaagcgcgcaattaaccctcactaaagggaacaaaagctggagctccaccgcggtggcggccgctctattcttgtggatcccccgggctgcaggttcagaatggcggcgatgcagccgatacacatagacccggagtcggtgaagcagccgaagcggaggaacgtgaagatttcgaaggatccacagagcgtggcggcgcggcaccgcagagagaggatcagcgagaggataaggatactgcagagactggtcccgggagggactaagatggacactgcttccatgttggacgaggccattcactacgtcaagtttctcaaaacgcaggttcagtcactccaacgcgcttcctccgctaacaacaatattaggccacttggtactagtactgttaacgcaacaggaatagggttccctgttgctatgtctaccacttccaattccaccccttattttcctctgcctaaaccttaccaagctcgccacatggagaatatgcacgatagatatgattaaggttgtttagtgtgtacaactagctagttaatcaattcattatattttaagctgtagcctctgagattatatatatatatattgtgtacaattgtatgtaaaagtataaaaaaataactcgagggggggcccgggttccaattcgccctattgtgagttgtattacgcgcgctcactggccgttgtttaacacgtn

SEQ ID NO: 6881 - DNA, 952 bp, Glycine max
  misc_feature (906)..(906): n is a, c, g, or t
  Predicted polypeptide sequence is orthologous to G1068
gaaagatgaaagattttattagaaattatattagagcatatatttaaaaactataggagaatgtatttgtacgcatccaaataaaaacatttactttttttactgattagcatttgtcataaacaataaagcacgatgcatggaggaaagcacattctgattctgctatatgctactgcggagtgcagacagcaatcttcaaaatgacagaattcggataattggcaccgtatctttggctatcatcactagaaatgttacgattataattaaaaggagaaggaaaaaaaaactaataatcaactgaagaactttaaccttaagatagactgttctaaagtcagtctcaaaaatgcagttagcattttagaattgacctctagccactacttagaacaggcatcatgctaaatacgcagtttctgcactgttaatccgaaatcacaccttcactgatgagattggccagcccatagtggatgatggtacatgggcatattatgaacgggctggctagcattattatagagtccatgtccaggccctggccccctacaaaatggactatgatcctgttcctcagaggattcagttgaaggcccttgagaggtaggactatttggggtcatgggtgcaccaaaggttagcatttggggtggtggtgcagaagaagacccagatttcagggcactcgagctcgactttttcgcaaacgcaataaagctacccacaatgacctgtacagttgatgctgcagttagcgttccagcgactccaccacccaaaacacgtccatcagaccctgcaagaagtacattcaaagtgcatgttctgctacgatcaccgttattttcagatttgctgcaagaacctgataaagatataatctcaaagcggccctcgtangtagcaataccaccagacatttgcagctgtcgaaaggtacattacc

SEQ ID NO: 6882 - DNA, 770 bp, Glycine max
  misc_feature (1)..(1): n is a, c, g, or t
  misc_feature (758)..(758): n is a, c, g, or t
  misc_feature (762)..(762): n is a, c, g, or t
  Predicted polypeptide sequence is orthologous to G1075, G1076
ngcgtgagaaaccctttgagtgagcgcgcgtaatacgactcactatagggcgaattgggttccgggcccccccttgaagttttttttttttttttttaattatccaaaatatatattttggttattgatttgagcctatgatttattcaactcaaggttaatgcacaacagtctagtctaataactccagcaaccaagagaaaacgttttacagttgttcctagaaactgatcgtccttacaacaaacctagccaaacaaaacgattcttcaatagaaaaatcagtacttcttcacaagcaatattcagaggaaagattagagaagaccaatatatatgagatcaattcaacttctcacctttgtgcccccaaagactctggatcagtaagattgccttccaccagagttgccagcccaaccatcaacaggtaactgaggcatgtttagtggcaaattgaagaatggaagcccggaagacggatccggaaaagagttattactaactccaccaccatggtcaccgctaccatcaccagctgatgattgcccttgttgcatctgcatagattcatcttcatccaaaggcaacctctcatatgctacattagtaaaagatgaagcaataacaataacaggcccagaagccaccaaaggaccaacaacatttccttccaccacttgaccctgtcctccaccaaagaacacagtcaaacttgtagcacctggtggagcctgaagtgggaggatgatcctgancaanaagagatc

SEQ ID NO: 6883 - DNA, 737 bp, Glycine max
  misc_feature (2)..(3): n is a, c, g, or t
  misc_feature (9)..(10): n is a, c, g, or t
  misc_feature (615)..(616): n is a, c, g, or t
  misc_feature (656)..(658): n is a, c, g, or t
  misc_feature (673)..(676): n is a, c, g, or t
  misc_feature (708)..(710): n is a, c, g, or t
  misc_feature (716)..(717): n is a, c, g, or t
  misc_feature (721)..(723): n is a, c, g, or t
  misc_feature (725)..(727): n is a, c, g, or t
  Predicted polypeptide sequence is orthologous to G1075, G1076
anntttttnntatttatttgagcctatgatttattcaactcaaggttaatgcacaacagtctagtctaacaactccagcaaccaagagaaacgttttacagttattcctagaactgagtccttacaacaaacctagccaaataaaacgagtcttcaatagaaaaatcagtacttcttcacaaacaattcaaaggaaagattagagaagaccaatatatataagatcaattcaacttctcacctctgtgcccctaaagaagctggatcagtaagattgccttccaccagagttcccagcccaaccatcaacaggtaactgaggcatgttaaggggcaaattgaagaatggaagcccagaagacgggtccggaaaagagttattactgactccaccaccactaccaccaccgccagcagatgattgcccttgttgcatctgcatagattcctcttcatccaagggcaacctctcatatgctacattagtaaaagatgaagcaataacaataacaggcccagaagccaccaaaggaccaacaacatttcctcccaccacttgaccctgtcctccaccaaggaacacggtcaaacttgtagcacctggtggagcggganntgggaggaacgatcctgacaaagacaggatctcaaacctnnngtgcagcgtgacgannnnacctgctgcagctggctgtctcaacgtcacgnnntcttgnncttnnngnnnctcatcgtct

SEQ ID NO: 6884 - DNA, 838 bp, Glycine max
  misc_feature (1)..(2): n is a, c, g, or t
  misc_feature (560)..(560): n is a, c, g, or t
  misc_feature (562)..(562): n is a, c, g, or t
  misc_feature (565)..(565): n is a, c, g, or t
  misc_feature (567)..(567): n is a, c, g, or t
  misc_feature (570)..(570): n is a, c, g, or t
  misc_feature (573)..(573): n is a, c, g, or t
  Predicted polypeptide sequence is orthologous to G1082
nnttggtattgcaacttgcatgtgtaggaacgagcgcgcgcaattaaccctcactaaagggaacaaaagctggagctccaccgtggtggcggtcgttctagaactagtggatcccccgggctgcaggaattcggcacgaggcttgagagaaaagtgagaaatatggatagagatgaccagaagctgcaaagcaaattcaagcattagagcgaaaggtggttctggtatctggagaaggcaaaggtctctcagtttctgagaatatcatatatcagagtgacaaaagcagtagtctacaggctagcttgcagcgcatttttgaggccatggagagatttactgatgaatctgtgagagcttatgaggagttgctacaacggagcgaagaagaaagtgctgcccgaaatcatgagagaagttcataggggtggtggagctggatggagttggaagatattatctttgccatttgccgagaatagaaactagctgatctccctctactaactattctttacaacagagtcttgggaggaggggttgggcttgattcctccctncnctncnctnccncccttggtgctgattgatcctatgatatcggctggtgtgtcttttgtggcgcggtgtgagcgtgtgacggcgtaggcgacgacgtacctctcgttgcataatactcgggagggtggatgatggctgaaggtcgataggcgtacgatacgtctctgttgatcagagtgtagggctgggggtcgcaccgaacacgaaggtatcgacacaggaggtatgtttgtgatatatgacggtgtggggatgtgttatttggtgacgatctggt

SEQ ID NO: 6885 - DNA, 423 bp, Glycine max
  Predicted polypeptide sequence is orthologous to G1082
gaaaggtgaaaatgttggagagggaggagcaaaagatgcacaaagtgatgcgggctcatgagaggaagatggttacagttggcagagaagaatctgatgcacttttacgtggagatgctgtgcatcacgctgatatcgttgattctactaacctacaatcaagtttgaagcagatctttggtgccatggaaaagttcacagactccactgttcgcttatatgaagaactttgtcaacaaattaagcaagaggatcatgttttgggagaaaccaacaaaattagctagctttacactttttagattggatgaattttgtaggattgaagttatcagaattttctgaacctaatttttatgtatacagcatctcaaagtttcttccgggaaacatttgttaaaaaaaaaaaaaaaaaaaaaaaat

SEQ ID NO: 6886 - DNA, 693 bp, Glycine max
  misc_feature (256)..(256): n is a, c, g, or t
  Predicted polypeptide sequence is orthologous to G1084
tactaaattcttcttcctacaaagaagagaaaaaatgcaatttctgaaaattcaaacattgtaaatctgttcttacaataacagagaaaatatgaaagctattcttgaaagttgaaacttgaacctaactcaattctgaacactatgaaatgcagaagcatgctagaacactttcaagtttcaacaaacctgacagttcgttagatgttgataaatactgagctttcttggcctctaacaatgctgagacatcatnggctgcattgcagattattgtgaattgagcttcaagatcctggatcacttcaaccatgcttgtgggccttcggtttacataaacagtaaaaccaggtgtttcctcctttgcttcttgattaccagttgccatttcctggcccacagtttgagctttagatgcttgaaaacattcactgccattggcttgtgagtctgagacttcatttgcaattccagtttcagcacctgttgcctcctcttcctcttcctcctcatgttcataaacatcttcaactgcgacttcttcttgggaggggtttacatcaattttggctctttcttctgctacatttctctttatagcaaattcttctggttcagtttcatcttcttccaggtctggtattccttcttcttctcgaaccttcctcagtcctctgatctcatcatcagttc

SEQ ID NO: 6887 - DNA, 803 bp, Glycine max
  misc_feature (37)..(42): n is a, c, g, or t
  misc_feature (747)..(749): n is a, c, g, or t
  misc_feature (758)..(758): n is a, c, g, or t
  misc_feature (788)..(788): n is a, c, g, or t
  Predicted polypeptide sequence is orthologous to G1089
actggaattaattgcttaaattaaagaaaaataaagnnnnnnaaagaaaaagaaaaactaaagacaagaaacataaataaacaaaagaaaaaaatcctggtaaaaaaaattgggtttcaatcttgtgtgggccctggatcccaagctctatgagcatcattaatgtctgcaacataatcatcatcagcttcaacatctgcggcatcatcatcaactacaccaaaggtgtcaccccccccccccccctaacaaaaggaagttggactcctagccaagcaacctgggctaggaatgcctttggtgtcatcacgggctgctggagggagagatggtggaggctctacattagtaggtactggccgtggtggagactatgcagcataggaaggagccgctccagctgagaaaaaagcataaaggtctagcggagggatcgctagtggaatgtcaagagtggctcgagtcttgacttgttttggccctagaaagaccctaaaagagtctgtagaattctcaactggcttggcttcatcttcttctaggaacacagaattcaagtgccccccaacgagattaattttttgctcaatttcctccaccttaaaacaagttgaatgtggctttttggtcttccacactcatctccaagttacctttccccatgtccacaacacactttgcagtcaccatgaatggccaacccagaatcaagcggatctcagcatcttcttcaatgtccatgattannnagtccaccngaaaaatgagttgatggactttgactaggntgtcttcaactaccc

SEQ ID NO: 6888 - DNA, 941 bp, Glycine max
  misc_feature (70)..(70): n is a, c, g, or t
  misc_feature (72)..(72): n is a, c, g, or t
  misc_feature (74)..(74): n is a, c, g, or t
  misc_feature (784)..(784): n is a, c, g, or t
  misc_feature (844)..(844): n is a, c, g, or t
  Predicted polypeptide sequence is orthologous to G1089
aggaccccccccccccccccccccccccgtgggcgtgagcggctacgcaactgctcccgcgcgcttgaancntnactcaggggaacaaaagctggagctccaccgcggtggcggccgctctagatcttgtggatcccccgggctgcaggaattcggcacgagtccgttataagaggaagaagatgaacagcgactcggcgacgcgtcggagaggaagagttggaaaagtttgaagcggcaaagactcggcggagaaaggcctccacgtggtgtcgaactcggacggtggtggcggaaaggagaatgcttcacgaccgccacttggagaccgcgggggaacatggaagaacttcgtaaacgacgacgacgatgctcgctggttcccaccgcgggttcgacgcgtcagtggcaaggtgggtttcacgttttctgtatttgtctctggctgggtgtggttttgtttggcttaggtggtggatttgtgatttgaaggttatcagggcttgtagtaattggaattcagtggtgcagagaattgtgctatccaccgtagtctaatgtgtttgataattattttagtagtttataacctagttgtacagtccattattttagtagtttattattaagaacttttttttatccataagcactttgctgtgcgccacacacaaaaacatatacaaaaaaaaactactcgaggggcggcccggtacccatttcgcctatagtgagtcgtattacgcgcgctcactggccgtcgttttacaacgtcgcgactggnaaaaccctgtcgtacccaacttaatcgcttgcagactatcccctttcgcagctgtcttantagcgagagggctgcaccgacgcccttcctacaggtgcgcagcctgtatgcgaatggaccgcgcctggacgcgcattaatacgcgcgggtggtggtc

SEQ ID NO: 6889 - DNA, 657 bp, Glycine max
  Predicted polypeptide sequence is orthologous to G1108, G2394
cagccaacttaagttccagcgagataaagaaaatatatgaacaaaaatgaaatggaatgattgacctcaggatcaaacatccatccaatgaagagttggtagcataggaaaagctttacaagactacaaagtgtgtatatgactctatgtatataaactacattacgatgaggtgttggtgaggccattctcaaccctgctttcaccctcatgttggttggcatctaccccagagactgatcctcttacgttctcactaacctcactcttgcaaagggggcataaagcatttatcttcaaccacttgtcgacacaatctttatgaaataggtgagaacaaggcaattctctcagctcatcgttattttcatacttagccaggcagatgcagcaagctgcatcttctccagagatcatacgttccttttcagttcctgcagccacaactccaccttcaccaacagctgagttgctttcccctttgcttttatttctcttcattttgaacttataagtcggcagagcattaattgattcagaggatgcacctcgggtttgtgccatatcctctctaactccaaggatggaaattatacaaggcaggcagcagcaaattgttgcacagagaatgaagggcatagcataaccgatgcagct

SEQ ID NO: 6890 - DNA, 760 bp, Glycine max
  Predicted polypeptide sequence is orthologous to G1108, G2394
ggatagagcttgagcatgattacgccaagctctaatacgactcactatagggaaagctggtacgcctgcaggtaccggtccggaattcccgggtcgacccacgcgtccggttgacaaatggttaaagataaatgcaacctgccctctttgtaaaaacgaagttggtacgagtaatggagggtccccttcagcctggaactccagtacgtagctgaaggcacgtatcccccatcaagttgcagcttttcaagtgtacatcatcaaacttttggattctgctttcaaggtgagatccaaggatagatgcaaatcaagtaattcctttaaacatgtgatgttacgtgctagtgaaaggttgagaatgtgtttctacccgctctggtcacctctctttttgcgcttttttcaccggttttacatactcaccaagtattgtttgtagaaaataggatgtttcaaatctttcttcgtttatcagttctgtatatataacaatttctagtgaaaatgttaatttttttttttaaaaaaaaaaaaaaaaaaagaaaaaaaagggcggccgctctagaggatccaagcttacgtacgcgtgcatgcgacgtcatagctcttctatagtgtcacctaaattcaattcactggccgtcgttttacaacgtcgtgactgggaaaaccctggcgttaccaacttaatcgcttgcagcgcatccccctttcgcaactgggttattaggagaaggcccgactgatgggccttgca

SEQ ID NO: 6891 - DNA, 806 bp, Glycine max
  misc_feature (1)..(3): n is a, c, g, or t
  misc_feature (18)..(18): n is a, c, g, or t
  misc_feature (22)..(22): n is a, c, g, or t
  misc_feature (615)..(615): n is a, c, g, or t
  Predicted polypeptide sequence is orthologous to G1129
nnnaaatgggaaggtaanagancgatcgctgcagcgcgcaattaaccctcactaaagggaacaaaagctggagctccaccgcggtggcggccgctctagaactagtggatcccccgggctgcaggaattcggcacgaggtaataacaaggacaaggacaagagagtcaaagtaactggcgaggaaggagaatccaaagtaaccgagcaccataccagaaacaagaatgccaaatccaacgcaaataagaacaacagagaaacctctgcggacacttccaaaggctccgaggttcaaaatcagaaaccagactacattcatgtccgagcgcgtcgtggacaagccacggatagtcatagcttagctgaaagagtaaggagggagaagattagcgagagaatgaagtatttgcaagatttaataccgggttgcaacaaagttgcagggaaagctggaatgcttgatgaaattattaactatgttcagtctcttcaacgccaagttgagttcttgtcaatgaaattagcggctgtaaacccaaggcttgacttcaacattgacgaactgtttgccaaagaggtgtttccttcttgtgctcaaagttttccaaacatanggattccctcagatatgagtattagtaacaacccttcgtatcttcagttcaattcagcgcagcaacttgtatcgtgctgtggtggattaataaacagcatgggaataagccctcccacatgggactccgaacgaacattattagtactagcactgtacctttgcccgaaacttttcttgactcttctgttc

SEQ ID NO: 6892 - DNA, 796 bp, Glycine max
  misc_feature (1)..(3): n is a, c, g, or t
  misc_feature (795)..(795): n is a, c, g, or t
  Predicted polypeptide sequence is orthologous to G1129
nnnaaggtgtctgtggatgattccgccaagcgcgcaattaaccctcactaaagggaacaaaagctggagctccaccgcggtggcggccgctctagaactagtggatcccccgggctgcaggaattcggcacgagggagcagtaaatttcattaatcgaaacccacaaataccaacaacaacaaagaaacttgcgcagagacttcaaattccaaggcctccgaaaagcctgattacattcatgtccgagcacgtcgtggccaagccaccgatagtcatagcttagccgaaagagttagaagggaaaaaattagtgagagaatgaagtatttgcaagatttagtgcccggttgcaacaaagtcacgggaaaagctggaatgcttgatgaaatcatcaactatgttcaatctcttcaacgacaagttgagtttctctcaatgaaattagctgctgtgaacccaaggcttgacttgagtattgatgatctatttgacaaagatgttttttctacttgtgctacaaattttccaaacataggaatttcatcaacatcagacatttctaaccctgcctatcttcagtttaattccccacaacaaattttttcatatgatggattagacccatccgatatggggctcagaaggaccataagtgctcctgtatcaatgcctgaaacatatcttcaatcgtcctgtttcacacaaatgcttacctcctcaacatggggaagggatttccaaaacctttgcaattttgatttgatcaagcaccggctacatcttttccctcttanc

SEQ ID NO: 6893 - DNA, 842 bp, Glycine max
  Predicted polypeptide sequence is orthologous to G1133, G1137
aaaagaagccccccccccccccccccccccccccccgccatgggttagacggtcgctagatacgccagcgcgctattaaccctcactaaagggaacaaaagctggagctccaccgcggtggcggccgctctagaacttgttgatcccccgggctgcaggaattcggcacgaggctcgtaacttcaatgcaaaggaaaaactccctgctggccacgcgaaagatttaggcgaggaaattgcgccgaatggggaactgggtttccctcagaagcaattcctggttattgatcaaacgggtgatcaaacaactcttgttcatagttcaaggtttgggggtcctcttgcttcctggaattcaaagctgcatggtttcaacaatttgaacaatgggaatgaattgcttaatttaaggagagatgtgaatcatgtggttggacttggaccaactttgaacgataaagttgatgaaaatcaaagaactgatgatgacattgaaagcgagatgcatgaggacaccgaggaaatcaatgcattgctttactctgagagtgatggttattccactgaggatgatgatgatgatgaagttactagcacaggacattcacccagtacaatgaccacacacgatgataaccaggaagaaccggataggtgaaccgccaaagaagttgctagctccgttggagagacacagaagcgaaactatgggacggtgctcatgacgacagcgatatgcagttcatggacactgctaatgctctgaatgggacaagactgctcggagctggagatgatgccgaatgaaaatgctccagtggctgccactgtagtagagggta

SEQ ID NO: 6894 - DNA, 393 bp, Glycine max
  misc_feature (60)..(60): n is a, c, g, or t
  Predicted polypeptide sequence is orthologous to G1145
ttttttttttttttttttttttttttttacctctcaaggcatgattaaaagggctatatngtgaatggtataactagcaatatttttcatttttttctgaagaactttcacagaggagttataaagaacttcacaacaattaaaagcaagccattggatgcaaatgcatctcataactattcctggcataccagattcaaccgcacagtaatccacaaggagaattccctgatactcgtatatacaaacctctacaactaggtacagatctcagaatggagctgatgctattcggcgaagttgatatttaggttcaggagggggttcacatggcaacatcagctctagctcctttagtttcctcagcctttcattttcctcttcccctcgtgc

SEQ ID NO: 6895 - DNA, 595 bp, Glycine max
  Predicted polypeptide sequence is orthologous to G1145
tttttttttttttttttttaaatatacaataatggtaatgaagtttaaatttaagattccacattaattactaaaatcccaactactagaccatcttagtaaaaactccaaaatcaggttatcaaaaaattgaaaactcttcctctaaaaaaaaaattataagaattcaatccatttataatccttgtgtttgtttcccaaacatttgaaagttgaaaacatccaagagtcatgatgggttcctttccttctcaaaatggagatgatgaggttctacacagagcggccattctgggagtgggagggttatcagaggaggacaagcagcactgcaactctttcaattgtctttttagtctggaattctcttccgttaaacgggcaatttcaacttccaagccttttctataagcctgttttctagctctggaccgaaccgcggattctcgattttttattatacgcgcatggcgttgatctagcagggtggttttcttagagccggaggcttcgaaggaagtgttggagacagaaagaagagagtggtcatggtcatgtatgtgaaagacagaagaggaagtggaagtgaggttaa

SEQ ID NO: 6896 - DNA, 816 bp, Glycine max
  misc_feature (15)..(17): n is a, c, g, or t
  misc_feature (639)..(641): n is a, c, g, or t
  misc_feature (688)..(688): n is a, c, g, or t
  misc_feature (704)..(706): n is a, c, g, or t
  misc_feature (731)..(732): n is a, c, g, or t
  misc_feature (734)..(735): n is a, c, g, or t
  misc_feature (766)..(766): n is a, c, g, or t
  misc_feature (768)..(768): n is a, c, g, or t
  misc_feature (771)..(771): n is a, c, g, or t
  misc_feature (800)..(806): n is a, c, g, or t
  misc_feature (808)..(814): n is a, c, g, or t
  Predicted polypeptide sequence is orthologous to G1145
ttttaaagaaccttnnnagaggagttataaagaacttaacaattaaaagcaagtcattggatgcaaatgcatcacatagctattcttgacatactggattcaaccacacagtaatccacaaggagaattccctgatactcaaatatacaaaccgctacaactaggtacagatctcagaatggagctgatgctattcggcgaagttgatatttaggttcaggagggggtgcacatgacaacatctgctctagctcctttcgtttcctcagcctttcattttcctcttccaggcgcgagactttattctccaattcatttgtgtatgcctgtttccttgctcttgaacgggcagcagattcccgattttttatcatccttttctgtctcctctcaacagtcttctctatcatgtcctcagaagtgctcttttttcttccaggagtctgcgtatctgacattgttcccatcagagacgatggcattgccatctgattatctgcaaacgaaacatctaatgaagctccagcccccatgtgtaatggctgtaccataccttggctaggcatatacatccccattaaactttgtggtggatgctgatattgtgcttgtggatattgtatccactgtgcttgtgannnaaactgtggtactgccacgtttgaatcaactccagctatagtactgntatttgttctattagnnnatgcacctgcaacaacacctgcttnnannaagaaatcctccaatgtcatttctcccaaantnggntgtctgtcttggaacttcttctcccctannnnnnngnnnnnnngg

SEQ ID NO: 6897 - DNA, 838 bp, Glycine max
  misc_feature (552)..(552): n is a, c, g, or t
  Predicted polypeptide sequence is orthologous to G1145
ggggagatgatagcttcgtgtgattatcgcacgcgcgcaattaaccctcactaaagggaacaaaagctggagctccaccgcggtggcggccgctctagaactagtggatcccccgggctgcaggaattcggcacgagggagaaaactgtggagaggaggcagaagaggatgattaaaaatagggaatctgctgctcggtcacgggcaagaagacaggcatacacacaagaactggagattaaagtttcacgattagaagaggagaatgaaaggcttagaagactaaatgaaatggagagggcattgccatctgtgccaccacctgagcctaagccaaagcaacagcttcgcagaactagttcagccatcttttgatatcttaattgcaatgaattcctaattcttgcccatgctatcacattacaatacctctcatgtgcattatactcccgcctcttcaagtttggttatagatgggaggctattgtttgtgatgctatcagttctccccagcttgctctattctactaatgtttacctcttatgtatatnttgataagtttggcttacaacttaagctgctctataaatatacttactctaattttgggcccatttgtgggaattatgaaattataagtcttactttttatttaaaaaaactaaaaaaaaactcgagggggggcccggtacccaattcgccctatagtgagtcgtattacgcgcgctcactggccctcgtttacaacctcgtgactgggaaaaaccctgtcgttacccaccttaatcgccttggagcacatccccctttcgccaggtgggatattatccaagaagt

SEQ ID NO: 6898 - DNA, 847 bp, Glycine max
  Predicted polypeptide sequence is orthologous to G1146
tgcagaattttcttacaatatgaacatggataattttttcacctctaattagtttctgtctactatatatatgctgctgtttctctactttgaagccttttattgtgcctaattcaactgtaaaacataacattcttcaccctgctctattcaacagtaaaacataacattcttcaccttctctttcagagcaggcagtggccgaacaggcccttctttcaatcttgttcctcgcagttttgtaatctcagcaacatcaggttccatgtagaatcgagccctgtaggctgctagatgagcataatatgctggaggcactactgaaacagaccgtgtacatcttgcataagtgtagcacaaattattggttagagactgaatttcatctgcagtgaaattgttctcgtcccagaggacatgatagtgtgctggtctacttgtaccctgaattcctgcatgactgcataagtagaagtcgaattcggaaggatgacagatcttagaatctaccacagtaccaggtaagatattcccactcttatcagtgctatttctgtcgtcatgattgtttgcgaagagtctagtgtgatgccgtttttgaacaactacaaatgttactggaggttggtaactaggttccaaggatgcacaagccttgcgaatggcatcaagctcatatagcaaaacctggtagaactgtccctcacttaccccatccctgtaaaagattattctcaatggtttttgtcctgttgccttcttaaatgatagtaaaagctccctgcagtttcacaaagtagtatgaactaattagcatgcagacgttagataacatcaaataataaat

SEQ ID NO: 6899 - DNA, 975 bp, Glycine max
  misc_feature (801)..(801): n is a, c, g, or t
  misc_feature (898)..(898): n is a, c, g, or t
  misc_feature (957)..(957): n is a, c, g, or t
  Predicted polypeptide sequence is orthologous to G1146
acaaagattgacagagaatattttttacaatgctaaatttggcatctatataaaacctaataatgcttgtagaaattcattctaaactatggctcaagaactgtaatcatggatctaccacagcaaaacctacacgactaatgtacaaagtaatgtgaggtgaacattgcactccatgatttgaaaacttgcttatcatgttgatgcttgccccatatatctatcattctaccaaggccaagccactaagcagtctaacagtaaaacatgactctcttcacattttctttcaagtctggcaatggcttgacactataatcaccagctgctcgtgttgctttggcaccatgaccattaccgtcacctgcagagccattgtcttgcatatctggttccatatagaaacgtgctcgaaacgctgctaaatgtgcataatatgctggaggaacaactgatactgagcgtgtacacctggcatatgtataacaaaggttgtttgtcagagactgaattccatcaggtgtgaagttgttttcatcccacaggacatgataatgagctggccgactagtaccctggatgccagcatggctgcagagataaaaatcaaattctgttggatggcagattttggtatcaacaacagtcccaggcaatatattcccactccgatctgtactgcttctgtccctgtagttgtttgcaaataaccgggtatgatgtcttttttgcacaactatgaaagttactggaggctggtagtttggttctaaggaagcacatgccttccgaattgcatcntactcataaagtaaaacttggtaaaattgtccttcacttacaccatccctgtaaaatataatttcgtagtggcttttgtcctgttgcctttctgaangaaaacagtaaatctcggatcatgccaccactaactgtgccacgaacagggtcttgccnagttttgtacaatcttgt

SEQ ID NO: 6900 - DNA, 995 bp, Glycine max
  misc_feature (1)..(7): n is a, c, g, or t
  misc_feature (14)..(14): n is a, c, g, or t
  misc_feature (19)..(20): n is a, c, g, or t
  misc_feature (795)..(795): n is a, c, g, or t
  misc_feature (880)..(880): n is a, c, g, or t
  misc_feature (995)..(995): n is a, c, g, or t
  Predicted polypeptide sequence is orthologous to G1146
nnnnnnnaaccccnccccnnttaccgcccccccctataaaataaacaaaagctggagctccaccgcggtggcggccgctctagaactagtgtattccccgggctgcaggaattcggcacgagatcaggttctactgtttgagcttgatgctattcgaaaggcatgtgcatccctggaacccaattatcagcctcctgtgacttttgtggtggttcaaaagcgtcaccacacaaggctctttgctagcaaccatcatgataagagttctgttgacaagagtggcaacatattgcctggcactgttgttgactccaaaatctgccatcccaccgaatttgacttttatctctgcagccatgctggaatacaaggtacaagccgtcctgctcactaccatgtgttgtgggatgaaaacaattttactgctgatgccttgcaaacactcaccaacaatctttgctacacatatgctcggtgcacccggtctgtttcaatcgtgcctcctgcatactatgctcaccttgctgcattccgcgcaaggttttacatggaaccagagacgtcggatagtggctctatgacaagtggtgctgttgcacgccgtgcgatgggcggtgtatggcgtagcacgcgtgtacctggtgccaatgctgctgtgagaccattgcctgcactcaaggagaacgtcaagagagttatgttttattgctaagacatgactgccacagattactgttagaacctcgttagtggagtgcttcttttgcttcaacgttctccagcagtcgtcattangtattgagttttttgaactactccacgagtgtggtgcgtcgaattacgtgtgtcgccttgaaagcatctcctgcgacgagtgctntctactttgctgtgtgaggaatgaagttgatgcaatatgcttatgtcgaagtactcgtcgtgccgttggaggtgcataaataaaacaaaaaaataaacttaggtggtccgtcccn

SEQ ID NO: 6901 - DNA, 976 bp, Glycine max
  Predicted polypeptide sequence is orthologous to G1181, G1850
gaacgcgaaagtatcgttttcttctgagaagcttctacgaaaaaagtcccaaacggttaacgacgtacatttgccacgcgcgtctccgtgctcaggactctgattctctgcgacgcccctagcttaacctaacgtgttcctagctgctgttacaacgtcgtgtgtcaattacacactctctgatttgctctatgacattgatttagccacggcgtttttttattttcgccacgtcttgcgaaatccaacgcttcggatttcacgtccgcatggaacggctgatgcagactcaaaaccgtatcattctcttctctcgctcgcttcgtaccaatcaccaccccaaacagcttcggattcatctcctccaccgcatcctcgccgaagcaccgcgccgccacccccgcggaaccaccgtccgcttgaacgttagcgtaattcgacatgagattgaatatattgttgcagagcgatctcatctcctccaattccttcgttaacagaatgttctccttcctcagccggtcgttctcatccaacagctccgccggcgacgagttagacgaaatcacctgctcctccgctgagttcgacggcgacacgatcagcttcgccggcggaatcgtagatagcggcagcggagatagaaccgccgcggtcgcagtcgctcgggtcggcggcgttgccgggaggatcttccgtcgctgtatttcgcagaggagccgcttctcgtctcttcggaaatactcgttcgagaactcccagcggtcaggtacaacttttataagtgttgagttggcgaacgaagctggagaaagtgttgtgcttgaaatatttaggaagcaaatccttggcgaaagcggtggtgttccagacgatgaaggacgatccagaatcgttccacgaaatcacatggtcgatggtgtgatcgtcgacaagttggaagggtttggtgagaaacggcgtcgcgacagcaaca

SEQ ID NO: 6902 - DNA, 1386 bp, Glycine max
  Predicted polypeptide sequence is orthologous to G1181, G1850
gaattcgctagggatttgcttcctaagtacttcaaacacaacaactattccagtttcgtccgtcagcttaacacctatggtttccggaaggttgtccctgaccgttgggaattcgccaacgactgtttccggcgaggcgagagagctcttcttcgcgacatacagcgccggaaattactgccggttccgcctgcagccgcggcaccgacagcagtcacagctaatacggtgacggtggctgtggcggcaccggcggtgagaacggtgtctccgacgacttccggcgacgaacaggtactatcctcgaactcatctccgattgctgggaataataataatacagtgcaccgtaccacaagttgcaccactgcgcccgagctgctagacgagaatgaaaggcttaggaaagagaacatgcaactgagtaacgagttgagtcaattgaagggtttgtgtaataacatactcgctttgatgaccaattatgcttctggttttagccgccagcagttagaatcctccactagcgctgcgaggaccgtgccggtgccggaagggaaggcggcgctggagcttttgcctgcgaaacatgtttcatcggctgatgaggccgggcatgtaggtggtgccgcgccgtgcgcgacggcgaacgcgggggaagcagaggttccgaagctgtttggggtttcgattggactgaaacgatgtaggacagagtgcgagggcgaagcggagggagaagatcagaatcaaatgcaaacgcgagcacaagcacaaacgcaaacacaatcgtcgcaagaaccagatcacggttcagatgtgaaatctgaaccgcttgatggcgatgactcggatgatcaggatcatgatcctcgttggttggagctaggtaaatgaaatgatgctcctccttcttctaatttggtgaaaatgacagaaggcacgtgacttgggtggggacacgctgtactattagcgctgcgacgctgccattgattgggccatgtatgtaatgtaacattacgctagatggaaagggcggatgaccatccttgtatgtaactcgcggatgggatgaaaagtgtcaaagtcaaagctttgcttgagcgccaaaatttgtaatataaggatttatgtattcttgataagctggggttaaagaacatgtcaaaatggagtaactgaagcaacccctaaaagattcacttctcgttttcctttttaaggaacatttgtgggttacagcaaaatatgtagataaacgtgtctgacatcattacatttttcgaatttgattcgtgtattctaatgtttccatcctttgaaccgagttgttcctaagattcataatcgtaccatgtttctttttaatgaaaaaaaaaaaac

SEQ ID NO: 6903 - DNA, 1207 bp, Glycine max
  Predicted polypeptide sequence is orthologous to G1181, G1850
gaattccgcttcattgtatggcgacccgcggaatttgcaagggatttgcttcctaagtacttcaaacacaacaacttttccagtttcgtccgtcaacttaacacctatgggttccggaaggttgtccctgaccgttgggaattcgccaacgactgtttccggcgaggcgagagagctcttcttcgcgacatacagcgccggaaattactgccggttccgcctgcagccgcggcaccggcagcagtcacagccaatacggtgacggtggctgtggcagcaccggcggtgagaactgtgtctccaacgacttccggcgacgaacagccgccagcagttagaatcctccacaagcgctgtgaggaccgtgccggtgccggacgggaaggcgccgctggagcttttgcccgcgaaacatgtttcatcggctgatgacgccctgcatgtcggtggcgccgccggtgccgcggcgtgcgcgacggggaacgcggcggaagcagaggttccgaagctgtttggggtttcgattggactgaaacgatgtaggacagagtgcgaggccgaaccagaaggagaagatcagaatcagatgcaaacgcgagcacaaacacaatcacaatcgtcgcaagaaccagatcacggttcagatgtgaaatctgaaccgcttgatggtgatgattcggattatcaggatcatgaccctcattggttggagctatagggaaatgaaatgatgctccttcttcttcttgatctctctactaatttggtgaaatgacagtgcgcacttgctgcctgtactattagtgctgtgacgctgccattgggccggcacgtgacttggccatgtatttaactcgcggttggggtgaaaagtgcgaaacattgtactataaggaattatgtattcttctgattgctgggggttaaagaaagattatcatcgcgtcaaaatggagtaactgaagcaagggaaggacagacccctaaaagactcacgtctcggttttttatttcaaggaacatttgttggatacagcaaaatgtgtagatatttgtgtctgacatcattaaattttcgaatttgattcgtgtattgtaatgtttccatcctttgaaccaagtttgttcctaagcttcataattgtagcatgtatgttcttttaatgaaatgaaattctaatattatctaaaaaaaaaaacggaattc

SEQ ID NO: 6904 - DNA, 997 bp, Glycine max
  misc_feature (784)..(784): n is a, c, g, or t
  Predicted polypeptide sequence is orthologous to G1190
aaaaaaaaaattgtatatcaactcatacattgcattgcatggcttagctgtataaatacagcactgaatcaaatgatcatagagaactaatgtaacagtacccagtattaatacaaaacgttgtattattctctggtaaggaggaattccaattcatgtataggtagcatatcatatgctttctgtcggaattaaaactttcatttcttcacatgaattcacttagatattacacaacaacaacaacaacaaaaaatagatagaggagagtggtagctgatacaattgatgccatataaagaatagtatctatatgaaaattttctacataacttaacaaaatcagattattaagttaccaattcttcatttgataaatttgaacttgacggagaggcttctatatcatagaataaatcaatgtttagttgagggtggctctgaattcgcttccctttgcttctgcttctggatttacaattgtagccaccccctctcaccactgcacaggttccagagtttgtcatcttgaaccattgttggatgagtgcaatagctttttctggcatatcagaatcttctctttgtcaactccatactcggtgttttctttgcgacatacccatctcatacccttgccaatagtagcaatggcatccacaaaataaacggactctcgaatgatagcatgcccagcaggtcttaaaattcggtccatttccaacagcacatgcttcatttcacatctgtggctttcagcagagaagagtccatcaagatgaangaggtcataggttcgaggatatgttgaaaaagcttcacaccagtcatggaggattccaataagaccgcgatcaaaaaccacaggaagtgtgttgggagcataagatgagaccacattcatgacccacaagggatcattgatcaaggctgcagcaaaagctccatatactgtattcatgtccatgacattttctaccttgtcagtgccaagttc

SEQ ID NO: 6905 - DNA, 903 bp, Glycine max
  misc_feature (817)..(817): n is a, c, g, or t
  Predicted polypeptide sequence is orthologous to G1190
ggcgggaaaaagatcacggtattattactgtatcatactcaacattgatacaagtgtagtgccattctttgtgaaaacaaatatcctgtacaaaaatatcagcatccttcaaatgacagctctcatgggaaatcatatgcttcctgtggggttcaattccttcatgctggcagcattttgttactaaacaaacatttttttttgtcacttgttcttcagaaaaatttgaacttggctgattcatggctcaatattatagaattcgagtcaacatactctgcatttgctttcctttgcttctcctccaccatctcaccactgctttagttccatagtttgtcatcttgaaccctggggttggatgaataccatagctttttctggcatactaatatcttctgaatgccactgccattctcagtatcttctttacggcattcccaacgcatacccttaccaatggttgtgatagcatccgtaaaataactggattcgcgaatgattgcatacccactaggccgtaagattcgatccatctccagcagcacgtacttcatttcgcacctgtggctttctagggtgaagagtctatcaagatgaagcaagtcatatgttcgaggatatgttgaaaaagcttcacaccagtcatggaaggttccaataaggccacgatcataaaccatagggagtgtattggtagcataagatgagactacattcatgacccatacaggatcatcaatcaaggctgcagcgaaacctccatatactgtattcatgtccattatgtttcttattttgtcagtcccaagctcanggatcaacttcttgtagtacgcagcctgctttttcccactactgtcgtcatgtttgaatgtactatcactcccatgatgaagcatt

SEQ ID NO: 6906 - DNA, 1230 bp, Glycine max
  misc_feature (1)..(1): n is a, c, g, or t
  misc_feature (47)..(47): n is a, c, g, or t
  misc_feature (119)..(119): n is a, c, g, or t
  misc_feature (813)..(813): n is a, c, g, or t
  Predicted polypeptide sequence is orthologous to G1190
naaggacggaaggaggaggaagaaaggggtgggcagggggggttgtnaagcgtgcaattaacccctcctaaagggaacaaaagctggagctccaccgcggtggcggccgctctagatcnagtggatcccccgggctgcaggaattcggcacgaggtcatgaatgtggtctcatcttatggtcccaacacactccctgtggtttatgatcgtggccttattggaaccttccatgattggtgtgaagctttttcaacatatcctcgaacctatgacctccttcatcttgatggactcttcactgctgaaagccacagatgtgaaatgaagtatgtgttgctggaaatggatcgaattttaaggcctggtgggcatgctatcattcgagagtccacttattttgtggatgccattgctactattgccaagggtatgagatgggtgtgtcgcaaagaaaacaccgagtatggagttgacacagagaagattctgatatgccaaaaaaagctatggcactcatccaacaacggttcaagatgacaaactctggaacctgtgcagtggtgagagggggtggctacaattgtaaatccagaagcacaagcaatgggaaatggattctagccagcatcaactaaacattgattcattctataatatagaagccaagcaatcgtcgagctccactctattaaacgatgaattcggcactccgtaatgtgatcctggtcacgtatctacaccattctcaatcgatctcatctttctttgcatccaatgctcagctaccaatctctatatccacttttggtcgncgtgtgcgtccacactatcatcttacaactctacattaccttcgtcgctccctcctctccctcccctttgtcgctcattatccctcctcggcgcgccgtctctcactctgtatagtgctctctccttctcatcgctctcttcaagtcctctcttcactctatgctctcgtcttccctcgccgttcccctcccgctctccgcaacgccgcgtcctctggatattatgtgtttttttttttttttcggttttcccccccccccccccccccccccccgtccgtgttttttgccccttttttttgctctgccgtcccccccctcctttatctgtgcctccccccccccccgcccctccctgtgtgttgtttctacatgcatgtatgtgcttataggcgcttagtcttcttactctctcct

SEQ ID NO: 6907 - DNA, 310 bp, Glycine max
  Predicted polypeptide sequence is orthologous to G1206
aaggctgatgtaccatgtcatctcagctagtgctatatagtatgtgatgcatttatgggtttgacgtcaaacgtgtgttgccttgcttttcaatgctttgtaccgaatcatagtgtcatttatttgttcattacatttttattttagtatgtgtgatcttgttacctattacccgtttaattgttttagtttgcatgcaatgcaacaaggaatcagtttgcttgatgtgtttgtacatagttaatgctgaattgttgcttgtaaagtaaaattaggtacttatttgcacggggcatgtaaaaaaaaaaaa

SEQ ID NO: 6908 - DNA, 737 bp, Glycine max
  misc_feature (631)..(632): n is a, c, g, or t
  misc_feature (650)..(656): n is a, c, g, or t
  misc_feature (668)..(669): n is a, c, g, or t
  misc_feature (677)..(677): n is a, c, g, or t
  misc_feature (679)..(679): n is a, c, g, or t
  misc_feature (681)..(683): n is a, c, g, or t
  misc_feature (685)..(685): n is a, c, g, or t
  misc_feature (691)..(692): n is a, c, g, or t
  misc_feature (699)..(701): n is a, c, g, or t
  misc_feature (704)..(705): n is a, c, g, or t
  misc_feature (721)..(722): n is a, c, g, or t
  misc_feature (735)..(736): n is a, c, g, or t
  Predicted polypeptide sequence is orthologous to G1206
actttacttcctttctaactgaactcagagtcttttttccctaaattactgaaaggttaaaataaaaaaaatacacgtgtcttgaactctttcataagctttatcttcaatcttgtatctttccaaggaaaaaaaatggcagtctttgtattttcttaggccatgaatacaacatttccattaactatttttttaattcttgtggccattacaacattttcactatgttattaccaaaatggaaaacactcgattgtgagtgcctctgatctttcaataaagattcttacttcacaattttctatctggactctaaccctccaataaacattctaacttcacaatttctatctggacattgttattatattcacagcaatctagagtatcatcgaccatggcaaaatgaagtagctttctgcaaaccagtcaagaacacttcagtaaatctttcaagtctttgacagcttgatcaacggcataaactatcatcttctttatctcaagcttatcttctctagccttgtggttcttgggaagctggcggaactcattagttaaacgtagacactcacggatattttctggggacacaaagtctacagcaacttttatgcatgacttgagattnntgacttgatgcgggcatnnnnnnngaataaatactnnctccccangntnnngntcaaanntccatgnnnctnnacctaaaagtcaaganntgcataaataacnna

SEQ ID NO: 6909 - DNA, 748 bp, Glycine max
  misc_feature (1)..(1): n is a, c, g, or t
  Predicted polypeptide sequence is orthologous to G1206
naggtgactcgctgattacggcaagcgcgcaattaaccctcactaaagggaacaaaagctggagctccaccgcggtggcggccgctctagaactagtggatcccccgggctgcaggaattcggcacgagggtcctcaccaagtcagaaatctgaagtcatgtattaaggttgctttggattttgtctctcctgaaaatgttggggagtgctttcgtttgacggaggagtttcgcacacttccaataaaccacaggtctactgaggacaaattggaggtgaagaagatgacaatatatgctatgcaagaagtgataacaatattagagaaagcaaggtccaggcaaaccatagttccagagtagatatatgtttaacagatcagagccaattgaaagtgtaaatttttttagtcaagctgttatacaggtgtgatgatgggttctgtatatcgtggctgaaaaaacgggtccatgttttgacttcgccaacacctggatgggtttttctcggggaaaacaagtgggctggagacggggacaagtgaactgtaggtcgaccagtgggcaggtagcaggaaggaaacggagagagagagccggtgggtgggcgggaccgaaagaaggcatgaaggagaggatacgcggacacagacgccgggtcgaccagcgtgggaagcgacatcgccgcagagcgccggcacaagcggtggcggcgaggcgcatggagagaagaggagcggcgaaggca

SEQ ID NO: 6910 - DNA, 139 bp, Glycine max
  Predicted polypeptide sequence is orthologous to G1206
ttttttttttttttttaataagttcattggatctcaagcatgctttgcagttgcaattaccacggcacacaggacatgcctcagcaatataatcctctttcaaatgaggataccaattttctatacagtggaacacaaa

SEQ ID NO: 6911 - DNA, 619 bp, Glycine max
  misc_feature (12)..(12): n is a, c, g, or t
  misc_feature (18)..(18): n is a, c, g, or t
  misc_feature (28)..(28): n is a, c, g, or t
  misc_feature (54)..(54): n is a, c, g, or t
  Predicted polypeptide sequence is orthologous to G1225
tttaaaccttgnacctgnatacgccaancgcgcaattaaccctcacttaaaggnaacaaaagctggagctccaccgcggtggcggccgctctagaactagtggatcccccgggctgcaggaattcggcacgaggaggaagaagaggagaaggaaaccaagggtttgcaaaaacaaggaagaggctgagacacaaagaatcacccacattacagtggaaagaaaccgccggaagcagatgaatgaacaccttgttgtccttcgttcactcatgcctgagtcctacgttcaaaggggtgaccaggcctctatagttggtggtgccatagagtttgtgaaggagctggagcacctcttgcaatcacttgaagctagaaagttgcaacttttacatcaagaagttgtacaagccaatgaaaatacggccatttccaaactcatgcaacccccttttgcacaatttttttcgtatcctcagtacacatggtcgcagactcctaacaaatacacatccaagaccaaagctgccatagctgatatcgaggttactttaatcgagacccatgcaaatcttcggattctcactaggagaaacagccccgggcagctaacaaagttagt

SEQ ID NO: 6912 - DNA, 809 bp, Glycine max
  misc_feature (4)..(6): n is a, c, g, or t
  misc_feature (20)..(20): n is a, c, g, or t
  misc_feature (22)..(22): n is a, c, g, or t
  misc_feature (40)..(40): n is a, c, g, or t
  misc_feature (42)..(42): n is a, c, g, or t
  misc_feature (48)..(48): n is a, c, g, or t
  misc_feature (594)..(594): n is a, c, g, or t
  misc_feature (597)..(598): n is a, c, g, or t
  misc_feature (600)..(600): n is a, c, g, or t
  misc_feature (611)..(611): n is a, c, g, or t
  misc_feature (630)..(630): n is a, c, g, or t
  misc_feature (809)..(809): n is a, c, g, or t
  Predicted polypeptide sequence is orthologous to G1229
gggnnncattggattgagcnantgtacggatcggcgcaananaccctnactaaagggaacaaaagctggagctccaccgcggtggcggtcgctctagaactagtggatcccccgggctgcaggcttgcgctcgaaatcgttcatgtcaacattaactgtgctgcggatgataccatgctaaactcattcactatcaagattggaattgaatgccaactcagtgccgaagaactcgctcaacaaatccagcaaacattctgctaattataaaagatgggttatgtttttccagagtccagaccaaacatcagcttgcatgcatccctctctctctctctctcttctcttattgtgttgtacgtaccttgctgtacaaataacatagaacatgggaagagccatatttaatttttcaaccatttatcatttttctttctttttaattattacagcaattgctagtgtaattcctcatgatgacaagtattagctagtttattagtatagagtgacaccactctcttgtaattgaccaccgtacgtcaagctgtgatttgtgtatgaattaaattttcatttcccaaaaaaaaaggnggnngnggggggggganaagaaaaaaaagaaaaaanaaaggaaagaaaaaaaaagaaaaaaaaaatctcagggggggcccgatccccaatcccccctaatatagttttattaccccccctctatggcctgttttgacaactgagacatggaaaaccttggtgttcccaacttatttcctttccacccatccgctctttcccaattggtgaaaagn

SEQ ID NO: 6913 - DNA, 920 bp, Glycine max
  misc_feature (71)..(71): n is a, c, g, or t
  misc_feature (920)..(920): n is a, c, g, or t
  Predicted polypeptide sequence is orthologous to G1242
ttatttccgcggcaagaatcaccccccggcaatgttcgccctggtcttttcccgggggagatcccccaacnctgggacaaaataacttgttaatcctcactaacgggggcaaaagctggagctccaccgcggtggcggccgctctagatcataattatcccccgggctgcaggaattcggggggagatgatatgcatggtgcacaaacctggctatgggaactgggatgagttaaaggcagcatttcgaacatcacccttgtttcgatttgattggtttgtcaaatctcgcaccactcaagaactggctaggaggtgtgacaccctcattcgactggtagaaaaggaaaaccaagaatatgatgagagggagagacaagctcgcaaagagaagaaactcgccaaaagcatgaccccatcgaagcgtgctttggcaagacagacagagagtccatcttctttgaagaagcgcaagcagttaaccatggacgattatgcaagcacggcgaagagaagaaaataatgaacatatgctctatattgcgtaggataagtaaggcgttgctgggttttaaagcccttggtgataaggatgtggcccatacttggcaattgatggccaggctagccttccaaaagccgtgctagtatgctaacaacctctaacttgtgtaggctccatatatctgccgcttggctagttagagaatatcaagcagatccgaggtgtcgtattgtaagtatgtatatctacaagacatatccttagaatcaacgactagtaccatgacaaatatgtagttctaaccaatgctatgttcgaagtacactgcattaagtcaaccgtcgaaaatcacgcctggcctttgtattcccatgtggtaagcctcattctgatgccggtatgacggctgcttaaan

SEQ ID NO: 6914 - DNA, 926 bp, Glycine max
  misc_feature (1)..(3): n is a, c, g, or t
  misc_feature (781)..(781): n is a, c, g, or t
  misc_feature (830)..(830): n is a, c, g, or t
  misc_feature (918)..(918): n is a, c, g, or t
  Predicted polypeptide sequence is orthologous to G1242
nnnaactccgaaaagtttagccagtatgacggcgagcgcgtcatttaaccctcactaaagggaacaaaagctggagctccaccgcggtggcggccgctctagaacttttggatcccccgggctgcaggaattcgggaccagggcaagctcgtaaagagaagaaaattgctgctaagagcatgaccccatcgaagcgttccatgcctagacagagtgagagtccatctctgaagaagcggaagcagttaaccatggatgactatttgagctcggggaagaagaaaaaataaatggacgtatgccctatatttttctttgggaaagtggggttggatggtgtggcgaatttatatggcctagctgacatttcaagtgatggcctggtgtgacttcccaagtccagcactactggcctcgtgatttttgtgggcctgaatataatgtttgattattgaaattttgtaaatttactaacaaaccgatagattagatgcttattttattttaactgcagccaattcaacatatttaatgttgtaattcttcatcctagtgttttttagtcatacttaaaaaaaaaaaaaaaaaaactcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagagccccgcaccgatcgcccttccccacagntgcgcagcctggatggcgaatggacgcgccctgagcgcgcattagcgcngctggtggtgtgtcgcgcacgtgacgtacactgcagcgcctacgcccgttcttcgcttctacttcttcttgcacgtcgcgcttcccgnaagcttaa

SEQ ID NO: 6915 - DNA, 901 bp, Glycine max
  misc_feature (573)..(573): n is a, c, g, or t
  misc_feature (703)..(703): n is a, c, g, or t
  misc_feature (717)..(717): n is a, c, g, or t
  misc_feature (719)..(720): n is a, c, g, or t
  misc_feature (842)..(842): n is a, c, g, or t
  misc_feature (901)..(901): n is a, c, g, or t
  Predicted polypeptide sequence is orthologous to G1246
aatgacgactgatgtagacaccccgcgcacttaatcctcactaaagggaacaaaagctggagctccaccgcggtggcggccgctctataactagtggatccctcgggctgcaggggcaagggtgtcaaatgatgcctgttgtattatgtatgttaaattgtaagtcactgttagcttagaaagtatagggattctgcaggtcatttgttgtgagattaataatattcacgaatgagtctacgtcaacttagacaggtttatttttttctttcatttgttctctttttttttggtgattacgttcagggaaatcaggttcaggaattggaaatgtatttgctgtataaatagttaaattagcgacattttttttttacctaagtaactaggtaacatggatttatgacatgcacgaacatgtgcagcctgaatggtaacactggtccttgcactagcaaaaaaaaaaaaaaaaaactcgagggggggcccggtacccaattcgccctatagtgagtcgtattacgcgcgctcactggccgtcgttttacaacgtcgtgactgggaaaaccctgncgttacccaacttaatcgccttgcagcacatccccctttcgccagctggcgtaatagcgaagaggcccgcaccgatcgcccttcccacagttgcgcagcctgaatggcgaatgggacgcgccctgtagcngcgcattaagcgcngnncggtgtgtgttacgcgcagcgtgaccgctacacttgccagcgccctagcgcccgctcctttcgctttcttcccttccttttctcgcacgttcagcggcttttcccgtcaagctctaaatcgnggctccccttaggttccgattagtgctttacgacctcgaccccaaaaacttggattagn

SEQ ID NO: 6916 - DNA, 952 bp, Glycine max
  misc_feature (1)..(1): n is a, c, g, or t
  misc_feature (29)..(29): n is a, c, g, or t
  misc_feature (32)..(32): n is a, c, g, or t
  misc_feature (34)..(34): n is a, c, g, or t
  misc_feature (904)..(904): n is a, c, g, or t
  misc_feature (906)..(907): n is a, c, g, or t
  misc_feature (909)..(910): n is a, c, g, or t
  misc_feature (913)..(915): n is a, c, g, or t
  Predicted polypeptide sequence is orthologous to G1248
nagtgacgcatcagcatgcatttgcagantcngnccagcgcgcatttaaccctcactaaagggaacaaaagctggagctccaccgcggtggcggccgctctagaactagtggatcccccgggctgcaggtctgtgtttgagaggactaaagtaaacagatgggtgacaacaacataggcaaagtcttagagagagaaggctttaagtacaacttcacggcagctgcaagtgacacctctgcacaagatgaggtgattaaagagcaagatcggttgcttccaatagcaaatgtggggcgcatcatgaagcaaatccttcctcctaacgccaagatctcaaaggaagctaaagaaaccatgcaagaatgtgtgtccgagttcattagctttgtcactggggaagcttctgacaagtgtcacaaggagaagcgcaagaccgtgaatggcgacgatatttgctgggcccttgctaccctagggtttgatgactactctgagccacttaaaaggtacttgcataagtatagggagttcgaaggggagagagcaaatcaaaataagggtaacaacaacacttatgaaaacaacattgcaaacatataaattaattatgtggaaggtgaactctttctccaattcccatgatcaatgtgattgatagttgttaatctgatcttctagttttctcctgaatttgagatacttcaaggtgcttgtatccctatgtgatatttattatgacgtgagtatgtattgctacctcacgtgttttagaccctatattttcattcagggttgaaatacactagatgacacatggtgcttggaaaattatgtagtacaatcaactttgattggctttccaatatagcctgatcattcccgaaaaaaaaaacaccaaaaancnncnnccnnnaaaaaatcggggggcgggccatctcccttttggagtt

SEQ ID NO: 6917 - DNA, 840 bp, Glycine max
  misc_feature (762)..(764): n is a, c, g, or t
  Predicted polypeptide sequence is orthologous to G1255
ggcttaaacctgccgagaaagatgatcattaattagtactaattactaaacctgctagagatatatatagacagaaatatcccaagcaacaattctagtaaaattaacctgacccagtaatattatttactagtattaatataatgcaggctatatatacatacatatagccaaaccaagtattaacccaaatttgtagaaaaagcaaagatggatccgttaactgatgattgatatcagtggtaagcaggaaaagcattggctccaacaaagcatgtcctcttcacaaaacgacctttcattctaggccttttctctgcgttcaacttccttacttcatatcttatcttctttgcaaacaaacgagtccttctcttctctctatacctcgacactcttgcttctcttccaccatctaggtgtccccttaagcttcttccttctccatctacaccactcaaaccctggaaataacaaacactcacatgtcaatcatagatgatagatacaattgtgcatgcatgcgcagcatcctatctagcattactcaaagagatgaagagcatgttgggttaattttcagttgggaggctcccaaagtctactacaaaagtaaaattgaaaaagattcttgtttagttttcagttgggttagattttaattttttttatccgtgagaatcaaagtgttaaataatttacaacaactcacacatcctgttcaatcaaatgagccaagagttttgcttcaattttgcctcnnnacttaatttgaaatgaaataaaatgaagggttatttttgcaaacttaaatttgcaaattttaatctaaatatgtac

SEQ ID NO: 6918 - DNA, 852 bp, Glycine max
  misc_feature (40)..(40): n is a, c, g, or t
  Predicted polypeptide sequence is orthologous to G1255
gggagtgtagctggtttagaagagatcctcacgttatttncacacctcctcctccccctcccccccccccccccagagcaaacaatcggaccaactacggtgtttcgtctccaccccgggaattcggccctcgatgccaaaaatacaagcgcttgaattcaagcgtatgtatatgtgagtgtatatagctccttattacatagttttgttattgaatttgtcgaatttgttgcaaccgaagatatttagtgtttgaaaaatgtagaatgaccttttacattcttttgaagctcaaactcgatgatcactgtttgacatggaagtttttttttttgttaattaagggttcgaatggtgggaatgttcaatgctgttatggggcagcgggaagcttaagggtgcatgcagatgggggaagggaagcaagagtgtcaaggtaccgagagaagagaagaacgcgtttatttgcaaagaagataaggtatgaagtgaggaagttgaacgcggagaaaagacctagaatgaaaggtcgatttgtgaagaggacaccctttgttggagccactgcgttgccagcttaatcatcaatcaccactgacatgattgatcatcaaagtgatcaaataaatggtgaacttatccaagtctgatttaatggaaaagttagcttgattaattattagacactactgtttgccatgtatgtacatcatactgactatgtaacgtattctcttgcttgggatatgtattgtatacatctagcaggtgctagctacgtactaatcgtacatggctgacgccctatcatcatacctgaagaactatagggtatcgaatatctcggagccg

SEQ ID NO: 6919 - DNA, 643 bp, Glycine max
  misc_feature (319)..(320): n is a, c, g, or t
  misc_feature (403)..(403): n is a, c, g, or t
  misc_feature (635)..(635): n is a, c, g, or t
  Predicted polypeptide sequence is orthologous to G1255
attattccaagcgcgcaattaacccctcactaaagggaacaaaagctggagctccaccgcggtggcggccgctctagaactagtggatcccccgggctgcagaaaaaagtgattatcatcagagaatcctaaaagcacctagtctaagttttatccttaaattaaccaaattggttccctgaaatgacaaaggcacaaactaagaaaagatttataaatgcaaatactaaattgattagtatttgtctgatttgaaacataggaataagctaagttttggttaggtgggattgtgggaaggctgatgagattggggggnnttttattatgttaaattgaacattgaatgtttaggtgatttttgtttgactaatgaagtttagtgctgtttttaatcaagcanggaagttgcggaacggcatttcatcacccttacggtgaactgggtggatttgggattcattcagtgatagtagacgggggcagagaggcaagggtgtcaagatacagagagaagcgccgaactaggttgttctcgaagaaaaaaggtacgaggttaggaaattgaatgccagagaaagaccccagatgaagggagggttggtcagagggcttcccttgcaccaccaactttnccttgcta

SEQ ID NO: 6920 - DNA, 805 bp, Glycine max
  misc_feature (4)..(4): n is a, c, g, or t
  misc_feature (6)..(13): n is a, c, g, or t
  misc_feature (562)..(562): n is a, c, g, or t
  misc_feature (600)..(602): n is a, c, g, or t
  misc_feature (645)..(646): n is a, c, g, or t
  misc_feature (678)..(682): n is a, c, g, or t
  misc_feature (724)..(724): n is a, c, g, or t
  misc_feature (726)..(726): n is a, c, g, or t
  misc_feature (762)..(763): n is a, c, g, or t
  misc_feature (768)..(768): n is a, c, g, or t
  misc_feature (781)..(783): n is a, c, g, or t
  misc_feature (798)..(800): n is a, c, g, or t
  misc_feature (802)..(802): n is a, c, g, or t
  Predicted polypeptide sequence is orthologous to G1272
atcntnnnnnnnngaaagacttcgctcgcaacagtatcaaaatagttaaagactaaacacatgtaaaggcataagcaaaatgcctttttacatgtataataatcctttcctactaccaatggcgcccatagtcaacggttcaaacaaaaaaactatcctatgaagtcttataaacagcactgttatcagttatcactatccctagaactgcaacagatccttcaacaaaagaacattgagctcgaaacattttcctgcaatcttggcaactgagggacgggaggagcaggcataccagaaccaccatgactcgaagatgtctcagatttgtcttcaaatttcataaactgacccatctgagtagcagccagatgagcatagcaaattggagcaacgacagaaatggcagtggtgctcctctgatacacatatgataatgaatgtacaagctcttgtagatcatcaggtgaaaagccaatctcgtctaacagaacatggtagtgtgtgggcctgctagtaccaatcattccagcatgtgcacacatatagaaatcataattcngaggatggcaaattttgttatcaattacagttccaggnnnaacattgtcaggagctccaggttgaaagaatttagtatgatgnntcttttgagcaacaatcaccaaaaacttgggnnnnnacttttcatctaaaaacttgcaagcctcgataatttgatcangntcaatgttcaaaacttgattgaactgggactcactnncaccntccctgaatatgnnnatattatcgggcttnnnantcc

SEQ ID NO: 6921 - DNA, 800 bp, Glycine max
  misc_feature (25)..(25): n is a, c, g, or t
  misc_feature (30)..(30): n is a, c, g, or t
  misc_feature (32)..(32): n is a, c, g, or t
  misc_feature (50)..(50): n is a, c, g, or t
  misc_feature (53)..(54): n is a, c, g, or t
  misc_feature (73)..(73): n is a, c, g, or t
  Predicted polypeptide sequence is orthologous to G1289
ggaaggtaggtgtgagaggagaganggagngnggattgcaaaaactaganganngttagttcgtaggaggggntccccgccatcccggccctcgacgccaagaattcaagcagatggtgggaagcctttatatgagctcaataggattcttagaccaggcggtttctttgcatggtctgctacaccagtttaccgtgatgatgaaagagaccagaaagtatggaatgccatggtggatataacaaaagccatgtgctggaaggttgtggctaagggtcatgattcatctggaattggacttgttatataccaaaagccaacctgatcttcttgctatgagaaacgtgaagagaacaatccacctttatgtgaaaataaggatggcgagaatatctgatggtatgccagactcgatagttgtcttactcctcttccggttgatggtaatggtaacctgcagagctggcccaaaccttgtccccagaggcttaccagtaagccaccgagctgacctacagattcagatgcgcaggacaagtacttgaaggacagcagacgtgtggctgaatgagtggcagacgtgtatatgaatggtctgttataatagtgggcaagtgttcgaaatgtaatggacatgtatgctaggtatgccagaattgctggagctctgattgacctagcagtatgggtgaggaatgtagtacgtattggatggccacatactgtgtctataagagagtacagaggtatacaggtaatgttgaagatgtgagaagagagcttgcacactatgcgtggtc

SEQ ID NO: 6922 - DNA, 1324 bp, Glycine max
  Predicted polypeptide sequence is orthologous to G1304
cagtgatgaaaatggtttgaagaaggggccttggaccccagaagaggatagaatattggtggattatattcagaaacatgggcatgggagttggagagcacttccaaaacatgcagggttgaacaggtgtgggaagagttgcaggctaagatggactaactatttgaggcctgatatcaaaagaggaaaattctctgaggaagaagagcaactcatcatcaatttacatgcagttcttgggaataagtggtctgctatagcaggtcatctgccaggtaggactgataatgaaattaagaatttctggaacactcatttaaagaaaaagcttctgcaaatggggttagatccggtgactcatcgtccaagatcagatcaccttaatcttctatccaatctccaacaattgcttgctgctacaaacattgtgagtaatctcacaaacacttgggacactaataatgctctaaggctacaatcagatgccacacaactagccaaactccaattgctgcagaacatacttcatgtccttggggacactactcctacttcaaacttggacctactcaatccatttggaccatcatcatcttcactgccagatggttttctaaatgaagttttaggattgaatcagtctaagcttcaaaacctttataatggctattcagctcagaatcagccaaatctccaaagctttgaaccccctcatcagcagcaagttcaaccaactgggaatcagcatatggatggaggaagcattgatagtagttgcatgaaacctgaaaagggtgatgaccaacttgatgtcccttattcttcttcaacaccgttcaattctcttccaaatctagtttcagcttcacctgaatgttccactcatgtactcatgcaaatggaaaacaaggtaatgccaaatgagtgctccgacccttcttcttccacttcaaccaactttgaaatgtggggagatttcatgtatgaggaagtaagcgatgcttattggaaagatctcatagacaaagagactaattaaccagtaactagccgtagtcgacagtttcttttaaagacaacggcattcaaggtttatcattgcgatgacaggaattatcattgatctctaggatcaacacataatgtttcatttagaatagttaattggttggttcgtgtgtatttgaagatggattaaattttggactcaatcattatatatataagcttccattgtatagacgaaccatgcaacattgagattgtacagaataattcaaatcctctcttttcatcctcgccaaaaaaaaaaaaaaaaaaaaaa

SEQ ID NO: 6923 - DNA, 961 bp, Glycine max
  misc_feature (52)..(53): n is a, c, g, or t
  misc_feature (63)..(65): n is a, c, g, or t
  misc_feature (69)..(69): n is a, c, g, or t
  misc_feature (757)..(757): n is a, c, g, or t
  misc_feature (922)..(922): n is a, c, g, or t
  misc_feature (944)..(944): n is a, c, g, or t
  Predicted polypeptide sequence is orthologous to G1323
aatatattaattccccctccccccccccccccccccccccccccccgtcccnnaaattgggannnactntaagtgtcgagctcgctcattaaccctcactaaagggaacaaaagctggagctccaccgcggaggcggccgctctataactagtggatcccccgggctgcaggaattcggcaccaggagaaccccatcttgtgacaaaagtggaatgaggaaaggtacttggacactggaggaagataggaagttaattgcatatgttactaggtatggctcctggaattggcgccaacttcccaggtttgcaggtctggcaagatgtgggaaaagttgtagattgagatggatcgaatatctaaggcctgatgtcaaaagagggaacttcactcaacaagaagaagaattcatcatcagaatgcacaaaaaacttggtaacagatggtctaccattgcggctgagttaccaggaagaacagataacgaaataaagaaccattggcacaccacactcaagaagaggtctcaacaaaacacactcacaaaggaagaagctagagcctccaaatcaaaggataaggtacttcccaacaagggtgttactgttactcttccagctacttcttcccagatttcagataattcatcattatcgccagcttcatccaccagcagcgagtattccaacataactacagatccttccactgctgccagcatgcataatctggtgtttgaagatgatgatgagttcngttctctggattcatacattgatcctatgaaatatgacagtatctggtaagagctaactctggatgacattatctttactatgtaccaatagtttcagaagataccattgggctgcttcgaagtacaagtcctaggcatagcaacatcctcgattctgtgcatanatcaacccagcgaagtatcgcntgcgatgatgacgttgg

SEQ ID NO: 6924 - DNA, 813 bp, Glycine max
  misc_feature (18)..(18): n is a, c, g, or t
  misc_feature (25)..(25): n is a, c, g, or t
  misc_feature (27)..(27): n is a, c, g, or t
  Predicted polypeptide sequence is orthologous to G1324, G2893
cccctgcatcaaaccccnttaggcnancaattcttgggttgaccctcactaacgggaacaaaagctggagcttcaccgcggtggtggccgctctagaactagtggatcccccgggctgcaggaattcggcacgaggcaaaaattgcacaacatttgccaggcagaacagacaatgaaatcaagaactattggagaactaggattcagaaacaagcaagacatttgaaaatttacactgacagcagagagtttcaagaacttgttaggcgtttctggatgcctagattgcttcagaaagcaaaagaatcatcttcttcaaacatgtcaattcaaaaccaggcaattcctatgccttttgattatgtttctcagcatttaactgttgggaccatacctccttggcagggaccttgtatgaatgaagctggtcccacttacatggaccaacatgagcagaactcatactcggaacacaacaatggttcatgcatctccttgtttgagttcagcaaatataccaaaagtgcctcatcatatgtggacacaccatcatcaccgcaattcatgccttgaataccaatgactttggcacctttacatatgaaggctataatgtagacagacatgtttatgagatggcgtacttcagtatgactactacatgggtggctgtagatgctcaataaccacatgattgattgccacatgcgtggcaagcatataggtacacgactatatcgcatgtagtatggtgaacattgatgacgcggcgcgatgctacgagtaaccagaactacattatacggcttaggc

SEQ ID NO: 6925 - DNA, 893 bp, Glycine max
  misc_feature (891)..(891): n is a, c, g, or t
  Predicted polypeptide sequence is orthologous to G1330, G2423
gaaattaattgaagtatagattattaaatttcacaccaaattaacataaaaagaaacatgcatgtttcacgactagtgttacaattgctttatatgttgcagtttagagtgaattttggagcaagatgttgaagtatgcatgatcagaacaagacatgatgagcaagctggtgttgcagaaagcaaatgttttgatccgtccacaagtccgcaaccaaaaccattgcctgctatgtctgagtagtagctatgagatgagcaacttccagcatcagcacccataagattgtacgacgcgctcgagtcagagagagaaggcgcgtgggcatgaagcgctgatgacaacaatccactgtgtgcttgagtgttactgttggagattaagctgctttggtgggcttgggccgatgatgaggcctgagcccgaatccgctctagcatacgtggcatccacacaaaacgcaacgtgtccctgaattgcttgctgttcacatcacattttagttgcttagcctgctttaccactctcgttctccaataattctttatctcgttgtctgttcttcccggtaaatgttcagctattttcgaccacctgttgccccaacgggaatggaggtcaagaatcaagagctgttcttggagggttatgttcccacgtcgaacatttggacgcaagtagttcaaccatcttaatctgcagcttttgcccgttcgttttagacctgtgtagcgagcgacagagttccagtgaccttcgccgtggacagtgatgtaattgaagagaagagaatcctcttgctctgtccatggacctttcgttattaacatctcctcttcactacttctctccatctcacaacttaattcttgtgtcaaagagcgacagcnac

SEQ ID NO: 6926 - DNA, 803 bp, Glycine max
  Predicted polypeptide sequence is orthologous to G1330, G2423
ggatacagctgttgcatgattccgccaagcgcgcaattaaccctcactaaagggaacaaaagctggagctccaccgcggtggcggccgctctagaactagtggatcccccgggctgcaggaattcggcacgaggtgaatagcaagcaattcaaggacaccatgcgttacctttggatgccaaggctcgtggaacgcattcaagcagcggcgacggcccccgtaaccaccaccgtaactgcggccgccaccaacaatgcattcacctacggaaacaaccttaataacaacaaattcgaggttctgaatcacaagggcagaatggggttaaccgatccttcacttgcgaacaatgactttgtgggttcacatgtcacgcaaagttacactactcctgagaatagtagcacgggtgcgtcatcatcagactcgtttgggactcaagtctcaacaatttctgatttgactgaatattacagtgtccctgaaaatactaattctgcggattattatcaaccctctcaaattagtaattactcggataattgcatcacaagcccatctgggttcttgttccctcaaagactagatcttcaatccatggatccaaacacaccgtggaacatgcaaagtggggactcctctgacaatatttgggacgttgaaagcatgttattcttagagcagcaactcatgaatgacaacatgtgaaacatatggaattagaaaataagactcacatacggctcctcctaatattttataagtgttgtgttgtaatcagagtaaagttaacaccagttat

SEQ ID NO: 6927 - DNA, 482 bp, Glycine max
  misc_feature (264)..(266): n is a, c, g, or t
  Predicted polypeptide sequence is orthologous to G1330, G2423
aatgacattcagtagtttaattagccatatcaggcaaactatgatatatctttgaacttgttaattgcaaaactggatcataagtgatcagcaagatgctgctgcaagaaccatatgttttcatcggtccacaagtctgcatcaccaaaaccattgcatggttcaaatgcttggaggtcagagtagtcccattgctgccaaagggaggaggatatggactccttcttctctgcactttccgatgatgaagttgtacttgtatcnnnaagagaaagaggctgaagatcaacctctgatgagtacgatgaaaccattgagttgtcacaaaacatggtgggattggcatcagtactagattctgtttgttgagtgttgcacaatgtggtttgatcaaggccatgggaagaatctgaaggaacaatcctgaaagaagcctgaatctgctccataaggcgcggcatccaaacgaaacgcaccgtgtc

SEQ ID NO: 6928 - DNA, 1064 bp, Glycine max
  misc_feature (1)..(1): n is a, c, g, or t
  misc_feature (42)..(46): n is a, c, g, or t
  misc_feature (49)..(56): n is a, c, g, or t
  misc_feature (58)..(58): n is a, c, g, or t
  misc_feature (60)..(61): n is a, c, g, or t
  misc_feature (64)..(64): n is a, c, g, or t
  misc_feature (127)..(127): n is a, c, g, or t
  Predicted polypeptide sequence is orthologous to G1341
ntttccggttggttgtggtagtggtgggtggagtggttttgnnnnnaannnnnnnnancnnccncccccccccccccccccccccccccaagcgaggcgatggactgcagttctaatgtacataccncaagcgtcgcattaaccctcactaaagggaacaaaagctggagctccaccgcggtggcggccgctctagaactattgtatcccccgggctgcaggaattcggcaccagctgattcccattgttaagcctataccaaacccattaagagtgaaaaagtctatccctgcttttgggtcagaggaatttttaaaaccaaaacctttctttgaaaagcctattcctaaactaccacttgatcctaaattcaagaaacctcttctaccaccattgccaattcacaagccaattccaaccccataaaatgataacactctacgccataaagctataaggatattcctttccgttcctaatgcctttatatatataaatgcaccgcattaatttcaacctgaatcatgatttcgataatcctttcgtacccctcttgtgtactggattggaatatatatgtacttgatgttttctatgtaatgaaggtctcaatattattatttgtaagattaattatattattaagaaatggttcgctttttttgttttgtttaagtaaaaaaaaaaaaaaaaaactcgagggggggcccggtacccaattcgccctatagtgagtcgtattacgcgcgctcactggccgtcgttttacaacgtcgtgactgagaaaaccctgggcgtacccaactttaatcgcttgcagcacatcccccctttcgccagctggcgtaatagcgaagaagcccgcaccgatcgcccctacccacagttgcgcagcctgaatggcgaatgggacgcgccctgtagcggcgcattaagcgccgcagatgtggtgttacgcgcagcgtgaccgctacacttgccagcgacctagcgcccggtctttcgctacttgcttacttctcgcacgtcgccgcttccccgcagctctaatcgggcttcctta

SEQ ID NO: 6929 - DNA, 853 bp, Glycine max
  misc_feature (16)..(16): n is a, c, g, or t
  misc_feature (727)..(727): n is a, c, g, or t
  misc_feature (853)..(853): n is a, c, g, or t
  Predicted polypeptide sequence is orthologous to G1341
cccaatcttaagtganctactcctggattacgccaagcgcgcaattaaccctcactaaagggaacaaaagctggagctccaccgcggtggcggccgctctagaactagtggatcccccgggctgcaggaattcggcaccaggtggagcacatggtggtggttttggaggaggtggtggaagcttgggagtgaaaagggtttgtttagggatgagaagaacttcttccatcgtccagggtttggaggagggttaggtggtggtgcagaatgatggttatgctattaataacaggatcataataattaataacgtaacaatcatatcatcaccattaattctaagcacgttgttatcaactcgtgatttttatgtaacaaaagtatttccataattattatttgcattatcgtgaaactactatcatcttgtaattgctcttctgattatatatatttgcataaaagaaatatgtttagagtttaaaaaaaaaaaaaaaaaactctagggggggcccgatacccaattctccctatagtaagtcctattacccacgctcacttgccgtcattttacaacatcataactgagaaaaccctgacattacccaacttaatcacccttcaacacatccttctttcaccacctgtcataataactaaaaatcccccaccaatctccctttccaacatcttctcaacctgaatgcaatttgtacacactctatancacttcattaatcacagcattattgtagttactcacaatcttaaccctacactaccacaccctaacaccactcctttcctttcttcctttctttctcaccctttccccactttccaccaaactctn

SEQ ID NO: 6930 - DNA, 807 bp, Glycine max
  misc_feature (366)..(366): n is a, c, g, or t
  misc_feature (612)..(612): n is a, c, g, or t
  misc_feature (803)..(803): n is a, c, g, or t
  misc_feature (805)..(805): n is a, c, g, or t
  misc_feature (807)..(807): n is a, c, g, or t
  Predicted polypeptide sequence is orthologous to G1341
gaatcatgacgccagctctaatacgactcactatagggaaagctggtacgcctgcaggtaccggtccggaattcccgggtcgacccacgcgtccggacttaaagaagagttaagggaaaaaaaataagatgaacactattggagttatgattatgatcatgtctatgttagggttcgcacaagctaataattacaatcctccatttgtgcaagttgagtcaatcagtgagactaatagacttacttgtccacaagcatgcagagtacaatgtgcagctttagcaccagttgaaccatggtatgacaaatgtgttaaagaatgcactggcaatggaagcatgatgtgtccgttgctaaggattgctntactagttgtgccttaatcaagtccattaacatcaacaatgatgttcgtgatctttcgaccaatattgtgatgaattcctgcttgcaagaatgtcaaaacaagaaataagttgttacaagaatcttcaagaaaaaggttgttaattgtaataaaataaattttaatcaataagtaatatctatttctctaaaaaaaacaaagagaggggggggaggggaggggggggggggggggggtggaggaanggtggatgaagaagaaagggtgaggtgagttgtgtataggatgtgggatatagagactctagtcgatacgcaattagtagtggtatggtgagagttgagatgatggtcgtggtcacaagcgacagcacgtgaagtactgacgtcatcatgtatagaggagggcgcaaatcctgtatgagcgggctgcgaananan

SEQ ID NO: 6931 - DNA, 690 bp, Glycine max
  misc_feature (22)..(22): n is a, c, g, or t
  misc_feature (28)..(28): n is a, c, g, or t
  misc_feature (31)..(31): n is a, c, g, or t
  misc_feature (33)..(33): n is a, c, g, or t
  misc_feature (44)..(45): n is a, c, g, or t
  misc_feature (122)..(122): n is a, c, g, or t
  Predicted polypeptide sequence is orthologous to G1341
gggggggggggggggggggggngggggnggngnagggggggagnngttggcggccccagaagggctaaacgtgttagaacctcctgctggccgagacgcgcaattaacccctcactaagggnaacaaaagctggtagctccaccgcggtggcggccgctctagaactagtggatcccccgggctgcaggaattcggcacgaggaaggaatgctgtgccaaacttggtcactcatcaagacctagatttgtaggaggtttgtcagaaattattacagaataggtgcagttgactccagcgtaagcaacagatgtcagcatgctagcttgttcttgcaaatttatatttatttagaagatttttagtgacatgaatgaaagcccgtaaaatattactgctcatgtatatagtttgaggagcttgacatgaccaacatagatttttacgtaagtctggtatggccctttattttggggttttagttatagggaattgggctcctaaaggagaaggggaattcactttggcagttgtttggatatatgttaagggcttcttcctttttttatatttaaaaaaaaaaaaaaaaaaaaaactcgagggggggcccggtacccaattcgccctatagtgagtcgtattacgcgcccccactggccctcgttttacaacgtcgtgacttgaaaaacca

SEQ ID NO: 6932 - DNA, 830 bp, Glycine max
  Predicted polypeptide sequence is orthologous to G1361
ataaacacattttacgaatatacatgtaccctaaaattaaaatcaaactacagtaccgcaaatatatataccttcttgcttgtctctcaacttcaaccagggtcaattatgggaaagtccatcatgcctgcgccatattgatctcaataattcaaggaaaaacctatatttttccaacccttggaattccttcagtctaatttcacatataaatactattactcaattagtaatggaaacaatatggaggacatgctgtaaatcattgtcactgcttgtctacctagaagctcttcccagtgttactttcaaatcttgctttctttgcatccattgttgagcgaatataagagccatcaacctgaacaaccgagctgggaattattagttgtgaggaactttccctattatgactcgcatgggcatgatcataatctatgtaaggagcattgtagcaatccaaaagagttgcagtagttttagttattgatgtatttgtgctgtcttggacacttccaccattcaacattttttcgtacgggtcctttatgataatgggattaacacattgtctaggttgtgtttggtagaagacttttgaaacaactagttctccatctttctcttcttcagtattgccaagatggtattgatgcatcacccagtaagttttctcaggcttcttttgccttccatagttggtgtagagtactagtattttcttaaaacctttcactgcaccaccagatgcaaaaactgctctagtttttcccgttttgtgccatcttgtttcattccttcatcatcagtgtgaacctttcttcttttcc

SEQ ID NO: 6933 - DNA, 740 bp, Glycine max
  Predicted polypeptide sequence is orthologous to G1361
atataataataataatggaagccttgtctttcttccaacttatcgtcccatatatagaataaatacatgttatatatataatagtaatataaaaaaaaaaaaaacatcaacatcaatatatggtcattgtcactactatatgttctaccaagaaagttcttccagtaaggagctattttctgtccatcttggctttggttgcatccattgctaatcgaatgaaagaagagctatcaccttgcatgaccaaatttggaataagttgaggtgaattttccctattactacaaccacccaattggtcataatttatgaaaaaaggattgtagtagtccataagagcacttgcattattatttctaggtattatattgttgtcatcatcattatggacactttggttagtcatcaatctttcttcatcataaagatcctgctttataatggaattaccacattgccgaggttgtgtttggcagaaaacctttgaaaccaccaattctccatctttctcttcttcgctagtgccaagggggtattgatgcatcacccaattggtcttctcaggcttcttttgccttccatagttggtgtagaggactaggattttcttgaaccccttcacagcaccgccaacaaaaacgggtctagtttttcctgttttgtgccaccttgtctcgcttccttcttcgacggtgtgaacctttcttcttttccttgttcctgttgagtatgcttta

SEQ ID NO: 6934 - DNA, 793 bp, Glycine max
  misc_feature (720)..(723): n is a, c, g, or t
  misc_feature (727)..(729): n is a, c, g, or t
  misc_feature (737)..(742): n is a, c, g, or t
  misc_feature (755)..(756): n is a, c, g, or t
  misc_feature (758)..(758): n is a, c, g, or t
  misc_feature (760)..(762): n is a, c, g, or t
  misc_feature (765)..(767): n is a, c, g, or t
  misc_feature (780)..(783): n is a, c, g, or t
  misc_feature (785)..(787): n is a, c, g, or t
  Predicted polypeptide sequence is orthologous to G1363, G1782
attagaatatatgcaccaatttagaataacaaatgtgcaaggagatataggacaaaatagaggaaaatttaaggttctgtggagcatgtcacacaaatcagtctacagttttatgaaccttaacacagttaatataaactttaaaaagttctcaaaccaaagtgatttttctttttctttctgttatccattttacatatggacttgtagagagaaacaaaagcaagggagagaccaaacaaggccatagtgtacaccatgtcactggtctcaccacttaactaagccaagaatgaattgccttctatacagcatcacaagttggatgagataaagcccttcatcttcacctaactcttgctgtatggctgagggaagtgttatttgaaatccccattagggtccctctctttaccaaagcagtttccctcctttttcccatttgcttgtgaacggtatagtgctgtaagaccatttccattatggtaacctatagtgaaactctgctctgtgtgcatgtgctgaactgtggcttgtgaaacatttgatgagcctagattcaaattgttggtgaacaaaagttgagtgttaggcgagtttgttgaggcgtttgcacgagtattgttgcctttgtctgaagtggaattaaaattgttattttcaagcttctttgtgttgagaaagcgaccaccgttgcctcttgcccttctcattgcatgnnnntgannngattcatnnnnnnatggcttcctgtnntngnnnacnnncttttcaatctcnnnntnnncacgtg

SEQ ID NO: 6935 - DNA, 713 bp, Glycine max
  misc_feature (13)..(13): n is a, c, g, or t
  misc_feature (528)..(529): n is a, c, g, or t
  misc_feature (633)..(635): n is a, c, g, or t
  misc_feature (640)..(644): n is a, c, g, or t
  misc_feature (652)..(654): n is a, c, g, or t
  misc_feature (658)..(660): n is a, c, g, or t
  misc_feature (679)..(679): n is a, c, g, or t
  misc_feature (681)..(683): n is a, c, g, or t
  misc_feature (689)..(690): n is a, c, g, or t
  misc_feature (694)..(694): n is a, c, g, or t
  misc_feature (696)..(696): n is a, c, g, or t
  Predicted polypeptide sequence is orthologous to G1363, G1782
cactattagaaanacatattttgaagcaaggaaattcaacagtaactaacacaaacatacaagttccatgcaaaagactattccaatccagttcaaaatccagtacaatagcaactttaaaatacatgccaaagcaattggaaaggtcttatagtgctaatgcagactgaaaaaagtctctcaaaatgagcatttagtacgaacacataaagacacagacaaaagtgactaagccaaggatgatttgcctgaccggtgaagtcggtttcgatcagtttcttctctcaccggacaactgatgtgcgctgctttgctccgccaaaggtgagtcccccactgaactgtggtgatccacccatgtttgcagaattccccagaaacatgcactcctgctgccgaaaattgacattgttgccagataaacatggccggtcggagcaggttgtgatgaaagatgaattatctccatcttttgaggaatgactttccacctctgatagatgttccttttgatatctgttggtaggnncagaaccagaatgtgcaccagtgacaaattctgcattagactgtgcaagctgtttggtgctgagaaatcgccccccggatcccctaaccctattcaaagcatgnnngtgcnnnnnctcgtgannntatnnnttacgatttttgataagtntnnnctgagnntcangntttgctcgtgactgacg

SEQ ID NO: 6936 - DNA, 892 bp, Glycine max
  misc_feature (632)..(632): n is a, c, g, or t
  Predicted polypeptide sequence is orthologous to G1380
cccccccccccccccccggccaagggactacccgaccactagcgcagcgcgctctaaccctcactaaagggaacaaaagctggagctccaccgcggtggcggccgctctatatactagtggatcccccgggctgcaggaattcggcacgaggtaccgccttcaattctctctctccatttctcatcctcatcatcttattatacctcttccatctccataacatccacttgtgaaaaaaacccattaatatatatcacacacacatgtatctctgagctccaatccaatccaagaccacaccttgtcgcgtcggacgaaccttggtgtctgtctttttttttttttttgtttcattagtttctccgaagagatgcggaagggcagaggaggaggagcctcggcggcggcggcggcggcggtgaacggatccgttttaaaggagcctcggtaccggggcgtgcggaagagaccgtgggggagattcgcggcggagatcagagacccgttgaagaaagccagggtttggttgggaaccttcgattctgccgaggatgctgcacgtgcctacgacaccgccgctcggaatctccgaggttccaaggccaaaaccaatttccctctctcacctttntgctatcaacaccccaccacggatcctttcttctacgctggtttccacgaccaccaaaacaacagcaacaacaacaacgacatccttaacaaccctcaaagaccaacttcaagtggcatgagtagcaccgttgagtcctgtcatgggccccgccttccaccacaaccaccaccaccactgacgcgtttttgaccactacgcgaagatacccgcgcactcccactcttggtcccgaagacatgcacagtgactgcgactct

SEQ ID NO: 6937 - DNA, 795 bp, Glycine max
  misc_feature (1)..(1): n is a, c, g, or t
  misc_feature (32)..(32): n is a, c, g, or t
  Predicted polypeptide sequence is orthologous to G1380
nagggagcgaattagagcttcactaggtatgnccccagctctaatactactcactatagggaaagctggtacgcctgcaggtaccggtccggaattcccgggtcgacccacgcgtccgagaagaagaagagaaggtggtaccgccttcaattctctttttctctctccatttctcatcctcatcatcttattattcctcttccatctctattctccataacacccaccacaccacttgtgaaaaacctcattaatatcacacactgacatgtatctctgagctccaatccaatacaagaccacaccttgtcgtgtcggacgaaccttggtgtcttttttttttttttttcattattttctccgaagagatgaggaagggcagaggtggaggcgcctcggcggcggcggtggatgtgaacggatccattttaaaggagcctcggtaccggggcgtgaggaagagaccgtgggggagattcgccgcggagatcagagacccgttgaagaaagccagggtttggttgggaaccttcgattctgccgaggatgctgctcgtgcctacgacgccgccgctcggactctccgaggtcccaaggccaaaacaaatttcccccctctctcacctttttgctatccacaccccaccaccgatcctttcttctacactggtttccacgatcaacaccaccaccacaacaacaacaaccttaacaaccctcaaagaccacttcaagtggcatgagtagcaacggtgagtcccttcatgggccccgccctccaccaccaccacttcc

SEQ ID NO: 6938 - DNA, 868 bp, Glycine max
  misc_feature (12)..(12): n is a, c, g, or t
  misc_feature (17)..(17): n is a, c, g, or t
  misc_feature (22)..(22): n is a, c, g, or t
  misc_feature (27)..(27): n is a, c, g, or t
  misc_feature (868)..(868): n is a, c, g, or t
  Predicted polypeptide sequence is orthologous to G1380
gcgccctgatanttttnagaanatacnagctatcgcaagcgcgcaattaaccctcactaaagggaacaaaagctggagctccaccgcggtggcggccgctctagaactagtggatcccccgggctgcaggaattcggcacgaggctaccttccttcaaccacaaaccctctctccctctaccacccattctcttttctctctctttctttccccctccctctctcacctactcaatctcatcaccaccaccatcatcatcatgatcttctccaatctctataaccttcaatcactcaaaacctcaccattaaaccaaatgagttgacccatttgtgagaacaattctccctaagaaaaggtcaaaggctgcaactttttcttaaccaatctcacaacattttgcaacgtttcttctggttcggtttggacttctgggtcgtcttggaattcaaaagagattccaactttgaagatgggtaggggcggaaccgccgcggcggcggtggagatcgccgaacccggttcaaggccggtttttttcaaagaaccgcgttataggggcgtcagaaaaagaccgtggggccggttcgccgccgaaatcagagaccctatgaagaaagccagggtttggctaggaaccttcgacaccgccgatgaggcggcgcgtgcctatgacactgctgcgacgacactttcgcggccggaaagcaataccaatgtgtgctttcgtacgcgtactccatcccgatgcggtatccatgaccagtactatgacaggcatgcgacagcgaagattactggatcaacggcgacccacgtcaatggtatagcagcgcgcagatccgtcaggggcaaggaccggcgagn

SEQ ID NO: 6939 - DNA, 776 bp, Glycine max
  misc_feature (1)..(3): n is a, c, g, or t
  misc_feature (776)..(776): n is a, c, g, or t
  Predicted polypeptide sequence is orthologous to G1380
nnnaaggcaaaccgctcgatattcgtccagcgcccaattaaccctcactaaagggaacaaaagctggagctccaccgcggtggcggccgctctagaactagtggatcccccgggctgcaggaattcggcacgaggtctcgatcgatcttgttattgtaaaatataataacttttttatatcgtgatcaagatgcgccgagggagagccaccgccgccgtcgtggatccgacggcggagcaagcgaaggagacgcggttccgcggcgtcaggaagcggccgtgggggcgattcgcggcggagattcgagatccgtggaagaagcagcgcgtgtggctggggacgttcgattccgccgaggatgccgcgcgggcttacgacaaggctgcccgatccttccgcgggcccaaggccaagaccaatttgccctccttccccggcccgacggaccaccactcctcgcagcagattccgccgctctaccaggcccacgggctttccaccaagttcgagcccgcccaggtgaaccggcccaccaccagcggcatgagcagcaccgtggagtccttcagcgggcctagggttcctccctgctactcgttctctctcaagccgcttgtggttgttaacactgtcatgcctctcgacgacgacgaccgcgattggccacacgattggcacttttcttgctccctcggtcgcgaccaggaactggttcttcactgcgtctttcggcaacagcttgacttcatcttgaccttccgaccgcctgatgctn

SEQ ID NO: 6940 - DNA, 2226 bp, Glycine max
  Predicted polypeptide sequence is orthologous to G1382
gtacaatgctatctttgtcaaactgactccaaataaacaacatgcaatatcatcagcaggagaaaatggagaactttgcttaggctcaattataatgggctgcttgcatcactgactgataaaactgttcaattagttggcttattcataagattatatatatatatatatgctctctttccgctgttattactgatatcataggttgattgattgctgtttgaggcctttagggtttgcaggtattcaggaacttgcttgttttggtttccccccctctctttttattgtttttttgagaatattttttttccagtatctttttgtgcattttaatttattattattcatttgactcaacaaccgttgctcaaagaacattatagtttaaatattatttgtgccatgcattgcaggtggaggcttcaccaactacaggttccctccgtaagctccaacaaacaatgcatggttctatggcctctgctgcatttccagtaaccactgcctgcttcgataccaatactgttgatgacagaaaatcaagtttctttgagttcaaaccactcagcagatctaatatggttcctgcagacttcaacaaccatgtaagtaaacaatctactcaagtagaaggtccaggaaaaactcaatcatttgcttcctcaccattagtggaaagtgagatagcagttccttctaatgaattaagcctatcatcacctgtacaaaaggttagttctagtgctagtgctcctgttgatgttgacttggatgacattaaccacaaaggcaacacagctactgggcttcaagcatcacatgttgaggttagaggcagtggactttcagttgcagctgagaaaacatctgatgatggatacaattggcgaaaatacgggcaaaagcttgttaaaggaagtgaatttcctcgcagttattacaaatgtacacatcccaactgtgaagtgaaaaaactttttgagcgctctcatgatggtcaaatcactgagatagtttacaagggaacacatgatcatcctaaacctcaaccaagctgccgatactctaccggtactgttttgtctattcaaggagagagatctgataaggcttctatggctggccgagatgacaaagcaactgctatgtatggtcaggtgtctcatgctgctgagcccaacagtactccagagtcatcacctgttgcaacaaatgatgatggtttagagggtgttgccgggtttgtgtcaaataggactaatgaagaggttgataatgacgatcccttctcaaagcgaagaaaaatggaacttggaaatgttgacatcactccagtagttaagcctatccgggaaccacgggttgtcgtacaaactttgagtgaggttgacatattggatgatgggtaccgctggcgtaagtatggccaaaaggttgtgagaggcaatcctaacccaaggagctattacaaatgcacaaatgctggttgccctgtcagaaaacatgtggagagggcatctcatgatccaaaagcagtgataaccacatatgagggtaaacacaatcatgatgtaccagctgcaaggaatagcagccatgacatggcagtaccagcagctgcagcaggtggacagacaagaactaagttagaagaaagtgataccattagccttgaccttggaatgggaattagctcagctgctgaacataggtcaaatgggcaagggaaaatgctgcattcagagtttggggacacacaaactcatactagcagttccaacttcaagtttgttcatactacctcagctccagtatactttggtgttctacataacagctcaaatccctttggttctagagacaataggagtgatggtccatctttaaaccgttcctcatatccatgcccacagagcatgggaagaatactaatgggtccatgaagttgattacaccacagatattaaataaaaaactatgagtaacaatttgctttcttttttcttatttttggcgggtatagcttcaaaggtgtaacatctcattttctgtaagaaaatgcagataagttcttttatgtttatatcactattccatagttgctgtttagtagagttggtagcagctccatcttgacttttaaatctaattgccgtttgtaattgtataattataaattataattatatccaaattcttctgtataaaaaaaaaaaaaaaaaa

SEQ ID NO: 6941 - DNA, 882 bp, Glycine max
  Predicted polypeptide sequence is orthologous to G1411, G2509
aggaaaagaaattctactaattaaaagtaatcggttaagtctctctatagatatttatgatcgttaaaactaataaatacattttataaaaaaaaaaaagacggataaaagaagaaagaggagtattataatctgatttagacctcaggtattattttgtaattggaataataaaaacaaaagaacaaataagagatgtgtgattgaacttccttaattgttgtggcagcaacctagctagcccccacttttccaccagcatgcagtgctcagaattcagagacaaaaaaactacgaccccctcttattctcttcatcaaaaccactccctccttgaccaagaaaatcagaaaatgaagatgccattgcagaagaagaagaagaataagaagacacaaaaaacggcactggtggtggttgtgatgaaccataaatataatcctcattattgtgatgctggtagagccccaatgcaacacgttgaaagtcatcatcatcgctacaattcagcaaccttgcatactcctcaagatttggaaacccttctgatgaaagagaactattattattgctactattttgtagagattgtgatggtggtggtggaagagaagaaggttgtgtagtaggagctgatgatgaagaagtggtattgttattattgtaattggtattggtttgtgatggtattggcataacaacacgttcaggaaaattgagctttgctttgtttcctttgaacctcaatgcagcagcatcataagccatagctgcagcctctgccgtgtcaaaggtgccaagccacactctagctgctttcttagggtctcttatttctgctgcccatttgccccatggtctctgcctaactcctctatagtg

SEQ ID NO: 6942 - DNA, 495 bp, Glycine max
  Predicted polypeptide sequence is orthologous to G1417
gaaaaaccttgccctggtggatgttgtcagtgaggccataaacaaagatccttctctcaaggcagcattgttttcagccatttcctcactcactggagatcctgatcagaaggacaacatcaataacataagccaattacatagtaagagtagtggtggttatgacccttgttctaagatgcctgcaataccacctattcagccttacactaagttgatttagagttgacatttaatattgttgtcaaattaaataatctaatggcaaatgtggcttgcttgccagaagaagaggtgagcatatatatatatgtgtgtctgagaggtaaagttttataagaagtctacggtcactccaaggaagacttccttcttaatacactggttttcgttagtcttactttgtaaaataagttaatgaacatattaaagttttggcttttggtcttgtatttaaatatacagtaagcctaagagtaataaaaaaaaaaaaaa

SEQ ID NO: 6943 - DNA, 1008 bp, Glycine max
  misc_feature (1)..(1): n is a, c, g, or t
  misc_feature (105)..(105): n is a, c, g, or t
  misc_feature (111)..(111): n is a, c, g, or t
  misc_feature (116)..(117): n is a, c, g, or t
  misc_feature (134)..(135): n is a, c, g, or t
  misc_feature (142)..(143): n is a, c, g, or t
  misc_feature (508)..(508): n is a, c, g, or t
  misc_feature (556)..(556): n is a, c, g, or t
  misc_feature (571)..(571): n is a, c, g, or t
  misc_feature (677)..(678): n is a, c, g, or t
  misc_feature (688)..(688): n is a, c, g, or t
  misc_feature (697)..(697): n is a, c, g, or t
  misc_feature (706)..(706): n is a, c, g, or t
  misc_feature (708)..(708): n is a, c, g, or t
  misc_feature (716)..(717): n is a, c, g, or t
  misc_feature (740)..(741): n is a, c, g, or t
  misc_feature (749)..(749): n is a, c, g, or t
  misc_feature (760)..(760): n is a, c, g, or t
  misc_feature (787)..(787): n is a, c, g, or t
  misc_feature (797)..(797): n is a, c, g, or t
  misc_feature (800)..(800): n is a, c, g, or t
  misc_feature (806)..(806): n is a, c, g, or t
  misc_feature (808)..(809): n is a, c, g, or t
  misc_feature (813)..(815): n is a, c, g, or t
  misc_feature (817)..(818): n is a, c, g, or t
  misc_feature (823)..(825): n is a, c, g, or t
  misc_feature (827)..(828): n is a, c, g, or t
  misc_feature (830)..(830): n is a, c, g, or t
  misc_feature (832)..(832): n is a, c, g, or t
  misc_feature (838)..(838): n is a, c, g, or t
  Predicted polypeptide sequence is orthologous to G1419
ngggagtctactcgacgccagcgttcaattaaccctactaaagggaacaaaagctggagctccaccgcggtggcggccgctctagaactagtggatcccccgggnctgcanggaannttcggcacgagggctannaaagcgnncttctaacttaagtgatggctaacgctgtgaagtttcagcgttgaaacgcatcaagttgcatcttttgggtgaactctctccactggccactccccaaaacaaatttgaccaaacaaaccctagcccctctgaatcttccaattccgaatcttcttctatttctcttaaccactacttcactgacctcctcgaacccgaaattgaatttcctctcttcgaattcgattccaaaccccaagtaatcgacctcgaaaccccgaaaaccctaatttcagctgagaagaagcctcaatttaatcggaaaccgtcgctgctaatcgctgttccgaagaagaccgagtggatccaaattcgaaaacctgangtggcggcgccggagaaccagcctgagaagaagcactacagaggtgtncgtcacggggcgtgngcaaaagtcgcgccgagatccgcgacccgaacaagcgcggtctagggttggctcggaacctcgacaccgcatcgaagccgcaagcctacgaccgagcccgcttcanngctcgcgctncagggcatnctcaactcncnctcgaagnntacacccgcgcggagaccgtctnncgtcgcgnccgcgacgtcnagaagaagcgcccgcgcgaagaagatngatgtgtggnttngagatnanngcgnnngnnaagannntnncngncttgtntgagtttttttatggatgcgttaacgcgcaatgtggccggtttggacaggactcaaggatatccacttcccgcgtgcgcgttattctttggatttaccgttcggctggtgattccaattagacgggtttttgggttagtctttagtgcctcgttcagggtatctttactt

SEQ ID NO: 6944 - DNA, 1156 bp, Glycine max
  misc_feature (1)..(4): n is a, c, g, or t
  misc_feature (45)..(45): n is a, c, g, or t
  misc_feature (815)..(815): n is a, c, g, or t
  misc_feature (866)..(866): n is a, c, g, or t
  Predicted polypeptide sequence is orthologous to G1420
nnnnaagcggtagtaataatataacacttttggtagactgaacangccaagcgcgcaattaaccctcactaaagggaacaaaagctggagctccaccgcggtggcggccgctctagaactagtggatcccccgggctgcagggaagcatagcatgaacctacttaacaagggggaggtagatgatattgcggtatccaaccagatgcaagtggatgagtcatttcctattcctagtttggagaatgggcatgtttttgtctcagcatccaatgggataaaagatgtgccaatgcctacattagaatcaggcaaagtggaaactacatctcctgcaaaggagcaattggaagagatcaatcaaacctacggccaaatggaggaagatcataacaagactggcctgtctagaccatcttctggttgtgcgaaccaagaagcagctgtagcaggtttgcaagagaaagagcccaaaatcacttctgataaggtgaattcaggggatgcaaaggaggattacactttggcagctaaaaatgaagctcagttggcccctactttgcacggagagggagataacatagatagcgaagccaaaactactggttttgcccgttgtgcagatgaaaagctgggttttggtgacacaaaggttaatcctaatcccttaattgtgaggatggtctcccaagctttgatgcttgatgcctgttcaatgagtctgatcactaattttagccggatcatcatctcctgaagtcacattgagacattctatacttcatgcttttatcatcagtttatttcttctcttttngtgcttcatttggctagataaaggaatgctttctatcctaaaaaaaaaaanaaaaaaaaaaaaactcggggggccgtcccattccctaggggtgaatacccctactgcgtgttaaaacttaatggaacctgggtccactttgcttgaaaacccttccgaggggaatagaagccgacgtccctccacttccactaaggatggacccctacggctaaccggtgtgggcccacgacctaatccagcctgccctttttttctttttgccggcggtccgggtaagggctttgtcaaagtagccacaaaatggggttcaggcccctacgtcccttggcctttaaatt

SEQ ID NO: 6945 - DNA, 736 bp, Glycine max
  misc_feature (1)..(1): n is a, c, g, or t
  misc_feature (15)..(15): n is a, c, g, or t
  misc_feature (736)..(736): n is a, c, g, or t
  Predicted polypeptide sequence is orthologous to G1444
natgagaagctaganagacactgccagcgcgcaattaaccctcactaaagggaacaaaagctggagctccaccgcggtggcggccgctctagaactagtggatcccccgggctgcaggaattcggcacgaggagaaggcgattccgctgaagaaaaggagagggaacttcgaggagaataataagaataatgctgctactcatagcaagaagatgaaggcgaagatgaagacgaagatgaacaagaaatgttcgacgcgcaacaaggaggatagcatgggagaggaattagacgaggaagatgaagaagagaagaaggtagaagaaacaaaagcggaagtgaatattgtgagtaaaaagagagcaaggggtagtgcactcatggaaggttctaggtgcagtcgtgtgaatgggagagggtggaggtgctgccaacaaacgctggttggttactcgctgtgtgagcatcacttggggaagggaaggctcagaagcatgatcagtgttagaagccgttccattgcttcaactgcaccaaaggaggtgcacgtgcaccacttgcctgacccatcttcttcttcttttctcctcctccttctttgtgttctcttgatcatgagaaagaaatagagtgtgttagtgatgctgagcgcctttgggatgaggagaagaagccagatattattattgcgaacacgaggatggaagcttgctgtggggagagcgccgctccttan

SEQ ID NO: 6946 - DNA, 707 bp, Glycine max
  Predicted polypeptide sequence is orthologous to G1446
ttttttttgactatgattagtatctatctatctataaatttacatttcaaagtacaacgcatgaagttggattcccaacaaatggttggagttcctatcatgggaataatcctctcctcagtctttctagactaaacatgaaatttttaccagctgtgtatcataatccagaaacaaagtgggaataaaaaaagtaaaaaacacaaaaacttgttcccatcaagagtttgaaacagaacacttgatcatattcataggcactttctgtgttctccatagaatcccaagtatcttcatcaagcaacaccatgtcatcaaaagtaccaatgctggaaaacgacccaaaagaagcccaacaagggcaataatcataactaaaaccatggaagaacctgaattctcaactctattcactttcttctcataggaacaagtgattccacaaccaggtttagtgttacttgacttattatccccattctcttcctcctcttcctcttcaatttctaaaattggtaacttttcttctcccacagcacttgaaatttcactacctgactcaccctcattgtgtttattctttttcttagacccacgaaatttcttagaaacaagcttcaccatcttcgacctaaacctaccacttcggctaggtctaatcttgcattcagaaacatcttcatcacataaacacggctccaaaacct

SEQ ID NO: 6947 - DNA, 841 bp, Glycine max
  Predicted polypeptide sequence is orthologous to G1451
agtgttcaaacagaagtactaaacatgtggatatgtaatagtcttcttaaccgtaggacctgagagaaaaatacatgttaaaattctctcagtattcaagggagccaattgatggtagtcctgaaacaatttcatgagaatctgcaccagtgctattcagcctctgtcctggacttggaccaagggattccagggcttgttctcccattttatggatatcttcaggtgaaagtattttgatataccatacattattgacaaatgattcccacggatcgtctccaaggagaagaacatcgttctccctgtcgacgaatacaagctgccagcctgatctaagagggtcttctaatttcccctcaataccaaacatctgtgccaactcctcccgcagctcatgataactgctgaaccgggagatgtcaagtgagcgcccaactgaccctgatttgtaaaccttgacgaatgttcgtgtctggttttgagggtcaacttgccctgcactttgcaccaactctgatgaatcttgaccacaaggatataaaggagactggaatccagactctcctaatggcattgctgatgcatcactatccgctgatgcagtagtataacgcgggacagtcgtagggagcagaagaccagatgaatcgatgttgaccccaaatagaataggattttgggtgtccgagttacaatgtggtggcaccattgcggtatcttttccagaatactgcacatgttgcattgagttgccaaaagcattaacctgcaacggtgtgaattttggggcccatgattgttgaggtaactgttcagtcagcatggactgaccacttct

SEQ ID NO: 6948 - DNA, 960 bp, Glycine max
  misc_feature (21)..(21): n is a, c, g, or t
  misc_feature (383)..(383): n is a, c, g, or t
  misc_feature (839)..(839): n is a, c, g, or t
  Predicted polypeptide sequence is orthologous to G1451
ggcgctgcaggaacggaatangtaccgactgcacagtgagcgcgcgtaatacgactcactatagggcgaattgggtaccgggccccccctcgagtttttttttttttttttttttttttttttttttttttttttaagagaagctatctcacgcattgatttcctaacggattaagtatcgtatatattgtagctggcacaatgactagatgccatatagttacagtattagtttatgaattgtcctagcaggaaaaagcaggaaaacaaaatccaaaggctaaagagtaggctatataaactacattttggcaaaggtgcttccaaccgtacactaagggttgagaagcaagggtaataatattaaacatgatagaagaagntcagactattagtagtctaaagaccccacagttgttatcccagtgcttaaatttcttgggtcttgacggctcacatagtcatcacagatgccattagagagcctttgatttggaaccgagttcaacagctcaaggccattgttgcccatttgctgcacttcctgaggagaaagtatctttatgcaccatacactatttacgaattccggccaggggccatcaccaaggagaagaacatcattctctcggtctacaaatacaagctgccagcctgatctcacagggtcctccaactcgccttcaggccaaacattcgacgagtcaccacgcagctcatggtagctgtgaattgtgatatcaatgaccttcaaagaccctgacttataaccttcccaaaagtttgttcatggtttcttgcctgatcttcccgacatgaaggaaaacgagtcgcctatntggtgtgatccttgtccaagaaaaacacccccccgtgagatcaaatattaaaaatgatattggcaggggtgggttatccgtaaccccttagggtgaatccattaggctgaaaagggaaagg

SEQ ID NO: 6949 - DNA, 1057 bp, Glycine max
  misc_feature (1)..(2): n is a, c, g, or t
  misc_feature (519)..(519): n is a, c, g, or t
  misc_feature (684)..(684): n is a, c, g, or t
  misc_feature (766)..(766): n is a, c, g, or t
  misc_feature (773)..(774): n is a, c, g, or t
  misc_feature (895)..(895): n is a, c, g, or t
  misc_feature (1004)..(1005): n is a, c, g, or t
  misc_feature (1047)..(1047): n is a, c, g, or t
  misc_feature (1049)..(1049): n is a, c, g, or t
  Predicted polypeptide sequence is orthologous to G1451
nnggtgtttcaccgtgggagcccctgctcgtaaccctactaagggaacaaaagctggagctccaccgcggtggcggccgctctagaactagtggatcccccgggctgcaggaattcggcacgaggtaaccttctagccaaacacacactaaataattaatatattgtagatagcacattgccaagatgccatatgtttacattgtttatcttaagaatggtcctaggcagcaagaacaggaagacaaaaaaaaaaggcttaataagtagcctataaactacaactaggcagtacttcccaccatttgacaaagggtggagaagtaggagcaataatacaagagagaagagattcatagtatttgattgtcatatcattcagtagtttaaagaccccacagttgttatcccagtgcttaaatttcttgggtcctcacagacaccgttagagagcctctgaatggggaccgagttaagaagctcaagttcattgttgcccatctgctgcacttcctgaggngaaagtatcttgatataccctacactatttacaaattccggccacgggccatcaccaaggagcagaacgtcattctcttgtcaacgaatacaagctgccagcctgatctcacaggggtcctcaactcaccttcaggccaaacatacgagcaagctcgctggtacntagggtagctgtgaatttagtgagtccagatctccaaaagaccctgactgtaacctcacaaacgtttgtgcatgttcttgcncccattnnctgattgcagaagccgtttaccaaatatgtgattcaggatcatgaggatcggttcttgtgtcagaataagattgaaagggtttggggatatttggggcgaccatccccctaaggatatacncgcctatctgcgttttaagtgaatgaaaactgtacaatatctttgacatcctttgccatggttaataagcacatccttcacatgcacttatgagaacctgtggtatatnngggggggtggacgcctacgcacaccctttttttttttttttncngccgttca

SEQ ID NO: 6950 - DNA, 800 bp, Glycine max
  misc_feature (800)..(800): n is a, c, g, or t
  Predicted polypeptide sequence is orthologous to G1451
ccatgtgcacttacgccaaactcgcgggttaaccctcactaaagggaacaaaagctggagctccaccgcggtggcggccgctctagaactagtggatcccccgggctgcaggaattcggcacgagggtcttaagggagttagcagcaacagtgactcacccacaatacctttgcaatcttctaattacctgaacaccacaggacctgattcctcattgaatcctggaatgacacacaatattggtgaaacgggcttcctgcaaactccaaaaaatggggggcaaggaaacccatccaacaaaacctttgtgaaggtttacaagtcagggtcctttggaagatccttggacatcactaaattcaccagctaccctgagctacgcagcgagcttgctcgtatgtttggccttgaaggtgagttggaggaccctgtgagatcaggctggcagcttgtattcattgaccaagagaatgacgtgctgctccttggtgatggaccgtggccagaatttgtaaatagagtagggtatatcaagatactttcccgtcaagaagtgcagcagatgggcatcaatgagcttgagcttcataactctgtcgccattcagatgctatatagctgtgtctgtgaagacacaacacatcgatgcactggtataacaacgtgagggggattataactacatgagtgatagtgccatacaaatactatgacatgactccacgatacgtataatatctcatgaatctcacccgtttgtaaaatgcgtggatagattcagcataggtgtagactattn

SEQ ID NO: 6951 - DNA, 833 bp, Glycine max
  misc_feature (1)..(1): n is a, c, g, or t
  misc_feature (35)..(35): n is a, c, g, or t
  misc_feature (611)..(611): n is a, c, g, or t
  misc_feature (663)..(663): n is a, c, g, or t
  misc_feature (693)..(693): n is a, c, g, or t
  misc_feature (791)..(791): n is a, c, g, or t
  Predicted polypeptide sequence is orthologous to G1451
ntggctgtgaccatgattacgccaagcgcgcaatntaaccctcactaaagggaacaaaagctggagctccaccgcggtggcggccgctctagaactagtggatcccccgggctgcaggaattcggcacgaggagcgtatggtgcataaagatactttctcctcaggaagtgcagcagatgggcaacaatggccttgagctgttgaactcgtttccaattcaaaggctctctaatggcatctgtgatgactatgtgagccgtcaagacccaagaaatttaggcactgggataacaaccgtggggtctttagactactaaatagtcttcacttcttctatcacatgtaatattattacccttacttctcaaccctttctttgtgtacggtgggaagcacctttgcctaagtgtagtttacatagcctactctttagcctttggatgttttcctgttttttcctgctaggacatttcataaactaatactgtaactatatggcatctagtcattgtgctagccacaatatatacgatacttaatccgttaggaaatcaatgcgtgagatatgttctcttaacttgtacagaactttttctttctagtttggttntattttggcttaaatgtttgggggtgcatgatttgactatgaagcatactangcaatggagtggaggtatgttgaacttggntgaccttttattgtcatcataatatttattaaaaaataagaaaaaatattcgaggggggggcccgggaccccattcgtcctatagtgagtctaatacncgccctcactggccgtcgttttagcacgttgtgactggcaaa

SEQ ID NO: 6952 - DNA, 875 bp, Glycine max
  Predicted polypeptide sequence is orthologous to G1468
gaaaacaacaccacaagtgttaaaatctgttaaaccaaattcatgagcttaaaatttgcagcaaggaacttattccttgaagtatgaacaaagtaaccaacaaatatcacccccaccaaaaaaaaaagatagaaaatgaaaaagagaaacatatgaaaaaaagttccttatgaacttcttgaagaataacagaaatacctcaaagaagacatgaatcctgtaaagaattaatgaaataagtgcataaactttttctatacagtttggaatcttcactctgaagttgaattgcagtttgaactttaaacctctgctggaatgaactatgataggtttactttagttagaaatgaggccaaccagtgcctcctgcttgtgatttcctcctactacccaccaaggtttgtaatgctcagcatggcgatggccagtgccttcttcctctgtagaagcaggaaggttaaggtcaaaaaagtccctaatttcaggtgctgcttcctgaagtacaattgtttgactttgaaaatttctagcactctcagacccaccagccaagtgatgagatctcttgtggccacccaatgcttgaccagatggaaaaatcttgaggcaaattgaacactcatgcactttccccttcttggaatctctcactgtgtttatctcattgtcaaaatcagtaatagcagtagtcgtagtagtagtagtaacagtagtaaccatttcatgttcttccacatactcattcttcagaagcttattttctgttgtatggtcaggggagagttctgcttccaactcagtgctgttctcactgctctcatttcttgaagcaaagcaacccttgatcctcttgtgactagctctatggcctc

SEQ ID NO: 6953 - DNA, 826 bp, Glycine max
  misc_feature (187)..(187): n is a, c, g, or t
  misc_feature (628)..(628): n is a, c, g, or t
  misc_feature (665)..(665): n is a, c, g, or t
  misc_feature (703)..(703): n is a, c, g, or t
  Predicted polypeptide sequence is orthologous to G1478, G1929
gcagctatgacatgattacgaatttaatacgactcactatagggaatttggccctcgaggccaagaattcaagcgcttgaaatcaagcctaccaagtagcaagcttgattattattatcatcacatagagcttctgaaaatgtgcaaaggtgcagaaggagaaaagcaacatggtttctgcagcagnctttctacataaagagagtgcaaccagaagtgctatatgttgtgagctatgtgggttacaggcttcattgtattgccaagctgatgatgcctacttgtgtaaaaaatgcgataaacgggttcatgaagctaattttttggcccttaggcacattaggtgctttctgtgcaacacatgtcagaaccttacgcgaagatatctcattggagcatcactagaggtggttcttccggccaatataaactggaccattagaaatctccttaacaacagaggaatctacagaaagtgttcaagaatgcataacagcccttccctctttttataacttccatctttctttattctccgtagaagatcttttgtaatagaaaaggttagtgagtaccatctcaggtatataggaaactgctaaatgtttttattatcatgatttttaanaaaaaatggttggtaatacaaccatgttcaatagaanggaggaatgtccaatggtttttttttctttaatttctngtagatgtagttaattgaaatttgacttctattggtatttttatttttagccaatttccacagcaggagaacgaattttctgccaaaaaagcctaatcccttttagtgagggtaattcaagct

SEQ ID NO: 6954 - DNA, 1077 bp, Glycine max
  misc_feature (55)..(55): n is a, c, g, or t
  misc_feature (75)..(75): n is a, c, g, or t
  misc_feature (135)..(135): n is a, c, g, or t
  misc_feature (786)..(786): n is a, c, g, or t
  misc_feature (884)..(884): n is a, c, g, or t
  misc_feature (935)..(935): n is a, c, g, or t
  misc_feature (943)..(943): n is a, c, g, or t
  misc_feature (994)..(994): n is a, c, g, or t
  misc_feature (1044)..(1044): n is a, c, g, or t
  misc_feature (1077)..(1077): n is a, c, g, or t
  Predicted polypeptide sequence is orthologous to G1480
cattacacatcataacaaacaatacaacggactactttcccccatcctctcctcntctcaagaggccccaatccncgcatcatatatagtggtggctgggtgaaggggcacaaacgctggagcctccaccgcggntggcgagccgcatctcagaactagctggaactccccttcgctcgcaggcaattgcggcaccgagggtagcgcaccaactcatggcgttccaagcctctgccgcactcatagcaaatcacgccatctgctatccttgtacctgccgccactgacgctcgcgttacctctgcggcgcgctgcgattctaaggtccacgccgccaacaagctcgcgtcgcgccacccgcgcgtggcgctctgcgaggtgtgcgagcaggccccggcgcacgtaacctgcaaggctgatgccgccgcgctctgccttgcctgcgaccgcgacatccacttcgccaaccccttcgcagccgccacgagcgcatccccgtctcaccgttcttcgagtccgtacactccgtcaaggcctcctcgccgatcaacttcctagatgaccaccgcttcttctccgacgccgatgctgacgtcagcaccgaggaggccgaggccgcctcctggctgcttcctaatccgaagacagatctaaattcctctcagtacttgttctccgaaaccgagccgggtccttacatagatctggatgatgctgccgtggatcctaacgcggagcagaaaagctccgccaccgccgacggcgtcgttccgtgcagagcaactncgagtcattcgcctacgctacaagtacataccactctctcacagtctcagatgagccagagtgtatcgtcgtcgtcgattgacgctgagtcgtgctgnacgggaacacgatgtccgagacatcgaactgcatctacagcatggtgcctntcgtgacngagactgtgaccgcgccagtcttcgacggctgagtaggacgtcgagatgcntgagttacacgtagtataagaagcatccgaacgttcgatgaagactatcncgttacgccatcgtctaaaggctatgtcggggn

SEQ ID NO: 6955 - DNA, 954 bp, Glycine max
  misc_feature (326)..(326): n is a, c, g, or t
  misc_feature (645)..(645): n is a, c, g, or t
  misc_feature (671)..(671): n is a, c, g, or t
  misc_feature (706)..(706): n is a, c, g, or t
  misc_feature (708)..(709): n is a, c, g, or t
  misc_feature (767)..(767): n is a, c, g, or t
  misc_feature (813)..(813): n is a, c, g, or t
  misc_feature (851)..(851): n is a, c, g, or t
  misc_feature (855)..(855): n is a, c, g, or t
  misc_feature (863)..(863): n is a, c, g, or t
  misc_feature (905)..(905): n is a, c, g, or t
  Predicted polypeptide sequence is orthologous to G1480
ctgagcgattgtatgcgccgcgcgcaattatccctcactaaagggaacaaaagctggagctccaccgcggtggcggccgctctagaactagtggatcccccgggctgcaggaattcggcacgagcaaccatggcttccaagctctgcgactcatgcaaatcagccactgctaccttgtactgccgccccgacgcggccttcctctgcggcgcctgtgactctaaggttcatgccgccaacaagctcgcatcgcgccacccgcgcgtcgtgctctgcgaggtgtgcgagcaggcgcccgcgcatgtgacctgtaaagccgacgccgncgggctctgccttgcctgcgatcgcgatatccactccgccaaccccctcgccagccgccacgagcgcatccccgtcacgccgttcttcgagtccgtacattcagtcaaggcctcctcgccgatcaacttccaccaccgcttcttctccgacgccgacgctgatgctgacgtcagcaccgaggaggccgaggccgcgtcatggctgctacctaatccaaagacagatctaaattcgtctcagtacttgttctccgaaaccgaaccggttccttacatagatctggattacgcggccatggatccgaagacggagcagaanagttccgccaccgccgacggcgtcgntccggtgcagagcaacttcgagccgttcacctacngnntacagtacaacactactctctcacagtcacagtctcatatgagccagagtgatcttcntcgtcgtcgatggaagttgagtgtgccggacggggacacgatgtcngagatatcggactggcagctacagaaagtggcaccggntacngtgaaccntccagtctcggcgcggataggtagggctgatggtgagtacanggagaagaggaggaacgaagttcagaagacattcgtacgcatcggaagc

SEQ ID NO: 6956 - DNA, 970 bp, Glycine max
  misc_feature (49)..(50): n is a, c, g, or t
  misc_feature (53)..(53): n is a, c, g, or t
  misc_feature (790)..(790): n is a, c, g, or t
  Predicted polypeptide sequence is orthologous to G1480
gttccccccccccccccccccccccggggttgggggcgatgagtgtgannganagccatagcagagagcgtcccgcgttttaaccctcctccagggaacaaaagctggagctccaccgcggtggcggccgctctagaactatgtggatcccccgggctgcaggaattcgggacgagagttcaaaaaccctctctcgcccctcccctaatcaataatcaccaccaccaccaatcagaaacttgcttcgacgtcgatttttgtcgctcgaagctctcctcctttaactacccttccaattctcttagccaaagcgtttcgtcgtcgtcgcttgatgttggagtggtgccggacgggaacacggtgtcagacatgtcgtattcttttggtcggaacagttcggattcgagtgggattgctgttgtgtcaggaaatagtgtggggcaaggtgcgacgcacttgtgtggaatggatcgggaagcgagggtactgcgatacagagagaaaaggaagaaccgaaaattcgagaagacaattcgatacgcatcgcgaaaagcatatgcggtaacccggcccaggataaaaggccgcttcgccaaacgaacagaaattgactcggatgtggagcgtctctatagtcctggccctgcggtgctcatgcttgacactccatacggcgtcggaccatccgtttagctaattacaatatgaagaaacgactgcatgcatgaatcctatgattatgattagcgatcctgcgggattgtacggcaaaaaagtgaagcatccgatngctccgaaccgtgatcttagcttgacgccgaccgggcagaataatgtaagatatgctcgatcgacagaacagcccgtctactttcaatacaataaagaatacacatctgagcgtgggcctgtaccccattcgctctataggatcggattcctccactccactggcgtgctttacacgtcg

SEQ ID NO: 6957 - DNA, 883 bp, Glycine max
  Predicted polypeptide sequence is orthologous to G1481
aatgaaagtaggatttgaagtatatacattctccacatacatatatatcatgaaatgtgaactacagagttattatcaatggggttggctacaaaaattgaatgcaaaaagaaaacaattttttttctgaatctaagttgttctataaactaagtagtttcaagagaaagatggaagttaacactaaacataatctgaagttgccctataaacagaagttgtcctatcaattcaacggtccagattaattttcgatcaaattgggttcatcaacacaaaccgtcaccacctctaacctcttcaattttcactaatcaacccgatgcctctttaatacactactcaaagaggttgattcatcaccactaggcaatgtagaactaagcatctcagatgaagagcacgctgtctcatcatgtgaagaatcgacagaaaaagagttgtttctcaatcgcttcaacgctaaacaggcaaccttaggtggtgacgtggcagaaccagaagacattggaaccacttgattctcattctcctcttcatcatcctcgtcctcttcttcttcttcaccactatcatcactataatcaccatcgtcatcatcaaaaacatgatcagaaccatattccctaccatcatccaccacaaaatcactctgttgttgttgttgttgctgttgttgatgttcattttcattattcaccaatcggttccacctcgcgttcagttccgcaacgcagcggttacaaaacgacacagtgggcgtgagtttcatccccgaagccttccacggagtcggggagtgacacaaacgacataaaagaaccctagaatgtttcgcgaccaagaaattggcgctgtggactttctcgtcgcattcccagca

SEQ ID NO: 6958 - DNA, 736 bp, Glycine max
  misc_feature (42)..(42): n is a, c, g, or t
  misc_feature (48)..(49): n is a, c, g, or t
  misc_feature (56)..(58): n is a, c, g, or t
  misc_feature (87)..(87): n is a, c, g, or t
  misc_feature (93)..(93): n is a, c, g, or t
  misc_feature (97)..(98): n is a, c, g, or t
  misc_feature (100)..(100): n is a, c, g, or t
  misc_feature (104)..(104): n is a, c, g, or t
  misc_feature (110)..(111): n is a, c, g, or t
  misc_feature (137)..(137): n is a, c, g, or t
  misc_feature (477)..(477): n is a, c, g, or t
  Predicted polypeptide sequence is orthologous to G1481
cgccgtcccagaggatgagtgcgaggggtatctccccaagcncccgcnncagcccnnnaaaaaaaaaaatatgttcctggaaagctnatgaanacgnnanttgntccaanncgcgcaattaacccctcactaaaggnaacaaaagctggtagctccaccgcggtggcggccgctctagaactagtggatcccccgggctgcaggaattcggcacgagggtagtactcatcaacggagagagaaaataaaaattaaaagtaaaatcccagagtgagagagagaaaagaaaagaagagaataaaacaccaaacaagcttcgaaacgatcgtgagtgagatgaagaagtgcgaactgtgtaaagttccggcgaggatcttctgcgagtcggaccaggctagcttatgctgggactgcgacgctaaggttcacagcgccaacttcttggtcgtgaggcacgtgcgaaccctactctgccgnacgtgtcgttctcccacgccctgtaaggccttcggcgcctcactcgcccacgccgtccccgtctgccaccgctgcgccgccgcggaagataccgacgatagcgaagccggcaatgacgacgaaccagacacctaggacgacgaccatgtgcacaaccaggtcatgccgtggtcctccacgccgacgtcgtcgtccgcctctagctcctcccgcagtcaacgcccccaatggaaaaacacttccgcctcctcctctcacg

SEQ ID NO: 6959 - DNA, 900 bp, Glycine max
  misc_feature (30)..(30): n is a, c, g, or t
  misc_feature (701)..(701): n is a, c, g, or t
  misc_feature (732)..(732): n is a, c, g, or t
  Predicted polypeptide sequence is orthologous to G1482, G1888
gtgtggaaagatgaatctacagtaagacanctagcgcgcaattaaccctcactaaagggaacaaaagctggagctccaccgcggtggcggccgctctagaactagtggatcccccgggctgcaggaattcggcacgagctccatcttccaccaccaccaccaccaccagcaacaacaacaacaacaaggttgctgttgaaggaactggttcaactagtgctagcagcatatcggagtatttgatagagactcttcctgggtggcaagttgaagactttcttgattcatattctgttccctttggtttctgtaagaatgatgaagtgttgccacggtttgatggtgaaatggaggggcatctgagttctttctcaaccgagaacatggggatctgggttcctcaagcgccaccaactcttatgtgttcttcacaaatggatcgggtgatagttcacggtgagaccaatatcaaaggtagcagcagatcaaagttgaaggatgataaattcactgttccacagattagtcctccttccaattccaagagagccagatttctgtggtagaaacaaataaacaaacaaacaagcctcagtttccattctcttgaggcagaattaacaaccctctttgttttgttttgtcccttttctctttttcttaccctggcttgtagtttactctgcccatgttttcaattnggttcagtttgacttttttttttttccaaanaaaaaaaaaaaaaactcgaggggggcccggtacccaattcgccctatagtgagtcgtattacgcgcgctcacttggccgcggtttacaacgtcgggactgggaaaaccctgccgttaccaacttatcgccttgcacacatccccctttttgcagctgcgttattacaa

SEQ ID NO: 6960 - DNA, 883 bp, Glycine max
  misc_feature (752)..(752): n is a, c, g, or t
  Predicted polypeptide sequence is orthologous to G1488
aattcaaaatttttcagataagaaagaaaaaaaggagtgccgaagctgacgatagtttaaagtttaaacttagacctgcacccttaattaaaattaaaaaatttaaactaggtactctaaataacgtgtctaaagtctggcccacaatgctggtgatgatgatggatcaagaactcatccccaccgttggatacgccgaaaattgaactttgactcatcaattgctggtgctgctgtcgctgcagctccttctgccgcctcagctccaaaaccttccgatgcgaattcgaatgcttcgttgacatgaacgttggactcgccgccggtcggtactccggcaccagcctcccggacttgaaccttacgccgcacgcgttgcacagcgtcttcggtcccatcggtcccgttctccactgcggcgtcttctccgtaccgcagtgcaggcatttgcgtccggaacactccgcattcgttccttctctcttcttcgccggctccgcctttagctgcggcagcttctcctgctccgtcgcgaccaggtggagcaggcgcgtggaccagtcccccggcgccgcccgtgagcgcttgctgcgcgccttccccgggagaggcgtttccgagtggagaaacggtgcgtttcgcaaggtgtcgtcggaggcgaacggcggaagcgtgtcggtggaggaggaggactccggcgtctgcggtttcgcgccaatggcggtggacgcggcggcggcgccggagagtanctgcagcgtcttcagctcctcctcggcggagaacgagtcttccacgaagttagagagccattccagttccgccatttcatcatacggaacgcagagttctccggagaaatgaggatcactggggaagccgc

SEQ ID NO: 6961 - DNA, 400 bp, Glycine max
  Predicted polypeptide sequence is orthologous to G1488
ggctggtgccggaataccggccggcggcgagtccaacgttcatgtcaacgaagcattcgaattctcatcggaaggttttggagctcaggcggcagaaggagatgcaacgacagcagcatcatcagcagttgatgagtcaaagttcaattttcggcgtatccaacggtggagatgaattctcgatccatcatcatcatcataatcatcacctccattgtgggccagactttagacacgttatttagactacctagtttttaaattttcattttaattttaatttagggtgcaggtctaagtttaaactatcgtcagcttcagcacttcttttttcttatctgaaaaattttgtcttatgaatttgaattcttagctttttttttcttctaaaaaaaaaaaa

SEQ ID NO: 6962 - DNA, 892 bp, Glycine max
  Predicted polypeptide sequence is orthologous to G1493
ggaaaaaatatttcataatgtgttattaagttaaaatgctcctacaagtctgcaggtgtatcaaagccttgccctctacagtttttccctaaaccagtgtcttcatgtacaccttaacaacataagcttgctagaaccttggcaaacgaaagcagccaaaaaattgcaaatatgccttttgcacacatgcatttaaagtttgttgttattcatcttttaagcatccagactaaatcataataacatactactccctgaagcctgaattttttacatcaattaaattctatttgttgaaaaatttaaactaagatccaaacaaactaattgcagtgcgatttggttcaaatggaacgccaactatttgcattggcgactgcaattaggaagagaacgggcagaatctgttctaaactggaatgttgtctaaggaatatccatcaaagtcaaactcattttcagctgttccaacgccttcttgctgtttcagaaatgcactgacaagatcctcctgaccatattggtcagagaagaggttattaatctgacagctaggatcaggaattctttcagccttaacccttactgaattgtcaagaagaaggttattgtggtgttgaccaatattttggagactactctgatgcatgccttcacctgtggagaacatagcttttccaattgaagtagtatctctattttgtacagtctgttgcatagagggaaaactctgatgaaccaaaactgatggtgagacatcaatgttaccttgtaaaggatttgcatgctgagaagcatcatatgtcatgcctgtgtttgttaagtcccaatcatgggacttctgatggtgaaagtcattaaacatgtcataaccttgaacaaatccaccaga

SEQ ID NO: 6963 - DNA, 747 bp, Glycine max
  misc_feature (1)..(2): n is a, c, g, or t
  misc_feature (8)..(8): n is a, c, g, or t
  misc_feature (17)..(17): n is a, c, g, or t
  misc_feature (19)..(19): n is a, c, g, or t
  misc_feature (562)..(562): n is a, c, g, or t
  misc_feature (571)..(571): n is a, c, g, or t
  Predicted polypeptide sequence is orthologous to G1493
nnatgganaagttaccngnacctatcttgattttaatacgactcactatagggaatttggccctcgaggccaagaattctttcagccttgatccttattgaattgtcaacaagaagtggattgaagttagcattttggaggttattttgttccaagccttctcccatggagaacatagcttttccaatcaaagcgccatctctgctttggccggtctgttgtgtagaagaaaacccttgatgcactaaaactgatggtgcaacatcaatgttaccttgtaaagggtttacatgatgggaggcattgtatgtcaagcctgggtttgttatctccaaatcatgggacttctgatgatgcagttcattaaaaatatcataacttggaaacccactggatcctttaattcctgatgtaacttcttcttgaaaagagccttttgttgtgatacttgatatacctggggtggttccaattgggaaactattgttgacagacatttcagaggtttgattcataggaaaactcaacaatgaagagctcggtggaacaggattatatgcangtcctctgntattacccgcaatcccatttctgcccagaagaccattagaaattccatttgatacagtacgctgcctcaaagatgatggaagtcttggaacacgaggaccagtatttcactaagcatctgacctctaaggtgggattgtgccatctgcatcaatatggggttggcttgcggtacaa

SEQ ID NO: 6964 - DNA, 624 bp, Glycine max
  Predicted polypeptide sequence is orthologous to G1506
tcggcgcgcaattaatcttcactaaagggaacaaaagctggagctccaccgcggtggcggccgctctagaactagtggatcccccgggctgcaggaattcggcacgagggtagaagaaggctctagcttcagtccaaaaagcttatttgccttaccccatggtgttggtggcttgcacatgctggattctttcaactttgttggtgagagttctgaggatctgcttttagaggtgccttctaacagttcttttccacaggctgagctcctgcacccatctttaagctatggtgctcgtcaggtcagcaccactagtagctcagtacactcacctgttactcatccttaactaatctttactaggttacttggatgggtatggacacaatattttgtcataatagggtccacatgttttgcatctgaaacaccaaagttcatgtacaagagatatgatgatgattgtgttttttgtttccttgcaaccttgagcttggattgccaaaggatggaagttgaatgggcttttttttttttttcttgtatagattggtaatagattgtaacatatagcatgaaattcggagtgatcatctccggagtttttggaaaaaaaaaaaaaat

SEQ ID NO: 6965 - DNA, 778 bp, Glycine max
  misc_feature (626)..(630): n is a, c, g, or t
  misc_feature (642)..(646): n is a, c, g, or t
  misc_feature (732)..(732): n is a, c, g, or t
  misc_feature (734)..(736): n is a, c, g, or t
  misc_feature (762)..(765): n is a, c, g, or t
  misc_feature (767)..(767): n is a, c, g, or t
  misc_feature (772)..(776): n is a, c, g, or t
  Predicted polypeptide sequence is orthologous to G1506
aagagtttggagagttatgatttaaacctattgggaaataaaagggtgtgaatcattcacaaaacataaactacaactgcatacaaaactccggagatgatcactccgaatttcatgctatatgttacaatctattaccaatctatacaaaaaaaaaaaaaagcccattcaacttccatcctttgtaaatccaagctcaaggttgcaaggaaacaaaaacacaaccatgatatctcttgtacaggaattttggtgtttcagatgcaaaacatgtgaaccctattatgactaaatattgtgtccatacccatccaagtaacctagtaaagattagttaaggatgagtaacaagagagtgtactgagctactagtggtgctgacctgagcaccatagcttaaagatgggtgcagaagctctgcctgtggaaaagaactgttagaaggcacctctaacagcagatcttcagaactctcaccaacaagttgaaagaatccaacatgtgcaagctaccaacaccatggggtaaagcaaataggctttttggactgaagctagagccttcttctacaacttctttgacctcacagctaggctttatgaacacccttttggggcttctcattnnnnncttcaattctgnnnnnttttgattttggctgtcatgctcacgcattctcttggcagttgtaacataactagattccatagcagtagatcccaaaccaatagntnnnccagatttgttttcacatttcttcannnnantatannnnnct

SEQ ID NO: 6966 - DNA, 647 bp, Glycine max
  Predicted polypeptide sequence is orthologous to G1510, G1779
ttttttattttttttttttttttttttttttttttgcaagtcacaaccaaacaaataatataattacgaaatactggtatatgaaaaactaaaaccaaaactaaaacaaaaacaaaagcaagaacaaagggaaaaagtatctagatttcttctagctagctaatattataagtggacaaaaccacaagataagtccatcagaagcaatgccgcctcagctacttcatcccgtggaaacatttgttcaaaatcagagttgttactcctcaaacttatggcgaagttgttgaaatattcaagcttcctcactccctcagatgagcctacagtagtagtagtagtagtagtagtggacttgtacttgttcttgaactgtgcaaaatggttcatacgagacttcttttccttgttgtgtagtctggtcttttcacatgctatgggagtgaccaaaccatttgcagcttccgccattgcccttcttgccttcctctgtctaatgccacaggcattgcaaagagacttgggacccttagggccagtcctccaaagtggggtagtgcttgtattgcaatccgaacaaaccctaggggtgctactgccgttgttgttacgagggcttctttggctgtaccttctgctttcgagcc

SEQ ID NO: 6967 - DNA, 631 bp, Glycine max
  misc_feature (111)..(111): n is a, c, g, or t
  Predicted polypeptide sequence is orthologous to G1510, G1779
ttggatgataatataaaatttataatttaaactttattaatatcccttgttctattattaaatgagtggaaaatccatggaagaaacattccttcttaacagtaaacaaangcccgcaagataaatccatgagaagcatcgctgcctgagctacttcatccattattggaaacacttgctgcttcaaagccgaactatccctcaaactcaaaccaaaatcgttcaaatcaatcttcacgttctcctgctgagatgttccttcagcagtactagtagttgccaacttgcacttaagcctgaaccgtgcaaaatggtttgtacgagacttcttttccttgtgatgcactctgatctttgtagaagatgaattcacggaaggagcaaaaccatttacagcttctgccattgcccttcttgccttcctctgtcgaatgccgcaggcattgcaaagtgactgcaccaccaagatgttaaaaacttcgtaacccattgcccagagactcttcgctatgcgcttgttatttaattttaattagaactagctatttattaattaatttgtagaactacatgcaagtatccaatgtaaaaaaaaatgacaagcaacaaaatatagctagcgttaattaga

SEQ ID NO: 6968 - DNA, 791 bp, Glycine max
  misc_feature (1)..(4): n is a, c, g, or t
  Predicted polypeptide sequence is orthologous to G1510, G1779
nnnnaagagatcagcatcaggatgctgccaagcgcgtagttaaccctcactaaagggaacaaaagctggagctccaccgcggtggcggccgctctagaattagtggatcccccgggctgcaggaattcggcacgaggcaaaggaaggcaagacgagccatggcagctgctgcggcttctgcatcgggaaatggaacagtaattgtggaagctaagaaatctgtgaagggacggaacaagttgcagaagaagaaagagaagaagacaagaactgagggtgcagcacagatgaaaaagaagcggaagcttggagttggatcagcaaaggcatctcaaagtagaaacaagtttggttttgaggatttgacgttgcgcttgagaaagaacttggctatgcatcaagttttccctcaggacgagaaggaggctgcgatccttctcatggctttatcttatggccttgttcattgatgaaccttaattaatagctagctagctagctagctagagctaccaccacttcacttaatttcagttcgttattaattaggttaatttcttgtattgctgtcttatgactagctagttgttgttagattatgattattgtgtgagatcaatggtgtagagtcgttatatgtgtgctaagaaagtatgtcttgcagtctactagtggagtggcaggatagtccaggagaactaacgtcatgagcgggaggcaagaaaagagaagtgctatcgaagagctcggcacgagaggggagcggataaggagagagagaggcgccgaag

SEQ ID NO: 6969 - DNA, 795 bp, Glycine max
  misc_feature (1)..(1): n is a, c, g, or t
  misc_feature (647)..(647): n is a, c, g, or t
  Predicted polypeptide sequence is orthologous to G1510, G1779
ncggtgagggtgtcgggggtgcgcgcggcgcgcaattaaccctcactaaagggaacaaaagctggagctccaccgcggtggcggccgctctagaactagtggatcccccgggctgcaggaattcggcacgaggaaaaggtccaaagtcactttgcaatgcttgtggaattcgacaaaggaaggtacgacgtgccattgccgccgctgcaacgtcaaacggaacaaatccggtggaggctgagaaatctcaagtgaagaagggaaacacgttgcatagcaaagggatgaagtccaaaactgagggtgcacaacagatgaaaaagaatcgtaaactcggagccaggtatagaaagaggtttggtgcttttgaggatttgacagtgagattgagtaagaacttcgctctccagcaagttttccctcaggatgagaaggaggctgcaatcttgctcatggctttatcttatggccttcttcatggctttcccacggatcgttatatcacttagatttatgagatattggttgtggaaccataattattgtatgagaccaatgcttagtgttatgctagatttagtgaagttaattaattagtatggaaaactgataatatagggacaataaagttatgaggagggtatcgntttatcaagttaattgtatgttgcatctgaaaaagaagaccaacacaaaatactagtgtcttattgttcatgatcatgagtatcctatattaatctcaataaatatttaattaaaatttcaagagattttatattgtaaaaaaaaaaa

SEQ ID NO: 6970 - DNA, 646 bp, Glycine max
  misc_feature (17)..(19): n is a, c, g, or t
  misc_feature (617)..(618): n is a, c, g, or t
  misc_feature (620)..(620): n is a, c, g, or t
  Predicted polypeptide sequence is orthologous to G1510, G1779
tgaacttaatttttaannncatcaagaagagacccacactttttggtcctcaacttgttcaaatcagacataatattatatgaagtacataagatcacccccacacccatgtaactttattttccctcccctttcctaactaactagctagtactgcaatattacatactcttctcgcacatataactcaaaccattgatctcacacaataataataatctaacaaaaactagctagtcataagacagcaagacaagaaattaacctaattaattaacgatctgaaattaagtgaagcggtggtagctctagctagctattaaggttcatcaatgaacaaggccataagataaagccatgaggaggatcgcagcctccttctcgtcctgagggaaaacttgatgcatagccaagttctttctcaagcgcaatgtcaaatcctcaaaaccaaacttgtttctactttgtgatgcctttgctccaactccaagcttccgcttcattttcatctgagctgcaccctcaattcttgtcttcttctctttcttcttctgcaacttctttcccttcacagatttctcagcttccacaataactgctccatctcccaatgctgnngncgcagcagctgccatggctcgtcttg

SEQ ID NO: 6971 - DNA, 974 bp, Glycine max
  misc_feature (1)..(1): n is a, c, g, or t
  misc_feature (582)..(582): n is a, c, g, or t
  misc_feature (758)..(758): n is a, c, g, or t
  misc_feature (800)..(800): n is a, c, g, or t
  Predicted polypeptide sequence is orthologous to G1512
naaagccaaagctaagcatgttctagctctaattcgactcactatagggaaagctggtacgcctgcaggtaccggtccggaattcccgggtcgacccactcgtccgaagaggtgtatttggtctgatgacaagtccttgcttgggtctaaagaaccactggtgaccaaaattgtgaaaaggggttccttgattttcatcaattcatggcatttcagcactacatttcccgggatttgaaaaccatcccaaatgctgcgactgagacagaaaactccaatggttgttttgattgcaacatctgcctagactttgcacatgagccggtggtgaccctatgtggccacctctactgctggccatgcatctacaagtggctccatgtccaaagtgattctcttgcacctgatgagcatccacaatgccccgtttgcaaggcagatatatccaatagcacaatggtcccactctatggccgtggccatgccgccacagctgaaggcaaaacatcttcttgtgatgttgttataccaccaagaccatctgcttcatgtgttcaagcccttttggcaacatcatctcanaggggtcagcaccttccatatcgtaatccttatcagggtcactacttcagctctcatccataccaagaagaagatgatgccacttcacaaatgctcaatcttggatccaccaccacgctgtgactgggatgtatggggagatggttatgccagagtgtttggcaacccagaagatntgtatgcatacgcgaaatcttatcagctgatggaagtgcccncctagacgaaaaggcagagatgacgctcacaattcttgacagattactatatgtattagctgctgctctatgctgatgatctagtgacactcgatatttcttattcttgttgtacttcgtgaagctggtagcgcttacgactgtagagttgatagtattcagctgatagtcgag

SEQ ID NO: 6972 - DNA, 944 bp, Glycine max
  misc_feature (698)..(698): n is a, c, g, or t
  Predicted polypeptide sequence is orthologous to G1512
ctatactgaggggattgatggacttctgctgattacccccagcgcgcaattaaccctcactaaagggaacaaaagctggagctccaccgcggtggcggccgctctagaactagtgtatcccccgggctgcaggttattgtctctgtagttagagttgaatcttgaatatgccaattttctgtttagtgaaaagttttgtgaggttagtatgttgttgagggttttcaaggtttgaagttagatcgtggtcacagttgttccaatccttgacattgtgggaaattgcagacaaatgtggccattgcggccacaattagtatgtgtttggattagcatttgtaaaattgatttaaaatcaacgtaaattactgaattcggttgtagagactccaaagacctcagcatgccaaaatcatggtggtggaccatttttttttataaccctgcaagttttgcatttggcatctctgaatttgcactcgtggcttgattttgagatactgtctgtgtaatggcacttactccttttgaaggattattaggcatgagagactaaattttgtttgagggaagactaagactttccttgtagattctgaactgatatctggtcataattttaagtgtttctcacctttcctagtcgtctagtaacagaaattgatccaatggcaatattattttttcttgaagccacnaatatgttcaattatgtatgcatgattgtgtataaagactaagatgcaaatgacatgggaaggctggcatttgaattgcacacttgatatgtcataatttatgccttacatagcattcacatagaatcacaacgttgactggtatttttgcacaatgtacaggtttcaggctttgaaaatggtgatattggaagcatgggtcttgacttcattctgactttctcctcgttcaagtcttcatccttc

SEQ ID NO: 6973 - DNA, 830 bp, Glycine max
  misc_feature (1)..(1): n is a, c, g, or t
  misc_feature (12)..(12): n is a, c, g, or t
  misc_feature (811)..(811): n is a, c, g, or t
  misc_feature (830)..(830): n is a, c, g, or t
  Predicted polypeptide sequence is orthologous to G1512
ngcagagactangcactgatcactccaagcgcgcaattaaccctcactaaagggaacaaaagctggagctccaccgcggtggcggccgctctagaactagtggatcccccgggctgcaggaattcggcacgagggtggccacctatactgctggccctgcatctacaagtggctccatgtccaaagtgcttctcttgcaccagatgagcacccacaatgccctgtttgcaaagatgacatatgccacaccacaatggttcctctctatggccgtggccagggcatagctcatagtgaccatgatggaaaggcatcatcctatagaggcagttgtataccaccaagaccacctgctttgggtgctcaatcgctcattgcaacatcatctcaaagtgttccatatcgcaacacttatcaaaatcagcatttataccaagaagaggatgcatcatcatcacaaatgctgaaccctggtgccaccattttggcaccagggttcccccaccttgtgtttgggatgtttggagagatgttttataccaaagtctttgggaactcggaaaatttatacacccacccaaattcttatcacctgtgggaaagtaataatagtcccaggttgagaaggcaagagatgcaagcaaacaaatcattgaacagaatctcaatttttctgtgctgctgtttccttctgtgtctaatcgttttctgagcacgaaattggattattattctctattgccctgttgattaatataaagaaacaccggtggtagcttgagaatgagatagaatgaacaattgtatgttngggtaaagaactggtgtcn

SEQ ID NO: 6974 - DNA, 433 bp, Glycine max
  misc_feature (1)..(1): n is a, c, g, or t
  misc_feature (6)..(6): n is a, c, g, or t
  misc_feature (8)..(8): n is a, c, g, or t
  Predicted polypeptide sequence is orthologous to G1519
nccagngnaattcggccttacggccggggggttcatttctgaagatgtttccttataaacagtaggcgactccaattcctgataactcatttttggtttaaagctcgtggacagacatcaagatagacatttggaatgacaaaagcgatcatttccatgcggcaaatacatgatgtatatgaaatttgaaaatagcatgtcctttgtgcaaacaattgactgatggatctgctgttttgtgtttgtaccataagttgtttgataatttggtaggcattattttggaagtagttaacaggtagttattaggttggtttcagattttcagtatttgattggtatatgatgacatgaaaccaagaaatcagctttttgtcattcttttggagccttattcaattcagatctcatcaactgcagcctaaaaaaaaaa

SEQ ID NO: 6975 - DNA, 926 bp, Glycine max
  misc_feature (859)..(859): n is a, c, g, or t
  misc_feature (897)..(897): n is a, c, g, or t
  Predicted polypeptide sequence is orthologous to G1526
ggataacaagctagaaaagcttaaaaagcttcaattaatccttcatgcaagacgtaatttatggtaaaataaaaattatgatgctcaaacgaaaaaaatttacaaatagatttttaacccctctcccaagggaaaaaaagaactgcaccttaaaatgcaaggtcaataattttataaacaagaaatattgattaaattacatttgatagcatttttttgtcagggtcctgaaagttactttgcgcatcaaatattcttgctgaattttgcccttcaggtgaaagttcaaatctatcgccttgaataacttgctgaataattttatttatggtgcttcctttaacctgaattcattgaaacataatgaacaactcgataaaccaagatccaaaaagacatatattataaaaatttagggatgtaaaattagtaagcataaagtagccgttccaaacaatgcaaagagttctcttaacaataatggcgttaattttttttttataagtatgattgtattacagcaaggaatctgtaaaaaacaaaaaaagagtaacaaaggggttttattgtaatattgaaattttgaagaaaaatccatggtcattcctcgagagaggcagttgtagtttccccaaaaaacttatatcgtgaaaaaatagcatgtttatattaacctgtcttgaagaaataatactttctaactgttttagaatttcttaaaaaaaactgttttagaacttttaaataatatttgatctaaaaatagcagaaccagacatgatattagatctagtgtgatgccaggacctgaacttaattccgaatagcatgggcgtttttattgcacaagttcacctangtctcaagaccttgtttagtatctctaacaaataccangggcacattccttgatgaagccaaactta

SEQ ID NO: 6976 - DNA, 586 bp, Glycine max
  Predicted polypeptide sequence is orthologous to G1526
tttttatattattagttgttgaattacatacatacattcactcaacttggactataagattgccaaggaaaaaaataagtccctccatttcctttatccactcgttcccctctcccaaacaacagcgtgttcccaattacatcaaagatgtccatctactttgcacctccccctccaaacagcctgattcaagcattgtgttgatcaagatattcagtaaacttgatcccactatgcaggctaaaagataactccctggcacacatgccgcctaagaagcaccttcatgttactagttacaactacctcgcactcgccagtcaccggcacttaagaaccaaaaaaaaagaaaaacatgggatgcaaaatttgtgaaagtgctggtgcacccaaagcaagcgaatatgtttgcactgcttcttgtctaagtaaaaagcatcttcaattcctcaatccttgcagttcgaacttcttgatcagtcaaggcaccagaaatcattcgttgtttacgtgcttgcactgcctccattctctcctcaactgtccccttcacaataaaccgtctaatggcaaccttctttgtttg

SEQ ID NO: 6977 - DNA, 902 bp, Glycine max
  misc_feature (14)..(14): n is a, c, g, or t
  misc_feature (21)..(24): n is a, c, g, or t
  misc_feature (26)..(28): n is a, c, g, or t
  misc_feature (796)..(797): n is a, c, g, or t
  misc_feature (805)..(806): n is a, c, g, or t
  misc_feature (813)..(813): n is a, c, g, or t
  misc_feature (815)..(817): n is a, c, g, or t
  Predicted polypeptide sequence is orthologous to G1554
gaataaatttcctnttgtaannnncnnnttgacagccctgtcgtgattacgccaagcgcgcaattaaccctcactaaagggaacaaaagctggagctccaccgcggtggcggccgctctagaactagtggatcccccgggctgcaggtggtggtgttcccacggaggaggaggtggaagagttttttgccatactaagaaggatgagggtggcggtgaagtactttgatgacaaagggagtggtggcaaggagtggcggaaggccctcgagacggcggagctcacggtggaccaccgccacgacgtcgttgctgccgaagaggatgacaagccaaggaaaaagggtggtgaggtaattatcaatgagggctttgacttgaacgccgtcgcgccggaagccgcagagggcggtggcgcgtagagttaattgattggcgtctgggacgcacgcgctgtcggtataaccaccgtaagattgaaggtttgggtttctcaaacatgttaattagttgccttgatttctccgaagaacaaaacgaaaaatgattctacacgtctccctctctctctctctttgtccttttcggattaattaggttgtaataataaataatataggaggctttagcagtgctgttgattgatgaaattttaaatgatacaaaaagttggtattaaactggtgtctttttttcttggggaaatggacacattttccttcatctctttggaatgaattatccttctctccccatatataccaattgaagggacctttttgggcttaaaaaaaaannaaaaaaannaaaaaanannnaaaattgggggggggcccggtccccaatttcccccttttttggggtcgtatttaccgcgcctacatgggggcgggtttttaaaaa

SEQ ID NO: 6978 - DNA, 715 bp, Glycine max
  misc_feature (715)..(715): n is a, c, g, or t
  Predicted polypeptide sequence is orthologous to G1560
ggggggcgggggttgtgaacagcttgacatgattacgaatttaatacgactcactatagggaatttggccctcgaggccaagaattcggcaccaggccgcaggaatttttttttttttttttttttttgagtaaataacgattgctatcactaccatagattcttgtccaagcaacagctgcaacctacctaatcaaacagagaaaagtgagaaattttttaggttctacaaaaggacatgcatcatcatataatgggggggttagaaacaccaaaaagtaaatcatttccacatgtatcatgccaaatgggatgcctcctcctccattcaccacatgagtgcctccacttgaaccaaattaatgaacaatgttaaccaataataatcttgagtactatatgtggttggtttcatttaggacttgaacccaagtaaccaaagcgattggccaacacattgacatgatcttcttcttcttcatcttggtcttgggaattagttggattagtatccaattcaccctcaaaaccctcactgaaaagttcttcccagaacccttcatcaagctctttctccagcctctcttgtgagcagattccatggaaatggagctatcagaaacacaaaatagtcttcaagatgaaaacatgtcaatgaatgaatcagattctgaagaggacagcattgtggattcctatgtaataaagaaagaan

SEQ ID NO: 6979 - DNA, 412 bp, Glycine max
  Predicted polypeptide sequence is orthologous to G1591
gttttctctattactgaattaggttaacaaatggtttaggaaatagaaagagatgaaatcaacgttttgttttggctttttgcacatagacggataagtgtcgaatccttgttcaccgtccaaggaaaaaagcgtcataggcgccgatcgaagatggcacttcaattaattaagatcaagtctatccatgttgaggagaatttttcagagaaaattttaataaaaagagagaatgtgaaaagggtgtcagaatagaatgagcacaataataagacatgctccttctatgatggttgttggaaatggaaaagggaatggagaatgatttacaatcgcgcgcagccattttgggggtcttgtctaaaataattcaataaactattgaaactttacatattaaaaaaaaaaaaaa

SEQ ID NO: 6980 - DNA, 802 bp, Glycine max
  misc_feature (15)..(40): n is a, c, g, or t
  misc_feature (49)..(49): n is a, c, g, or t
  misc_feature (58)..(58): n is a, c, g, or t
  misc_feature (736)..(736): n is a, c, g, or t
  misc_feature (785)..(785): n is a, c, g, or t
  Predicted polypeptide sequence is orthologous to G1635
gaggggggtaataannnnnnnnnnnnnnnnnnnnnnnnnnaaggggggngggtgtggnaaaaacgacctgccatttcctgccaagcgcgcaattaaccctcactaaagggaacaaaagctggagctccaccgcggtggcggccgctctagaactagtggatcccccgggctgcaggaattcggcacgagatgaagtctaattctctgaagtcgtcagactttgatcaagaaaaccaatctccaaaatcagtattatcaggagttggttcagacagccttggctcctctgattcagacacaccaaatggaagtttgtcgcccatgtcatccattagtggcttccatacaagcagttttacacgtgccaaacccaaaacaacaacatctgaggaagaagctgggatggacactgattcaactcatgatgagaaacctcttatgaaattcaagcttcctccaaatggatgtgtttccatcaaagaagacaacacagcagaagaatcttccggtcggactttcaaactctttggaatgactctatttgtaacagacacctgcaaaccatctccaacaatcgaggaatgctaaagatacctctaaacattcgcgcgcaacgcctttcctcctccatggaggatggcaaattggaacttgttggacactctagagcaagtgaaacatcagcaatatccaagctaaaggtgagagtggaacctgaagcatgtgggaaagggtntgtgccatataaaagatgcatatctgttgtgacagctgatgatagagcngagcaatgtattcatct

SEQ ID NO: 6981 - DNA, 764 bp, Glycine max
  misc_feature (1)..(2): n is a, c, g, or t
  misc_feature (764)..(764): n is a, c, g, or t
  Predicted polypeptide sequence is orthologous to G1635
nnaagagagacacaatgacatgcatcacgccagcgcgcaattaaccctcactaaagggaacaaaagctggagctccaccgcggtggcggccgctctagaactagtggatcccccgggctgcaggcttccccacaatactccatttatgccactgcacaaggagccaaaagggaagcatctatattctaatcttggagagtttgaacataaagaagttcaaaaggaaggatcatggactggttcaaacactagttcaattgatgatggagataacactgaaaaatcagatgatcaagccaaaagtcatgtacatggttttagcaaaagtgaaactttaactatatctgagctaagggtgaggcctaaaacatgtggaaaagggtttgtaccatataaaaggtgcatggcagagagggaaaaccagtgctcatcagtatattatgaggaaagggaagagcaacgtattaagctttccttatagtaccctcttattggcttttcttcaaagcaggttcccttttacaggtataatgtacctgtttctgttgctggatgaccttgcatgagaagaaagataacggagctgaaatttttgatatctctactgcatatgtaattctacacaagcctgtgtgttaacctatatgaacttgcagactttgggaaaacactatccaatgaattatcgcacctatctgtatttctttcatgcctagccctttggattgcttcaaatacttcctcagcctccactcggatatatn

SEQ ID NO: 6982 - DNA, 905 bp, Glycine max
  Predicted polypeptide sequence is orthologous to G1638
cgttagcaaagctgcaaaggcctatatttatttgaagcatcaagcatttaaaaaaaagtgaataatcacaaactcaaggtaactcctctcgtcctatacgttttacagataatcctttctgcctaggtggaagatgcatatcactgccaaactctgatattgcatctttggtgccagcacatttaatatcagaatacaatatgaaggctcttcaaagattgagtgataaggaaactcgtgaatccttgaaatatttacataaaaccacccttaagcatctaaaaatcaatccaacatcaatgaataaggtttagcattttagtaccttaactttaatccctgcattctatatagttcattgattttgcatggacggcatttgcataattgtatcataaggtccaaactggcatccactgaggaaatactgctcctgaagtggtttagatccatatgaagaaatcccacaaagtggtgtcatgaacatgtttccatttgtggaattgaaaagcataggcacagtttcacatggcaatttccaatcatgttcctgtttaattaccatagtagtagacaatctttgattctgggatggtggattcacatccttcactgagtgatctggtgaatagggtctgttgttactctctgatgaaggagattttgcttctgggagattcaccattgtgatgtcatggatactggatctcttcttgtcctttcctccacttagttgcctgatgaaatacttctgagcatgacttgcaacctgagttggtgttcttgtggtcacaaaattgcgagagatgtttctccagtctcctttaccatacttcttcagacccatcagaaattgcctgtgctcctctttagtccatggcacacctttcttcctctcctgctca

SEQ ID NO: 6983 - DNA, 784 bp, Glycine max
  Predicted polypeptide sequence is orthologous to G1640
gagttagatggcgatatttattaaagacaaaaaagatctcataactcagagatcatttacagatatatttacatatgatctatcaacaaagtttatatgtaagcaatgtgatcttcatgaactgaacaaatctttgttgatattcttttaatctaataaagattctgcaaatgaattcagttcgaattggccatggtccatgttcaagagctggaaatattcttcatacaattgctgtaggttgccatgatctgtgggaaaataagagtggcattcaatatctgagacgttgactaagtcatggtcctcactgaagaagccaaaaccatcactttcttctcccacattaccaacttcactaaccacgtttgattcttttgtcacggggctttcctccttctcttggcttgttgatccactagctgaattggaatcaaaggtgaaggtgttactatccgttctttgtaaatacattgccttcactctaattggttttggtaggtaaacttgtgtctttggcggctcatcattttctttgcctttgttcttctgcttgttctttttgccaccgttcttcttcttcttcttctttttgttgttgttgccaccatcacttgcagcctcttcttgaggattctctaacattttgtgtgtgtctgtgtcttctgttccttgaattttcagctttttgcttagatgggtgttccagtagttctttatttcattgtctgttctccctggtaaccttcctgctatgagggaccatctgtttcccgacagcaac

SEQ ID NO: 6984 - DNA, 835 bp, Glycine max
  misc_feature (38)..(38): n is a, c, g, or t
  misc_feature (744)..(744): n is a, c, g, or t
  Predicted polypeptide sequence is orthologous to G1641
gcctctaagttgaaacatttcattaattatacacgggngcttgaaatccattattcttagacaacatagaaaaaccaaccaaaaccaacgttggggacttggttgcctgccactcctttcaggaagttcttatttgttgaagaaacaaatgtatgtaccttccttcaagttcataataactaaccaacaatctagggtattcacataagaacttggggaaaaagctcaactcaagcactgtacttattgaaatggacagaagattctggttctacttctgcccattaataattcactacaacaagtgataatgcatggaactagtgttgagaggactgttgcatttggaaaaccatgttctgtgtctgaggtcgcaagtaagaagactcatgaagattctgtccctcaattttaaccccaaaggagttagcaccataatgagacatgaagactctttcatgagcagggttgagagtcatagctactcctgtgttagactgattactccactgaaaacgagttcttggtgtagtaggagtagaatttggctgttgttgctgtgagagcacatgtggtgaagaggatccattggtgtcttctgaagaagttgttatggtttctgtgagattcactgttgttatgtcatgtatgctagccctcctcttgtctttgcctcctgaaagctgccttatgaagtacttctgagcatgactagcaacctgtgttggagttcttgtaataacnaaattgcgagatatatttctccaatcacctttcccatacttcttcagacccaatagaaacaatttatgttcgtcttcagtccaaggcactc

SEQ ID NO: 6985 - DNA, 842 bp, Glycine max
  misc_feature (1)..(1): n is a, c, g, or t
  misc_feature (8)..(8): n is a, c, g, or t
  misc_feature (684)..(684): n is a, c, g, or t
  misc_feature (700)..(700): n is a, c, g, or t
  Predicted polypeptide sequence is orthologous to G1641
natgtganatgattacgccaagcgcgcaattaaccctcactaaagggaacaaaagctggagctccaccgcggtggcggccgctctagaactagtggatcccccgggctgcaggaattcggcacgagggaacactcctggctatgatgggtttaaaggatgtggaaagagaccttcctcagtgagacccattgagcatgaaaggaagaaaggagtgccttggactgaagaggaacataaattgtttctattgggtctgaagaagtatgggaaaggcgattggagaaatatttctcgcaattttcgtgattacttagaactccaacacaggttgctagccatgctcagaagtacttcataaggcaactttcaggaggcaaagacaagaggagggccagcatacatgacataacaacagtgaatctcacagaaaccatcacaacttcttgttcagaagacaccaatagatccacttcaccacatgttctctcacagccgcagcagcaaaattctactcctactacccccagaactcattttcagtggactaatcagtctaacacaggagtagctatgactctcaaccctgctcatgaaagagtcttcatgtctccttatggtgctaactcctttggggttaaattgacggacagaatcttcatgagtcttcttactttggacctcanacacagaacatggttntccaaattgcacagtcctcacaacactaagttcatgcatttagaacttgttgtagttgatttattaatggggtggaagtagaacagaatcttcttgccttttcaattaatacgggggcttgagttgagctttttcctaattc

SEQ ID NO: 6986 - DNA, 804 bp, Glycine max
  Predicted polypeptide sequence is orthologous to G1652, G2776
caacttctcaaatcatcctcaatccatcataaagtacaatacgatatttttttttaatacaaactgagaacttccttgatgcactagcacggatcactaattcactattgcatgtcatacacctccaacagatattctctaagttttttcactaggtcatccttggtcatgctgtattcgccattcatctgagcaataatgttgattataagagtagaagtcccaaatggcaatacggtgctactggttgtagatagatggaggtttctaagcaaggcatgtattttgaacactatgtccttttgcttctcacaatggattccaatgagtacttccttatctaggactcttgcttcaacctcaaatagtgatatttctttgttcgtttcacaattgccggtgtttttatctgaggaggcttcagatttccttatgaatgttgctgaatctactttgttttgattttccaactctttaactcgctcttgaagttgttttgtgtaattgacagcttcacgaagcacataagccttgtccatctataaagttagacaggaaatctagttataataaactattaatataattttaccccttatgccactcacacaatctaggatttgaattaaatactaaataaagaagtggaccatgaattttgtaaataaaaaaagtaccatgaaaaactttcttcaatgatttcttcctcgcaacaataatgtatttaagatttaaattttaattaatttttaaatataaaataaattatatttaaaagaaaaatatctatcctatatgtgttga

SEQ ID NO: 6987 - DNA, 933 bp, Glycine max
  Predicted polypeptide sequence is orthologous to G1652, G2776
agtcaaaatcaaaacaaaatagataaaagaatacaatgcatagtttccaaggctagcctttagcaacaagttaaatcccaatttccgataatggatcatactcctttattgttcgtccgtcacggtcactgaattgcctccctctaaccgattcagcgtgatgctgttgttcattctttttccttcccacatagcaattatttcttcgtctataatttgaagcttacacctaagattagattgactaggataggacatttaataccctgaatttgtggtgttattgtacttctgtcctgttcatctattacataaattgcatcagtcctactctaaggtttctggccagttcctttacgcccatgttgaattcatcctccatctcggctacgatggttgtgtcgagaacagaggaaccgaaagacaaggcgctgctattgacgacggagagatgaagtttctctatctctctgaatatgttcaccagcactgccttttccttctcgcagaggattcgaatcagcacgctcttctttgacaccctcgcctcaacttctggcagtgacaaagtcgctttcgtggagatatcatcggagtttccgaactcgcaggagtttgatgaagtgtctgagacatcctcgtccgcaggaaaaacctgagatttcttcgcaaacaccactgattcctcgtttttccttttgctctgctcctccagcaccttcacttgctccttcagctgcttcacataccttatagcctcccccaacacggacaccttgtccatctttttgaggtctggaataagggcagagagggcaatcaacttctggctaattttttctctcctcattctctcagcaatgatgtgatcttgtgtgtgatgagaagatccggcaaatgaccccattttcttgttctgctgagtaactactc

SEQ ID NO: 6988 - DNA, 935 bp, Glycine max
  misc_feature (801)..(801): n is a, c, g, or t
  Predicted polypeptide sequence is orthologous to G1652, G2776
ggttaatcaactcaattaaaatcttaattaagacatgtcagattgaaattattcctaatatctctacaaaattattcaattatttttccctctctagcaggcacacactgaaggcctcagaaaccaaaacataacacgaagaagacaagatcatttggggtcaagctgaatctacatattggggaacactgcaggttgtagcagaaatcacacattaataacaaggcttccattttgggtgtgatttactcggtggctggggcattaaatgtgattcagagtttcaatatccatgccatatgccatgagggtattctccatactcaagccacgttcatgttatgacaatatcttcaatgcagccacgcgtagattcttggcaagttccttagtggtcaaattgtaactttctcccatctgagcaacaatggtaatgtcaaggatagaattaccaaagggtaggacactgctattagcaacaaataagtgattactttgaatctcagccagtaacttgaccaaaagtcccctttgcttctggcagtggatcttgagcagcatctccttccctgatactcttgattccacttcaaacagtgagtcactgacactatcagcatcaatgctctcgtcacatgaagaagaatcattatcaccagagaggtctggcttgttcagaaccactatcgattctgcccttgttttcttgctctgctcttcaagaactgtcaaccgctctttaagctctttcacatattcgatagcgtcccctaacacagaagccttgtccatcttctttangccaggaacaagggctgcaagagcaatgaagctctggctgagtttctctcttcgctttctctcagccatgatgtgatcttgagcatgagcaggagacctcttagcatgagaggtttttgtttcaagttttgata

SEQ ID NO: 6989 - DNA, 967 bp, Glycine max
  Predicted polypeptide sequence is orthologous to G1652, G2776
agacgacgtgaggaatcagttaaactgggcagcattcaacccttactataagggaacaaaagctggagctccaccgcggtggcggccgctctagaactagtggatcccccgggctgcaggggaaaattggccttccgataattcttatctggatgaggtcaacgatgaatttggtagtgaagatgaagagggaggttcattttctggaatgggcgagaccgacagaaagaagagaaagcgagaactcgcagagaggttccttgcactttcagccaccatacctggcttcaccaagacggacaagacttcaatcctggccaatgctagtagctatgtgaaacaacttcagcaacgtgtgagggagctagagcaagaagttcaatccaacgttttttagcaatgaaagtgcccaccagctcttgccgaggtgaactcatcccaatgaattaattacttctgggtggtgggaccaaaatgaaaattcttcccgaggtccaaagtaaagagtggttacagaaggacgttcctcatcataaatccactgtgaagaaacagaagggcatccatgctcaaaatacttttcccagcttgaaaatgtttaatctctctgtagtcaacaagtagcgtcttgcgatttgggaaaatcactctcgacatcaccattattgcttagatgggtgagggttacaagatgacggtggatgaactagtgaagaccctgagagtagcggatatcttgagaactatagcttgcctgtcctaatgacctaccaagcagggcagattaattggaattgagaaagctagtataaaattttgtactcttttcaaaaaagaaaaaaaaataaataaaaacttgagggggcccgccccattctccttagagtcgttaaggcgcttactgccgggttccagttgacgggaacctgcgtaccagataatgcttggtctttgcgttgcagtgggg

SEQ ID NO: 6990 - DNA, 1730 bp, Glycine max
  Predicted polypeptide sequence is orthologous to G1652, G2776
ctgttaatcagatattagcttgatagcttcagctgtttttcattgcatgaggagttctcatatggagatttcatcaatcagagggctacctgaactggggataatagaggatcctaacttcctccatcagtggcagttaaactctattgatacaactagcttaaaaggtgctgcttttggagatattttgcaaaagcactcattctctgataactcaaacttcaaccccaaaacatccatggaaacatcacaaactggaattgaaagatatgcaaaacagctcggtgataacagctggaatcacaacaaaagtcaacaacagacaccagagacacaatttgcttcatgctcaaatcttctttcatttgttaatacgaattacacaagtgaattgggactagtgaagcctaaggtggagatggcgtgtcctaaaattgacaacaatgctcttgcagacatgttgatctctcaaggaaccttaggaaatcaaaactatattttcaaggctagccaagagaccaaaaagattaaaacacgtcctaaactttctcaacctcaagaccacataatagctgaaaggaagcgaagagagaagctcagccaacggttcattgctctatctgctcttgttccgggcctaaagaagatggacaaagcttcggttcttggagaagctataaagtatttgaagcaaatgcaagagaaagtgagtgctcttgaggaggaacagaacaggaagagaactgtggaatctgtggtaattgtgaagaaatctcagctatctagtgatgccgaagactcttcttcagagactggtggtacatttgtcgaggcactacctgaaattgaagcaagattttgggaaagaaatgtcctcataagaatacattgtgagaagaataaaggagtcatagagaaaacaatcagcgaaattgagaaactccatctaaaagtcatcaatagcagtgccttgacatttgggagtttcatcctggatataaccattattgctcagatggatatggaattttgcatgacagtgaaggatcttgtgagaagtttacgctcagctttttcatatttcgtgtgaagagttatgcatttttcggtcgtccccgaaaggtacatgaagaataggagtgcaatcaatttatatatagcagttccatatatcaactatattatcaagtttaagttcttcaataataattctgtttccaaggccggtctgcaatgtctgccatccacaccatgtttgctctgaggttcatttttgcagaagggttttttgtagcgatattttcttcttgcatggtcaacttgttgacagtgttatattgtcacactcacaccctactgtttcaagagtgaacgtagagcttgttaggcattttttggcaggaagttggaaagttcaactacctgttttccatctatttcttacctaaatcctgacagacaggcctttgttgagtgacttattatcttcttttttttttttcaagtgttctcgagttacttttttatttgaaacaaaatatgcttgtaaaagtttggttgaaattggtagtgatggaataatcgtacttttttatatcttgtgtatatgctcgacatgttgcatggcctcaacatgatattctgcaaaagcattaatgctaccaatttaagcatatgtaaattgtaggtggtggattaagcttaaaaaaaaaaaaaaaaaaaaaaaaaaa

SEQ ID NO: 6991 - DNA, 652 bp, Glycine max
  Predicted polypeptide sequence is orthologous to G1655
ttttttttttttttttttttttgataaaaggtactcctaacttttattatagattattgaatttttaaataaaatacaacctccacaccccaacattgaaagaagcccggtaatggtgttaaccttaccttcaccctttctctagaacccagatggtgtttttaaataggttgggtgcttaggagtttaggagtctccttttatactccatacaaattggacaaacaccttaggacagtgactttagcttcaagtagaagtatgtattgttcaatgctttggaaaaaattgtgcatgtccattacctcactcccaggaactgctccctgaagctccctaagcttcctttgcaaggaaggtttcactttcacagcattattattggccaaacaaactttcgcccttctcttccttcccctaactgttacatgtctcggccaacgccttgtgctcattttgcctagctaagggaaaaatttaagagagatgagagagagaactagtctcgagtttattttttttttttttaataacatttttctatatttcaattaaggaagaaaagaggagcaaattgcaactgtattgtttgacaagaccaaacagtccagcatatgatacacattacagatacacccgatctcctctctct

SEQ ID NO: 6992 - DNA, 833 bp, Glycine max
  Predicted polypeptide sequence is orthologous to G1655
ggaaaatataataaaattaatactccatatcatatatattagtacaattatatgtgtaaactaattatataccatatcatttatattattatgtaatataacaatatagaacatatcttactgtctattataacttttttaactgaaataataaaaaatgaagagaaaaaataaaataagtggcgaagatggaactgaaatctaaaaactaatataaacgatatatgaagaaacacctaatagtaagaattaacaacttcggtcaactcaaaccgatcggagctggcggcggagcaccggtggcgaggaggtcggcgagagccttcatggctcgcacttgcatctccaacgccgaaatatagtcaccggcttcttctagaagcttcgggaacgacaccttccggcaaccaggaattaactttccgagaacgcgcgctttcttctgcacagccggcaagcttctccgaatctcaggcgtcgtcttcttcatgaatttgttggcggagtacttcttgaccttcttgtggtgtctctgcttccagcggcagatcggatttgagagaatggcgcggctccagcgagttcggcctttggcagtggcggcgaggacgcggtcagcggaggcgcggacttcgagggcggcggtagggttgctgttgcggcggagcgagtggaggagcttggaggagtagaggcgctgttcggttagggaagtccaggagggagtgagagcgaaggagttttggtgtgtgatttggcggcgcttattgttaacggaatggaggtttgagtgcaaagacaaagagtccatgatgtgtgaatgcgacagcaac

SEQ ID NO: 6993 - DNA, 1038 bp, Glycine max
  misc_feature (1)..(3): n is a, c, g, or t
  misc_feature (13)..(13): n is a, c, g, or t
  misc_feature (447)..(447): n is a, c, g, or t
  misc_feature (596)..(596): n is a, c, g, or t
  misc_feature (682)..(682): n is a, c, g, or t
  misc_feature (791)..(791): n is a, c, g, or t
  misc_feature (798)..(798): n is a, c, g, or t
  misc_feature (842)..(842): n is a, c, g, or t
  misc_feature (851)..(851): n is a, c, g, or t
  misc_feature (904)..(905): n is a, c, g, or t
  misc_feature (928)..(928): n is a, c, g, or t
  misc_feature (978)..(978): n is a, c, g, or t
  Predicted polypeptide sequence is orthologous to G1655
nnnccgagcccangtagattttcgactggtatacgccaagcgcgcaattaaccctcactaaagggaacaaaagctggagctccaccgcggtggcggccgctctagaactagtggatcccccgggctgcaggaattcggcaccagatcaacttcttctttcgttcttcattgttcattcaatttcttctctcttcatctcaccgaacaaatcattcaattgcaatcatctatggcgtctttcgacccgagcgtagattctagtaattccgacacgttgcgagaatccaatcacaagaagcgcagaaaaatcggagaccacgccgccgccgatcaaaattcggctgccgcctccccgtggagatccgaagaggagcagcggatctactcccgccgcctcgtggaggctctccgccgcactgcgtcatcggcggccaagcctagagccgnccgccaggtccgcgagaacgccgaccgcgtcctcgccgccaccgccagaggccgaacacggtggagccgcgcgattctcagccgctggaggaagctccgcacgcagcacaagaaggcgaagaagaaggaggcatcgtccattaactgtntgaagagaacgaggattggcaacggagagagaggaaccggtacctgctggcagaagaagcgccgcactcagccgtggttccgttgnccgaggtctgtttcaaaccttctgagaagcacggactatttacgccttgagatcaaggcgagcatgacggtctcgcgactaactgccgcgcgggccggcagatcgcggncggaccnttaggccccggcctagctatatgcgccccagtgttctaattatnttatataanaatcgtttaatgttagatcagatttatcggcctgcatgaattgctatcctccnnttttgtccttatactcccccctntttttcttctttactcttataaaatggtgcagtcctattgtaaaaaaaanaaaaaaaaaaactctgggggcgcctctcctctctaggtaccgtctcttccgttaacctaa

SEQ ID NO: 6994 - DNA, 732 bp, Glycine max
  Predicted polypeptide sequence is orthologous to G1660
aacatgcttgggtgtaagcagcaaaaggcattgcatacctatgtaaaaacaaacattgacaaggattggctttctttaagagcaccaattgcagcaagaaaatgataaatatgaggaagggacatgaccagttcttcgtatatactctgcttgctcttcagtttttgcagcttgatgatttctattggcttctgctgctgctcgcttttcctcggctttatgccttgcagctgctaatttgttcattagcttatcatgcgccttacctcgtattctttcaacttctacctcaatttttttcatcttggcttctgtttttgctttctgatgattttcccatgcttgaattttcatctcctcacgcctaaacctggccatatacttggccttctcagcctcctcccatgccgctgcacgtgctacaacgacacttttaggtggttctgtttttgttttcaaggaagtggatgcatccttatcctcctcttctttactagcccaggcagcaatgctcattttacctagttgtgtcccgagaaccattatttctcgcctggttttcatttgtagctccttttcggacaactcattcatgttgagattcagattgtcactatgcagatcagttaaagtagatgcaggggaggctctggggggagtagaaggccgggaagaattagggctgcgcatcggtgttgttgccctcactggggtacctgttcttgatggctc

SEQ ID NO: 6995 - DNA, 479 bp, Glycine max
  misc_feature (398)..(400): n is a, c, g, or t
  Predicted polypeptide sequence is orthologous to G1662
attaacaagaatggtcacaagcaacccctgcggtgaacagtaatgtttctttgcttataatgtagagggtagcatttgtttgacaaaattttttatgtttcactcttctaaatcctataggcatatacaatccaaacaaatcatgtactagtactaatacttaaaaattctagagaatgctctgttgcttcaacagagttaaccctacgaagcaaaaactctactccatcaacccatttttgcttgtggagtttgttctggcacttaaattctagaagaccttgtgcagttttgaggccaaaataaagctcttctgatgcttccctttcttttctatatggccatgcattatctttatcacagactccatacaccacacatttgttctttttggagannnctcctccaacgtgcttgcttttgatcttaactttaacctgacatttcttgatataaacatggacatgtctccatcgtaa

SEQ ID NO: 6996 - DNA, 715 bp, Glycine max
  misc_feature (1)..(2): n is a, c, g, or t
  Predicted polypeptide sequence is orthologous to G1677
nnttggtgagcgtgattacgccaagcgcgcaattaaccctcactaaagggaacaaaagctggagctccaccgcggtggcggccgctctagaactagtggatcccccgggctgcaggaattcggcaccagctcagctcttatcttaagatggcaaccttgatcggttgccaatactactatctcttgttccttctttggtttatctctagcttaaccttcttattgtttttggactatcatgttatgtttctacgtgtgaaaatactactatttggtaacattcactcctttgacgttaatagaccagtgtcttcatcgctggctcgttgctgggaccagttcagcccagtaatccctcttggcctttatgcagacttgcaaacaacacaaatgcttgctcttgcttttcattcctagttgggggcatatgataccaaaggttgataatgtactggatgttgctcgtggaaactgataagcatttatgaagaaattatagtctatgatgcgtttggatttctgtaatctttttttttttttttttactttgtggtacattgtgttgcttagttgatatttcgggttgaatgagatacaaattgttagaaaaataatagtgtggtaatggccaaacttccctcgagtcaaaaaaaagaaacttcttagtactcctatcgtttaatataaaatacctgggggggggcccggtccccat

SEQ ID NO: 6997 - DNA, 839 bp, Glycine max
  Predicted polypeptide sequence is orthologous to G1706
ccttcaatgaaaatttgaaattagttaaaaatacaaaacacaaactagcttcatgtgtcaagtacctcctctggctttattcatccatggcaaagttgaagtgacagtagaactattaaggaaatgagcatctgatgaacctgtcaacttatctttcctagaccattgccagatcttggaaacagaaaagctttcacctttccttgcaatgttgattttcttgccctcaacagcatctccatcaatgaaagaacttccatttgtggctgttcttcccttcagttgtctcatgctgccactgctagtgcctaaagccactctcagatctgaatcagccaccacatactgaaaagaccccattgaatagcatctcctcacatccaaattaacactactagtactactctctccttcacctctctccaccaccatcccatcttgattattattagtgcttctaaattttccaagcctaacagaaaacacccttttcccattcactatgtgactttctgtagttttgttaacagaaccaattccaccacttcctgacatcccatcttcctcaagttgactttcaaagtcaaaaactgagttttcaaagggtgaatagagagtccctctacaaagagggcaagttgaattggaaagcaaccatgtgtctatgcattcaatgtgaaaagcatggttacacatgggaagcaatctgagcttgtcttgttccaagaactcacagaggcaaacagcacaatcaaaaggctctttcaagccaattatctctttgtaaaagaagacagggagagcatctatgaaagcctgatccaggcctgagtcatgaa

SEQ ID NO: 6998 - DNA, 707 bp, Glycine max
  misc_feature (1)..(1): n is a, c, g, or t
  Predicted polypeptide sequence is orthologous to G1706
nagagagtgatcagcgtagcactcgacacgccaagctctaatacgactcactatagggaaagctggtacgcctgcaggtaccggtccggaattcccgggtcgacccacgcgtccgttcatactttccgacacctaaaacttgagcatgctgagtaagtacctagctccaatttatactcatctcaaatgggtattagattttgttctctactaccctttttacatgctttatgattctcatccacccataaatcttggaactgaattgagtacatttcattatgaattttcctctggctcagaggaacatgtggattgtgctgtgtgtctaagcaaatttggagaaggagatgaggtgattagagttatgagatgtgagcatgtcttccacaaaggttgtttggatagatgggttggtttcgagaatgccacgtgtcctctttgcagaggatcactgactccaaaaaggcctatcactaactctggagctgaggttgtgctatttcagttttgttctgtccaaaagtgtaatgatgagacatggtggctacgctgagtacattaatgggggcttcaaggcttttgcatcctacaccagcacagtgtgtagattgttagtttgttcttttttaagatatggggtaagaaattcgagttctaatcatgtgtataaaagaaatgtgttgtgagataaaattcattacaat

SEQ ID NO: 6999 - DNA, 655 bp, Glycine max
  Predicted polypeptide sequence is orthologous to G1743
ttttttttttttttttttttgttttcgaatcaaaacataattaatttccaattatgttatacaggtcaaaatatgagatgaaccagatctcccaattctaaaaaaatccatcatctaagagaaatcgatatacaatgtgatagaaggtctctggtatatatacacatacacaaaaaaaaaaccacaaaatcaaaagaacctcttctggttatggctttggatatcccttccccaaaaaagtaaaataaggaaatatgaatgatactagaaaggagcaacatgcggatattcagcgataccagaggcagcccagagtctctcaataaaagcaccttgcatttcgtcgggtataaagggcattctgcagagagggcatgttctctgatcgtaccccatccaacggtccaaacatcgagagagagagagagagaactagtctcggtttttatttttttttttggatgaatttctcaatttctcataatagggaaaagggaattagtcatataggtacttcaccattacagaacaattaacttaaatatcaattaaagcaaaaaagttcaatcacaaataaaaccttggcatagtggtcttaaaccttccccaatttggtaggcttctacattgagtaccggatgacatcaatagcaac

SEQ ID NO: 7000 - DNA, 885 bp, Glycine max
  misc_feature (1)..(1): n is a, c, g, or t
  misc_feature (650)..(650): n is a, c, g, or t
  misc_feature (746)..(746): n is a, c, g, or t
  misc_feature (833)..(834): n is a, c, g, or t
  misc_feature (840)..(840): n is a, c, g, or t
  Predicted polypeptide sequence is orthologous to G1743
naggagatgggttcgactaagatgaccccgccagcgcgcaattaaccctcactaaagggaacaaaagctggagctccaccgcggtggcggccgctctagaatttgtggatcccccgggctgcaggaattcggcacgagagaatacaatcagcgactgtgggcagcttctggagtttcacagttttactaccaagacgattacacggcttctctctgatttttttttctttttccacttatatatttataattatatagcactatatctttttttcatattattattatggtgggggacttgacagctagtgtagcgaaatgtatatagctaattaaaacaaaaacattgtatcaataaaaaaaatcagaattttttggattggtatatacttttttccaacttttacttcaaaaaaaaaaaaaaaaaactcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgcnctgtagcggcgcattaagcgcggcgggtggttggttacgcgcagcgtgaccgctacacttgccagcgccctagcgcccgctcctttcgctttctcncttcctttctcgcacgttcgcggctttcccgtcagctctaatcgggggctccttaggttcgattagtgcttacgcactcgacccaannactgantaggtgaggtcagtgtggccatgcctgattgacgtttcgccctgc

SEQ ID NO: 7001 - DNA, 736 bp, Glycine max
  Predicted polypeptide sequence is orthologous to G1767
actgaaaagaaaaaaaaaaactccatcaatatatatccttccgcacgtgccaaaaaaaccgagaacacgtgcaaggcattcacccatgtcaaagccacatgatactattacgatacgatcgttatggcctccatgcactggcccacaccaccggcgtgtccttccacgagaggaatattccggcatcggagcacgccgccatcgaccacccttccctgtacctcctcaacagcgccctcacgtcgtcacaaacctcctcgctaaacggcgccgccttcagccctccgttgtgaagcctcgccacccaccgcgccgccgtctcgcggcgctccacggactccgccgtcgagcacgccaccaggtccaccaccgccctccctgccgctcgctccagcatcagcctctcgttgctcgtcttcacaaaactctcgtccaaagcatcgaagtaaaccctaaaccacctcaaacattcctcaaagcctttcacgaactcgtaaccgtcgatcccaacgtccaaatcagcctcctcctccaccaccgtcacaatccgcggctgcaacgcttgcaacgacgatatcaacgcgtcgcggttgtttcctacggcggaaaccgaatgcagcctgttcacacaattcacagccaaagcttcatcctctttgatatcaagttcgttgaaattgaactcggagagatctccgtaatgatgaatgacgttgaacttaaacggaacgcccat

SEQ ID NO: 7002 - DNA, 877 bp, Glycine max
  misc_feature (758)..(758): n is a, c, g, or t
  misc_feature (819)..(819): n is a, c, g, or t
  Predicted polypeptide sequence is orthologous to G1767
cagtcgaaaccaaaccgaaatgtcaaaacttcataaagccatataataaactatatatacagaaatcattgaaatttgaaatataaagccatataagaaactatatatacaatacttcataaagcaaaagtataaaaaacgaaatgtgaaaaaaagttaataatgaaaattaatttacttgatgatgattccttttttgaataatacaggaaaatccccttcctcctatcaccctcataccttccaattaatcccactgccttacgtagcaaactcaaaacaggaagtaaaaaaagccattaattaattaccttaaaagaaaaaagaaaaaaagaaccctcagcgttgggcacgtgtttccggaacagagagcacgtgggaatccgtccctcaacaccttactcacgtcaagtcattctcctctactctacgtcaaggccctccatgcactggcccacaccaccggctgctccttccacgtcaggaatattccggcgtcggagcactgtgtcattgcccacccttccctatacctcctcaacaacgccctcacatcatcgcatacctcttcgctaaacgccaccgtattgaaccccccacctccatgcatcctcctcgcccaccgcgccgccttctcccgcctctctacggaatccgccggagaacacgccaccaggtccaccaccgccctccccgccgccctctcaagcatcaaacgctcgttgctcgtccgcggaaaactctcgtccaaggcctcnaagtaaaccctaaaccacctcaaacactcttcaaaccctttcacgaactcaaacccttccnatccaagtccaaatcagcctcctcctccaacacgtcacgatcctcggtttcacctcct

SEQ ID NO: 7003 - DNA, 721 bp, Glycine max
  misc_feature (721)..(721): n is a, c, g, or t
  Predicted polypeptide sequence is orthologous to G1772
aggagaatctgcactgatagtaggatgcacgccagcgcgcaattaaccctcactaaagggaacaaaagctggagctccaccgcggtggcggccgctctagaactagtggatcccccgggctgcaggaattcggcaccagctcaatcttggcattcatagtattgctccatacaagtcaaagggcattgagagggcatcagaactttcagtttgctggaacaacaaagtcaataatactgtttgactttgtggatgctcatcagaaatcttactgagtgaaaaggattattgtatatatgctgcaagcgtaggtgtaacagaagaacttgatcgaccatctggatcagggagttcagaggatagtggatgctcttctcgtaagcgtcctagaaaagagggtcttggaggaggtggtttttttgatctaaacttgccagcacagtttgtagacagaaattgactttgaaggacaccttattatacggtacaggcgtacagggctaacaacatcaaatagcttgctgtctttgaaaggaagaataatttatttggatgggaaaccgcattgcgtaccgaaggtatatgttaacctgtagtcttgcgtagaaaagaaatggagcaaaggtgttatgtcgatagcatgatacctttgataggagacctacggcaaagtggaagcccgggacattatttgctaggatgtatgtcagaagagcggctn

SEQ ID NO: 7004 - DNA, 815 bp, Glycine max
  misc_feature (1)..(1): n is a, c, g, or t
  Predicted polypeptide sequence is orthologous to G1772
naagggtgatcgccgctgtaatacgactcactatagggaaagctggtacgcctgcaggtaccggtccggaattcccgggctgaaagagactatacaagggaagattgccatttcagaagaaaaagattctacactcagagattatagctgggtaaataatggactctccagacttttcagatctaggcgagtcctatcatattcatatgcatttgcattttatatgtttggagatgagctttttaaggatgaaatgacagatgctcaacgggaaataaaacagaacttatttgaggatcaacagcaacagcttgaggcaaatgttgaaaagctctctaaaattttggaggagccttttgaaaccttttcagatgataaggttgttgagataaggatgcagatactcaacctttcaacaattattgacaaactttgtcaaaaaatgtatgaatgcattgagaatgatctattgggttctctcaatcttggcattcatagtattgctccatacaagtcaaagggcatcgagagggcatcagaactttcagttggctggaacaacaaaggcaatagtactgtctgactctgtggatgctcatcagaaaatgttactgagtgaaaaggattattgtgtatatgctgcaagcgtaggtgtaacaggagaacttgatcgaccatctcgatcatggagttcagacgataatggatgtccttctattaacgtgctagagaataaggcgttgatagtggtgtaattgggttgacgcttgcccgagaccgtgtctggatttattactctacaccgctctttaacc

SEQ ID NO: 7005 - DNA, 706 bp, Glycine max
  misc_feature (521)..(523): n is a, c, g, or t
  misc_feature (593)..(593): n is a, c, g, or t
  misc_feature (595)..(597): n is a, c, g, or t
  misc_feature (617)..(618): n is a, c, g, or t
  misc_feature (638)..(644): n is a, c, g, or t
  Predicted polypeptide sequence is orthologous to G1793
gagaatattaaaaaacccaaaaacaaaaaaagaaaaaagcataacaaaattgtatggtaactaactcgtacgttgtgccatacattactagaactagcttcccttccctcagtcattccacattgtgaacaccccactattcgacgtctgcatggactccgccgccgccgccgaccatccaccgtaaccaccagtcggcatgtcatagtccaccttcaccagccctagctcctccgccgtccccaccgtgttccccgacgttgcattagaagccataccaaacccacttcccacaaacccaccaacattattattgttactattattattctccaacacagatgaagaagatgaagaccccatgttaatcattccctgaagcaatgcagggtggttctgaagattataaccattatagaactgagcattatttatattattattctgaaagctataagaagaagaaccaccactctgctgctggtgcaactgaagctgcgtttggatgtaaccctgatgcnnngggtcttgctggtgagagaagtgagaactgatatcatggttttgcaaagttagcagaggttgaggttgtncnnnctggtggtggtgctgcattnnagggtaagcatgtagcctannnnnnnagcttgtggttccatattggaatgtggatgatcctagtgcaatcatctcttcgcgctttctc

SEQ ID NO: 7006 - DNA, 757 bp, Glycine max
  Predicted polypeptide sequence is orthologous to G1794
tgatcataataacatggtcacaaaaaaccactcckggatggaaatggtcgtggtgcaaatgcaaaaaacagaggagagtaacaatgatacaatacaaggggcaaaaacgagagagacttgaaataaaacgcaatttacatcaccccgaagcagaagaagagctattataactataaccagaagaccatgccgctggatgcgtaggataaatcgaaggkggkgcctgcggagatgtcatagtcatagttgaggaagaagcaggcggcaaaaattgaagatgatgagaagccatagtagtagatgttgactctgcaatctgatcgtagagactcacgggaaactcatgaagatgcgaataagaatggtcataaaaattgcttgaaccaagtgaaccctgaagagcctcagtgtgaacagtggttgaaggaattgacaaaatagccccatgattaggtggtggtggagggttcaagttcaacggaggttcttgttgttgtctgagtctaacgttttcagggaagttgagtttggctttgttgcctctgaaacgcaatgaagcttgatcgtaggctctggctgcgtcctcagcggtttcaaatgttcctaaccacaccctagtagctttgaaagggtctcttatttccgcagcccattttccccatggcctctgtctcactcctctgtattttctcctcggktcttcctccactactttcacgttctctgttctgtattcgtaatcgtatactgtatcgcg

SEQ ID NO: 7007 - DNA, 912 bp, Glycine max
  misc_feature (19)..(19): n is a, c, g, or t
  misc_feature (51)..(51): n is a, c, g, or t
  misc_feature (53)..(54): n is a, c, g, or t
  misc_feature (912)..(912): n is a, c, g, or t
  Predicted polypeptide sequence is orthologous to G1835
cccagagcaaacatacgancatctaaagtggtgtggggtattcgcgggacnannctgacctccacctctgtggcggttcgatctagaacatagtatcccccgggctgcaggaattcggcgcgagccattacaccacagtggagggcagggccaatgggaccaaaaacactatgcaatgcttgtggtgttcgttacaagtccggccggctcttccccgagtaccggcctgctgcaagtccaactttttgcccatctgtgcactccaattctcataagaaggtcctggaaatgagatgcaggggcattgacaaatccggttttgcaatcaattcagctgactcacccgaactcattccaaacactaacagcagcctgcccctggagtacatgtgatgtgaaggagtgatcctttgttggaaatttctctttcattgctgccctctagagtcatgtcttatgttatttcttattgatatttcatttctttggttcattgatttttgtacagggtttgactgggggaataggagcaatagatgatgatgatcatatgttagcagttaggggaagattgtaatgagaagtgagttacaaaagggtagacatatgcaggtcacaaagggtagtgtcttatgtctagtaattgtaggtcccttaacgtcagtaggagtcggtgtctctgttgactctattcttcttggcaatctgtcattatttgcttttatatatatccctatttgcgcgacataaacacatacacatcagaatatgtggcggcgctggttccttcttatcgagctcactactagcataccttggacactaatctcgatcatctctaaatcatctcctcatgctgtctctcatatacctctactgctatttccgcgttgcgatgtctccaatccatan

SEQ ID NO: 7008 - DNA, 847 bp, Glycine max
  misc_feature (1)..(3): n is a, c, g, or t
  misc_feature (369)..(369): n is a, c, g, or t
  misc_feature (375)..(375): n is a, c, g, or t
  misc_feature (414)..(414): n is a, c, g, or t
  misc_feature (417)..(417): n is a, c, g, or t
  misc_feature (431)..(431): n is a, c, g, or t
  misc_feature (437)..(438): n is a, c, g, or t
  misc_feature (445)..(445): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (470)..(470): n is a, c, g, or t
  misc_feature (486)..(486): n is a, c, g, or t
  misc_feature (490)..(491): n is a, c, g, or t
  misc_feature (494)..(495): n is a, c, g, or t
  misc_feature (499)..(499): n is a, c, g, or t
  misc_feature (505)..(505): n is a, c, g, or t
  misc_feature (509)..(509): n is a, c, g, or t
  misc_feature (511)..(511): n is a, c, g, or t
  misc_feature (514)..(514): n is a, c, g, or t
  misc_feature (519)..(519): n is a, c, g, or t
  misc_feature (525)..(525): n is a, c, g, or t
  misc_feature (528)..(528): n is a, c, g, or t
  misc_feature (536)..(536): n is a, c, g, or t
  misc_feature (539)..(539): n is a, c, g, or t
  misc_feature (546)..(546): n is a, c, g, or t
  misc_feature (554)..(554): n is a, c, g, or t
  misc_feature (563)..(563): n is a, c, g, or t
  misc_feature (569)..(569): n is a, c, g, or t
  misc_feature (574)..(574): n is a, c, g, or t
  misc_feature (577)..(577): n is a, c, g, or t
  misc_feature (582)..(583): n is a, c, g, or t
  misc_feature (589)..(590): n is a, c, g, or t
  misc_feature (592)..(593): n is a, c, g, or t
  misc_feature (595)..(596): n is a, c, g, or t
  misc_feature (618)..(618): n is a, c, g, or t
  misc_feature (622)..(622): n is a, c, g, or t
  misc_feature (624)..(626): n is a, c, g, or t
  misc_feature (629)..(629): n is a, c, g, or t
  misc_feature (632)..(633): n is a, c, g, or t
  misc_feature (641)..(641): n is a, c, g, or t
  misc_feature (645)..(645): n is a, c, g, or t
  misc_feature (649)..(649): n is a, c, g, or t
  misc_feature (677)..(677): n is a, c, g, or t
  misc_feature (681)..(681): n is a, c, g, or t
  misc_feature (683)..(684): n is a, c, g, or t
  misc_feature (687)..(687): n is a, c, g, or t
  misc_feature (697)..(697): n is a, c, g, or t
  misc_feature (700)..(700): n is a, c, g, or t
  misc_feature (703)..(703): n is a, c, g, or t
  misc_feature (726)..(726): n is a, c, g, or t
  misc_feature (730)..(730): n is a, c, g, or t
  misc_feature (734)..(734): n is a, c, g, or t
  misc_feature (738)..(738): n is a, c, g, or t
  misc_feature (751)..(751): n is a, c, g, or t
  misc_feature (760)..(760): n is a, c, g, or t
  misc_feature (765)..(765): n is a, c, g, or t
  misc_feature (771)..(772): n is a, c, g, or t
  misc_feature (787)..(787): n is a, c, g, or t
  misc_feature (792)..(792): n is a, c, g, or t
  misc_feature (797)..(797): n is a, c, g, or t
  misc_feature (802)..(802): n is a, c, g, or t
  misc_feature (807)..(807): n is a, c, g, or t
  misc_feature (811)..(811): n is a, c, g, or t
  misc_feature (815)..(815): n is a, c, g, or t
  misc_feature (820)..(820): n is a, c, g, or t
  misc_feature (824)..(824): n is a, c, g, or t
  Predicted polypeptide sequence is orthologous to G1835
nnnccggtggatagactgccattatatgattacgaatttaatacgactcactatagggaatttggccctcgaggccaagaattcaagcggatattcccctgccgactaacaaaattgagatgaagagatcctcatcacaggagtcagttgcacccagaaaatgcttgcattgtgaggtgacaaagacgccgcaatggagagaaggaccaatgggtcctaagaccctatgcaatgcctgtggggttcgataccggtctggccggctctttgctgaataccggcctgcatctagccccacttttgtagcatcactgcactcaaactctcacaagaaggtcttagaaattaggaaccaaaaggaagcccacncccagngggtgggaaccttgggttagataaaccttcgttgaaatnttnccttccttttaagnaaattnntaaaggntnaattcntgggtcttntttaaagnaaatctctttcaattntggnnagnntggncccttntggntngcnccttnaaaaanaancccaaggnggnaaaattnttggggtnccccccttntttggnaattnttnaattnnttgggnntnntnncccttttccccccccttttttntttntnnnttnttnnaaaaaaanaaanaaanaaagaatgatggagcatggaagaggaanaaanannaanaaaaaaaaanaanaanaaaaaacaagggaaaaaaaaaanaaanaaanaaanaaagaaaggaagnaaacaaaancaaanaaaaannaaaaaaaaacaaaanaaaanaaaanaaaanaaatnaaanaaanaaaanaaanaaaaggaaagggaatgagaggga

SEQ ID NO: 7009 - DNA, 969 bp, Glycine max
  misc_feature (1)..(1): n is a, c, g, or t
  misc_feature (651)..(651): n is a, c, g, or t
  misc_feature (658)..(658): n is a, c, g, or t
  misc_feature (713)..(713): n is a, c, g, or t
  misc_feature (791)..(791): n is a, c, g, or t
  misc_feature (842)..(843): n is a, c, g, or t
  misc_feature (847)..(847): n is a, c, g, or t
  misc_feature (851)..(851): n is a, c, g, or t
  Predicted polypeptide sequence is orthologous to G1837
naagtgaactacctgttgtagacatctcaagcgcgcaattaaccctcactaaagggaacaaaagctggagctccaccgcggtggcggccgctctagaactagtggatcccccgggctgcaggaattcggcacgaggttgagctcttaaacgagcctttgtttcctaacgtgactctagagagcttgaccaagtactacaatgatgcttacaatgcagtgcgcaggcactcttccacagcttatgtggtgttatcaaataggttggatctctcaagtcaactagaaatcccaaacaccaaggaactcttccctcttgccacaggccttaggcgatgtgtgattgatgtccactactacaatctctattatgatatatttgaagacatgaatgcgcaagagaacattgatttcatctacaaagtccgttcatcacagttggataatattacaaccgtagatggtcctctcactttcgtgggtgaatggactgctgagtggaaggttgaaggggctaccaaaaaggattatcaaagatttgtcaaggctgaattagatgtttttgggcgagcaacatttgggtggtgttattggacactcaagaacgtcaataatcattggagtttggaatggatgatcaagaatggctacatntaagttntaaaaaaattcctctttgcgtgtgcaccctctattcctatcatattatgcccttntaatatttctcaatatcaattatgatattgatatcataattaatgtctacgtatagatcttttaacgtcgtcacttcncggaaagcagaaatatcaaagtgtagaccctttcattagtgaaacggtcannatantganagctcctctctgttttacatacataaaaaaaaaaacaaaaaaaaaaaaaaaaaaaaaaacttgagggggcccgtccccatcgcctatagtagcgatacgccgtcactggctgctttaa

SEQ ID NO: 7010 - DNA, 524 bp, Glycine max
  Predicted polypeptide sequence is orthologous to G1838
agaagaaaaaagtaagcatttattatgctgcagcaagttatcaagcaattagaaagcttgtgcatgcttgaaaaagagcaactcaatactcctcatctttgagaagttacttacataatccattccctacagttacgagcaaaagacctatctttctttcttctcagcaaaagggttaaagagggtcagacccagaagcagcaggtgaagctaaattgcaccaaaaactaactttctatttgttagcaaaacagaaaattagctagttgatcgtttcagtaggactggtgaggccatatgaagaacccaggaactgctggtggtggaagggtattgagtgcaatcgcatcggtcactgctgcagcagcagcagaatctgatgagctagttccaccgttggtaggattgaaatggtggtggaagaagttgtgggggtaacatgtgattgcagaatcatagggtatagaagaaactggctgaatggctgagaaattgatgctgctacttgcgtttgtgcctcgtgc

SEQ ID NO: 7011 - DNA, 828 bp, Glycine max
  misc_feature (750)..(753): n is a, c, g, or t
  Predicted polypeptide sequence is orthologous to G1838
caatactcctcaacttagagaagttacttacataatccattccctacagttactatgactcggactttccgagcaaaaaacctatctttcttctcagcaaaagggttaaagaggggtcagacccagaagcaggtcaagctaaattgcaccataaactagctttctatttgttagcagaacagaaaattagctagttgatcatttccacaattcaatagttctgatgaggccatacgaagaacccaggaactgccagtggtggaagggtagcgagtgcgattgcatcggtcatagttgcagcaaattctgcagtgctactttcaccgttggtgggattaaaatggtggaagaggttgtgggggtaacatgtgattgcagaatcatagggtatagaagacactggctgaatggttgagaaattgatgctgctactggcgtttgtgttctgaggtggttgaatggtgctgacaagagctttgttctccgtttctggggaaactttaaagcgttttgctatgccgccaactggaagagagttgttcaatatagcgtcgacgtcatatcgcctcatctcgaaattggttacggcacttgcacctctgaactttatggctgcaatatcatatgcctctgctgcctcctcttcagttgaaaatgttcccaaatatagatccttgtttcccgcaacccggccaattctcgcttgccatctacccttgtaacacccctgtaagcagaagctcccctcgnnnnaccactgcttttccttcgcagtgatgcaataaattcttgctttcctacatgcttcatctcctccaattcctttgt

SEQ ID NO: 7012 - DNA, 641 bp, Glycine max
  misc_feature (8)..(10): n is a, c, g, or t
  misc_feature (12)..(12): n is a, c, g, or t
  misc_feature (24)..(25): n is a, c, g, or t
  misc_feature (75)..(75): n is a, c, g, or t
  Predicted polypeptide sequence is orthologous to G1838
ggggggannngnttgctatttggnnggttaacgggttgaacattcattctccagcgcgcattaacctcataaggngacaaagctggagctccaccgcggtggcggccgctctagaactagtggatcccccgggctgcaggaattcggcacgaggagctggaaacaaagatttatacttgggaacattcgcaaccgaggaggaagcagcagaggcatatgatattgcagccataaagttcagaggtgcaaacgcggtaaccaactttgagatgaatagatatgatgtggaagctataatgaagagttctcttccagtgggtggggcagcaaaacgcttgaggctttcccttgaatcagagcagaaagctcctcctgtgaacagcagcagtcagcagcagaatccacagtgtggtaacgtgagtggtagcatcaatttctcagccattcatcagccaattgcttcaatcccttgtggaattccgtttgattcaacaacagcatattatcctcacaaccttttccaacattttcaccctaccaacgctggtgcagcagcgtctgctgttacttctgccaatgcaaccgcactaactgcactgccagcatcagcagcaactgagttctttatttggcctcatcag

SEQ ID NO: 7013 - DNA, 734 bp, Glycine max
  misc_feature (12)..(12): n is a, c, g, or t
  misc_feature (563)..(579): n is a, c, g, or t
  misc_feature (581)..(589): n is a, c, g, or t
  misc_feature (591)..(591): n is a, c, g, or t
  misc_feature (732)..(732): n is a, c, g, or t
  misc_feature (734)..(734): n is a, c, g, or t
  Predicted polypeptide sequence is orthologous to G1852
ggacgtgatcgngcaagctctaatacgactcactatagggaaagctggtacgcctgcaggtaccggtccggaattcccgggtcgacccacgcgtccgcctgaatcacacggcagagaaaagattctagttgcaaccaagactctctggaagctctaattcccattccacggacgccactgtgtaatttaggtgaattcccttttcctttctgtgagggtggtgtcaaagatatcttctctatggcatcaaagggatgccatgccattttctaatctgattcaatattctcatataaaggttaagatttgaaaaagatgggaagacccttgtgcagttttaggcggaaagcggaagccagtgttgattatactttctctcaacttcaaagatggttgtaattcaaaaaaaaattatattaaaaaagaataatcattgattctagttcagctacatttcaccctttttcttttcttttacatttgtattttattgtgaatttttatcatggattgaatctaaagtgttagagatgtaatattaaatcgattgcgaaaaaaaaaannnnnnnnnnnnnnnnnannnnnnnnnanaaaaaaaaaaaaaaaaaaaggggcggccggtctagaggatccaagcttacgtacgcgtgcatgcgacgtcatagctctttttatagggtcacctaaattcattcactggccgtcgttttacaacgtggtgacttgggaaancn

SEQ ID NO: 7014 - DNA, 778 bp, Glycine max
  misc_feature (778)..(778): n is a, c, g, or t
  Predicted polypeptide sequence is orthologous to G1852
aatccccccccccccccccccctggtgttgaagaactcgatgaacgattccgaatttaatacgactcactatagggaatttggccctcgaggccaagaattcggcaccaggtgtggttgatcaatgtagttcctgcactaaagccacccactcttgatgttatctttgacagaggccttattggagtctatcatgactggtgcgaaccattttcaacatatcctcgtagctatgatctaatccatgtggccagcattgaatcccttataaaagatccagcatctggtcaaaacagatgtactcttgttgatttgatggtggaaattgatcgaatgttgcgtcctgagggaactgtggtggtaagggatgcccctgaagtaattgacagagtagctcgcattgccagtgcagtgaggtggaagcctaccgtttatgataaagaacccgaatcacacggcagagaaaagattctagttgcgaccaagacactctggaagctctaattcctattccatggatgcacgcaactgtgtaatttaggtaaactcccttttccattctgtggggttggaggtgtcaaagatatcttctctatgcatcaaacgggtgcgattttctaattttgttcaacattctctcatataaagaagatagtgaggttaagattcgaaaaagattggaagacccttgtgcagttttaggtggaaagcggaagccagtgttgattgtattttctctcaacttagaagaatgggttgtaattcaaagatatatattn

SEQ ID NO: 7015 - DNA, 866 bp, Glycine max
  misc_feature (807)..(807): n is a, c, g, or t
  Predicted polypeptide sequence is orthologous to G1863, G2334
gattgttaattgacaatttagtattacttcgaattaatccaaccagggaccgaccatatcctttcatcgcccacttagaaacaaaagtagtctacacagtttgaaaagaacataaccgtggtccaagaatgctccaaaagtggaacttaaacctcgaaacaagaaacagaaaaataatcggggcacccactataactaaattcaggtgctaataaagctggtctcagatccacgaggcaagtgacgatgcaaaacactagtgggagatgaggttgaagtagatgatctgagtgcctcagcaagtggacctcccatcgaagccacttgattagacgaggcccatcctccggcccaattcaactgcagctgctctggctcgaggcttacattctcatttcctgggcccgagtcctctccatagcccgtggacaatttcaatgacacatccgaggaagcaccgggcattgaaatagagaggctacggccagcagcagcattgttttcaacgttgtcagagtcttggagtgatcgtggccaatcatcgaagaaatgcctcagcatatggccaccacctccacctgatctgccatccccacccacatgatcttcgtcttcattcttggtcccagaggaacgttcatcaagatgaagatcaaaaggagatttgaatgaagcagaagctaagggtggtgaacaaatggaagatgatgaagcacctggtcctagggatccaactccagttacaccacaattgttaatagcactagttggtgtgggtagttccacaggctttcttgaacggtttcntccacggtgcatgtggcgctcacagtacttttgcccagccaccacgtccctcgaacagc

SEQ ID NO: 7016 - DNA, 769 bp, Glycine max
  misc_feature (447)..(447): n is a, c, g, or t
  misc_feature (757)..(758): n is a, c, g, or t
  misc_feature (765)..(766): n is a, c, g, or t
  misc_feature (768)..(769): n is a, c, g, or t
  Predicted polypeptide sequence is orthologous to G1868
atgactctgactctgattacgccaagcgcgcaattaaccctcactaaagggaacaaaagctggagctccaccgcggtggcggccgctctagaactagtggatcccccgggctgcaggaattcggcacgaggtcagacttcatgtcattcactacttcctcaccctccaacgagaaactcacgttgtcgccacttaggctttcgagggcgttagaccccattcaaatggggttgggagtgggaagcggtgcctccaatgaagcaaatcctaggcaagccaattggattccaatcacttgggagagttcaatgggtggccctcttggagaggttttgaaccttagcaataacagcaatgcaagtgatcaatgtggcaagaacaacacttcagctctcaacctcatgaaagatgatgatgatgatgggtgggacaatagtcctccactanggtcatcaccaactggggtgttgcaaaaaacagcatttggatcactctccaacagcagtgctgggagcagtccaaggggggcaccagagaacaacaagatagagattctgattcttgtttcaatctgaactggttgttgttgtcttcgtcctaaagattgttgggatggattgcgtttgggaatgggaccacaccagtggactggtagtctgctcttcactttagggtggacttggttcacgggttgtatagtgctgtttattttagatggttgactgaagagtactgcagttgctgtaggcaacgaganngtagtannann

SEQ ID NO: 7017 - DNA, 779 bp, Glycine max
  misc_feature (762)..(764): n is a, c, g, or t
  Predicted polypeptide sequence is orthologous to G1868
aaacaaatacaagtcaagcaaaccacacaaaaaaccttacctacacatccaaattatgagggcaagggtaattagcatgaacatgaacacgaacacatctttccaaattctaacattaccatatatatataaacttcactaataattgaagtcaaaagaacaaagtccttttcatcttcttcctcctccaacatggcttcatcatatttcaaagggcaaggggcttcttcttcttgtatgaagtactttacaaggcattgcacaaggtggcaccttctttgttgttctctgccccccttggactgctcccagcactgctattggaaagtgatccaaatgcagatttttgaagcaccccagttggggatgaccctgatggaggattattgtcccatccatctttcatgaggttgagagctgaagtgttgttgttgttcttgccacattgatcactagcattgctgttgttattgttactaaggttcaaaacctctccaagaggaccacccattgaactctcccaagtgattggaatccaattggcttgcctagtgtttgcttcattgggggcacttcccactcccaaccccatttgaatggggtctaactcccttgaaagcctaagtggtgacaacgtgagtttctcgttcgagggcaaggaagtagtgaatgacatgaagtgatctgaggaagatattggtatgggagattgataactgagtcctgtctgactgcatgttgtcaagttcaggccatatagannncgaacgatgatgatg

SEQ ID NO: 7018 - DNA, 750 bp, Glycine max
  Predicted polypeptide sequence is orthologous to G1893
cacaaattaactgagatttaattaagaataagataataattcacatgcagacattatatatataattaaaataaaaccagttcagttccattttcgatccttcagtcattatcttgttctacttcagatgcaggctcttcttcttcttcaaatccatcaatcccgtaagctgcatggccacttccaaaggctttgatgtgatccttaagggacctcttgtgcttgaaatcagatccacagatgcaataccaaagcttgccacagttcttctcatgtgttctccaatcacccctcacagcaaaggccttgccacattttctgcacatgaagggcttaatcccatgcttcctcttgtagtgtgtttggagggttctgaagtctttgaggggctttgctcttgggtgatcaatgttgttcctgcaacctggggaacagcaatagcatggaagccttagcatacctgttggttgggtacccctcagagattcaggcccttttctgtactgtgatccatgcccccacatatgcatctgcatgttgttgtatctgttgaaggttttgcaacaaacgggacaagagaactgagtaggaccaatgagaatctgagaaggggtagggatccagtactgtcccttgttgagcctgttagacaagaaccctgaagaagaaaaatcctcactcccattattactgttgttattaccaactccatgtcctccttgttgttctttgtctgtagaacaagctgct

SEQ ID NO: 7019 - DNA, 730 bp, Glycine max
  Predicted polypeptide sequence is orthologous to G1902
aaaatacacatatatagattaaataaattagaatctccaagccatggcaacacttcctctacgtgatgagactgaaaacaatctcactacaacaacattcatatccccccataccctgccctaaaatatgacttgctttccatttctcttccatcattgatataactgaagaacaccaaccacaattcacaaatataaaaatccaaaacaggagaaactttacctaatgatcctatagcagtggccttctggtttgtgatcctccataatagtacgacatatgtctaaatatacagatcagagtaatcatattcattaatttgtcattactgaaagcttgacccaggagtgaaaatagcaaggtgagaccaaccactagtaccattccaacagcttgaatcaccattttgcaaactcagaaaattctctgcgttcccattgctttgcatctccaacccgggattccgacccgaacccggatccgcaaccggacccgaactaacattctccccaaactcttccatttgcacagttttcagattagacccacttgaattcagaccctccaagaggttccccaggcccaaatggccacttgatgccaaaagggaactgaaacttccgccaccaacaaccggggtggggccaatccgggtagggtcgggttctggagcgggtgccgaggaaactgggggtgatggggaagcgcgtttggtgttgcgacagcaac

SEQ ID NO: 7020 - DNA, 874 bp, Glycine max
  misc_feature (651)..(651): n is a, c, g, or t
  misc_feature (682)..(683): n is a, c, g, or t
  misc_feature (716)..(716): n is a, c, g, or t
  misc_feature (725)..(725): n is a, c, g, or t
  misc_feature (739)..(739): n is a, c, g, or t
  misc_feature (749)..(749): n is a, c, g, or t
  misc_feature (751)..(751): n is a, c, g, or t
  misc_feature (765)..(765): n is a, c, g, or t
  misc_feature (776)..(776): n is a, c, g, or t
  misc_feature (802)..(802): n is a, c, g, or t
  misc_feature (871)..(871): n is a, c, g, or t
  Predicted polypeptide sequence is orthologous to G1927, G2184
ggggaaagtagatctccgtgtcggagccacctaaaattaaccctcactaaagggaataagcttttttttttacaaagatttttttttattttgagaatatgttaggacagcactgtttggtaattctggggagatcccagacaacagtcattctgggaggtcccagacaaaatacctagcagcaaaactttggatttacataaatatattcaaggagaaatacttctacctactagtcttaagtttccaacaaaaacccaacaaaaagcacataaagcaataagaatagagaagaaaaggaatggaagtccctttctgccagctctcttcatagttccttggcctcgagggccaaattccctatagtgagtcgtattaaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggttgcgtattgggcgctcttccgcttcctcgctcactgactcgctgcgctcggtcgntcggctgcggcgagcgtatcagctcactcannagcggtaatacggtatccacagaatcagggatnacgcagganaggactgtgagcanaggccagcananggccaggaccgtanaaggggcggtngtctggcgtttccataggctcgcccnctgagagcatacaaaatcgacgctcagggcagagtgcgaacccgcagactataagataaacagcgttcnctg

SEQ ID NO: 7021 - DNA, 696 bp, Glycine max
  misc_feature (1)..(1): n is a, c, g, or t
  misc_feature (586)..(592): n is a, c, g, or t
  Predicted polypeptide sequence is orthologous to G1928
naggaacctgtagcatgctcacgccaagcgcgcaattaaccctcactaaagggaacaaaagctggagctccaccgcggtggcggccgctctagaactagtggatcccccgggctgcaggcgagttttttttttttttttttgtataattgcccctaggctgttggtcatccatataattttttttctccatacttgcttttctaggctggggatcgattgtgattgttgacccaggatgggaaagattacatcctagcattatgcatttttttacatgtcagttggtttcgtaggtcaaaaatcatcatgcattcatgaaaatcatcaaccgttaaattcctttgttttgaaatgcatatgtaaatcatatattggctattcctggggatacagaagaaacttgccatatactgtgatgataccaaaagaactttagtgtggtggattgttgtttcaattgttggaaggagtcgtctgagtttagcttattattggtgttatctttctcttgtctaagtaaaagtttgtgaattttgtcatgtttcctgtatattttatttggtgacctgaaaaaaaaaaaaaaannnnnnnaaaaaaaaaaataataaaactcgagggggggccccgtacccatttcgccctatagtgagtctgtatacccccgctcactggccggcgttttacaacgtcgtgaa

SEQ ID NO: 7022 - DNA, 769 bp, Glycine max
  misc_feature (501)..(501): n is a, c, g, or t
  misc_feature (629)..(629): n is a, c, g, or t
  Predicted polypeptide sequence is orthologous to G1928
tggagtaagatagacacgaatttaatacgactcactatagggaatttggccctcgaggccaagaattcggcacgagctcactccaagacctgtggcactagagattacagatgtgactgtggaaccctcttctcaaggagggacagtttcataacacacagagccttctgtgatgcattagcagaggagagttcaagatcagtgacaggcataggcatagtagccaactcaacttcaactcaaccaactgcagcagcagcctctcatcaacaagacatcatccatggtaatagtaacaatttctcattgaagaaagagcaacaagcaggtttcagaccaccttggattggacaaccatcaccctcttctgcttcatcattcttggtctctcatcaagaaaaccctaaccctagaggtggtggtcctggtcccactcttcttcctccttaccaaacagctcctcacatgtcagccacagcgttgctgcagaaagcatcccanatgggtgcgacgatgagcaaaaccgggtccatgattgggacccaccaacaacaggctcacgtgtctgccaatgccgctttgaatttgtcctcacgtgaccaccagatgaccctcactctccatggctnggtacctttcgggaataaatctgttcctgctgttggtaattgtgtttcttcctcactccttcaccatatcatcgactctttctcttcacctttgaagggactcttttgagacactttgggtggtgctgtggcgaatgcat

SEQ ID NO: 7023 - DNA, 396 bp, Glycine max
  Predicted polypeptide sequence is orthologous to G1928
cctcgtgccggtgaattggagaggttgggatccggggctgagggttggggtatgtggggttgcggttgggtccagggttgtgttgagtggatccgattacgaaggtgcaccgcatgggttctatttggtggacaaccgtaaattgacaaagataaatgtgcctgagggtttctctgggtttgtccaatcggggtgctgtgttgaaatataagacacttgtaaagatgctacactacccttccagaaaacccaaatctgtgactaattttgttttcttttgctaaaatggagatttgtgcttttgaatttcccatacaaatgtaaatagtatatttgttttgctaatcgaaggaaggagtgttgaaaattacaacattaaaaaaaaaaaaaaaaaaa

SEQ ID NO: 7024 - DNA, 943 bp, Glycine max
  misc_feature (18)..(24): n is a, c, g, or t
  misc_feature (26)..(26): n is a, c, g, or t
  misc_feature (29)..(32): n is a, c, g, or t
  misc_feature (35)..(37): n is a, c, g, or t
  misc_feature (39)..(39): n is a, c, g, or t
  misc_feature (91)..(91): n is a, c, g, or t
  misc_feature (110)..(111): n is a, c, g, or t
  misc_feature (113)..(116): n is a, c, g, or t
  Predicted polypeptide sequence is orthologous to G1932
cccgccagcctgtgggtnnnnnnntnttnnnnttnnntntttaatcgtgatctgcctatgtccgttagtgcttctcttcttcctccatctnttctttctctcctttctcnntnnnnaatgtgctacttgcgacttagatagacgacgccaagcgctgctttaaccctcactaaagggaacaaaagctggagctccaccgcggtggcggccgctctagatctttggatcccccgggctgcaggaattcggcacgaggggtttggttaccacaggagggggtgattattatatatataggaaccttttgtgctagctgacttgaaactgtgacatatatagctgttgtatatgcagccagagaataagggagtgtcttgtatttccaaaaagcttgtttaattgccagtgtttttgaagcagaaagagaccaaacaattgaaaacttttagtctgtttagttaattcgtgtcggctcattggatcttggaaagttctatgtaactaatttggaattctgggtttggggggtgcttaagcttcattattttggttgaatgattgagacttcttgtatcattaggttttaaaaaaaaaaaaaaactaataaaaaaatactactatacactcaaatttatcctataaaaaaaaaaaaaaacctggagggggggcccggaccccatttccccctatagggagtcgaataacgcgcgctaactgcccggcgttttcaacgcggggactggaaaaaccttggcgtcaccaaacttaatggcttggcagaaaatccccctttcgccagctggcgtaataccgaataaggcccgtaccgatcggcctttccacacagttggggcagccctgaatgggagaatgggaaagcgcctttgtacgggcgcattaagcacgcgcagtgtggagagtattaacacccaacattaacctt

SEQ ID NO: 7025 - DNA, 545 bp, Glycine max
  Predicted polypeptide sequence is orthologous to G1932
cgaccatggggacgctacgctgcagaaataagagatccgtggaagaagacacgtgtctggctgggcacattcgatactcccgaggaagccgcccttcgcctacgacggcgccgcccgctccctccgcggcgccaaggccaagaccaacttccctccggcgccgcctctctgcctcgacctcaacgtcccttcctccgatcaccgctggccccacgtcccccctcgcagcctcgtcctcagcgagttcctccacaccgccgttctcagagacatcgacttgaacgaacccccacccttgtggctatgaataatgaatgaaccctgactaggtttctttcgacgtcgttttatgttccctagtattatctactactactcccatgttttttcattttaattttccctcagcatgcttaggtttttattagtagcgttgtacgttcatcgtagagggagtagtcgtatgtatctgtccatgtgagtctaacattaggttaatggaaggggaaaaaaactgctatgatattttgtaaaaaaaaaaaaaa

SEQ ID NO: 7026 - DNA, 959 bp, Glycine max
  misc_feature (392)..(392): n is a, c, g, or t
  misc_feature (606)..(606): n is a, c, g, or t
  misc_feature (638)..(638): n is a, c, g, or t
  misc_feature (696)..(696): n is a, c, g, or t
  Predicted polypeptide sequence is orthologous to G1938
tggtcgtcggattgcacgcgcgcaattatccctcactaaaggcaacaaaagctggagctccaccgcggtggcggccgctctagaactagtggatcccccgggctgcaggaattcggcacgaggggaatttggggagaccccatttgggtgtgggtgtggccacagcagcaggcctatggccccctcatgtcagtggatttggatttcaaacaccaccaacaacaacaacaccaacaacaacaacatcatcatctggtccatctaatgccaccttagccactgagagctccaattaccttcagaaaattgcattccctggctttgacttgcctacttctgccactaacatgatgggtcacatgagtttcacctcaattttgggtggaggtggnggtggtggggcccagcatatgcctggcttggagcttggtctttcccaggatggccatattggggtgttgaatcaacaggccttgaaccagatttatcagcagatgaatcaggctggtagagtgcatcatcatcagcatcagcatcatcatcagcatcatcagcagcaacaacaccatcagcaaactcctgctaaggatgattctcaaggctcangaggacagtagtagagtgtttaattatggatntggatgaaagacagagaaagaaaaagagagtagcatcattgtctagatgctggctgangtttctagtttctacaatggctcttgtattgtataattgggagactgtgagggaaaaagaaattagtgtctcagagaatccatagaaagctgggatttggttacccccttggttaccccccccatattgttctttctcccaagactcaagtctccataatccaggtgaaatgcatgggcaggatgctttgcctgctttggtctgcccttaaaaactattggtaaattcagaagtggttggatatttggtcttttttaggaagg

SEQ ID NO: 7027 - DNA, 902 bp, Glycine max
  misc_feature (55)..(56): n is a, c, g, or t
  Predicted polypeptide sequence is orthologous to G1946
gggtagagcattggataaaaagaaatggaataaattccatcaagttcaattccannatgttatgaacaatttcaacaatggtgactaatatcattcaatttcatttccttctattttccatcagttgaaacataacctcggaaaggacaaaataaaattgacgaagaagcaaacagcctgcagcttaacatcgtaccactgctgtccattgttgccgcccttgttcagaaagcaaatcttccaatgtgcatttttcagacgccttgagcagtcaatcatcacccaacatgttctctttttcccctcatcaaggaaacttgaaaattgggaaagaaccgaatcgttcacatataactcaacttgacagattgcctataacattggaaaaactgatcttgtgatcacaaacacttcctgaggatgccatgacaaggccataagttcataacttgttttcaacacgaagtcgaatgaaaaatcaatgtaaatgcacgtgtgagaaagttggatttagccttggtatgcacaacaaactaaaaaaagccattgaagaccaaatgaaaaacattgtctttttcagtgaccaagtgggagtgtaattactaattatatattatagacatcacttcagtcatgtattgtttgggtcagggactacctcagacaatatgaagattaatcatatatcatagatatcaaactctttttgcatcggaagaaagaagacccatctgctctgtaaggtgatccatatgttgagttttgccccatccattttccattggttggacctcattccctttggatgcttcagccacattggtatcgatatcctctggaactgaagtttgcaaaatttcatcccaaataggattggctaacaaatcatcaatgtctgcatc

SEQ ID NO: 7028 - DNA, 610 bp, Glycine max
  Predicted polypeptide sequence is orthologous to G1948
tttttttttttttttttttttttttttttttttttttttttttttttttttttgggatttgattagctttttcatgtccacaacttgattgggtacaaaacaattattaattaattggctcccgaaatttggcaacaaaatcccagtccaaacaaactatgaaaaatcacaggctagggctatcctgatgggaaaagaccacagcgggcccattactactgggctgggcctggttgttacttccctcgaaagctttgacaagctctgggtccacattctcctcgggctcccatgtgggctcctccaaatcggcccatttaaccaaaaactccggcgtcccttcatccggtacccttttcgcgagcaccggctcagcgacggggtactcgaggccagcctcgtagtctttcaccaaatcctccggcacaaacttcgccttcacccactcgttggcaccaccggccttccaccggacaagatactccaaattctcaccctttcctctccgttccagaatctcctggacctccgcgtactcgaacactggcccttccaaaaccctaatcacaccttccagtccaatcctgggtccgaactggatcggattccc

SEQ ID NO: 7029 - DNA, 749 bp, Glycine max
  misc_feature (1)..(1): n is a, c, g, or t
  misc_feature (520)..(520): n is a, c, g, or t
  Predicted polypeptide sequence is orthologous to G1950
nggatgaatcgcgccagcgcgcaattaaccctcactaaagggaacaaaagctggagctccaccgcggtggcggccgctctagaactagtggatcccccgggctgcaggaattcggcaccagacgatggagatggaagtagacaccgagaagaagcaacaagacgtggtgaaagagaaggacttattcaaagccgctgaagagggtgacatgtcaacgttcgaagcacactcctctgaaaccctctccaaagccctctctctcagaaacgaagacgctcgctccctcctccacgttgcagcttcttccggccactcccaggtagtgaagatgctattgtcttgtgatgcgtctgttggtgtggtgaattgtgccgacgaggaagggtgggcgccgcttcactctgcagccagcattgggagtgtggagatagtggagactctattgagcaaaggagctgatgttaacctgaaaaataatgggggccgcactgctctacactatgctgccagcaaaggttgngtgaagatcgctgaaatgctcatctcccatgatgccaagattaatataaaggataaggttggttgcactccattgcatcgggcagctagcactgggaaatctgagctgtgtgaatttttgattgaagaaggagcagaggttgatgcctgtgatagagcttgtcaaactcctctaatgaatgctgtgatttgctattacaaagagggtgcccttcttttgataagacctg

SEQ ID NO: 7030 - DNA, 1012 bp, Glycine max
  Predicted polypeptide sequence is orthologous to G1958
gagaactagaattgtgcccttctttttattattccggtacagttaaaataaacaattcatattgagatgtacgtactaacatagaattttgggtggtagtatttggaaagatactgtcctaattcattcctcacttatgatttgagatgtagtcattatctgtactgtacactagaatctcatcctaacaaggatgctaaataagaagttcgaagaacctcatggtccaaaaattgactcatcatttttgtaacacaatgacatacatatgcaagtcctcattgatcacaacaggttaggggaaactcaagttatggatctaccaagtcttccttactaaatagaaatcttaaatgaattggtatcgtcttgtcagttcaatgctgattcagtagatcatatggcttactcctctgtccttggacgctttgaggcattactatcttcactagcatgttgctcaggattgtcggaagcttgaatttcaggagcatcctgcttctcagccacttccaatgagctttcctcaactgtggtactgccattagccagatcagctcctgacttgcagtggtccaccttgatggtttctgattcagttttggctggagaatctttgatggcatcagaagacactccagattgactctcgatgacagatgatgatgccttaaatgtttcaatgccaggtttgcactgcttctcaaacatcatctgaaggtaccttccttgttcttctattcgcaactgtagatttctttgaatctcaagctgttcatgcaaccgcttctgaacctccatctgcaacctcagagcttcagtgatctccataccagttttcaaatctagagatgacatctcttcgattcgacttagatttttctctgcagctccttcagatgactcaggtctatatctagctgtcctggatttctgtaggtggcttttacatggtatatagtttatccttcaactttcatgagcttcgcacacctttaggggtagctctttc

SEQ ID NO: 7031 - DNA, 804 bp, Glycine max
  misc_feature (740)..(742): n is a, c, g, or t
  misc_feature (749)..(749): n is a, c, g, or t
  misc_feature (752)..(753): n is a, c, g, or t
  misc_feature (755)..(755): n is a, c, g, or t
  misc_feature (759)..(763): n is a, c, g, or t
  misc_feature (770)..(771): n is a, c, g, or t
  misc_feature (773)..(776): n is a, c, g, or t
  misc_feature (783)..(784): n is a, c, g, or t
  misc_feature (786)..(787): n is a, c, g, or t
  misc_feature (796)..(803): n is a, c, g, or t
  Predicted polypeptide sequence is orthologous to G1958
tatttctttggagtcttaatattacttttatttttcaattctgattttctatataatacattaaacacaggtataaataaatgctagtttacatgtgaaaaagaaaagaaaaaaaaaaaacctcaaggaccactaagaggatggtaacaaaatttccatcacaatgagccaccattacttgtggcactcatgccatattttcataggaaatggctgtgataaatgagcaagttgaaacatccttggatccaataatatttctacaagttccatggagtccaaaccagtctaagaatattaaacaaatctagaaggcataaaacaacgatcctgctgttacgaacttttcacccgttttgtgggtggtgcaacttcatcttccttgatcatttcttcagcttcacctgcaatttgttttgttgtgcttgactccttctcttcgggtatggcttttggaatgctttcaaatttgtggcgttcctcatttgtggtttctactgtttctgatggtgcagcagcagaaggctcgtccaaggagacgttaaccttgctgtcacccatctctctctgtttctcaaacatcatctgaagacgtttcccttggtcttcaatttgaatctgcaactttctttggatctgtatcaaagttgccatatcagaacatgccaaaaacttgcaaagcaaacaaaactcctcctcaagaaaacctcaagtactactatattaattacctcaagttnnncgtgaantcnntnctgnnnnntcatctnnannnntaatgcnncnntgatccccnnnnnnnng

SEQ ID NO: 7032 - DNA, 638 bp, Glycine max
  Predicted polypeptide sequence is orthologous to G1958
actctaccaaggtggatttctaacggcaaaactaacatcagcctttcaagtaaccgaggccatatcttttgctaaatgtacattgtactcattcattgaccacaattggacaggagggactcataagttacgagctcgaccaatcattcagcctaatctttcttaaaatgaaatctttcatgattcagtattgtcttgtagtatcactattgatactgtaattcagcagattcatatagcttaattactcagttctttgacgctttggggcttgagcactatcttcactagctatagcatgttgagttttgggagaatcaggcttcccacacttttccaatgagccttcctcaactctggtactgccattaacctgatcaggtcctgacctgcaatggtccagtactagtgatgcttccatttcatttttggaaagggaatctttcgtagcatttgaagacatcccaaatggagtctcaatggtggtaaatgatggtgccttgaacgtttcagttccaggtttacattgcttctcaaacatcatctggaggcatctaccttgttcttctattcgcaactgtaggtttctttgaatctcaagctgttcatgcaaccgcttctgaacctccatttgtaat

SEQ ID NO: 7033 - DNA, 810 bp, Glycine max
  Predicted polypeptide sequence is orthologous to G1985
aattatcaatgaattaatccaatccttaaaattacgtaattatcaaaatttttgtaacacaaacattagaggcccttagttccaacatggtaaaactcaaaattctctatcctacttcgtctttcacgcccttaaaccaaatggaaacaaataaatcaccctggtaaaagaaaatcaatgattttgaagtttatgaatgtttcgatggatagatgatggtgcttctggaacttgctcagctccaaacagttaaacacttctttttcattcctttcactttctttcctaagctgaatatatcataaatttgttgagtttgtgccaagggtttaagttgctatatggtcgctgtttcgttgcaatccttgatgttgtgggggtaaattgctgacaactgtggccacatagtcgctgcatccaaaattgcggtcccaaaaaacaaaacactgttatctgtctttgattccatttaatggaggcttcaatctcaggagacgtccttggcgttgttgaagaacgcagtggcgcagagaatggaagcaatgaaggcaatgaagcccaaaccaatgattaaagaaaccccagcgacgaggaagtccaataggcccaatcccaccatcaccataatcgccatgttcttcttattcaggtgagattgggagggagtgtatcgactaagaagagattcagaaacagatgagaacgtggatgtctctgaacggtggtgacagaatcgaaacagagggaacgcgaggagacagagacatcggagttttctcgattgtgttttctcggtccaccgacagcaac

SEQ ID NO: 7034 - DNA, 794 bp, Glycine max
  misc_feature (1)..(3): n is a, c, g, or t
  misc_feature (483)..(483): n is a, c, g, or t
  misc_feature (689)..(689): n is a, c, g, or t
  Predicted polypeptide sequence is orthologous to G1999
nnnaaggccactgcccattcggctaagcgcgcaattaaccctcactaaagggaacaaaagctggagctccaccgcggtggcggccgctctagaactagtggatcccccgggctgcaggaattcggcacgagggtggtatggagttgcgatggatggtcgtatgtgtacaatagatgaacaacatgatgtgggaaacatgggctcatatcatcttcagagctatgaattgtctcataaaccttaacatatttacttacctggatttaaaaggagtgggaactttgttgtttgcttgtgatgtggatgtgatcgatacgttgtgttaatgtaagaaacagctatttcggctaggttatttagctgagaaaacggtaaaacaaaaatattttggcggcagaatagggtagccttccttgtctatccttgctttggaagttacggtggggaggattattctgtctagggtttcgttggccttgtganaatggtttatttcattagtgttctcacatggttttcttttatttttgcgtacttaatttgtttggtgtttattacccttcagagtatgggtgatgaaacaagggattatactgaactatgctgatcacttggacaatcgtattggttaaataaagccctaatgtgtcaaagtttataaattggagttatcaacaaaaaacataatnatctcgagggggggccccgtacccaattcgccctatatgagttgtatacccgcgcttacttgccgtcgttttacaccgcgtgaattggaaaccccctgcgttccc

SEQ ID NO: 7035 - DNA, 840 bp, Glycine max
  Predicted polypeptide sequence is orthologous to G2035
caaacttaagtagtggacttccctttcatattatttttattacatatacataaatctacaagttttgattattaattataatcacatacagcctgaaaccaaaaactgcaaactcaagatgaatgatgaaatcccggtgagctaacattatcacttggcagtagtataacagtttcagttaaaaggttgaaacatttctcttgattcttgactcacagggcatagatcttctcaatgtcagaattgtattcatccaaatctgatatatttgcagagtaagaccatgagaaagatttgcttccacttgctctcttgatgcgtctctgggaatcactgcggaaaatgccgaaatgttgtcgaaaaacaaagtagcacatgcttgctagagtgccaactagaacaggtacccccaaaagggtgatggtgatagccatccatgttttctttccaacaacctcaaaagctattgctagaaaagcaccacaagtgcaagcacatgcagcccacatcaacttgttaaccaccgacacaatctgcttttgagcccttgtgtcccaggctaccaaagtaatttgaactacaacaacggcaagagaaatgaaaagagatgtagaattcagaaggcagaagacttggaaactaacatgatcggctattttagctttcccaatctcttttccttcgtccgttatatattgacccggcaaattgaagatggctaagaatgctattgaggcaaaaagtacagcaaccaatgtgacagaattaatggtgttttgaactgcttctctatgaagtttcttcaactccttggcaataccagaaacccgtcgtcgtgtc

SEQ ID NO: 7036 - DNA, 936 bp, Glycine max
  misc_feature (1)..(2): n is a, c, g, or t
  misc_feature (14)..(14): n is a, c, g, or t
  misc_feature (19)..(19): n is a, c, g, or t
  misc_feature (646)..(647): n is a, c, g, or t
  misc_feature (660)..(660): n is a, c, g, or t
  Predicted polypeptide sequence is orthologous to G2060
nnaacttccaggantttancgccttacgtgtgggatatgtgaccatgactcaagggaacaaaagctggatctccaccgcggtggcggtcgctctagaacttgaggatcccccgggctgcaggaattcggcacgagcttgtgtggatttgatattgatttcatgtttaagtgggtgtctcctattaccatacaatgtttattgagtttcaaatacattactattttcatttggctctaaaggcactggaagctattgcctatggaatggggtatcaattatgtcttgttggtgggctcgtttaagactacaaagcttttaggatttatgaatttttgctaaataaggtgcttttacatatctaaatttctcatgcatataactcagattttagattattgttgcattaatattctcaggttcttaggcttttcaaattgttaatcttacaagtgattaggtgccaacttgtgtttcgattctcatcgttcccgggtttcatttaattattcttcactcggtgagggttatatactaacttaagttttagtttccagtttgttctctcttggtgcagggtctaaactctcattaagcctttgttctgtaactccctctatatacaatatggaagtctaccttatattnnttggtatcttgtnttatttagttagatgctgtcacaggattatgtaaatcaatgttttgtggattggttcatgcatgacattgtacatactgggcaaagtagcatggtgctatcagatcctatttattcctcctatgttgtgcatgtatggctgcatatgtatcgcatagctacagaatacatggttcttggacgttacaaaaacaataaaacaataacaataaaaaacctcgaggggggcctggtcccaattcgccctagtggagtcgattacgcgcgttactgccga

SEQ ID NO: 7037 - DNA, 1076 bp, Glycine max
  misc_feature (1)..(1): n is a, c, g, or t
  misc_feature (393)..(393): n is a, c, g, or t
  misc_feature (629)..(629): n is a, c, g, or t
  misc_feature (635)..(636): n is a, c, g, or t
  misc_feature (639)..(639): n is a, c, g, or t
  misc_feature (646)..(646): n is a, c, g, or t
  misc_feature (685)..(685): n is a, c, g, or t
  misc_feature (688)..(689): n is a, c, g, or t
  misc_feature (710)..(710): n is a, c, g, or t
  misc_feature (713)..(713): n is a, c, g, or t
  Predicted polypeptide sequence is orthologous to G2071
natgtgcgatcggctgctgacaactcatatagggcgaattgggtaccgggccccccctcgagtttttttttttttttttttttttttttttttttttttttttactaacacgaaaaagcttttgtgttttcttgtatatcatcccttggtctgcatgcagggtccaaatccttatttttctgcatttccatgatttcttcctgttttctttggaattctctgtttaattccttaagttttgcaacctcagcttctagttcgaaagtgtaggcctgcttacgagcccttgacctcgcagctgattctctattttttatcattctcctttggctcctctcaaccactttctctatggcactgaatttccttcccctgttgattacataatgcggngatattggagagttatcaacattattactccttgtaataacatcaggtgatattttacttgaggcagaagctgtgacattagctgtggctaaaccaaccattccaacattcatcgaatgctcagcaactccaatcaaccctctccttctgccagggctagcaagttgtgcattgttcaacaaatgcataggagcagctgcaaaagttacatttgctggctttggaaaaagtgtggntgctgnntgnggtgctngtgtgctgtcctttgggagtgtttgagttaatgataaanggnnggaagggagagttgactaaantantgtcttaaccaaaatcccgttgtttctatttggtgtgaaaccccaaaagaagccagggtgtattgtctgtcttagaaagcaccaaccctgcggcccgggatcataattctaagcgccccccacgggtgactctcgcttttgtcccttatgggggtattgcccttgcggatcatgccatactgttcttgggaattgtttcctccaattccaaacatcgaccggaaacaatgtaggccggtgtccagtgactacacatattgctgctcattgcccttcacggaacctgtccatcttttataaacaaacagcgggagatcgattgggtcttctttccttctcttaaatccatatcactaactctcc

SEQ ID NO: 7038 - DNA, 803 bp, Glycine max
  Predicted polypeptide sequence is orthologous to G2085
gaacaaaaaatctacgtgtaaaattaaattcaaggtattgggtgagaccatcaccaagtcatcattcaagtttcaggttatacatccagagatcaatggttaatgccatagatccaaccatataaaaacaaagttcttgcattgatgggagtattgttatgtctgtacattcctattggtcaatctgaatggaagaactatagacctacttatgccagagtaaactacttcaacattttctgagactggaaaactttatgatcagctaccaaagctggattatcatgctctgagaaagcaggaagattgttatgtgcagggtcggcagtggcagtccgacagaccgagtcattaccttcatcaacctgctcaactggtggaagagagtgttcctgatttctcttacaaaggtctcgcaaagcacccctatttgcccaaaaaagcccacaaacgttgcaaagtgaccttggaccaaatggccctcgccgcatcattggggtggattttgaactaatgccacaatgtgtacatgaggtttcagattgactatcatcctgtcctgaatcatggtcagtaccataactattaactccatcttgtttcttacatgaagtaaactggcccttgttacggtgcatcctgagcgcaacttcttgccgcacgctatatctcacttttttgtcaaagcatcgctctttcctcttctgcctgaacctatgtaatgaagcagctcggtgtggtagactacatttatgaaattccattgaacccctttgattatgttgagcccccgcgacagcaac

SEQ ID NO: 7039 - DNA, 793 bp, Glycine max
  misc_feature (1)..(1): n is a, c, g, or t
  misc_feature (462)..(462): n is a, c, g, or t
  misc_feature (677)..(677): n is a, c, g, or t
  misc_feature (793)..(793): n is a, c, g, or t
  Predicted polypeptide sequence is orthologous to G2094
naggtcgctcgtagaagacgccaggcgcgcaattaaccctcactaaagggaacaaaagctggagctccaccgcggtggcggccgctctagaactagtggatcccccgggctgcaggaattcggcacgaggcgcgtgtgtctgcgttgcgagtgtcgtcgttttgattcccctctctctctctctctctccaccttcactcactctgcatgcttcttcttcttctctcactctgattccgcgaaatcaaatcaaaatcagcttctcggaatcgaatctcagatctcggagatcagaaatggtggatccaactggaaaaggatcggagattgaagtcgaggactcaaactcaaaccctaacgctccttcctcagggaacagtccaagcagcaacaatgagcagaagaaaacctgcgccgattgcggcaccaccaagactcctctctggaggggtggtcctgcangacccaagtctctgtgcaacgcgtgcgggatcagaagcaggaagaagaagagagcgatcttgggaataaacaaggggagcaacgaggacggaaggaaaggaaagaggaccggcggcgctttggggaaggaggtgttgttgcaccgatcgcattggaagaagctcgagaggaagagagactgcggtcttggtgatgtcgctctcttatggatccgngtatgcctgaactgagccagaattaatcaattatgattatgattctaggtgtagatgaaccattattgaagaaaatacttgaatatggtgtaggatggtgcttccgctaacccctn

SEQ ID NO: 7040 - DNA, 660 bp, Glycine max
  misc_feature (14)..(14): n is a, c, g, or t
  misc_feature (32)..(32): n is a, c, g, or t
  misc_feature (56)..(56): n is a, c, g, or t
  misc_feature (630)..(633): n is a, c, g, or t
  misc_feature (643)..(644): n is a, c, g, or t
  Predicted polypeptide sequence is orthologous to G2094
atctttttctatgnacctccattactttcaancgcgcaattaaccctcactaaagngaacaaaagctggagctccaccgcggtggcggccgctctagaactagtggatcccccgggctgcaggaattcggcacgaggggcattccggtcattgagtagggtacattcacatagtcggttgttgtgctgtgtctccatttttcttttttggtgcatgcgagcgaggctttgcaaatttgttctagtattagtaacgattgatcgagtgaataatattggaaatgatggatctgaatgtgaatgagaaaaagaaatgttgcgctgattgcaaaaccaccaagacaccactctggagaggaggaccagctggacccaagaccttatgcaacgcttgtggaattaggtataggaagagaagggcttgttcgaggaagcgagaggagcagaggtggaagatgttgggggaagaggaacaggccgcggtgtgcttgatggccttgtcctctggttttgttttcgcttgattgcaaggcattccttaatttagtaatccacgacaatcctttttgatgtcgcatacctaaccttgtaaaggtcaagcctctgtttataacatggtggttctttctcnnnnaaaaaaaaannaaaaaaaaaaaaaaaa

SEQ ID NO: 7041 - DNA, 913 bp, Glycine max
  misc_feature (683)..(683): n is a, c, g, or t
  misc_feature (705)..(705): n is a, c, g, or t
  Predicted polypeptide sequence is orthologous to G2131
ccgcgggccctactaaaatgaacggacgtacgaagcttacgccaagcgcgcaattaaccctcactaaagggaacaaaagctggagctccaccgcggtggcggccgctctagaactagtggatcccccgggctgcaggaattcggcacgaggggggttgagcttgtatagtataacatacacatatatgaaaaggatcagggttgagcctgtgacatttggctttatgtgcaccccaaagctaggagaaagagacttcaaactaggtcgtccccaggcattgataagcaagcaggtgctccttgttcatctctccttttccattaattcttccacttaactgatctcggagtttgtattgtatcaatctatgagtgtttaatagttattcttaatgtaattatttcaatttcttacatggtttagatgtgtagaatgttgaatatagataaggtgttcaatttatactcaacttattacaatataagaacaacaatattcttgttttgcatgaggtcaattacaaggtcaattaaaaaaaaaaaaaaaaaactcgagggggggcccggtacccaattcgccctatagtgagtcgtattacgcgcgctcacttgccgtcgttttacaacgtcgtgactgggaaaaccctggcgttacccaacttaatcgccttgcagcacatccncctttcgccagctggcgtaatnacgaagaggaccgcaccgatcgcccttcccacagttgcgcagcctgaatggcgaatgggacgcgccctgtagcggcgcattaagcggcggcgggtggtgttggtcgcgcagcgtgaccgctacacttgccagcgccctagcgcacgctcctttcctttctccctttctttctcgcacgttcgccgctttcccgtaaggtctaaatcgg

SEQ ID NO: 7042 - DNA, 779 bp, Glycine max
  misc_feature (721)..(721): n is a, c, g, or t
  Predicted polypeptide sequence is orthologous to G2131
ccccccccaggagagattgaatgactgctgtagataacgcccagcgcgcaattaaccctcactaaagggaacaaaagctggagctccaccgcggtggcggccgctctagaactagtggatcccccgggctgcaggaattcggcaccagatttgggcttgtgttctgaaataatccgtcgtgacaggcaaccatctgaatagaacttcctaaaattgaccaatgttaagaagtcagcttaattgtaaattctctggtttgatgctttttatgtaaagtttattatgtctactggaacttatttgaaaattgtcgtgtttctatcagttctaaattgaataagtttaagggtatgtttgttctttgttcacatcgttgatccttgacttgtatctctcattggtgtcatacaattatatttttacatatatttaaaaaggagtaaaaaaaaaaaaaaaaaactcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcgggcgggtggtgtgttacncgcagcgtgaccgcttcacttgccagcgccctagcggccgctcctttcgctttcttcc

SEQ ID NO: 7043 - DNA, 771 bp, Glycine max
  misc_feature (47)..(47): n is a, c, g, or t
  misc_feature (771)..(771): n is a, c, g, or t
  Predicted polypeptide sequence is orthologous to G2131
cccccaggtgattgctgcgcgatgacaggcgcggcggagcgcgcaanttaaccctcactaaagggaacaaaagctggagctccaccgcggtggcggccgctctagaactagtggatcccccgggctgcaggcttctatcgaccaagttattgcgaaaatcccggttttgaaaaggtcgaatagcaccagggttatgtgcttggacttggagttacacctgtagataatgactctgtgcttggaatcaactatgaaatcaccacctcagcttctttttctttgttctgactaactcttttttacctctttctggacacatgtagtattctttcatttttgtgtaaaaatttcattgacttttcccttataaagatcattgattctttatttgttaaaaaaaaaaaaaaaaaactcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctgtcttcctttctttgtcgccacgtcgccggctttccccgtgaacctn

SEQ ID NO: 7044 - DNA, 943 bp, Glycine max
  Predicted polypeptide sequence is orthologous to G2140, G2765
aacagggtacaatatcacagaagactctatttaaatcaaaggattaaaagtgctatgatcagttatccatcaaccaatctgtcaaagcacctaaatatttgtacaccccagaattgttcacatgatttgtcttctaagaagtacatatccaagttacaaatcatggaacaacatttcagtatgtatacatgagtttacatggtacatgaaatcactactatgactcacctcctcatcacattcaaacttggtatggaactatggatatgcagatttaaattacttaacaaggtatcttacaaaaaatcttctaaagatgaagaactgaatatagaaatccttcttcttttcctggttcctaaaatgtcctctgaaacagaaaatctgttgagcacagacttgagagcttggtgaacagaaacggcaagaaactgacggtatgcggcatcttcaaagttctgttctttgcaactaattatcacaaagacattcttcatcctgccttccaaggttgcaatatctgcccttgttatcataagatggagagcatctagtgcttgttttatatcagacaacaatccgggtttatattcacaacatagtgatgctctaattgaataaggaaaaccattcaacccaccctcctgttcttcaacacttatttcatcattgtcctttggtatcatcaaaccctcacaagcttgtgctgcattcttcttcagctctttcaaatgtctaataacctcaccaagtaatgatgctttgtccatcttcatagcacccggaatcacactgcgaagtgtatcaagatgtgcattaatccttgccctccttttcctctctgcctcactatggctcttcaaagctttcatgcttctctcagtggacacccctttcttttccatctcacaggttcctccacaagctcccctctctcccttat

SEQ ID NO: 7045 - DNA, 625 bp, Glycine max
  Predicted polypeptide sequence is orthologous to G2140, G2765
cggccagggtggaaattcgcccctgactgctacttccagtgcgcaattaaccctcactaaagggaacaaaagctggagctccaccgcggtggcggccgctctagaactagtggatcccccgggctgcaggctcgagttttttttttttttttttatcttctaagaagtaaatttgcaaaatataaagcatggaagaacaacctttcagtttgtatacatggtacatgaaatcactactataactcacctcctcatgacactcaaacttggtatggaactatggatatggagatttaaattacttaacaaggtatcttacaaaaaatcttctaaaggtgaagaactgaatatagaaatcctccttcttttcctggttcctaaaatgtcctctgaaacagaaaatctattgagcactgccttgagagcttggtgaacagaaccagcgagaaactgacggtatgcagcatcttcaaagttttgttctttactactaattatcacaaagacattcttcatcctgccttccaatgttgcaatatctgcccttgttatcataagatgaagggcatctagtgcttgttttatatcaggatataagccgggtttactcctgccgaattttaac

SEQ ID NO: 7046 - DNA, 703 bp, Glycine max
  misc_feature (4)..(4): n is a, c, g, or t
  misc_feature (489)..(491): n is a, c, g, or t
  misc_feature (626)..(629): n is a, c, g, or t
  misc_feature (631)..(631): n is a, c, g, or t
  misc_feature (675)..(675): n is a, c, g, or t
  misc_feature (677)..(677): n is a, c, g, or t
  misc_feature (679)..(681): n is a, c, g, or t
  misc_feature (684)..(686): n is a, c, g, or t
  misc_feature (700)..(702): n is a, c, g, or t
  Predicted polypeptide sequence is orthologous to G2140, G2765
gatntccatatgctatttaacgaatctcatttattgttcagggagattcacccaataatagaaaacatattaaacaatatactatcagttgtgttgttagcattcctcaaaaaataagaaatgttaataccacactctaacacttgcagcaaaaacagataacataacacatcaaattcttgacatcagcacaaacaaaacccatggttgcatgtggaattggatgtttcaataaagcatagtcttctcctcttgcttgcatgtgatgttcttggtgagaaatccagggaggcagaagccttttccatcacagaacatagtgcctggggaacagaacttgcaagagcttggcatttttcaaaatcaatattattaatgttttctttgcaacaagggaagacaaacacattcttcatcctacctgccaaagttgaaatttctgccttgactaaatgcaggggaagggaatcaagggtctgtcttaggtcnnntagtatttcaggtctgaaatcacagcaaatagttgcactgtaagacatggatccttctcctccctcatgatcattatatggttcaactttcacttcatcagcatcctttggaatcagaaaacccttgcttacttnnnntncatttttcttcaactccttcacttggctaatcacttcagccagnanannngcnnnatccatcttttcannng

SEQ ID NO: 7047 - DNA, 791 bp, Glycine max
  misc_feature (6)..(8): n is a, c, g, or t
  misc_feature (20)..(21): n is a, c, g, or t
  misc_feature (745)..(747): n is a, c, g, or t
  misc_feature (750)..(755): n is a, c, g, or t
  misc_feature (759)..(762): n is a, c, g, or t
  misc_feature (779)..(781): n is a, c, g, or t
  misc_feature (787)..(787): n is a, c, g, or t
  misc_feature (790)..(790): n is a, c, g, or t
  Predicted polypeptide sequence is orthologous to G2140, G2765
ccccannnactctcatttcnncatttcttataccgatgatgatgttgatggagaatacatataaagtaacaacatttgccagcgcacaccattaacaagaaaagaaaaaaaagtaaaagccaaaccacaccccccaaaaaatatgcaaatcaaaatcaaaatatatatatatgcttatataacaactaattaattagtagatagtaataataataataatgatcatgcatatataggcctttaattaaataaaattcataaagacctcgatccgttcctaggacattgatattatattggtcctttgcctcttaatattcgccgaagcagactcatgatgatccccaacgctcttctccatcacagccttaagcgcttcttgtattgagctaatgcagcactgttgttgttgctggctatggtcctcactgcttgatgagtctgtttcttctccagtgatgaacaatacgttcttgacgcgcccaccaagcgttgttatctcagccttaagcgttcttagcctcaacgctttcaaggtcttgatgagttcagggaacagatctgacctatcttcgcagcacaaagaggctttgatcactgagtttccatcttcatcagcttcgtccactactgttaactcatcagcttctgttggaaccggactcgtttctgctatcagtgaggtttgacgcttcagctccttcacatgctggatcacttctgctagcaatgatgctttatctgnnntgnnnnnnctannnnacaagctgcgcagcttnnnaagatnggna

SEQ ID NO: 7048 - DNA, 931 bp, Glycine max
  misc_feature (1)..(2): n is a, c, g, or t
  misc_feature (697)..(697): n is a, c, g, or t
  misc_feature (753)..(753): n is a, c, g, or t
  misc_feature (931)..(931): n is a, c, g, or t
  Predicted polypeptide sequence is orthologous to G2142
nnttggaattcgcaaatgcatgtgacgagcccaagctctaatacgactcactatagggaaagctggtacgcctgcaggtaccggtccggaattcccgggtcgatctatgcgtccgcgagatacgcatgggatcagtcacatgctagcgctcctccttcttcttctctctccggtggtggtgactcgccggaagacaccaacttccaccttcaacgccgccgctggtgaacacccttctcaaaatctcacctgacccaattccactttctcctttctcttctcaatttcccatctgggtatccctgtttccctcaaagttctcttcttttttcgtgattcagaagtgctcagtgataccctttgtttagaacaatgagagcagggaaagggagccaggaagaggatgagtacgaggaagaagagtttggttcttccaagaaacagggtacttcctctgcccctaacgccaacaaagatggaaaagccatcgacaaggctagtgcgataagatcgaaacattctgtgaccgagcagcggagaaggagcaagataaatgagagattccagatattgagggatctcatacctcatagtgatcaaaagagggacacggcatcattcttattagaggtgatggagtatgttcagtacttacaggagaaggtacaaaagtatgacaggtcatatcaaggttgcngtcaagagccccctgagtgatgccatggagacatagtcattggcgtgtccagagcnttgctggtcaacctacagctgtaaacgaatggttgggttcagtatcaccttctcctgtacagttgacgaaagcaatgctagtatctctccaactatgcttagtgcacccagaataccatagatccttatcagagcagggatattggtcacacgacggctgagaggcaccctgattagn

SEQ ID NO: 7049 - DNA, 976 bp, Glycine max
  misc_feature (1)..(4): n is a, c, g, or t
  misc_feature (645)..(645): n is a, c, g, or t
  misc_feature (670)..(670): n is a, c, g, or t
  misc_feature (677)..(677): n is a, c, g, or t
  misc_feature (785)..(785): n is a, c, g, or t
  misc_feature (800)..(801): n is a, c, g, or t
  misc_feature (908)..(908): n is a, c, g, or t
  Predicted polypeptide sequence is orthologous to G2144
nnnnaaggcactgctaatggtgacgacgccaagctctaatatcgactcactatagggaaagctggtacgcctgcaggtaccggtccggaattcccgggtcgaccctcgtgtccgggctgtttccggattcgaacccatgaccaacaagtcaccaaggcacaactttaccgctgcaccagggctcgccctcgctcaaaagatcttatcaatgaaactggcagcagttaaccctagaattgatttcagcctcgacagtttattggctactgatggggcatctctaatggataataacttacctagcatggtgacacctctcatgtggccagaaatcccactcaatggcaaccggcagcattatcaacagcagtggcaattggatgcattccaccaacctctctgggagagggaagaagtcaaccataatttcatgactccggaaaactcacttttgagttatgactcgtcggcaaactcagcttctctgcactcaaatcaattgaagatggagctctgaaagcgtacagaagtcgtaccagtagctattagcctagtagtgtatatatcaaatatagtatttgcagttagctgtgatttgagtggtctcaactctccagatttagcagggtttccatgtcttctatntgtcagaggcggttggaaacctggnatttctntggcccggaagtaagatgaataattggcatgctattcttatataaattactatgtatactaactatagggtttattcaatccatgatgtgattgattcatgattgtanaatcatagacggacnntgtactgactataacataatacaaaaaaaaggcggctcgctctagagatcccagctacgtcgcgtgcatgcgagtcatagctctttcatgtgtcactaaaatcaatnaatggccgtcgtttacaacgcgtgactggaaaaaaactgcgtaaccaactaaatcgcttgcagacaac

SEQ ID NO: 7050 - DNA, 781 bp, Glycine max
  misc_feature (712)..(712): n is a, c, g, or t
  Predicted polypeptide sequence is orthologous to G2144
gcgttgggagcctctcgtagattacgccaagcgcgcaattaaccctcactaaagggaacaaaagctggagctccaccgcggtggcggccgctctagaactagtggatcccccgggctgcaggaattcggcaccagatggactgtaacttccctccgacagttgcacctgtcatgtggccagaaatcccacagaacggaaacagacaacaatatcagcaaccatggccgtttgatgcactccaccaacccctttgggggagggaagaagacaacactaatttcatgactccagaaaactcactcttgagttatgactcatcggcaaattcagtatctctgcattcaaatcagttgaagatggagctctaaagggaaactacaaaggtggtggtaccagtagcaattagcctattagtgtatataacaaatatagtattagcaattattcatgattggagcagcctaaacattcagcaggttttccctaactctatttggtcaaagtcagtgggaaacctgaattttattcagccagcaaggaaaaaaaatgggtttgctattttaattaaatatataactatcactatgtttactaactatagtaatcattcaatctttcaagtgatggattgatttagatggtaaaatcattgaacgaactattactgacctatcattgaagttggttgctttgttccaaaaaaaaaaaaanaaaaactggagggggggcccgggtcccaattcgccctatagtgagtcgtattacgcgcgctcactggca

SEQ ID NO: 7051 - DNA, 829 bp, Glycine max
  misc_feature (39)..(40): n is a, c, g, or t
  misc_feature (42)..(45): n is a, c, g, or t
  misc_feature (82)..(84): n is a, c, g, or t
  misc_feature (703)..(705): n is a, c, g, or t
  misc_feature (729)..(730): n is a, c, g, or t
  misc_feature (769)..(769): n is a, c, g, or t
  misc_feature (771)..(771): n is a, c, g, or t
  Predicted polypeptide sequence is orthologous to G2157
cacaaattaacaaaaccatcctaataactaaccttgctnncnnnntagctatgcttgcaagaaaaaccgtgagaaattaatnnncatagtacttaattcgcaagtcagtgagagattaaagacatgatcatattggcaagggtgatcagaaggaaggaggagggcgaggtggagctccccagaacacatcatgaggcatgttctgaccattgtgtagcaaattaggaggcaaattatacataggcattgaaacctgttcccccaaaccttgagattgttgttgctgctgctgctgctgctgctgttgctgctgctgctgctgctgctgcacttgcatttcctcctcaccttgatcatcctccagaggcaacctctcataagtggcattagcgaaagtggcggcgatcaccatcaccggtccggaggcgacgagagagcccgccacgttgccgccgacaacctgcccctgcccgccggctaggtagacggtcagtccggtggcgccggacggcgagggggacggcaaaaaggcacccgagagggagagtatctcgaacctcccgtggagggttatgacgccggcgggggcggcgggctggcggagagtgacgttggctacaatgccactcccgctgaggaccgacacgccacggtggcggcggttggcgaaggcggcgatgctctcggcgacatcgctgccggnnncgatttccaggacgtggcttcggnncgcgttggggctttccttagttatgactatgggcggctngngcttgttcttggaccccgctggcctgccacgtggcctccgaccgctgcttccgggctc

SEQ ID NO: 7052 - DNA, 900 bp, Glycine max
  misc_feature (175)..(175): n is a, c, g, or t
  misc_feature (648)..(648): n is a, c, g, or t
  Predicted polypeptide sequence is orthologous to G2213
gatgagttaaaattcaggttaggattacgcaagcgcgcaattaaccctcactaaagggaacaaaagctggagctccaccgcggtggcggccgctctagaactagtggatcccccgggctgcaggaattcggcacgagggatttgatcatttggaaaaatcaatatgacctttgtnaactactaccttcattcaatcatcttcagatgattctgttttgactttggtttggtagttgtaaacttttggctcactttcattgcacatgttgcttcaaaatgcttgaaaaggaagatcttaagcccccgttgggaacatattttgagtttcagactgaaagttttgaagaatggttcccatttcattgttaaaaaaatttgacacttcattcccaacttttcccgtgcattcttttgtagaacattaacactttcattacatgtttctttaatttatttgccctatgtattttgctttcagcctatgaggaatagcttggagggctaagaggaaatgcaggaaaactattctcccaactcagatataggttaataatattcactgattttatatttttatatctagacatatttatattacaggaatctataaatttattaatattcttgcaggcatctaaacaaaattgntactttttatttcacttggtttatatttttatatctagaacaaagtggtactccctatacaccctcttattttttaatctaagggttataaaaaggaatcctttgcaggtgggatatcaaacaaactccccttcctttattatttgccatcatattataaaaaaactttttttatgggggggctttcttgaccggcccattaaacttaagggggcttaattctctccgcggccccaaataaattttatttgc

SEQ ID NO: 7053 - DNA, 867 bp, Glycine max
  misc_feature (833)..(833): n is a, c, g, or t
  misc_feature (864)..(864): n is a, c, g, or t
  Predicted polypeptide sequence is orthologous to G2226
ggcaaaagcaaaagggtctgtatatgatgtctgtttacatatcaagaggatattatggacaaacacaattatcccaaaaaagtagatccctcgactcatatgtggcaacaccagatacagagaaacaaaggaaaacaagaccctccacacactttaacaatcataaaaaagtaaagggttaaaaaagttagagccaagaccaagggaacatcaacactgccacaactatgtacatacaatatatactgtacatgaatatatctcttttcttttatatgtacatgtttttttaccaaaagcaagatgcatcatcttcaggcatcaaggaagtcctgcaaagtgggcatgtaatgttccaatagtccaaccacttctccatgcacactttgtgaaaaatatggccacatgataaacagtttatctcagattctggttcaaactttgtgagacacacacaacaacattcatgttgaggttgtttactgccacacatgctgccaaacctaagtgttggtgtcctgcttctgaactcttcaatgaaaccctccgaggggctgaggttgaattctaatggctcaggtgggtttcgggagatgtctggtgaaggagacaacgacgaaacgcggataccgacaatttgtagaattgtcctaacaatgcctttgaatatggatatagacaaggcagtgtttacaagaagcacacataacactccttcagatggtgctgggagacttgacaggcccattttgataccaaattgtgttggttgcaagtggatgatgattttttctctttgaatctgaaaccagcagaatgaacaaattgctatngtcacttcatcaatggaaactcttcgacagncac

SEQ ID NO: 7054 - DNA, 757 bp, Glycine max
  misc_feature (1)..(1): n is a, c, g, or t
  misc_feature (704)..(704): n is a, c, g, or t
  misc_feature (756)..(757): n is a, c, g, or t
  Predicted polypeptide sequence is orthologous to G2226
naggatgctgttgattacgccaggcgcgcaattaaccctcactaaagggaacaaaagctggagctccaccgcggtggcggccgctctagaactagtggatcccccgggctgcaggaattcggcacgaggctgagagttacattgaagagttcagaagccggacgccaacacttcggttcgacagtgtgtgctgctgtaaacaacctgagcatgactgctctgtatgcctcactcagtttgaaccggaatcggagataaaccgcttatcgtgcggccatctcttccacaaagtgtgcttagagaagtggctggactactggaacattacatgccctctttgcaggactcccttgatgcctgaagatgacacaccttgctttcagtaagcaaaaacaagggagcatggcaataagagagagtttcatgtacagtgtagtgtacatattcttgagggtttttgatgttcatgcatctgagttctgccacctttataagtttttaacctttttccttttatggtctgagtttgtggaggattttgtttttacctttatctgtctgtgcgtctatagacacatgaggaggatactggttgcttgcatgtaatgtttgttcacaatgcacaccttgtttagaccaccttaaatgtctatatgtgggcagttttgatcctaagtaaggaagcatggattgtagactccatntggtttggcctttcaactctgatcggcgatgtgtatatatagtgatgtgtgnn

SEQ ID NO: 7055 - DNA, 1055 bp, Glycine max
  misc_feature (1)..(1): n is a, c, g, or t
  misc_feature (22)..(22): n is a, c, g, or t
  misc_feature (29)..(29): n is a, c, g, or t
  misc_feature (739)..(739): n is a, c, g, or t
  misc_feature (832)..(832): n is a, c, g, or t
  misc_feature (906)..(910): n is a, c, g, or t
  misc_feature (912)..(918): n is a, c, g, or t
  misc_feature (921)..(922): n is a, c, g, or t
  misc_feature (925)..(926): n is a, c, g, or t
  misc_feature (929)..(929): n is a, c, g, or t
  misc_feature (934)..(934): n is a, c, g, or t
  Predicted polypeptide sequence is orthologous to G2239
naacatgcccatcggcggatgnacactcntatagggcgaattgggtaccgggccccccctcgagtttttttttttttttttttttttttttttttttggatttaagaatctatcgggattcaggatttcagttatttatcttcaaacgcaaaacaagtgtgccaaatattatacacatcttacaaattctagcgtaaaaaaatcgtggcagcaaaaaataattggtaaatacaataaaatattgaaatcttgcagaagggggaatcaaaactcaaacagactccacagcaggcggcggaggcaaagacgcagcagcggaagttccttcgccaccgttattggccaccctgggcgacctaatcgacgacgctctcaccaaaaaaggcggcgccatggtgaaaacccaccggtccgacttaaacccccggtccaaccgccttgacgatctccctctgctacttccttcaccggttcgatacccccgccgcgaactaccttctctcggtaagataacgaggcttctcgcgcgatgcagttgcgggttctgcaatatctgctttctaacttcctcgggaagccgcaaagtgaaccgttcagtgtcttcgcccggcaggactaaagaatgaccggtcgagtgagaccgcgggaatcgccgcggccggcccgaccgggagcctctggtgggttccggttagcgtctgttttatgacagcacttgaagtcagtgggaacggaggcntgggggtctgctgtgctgtcggctccacgaggcgtttgggcttcggtgggcctatgtctcaaggacgttaggattggatcgtgacgactcccngctgaaggacagtgcgcgcaaacgggcagggtgtgagtagcatcctactcactccccctctttctggggaggtnnnnntnnnnnnnttnntcnnttnctttnttttcttcttctcctctcctcctcctcttccttctctctcctcttctctcttctcctctctctctcttcttttctctctctctcttcttctctcttctctttctttctctccttctcctcc

SEQ ID NO: 7056 - DNA, 973 bp, Glycine max
  misc_feature (1)..(1): n is a, c, g, or t
  misc_feature (560)..(560): n is a, c, g, or t
  misc_feature (679)..(679): n is a, c, g, or t
  misc_feature (753)..(753): n is a, c, g, or t
  misc_feature (886)..(886): n is a, c, g, or t
  misc_feature (916)..(916): n is a, c, g, or t
  misc_feature (973)..(973): n is a, c, g, or t
  Predicted polypeptide sequence is orthologous to G2311
naaaggatcgcctgactatcagccgctctaatacgactcactatagggaaagctggtacgcctgcaggtaccggtccggaattcccgggtcgacccacgcgtccgctgatgctgctgttgcccctgacgcttctcagaatgaccaagatgccaaaaaccctccaaggtataatgcattgatttttgaagctctatcagcactgaaagatagtaatggatccgacatgaatgccattattaaattcatggagcaaaaaaatcatcaggtaaaccaaaattttaaaagggcattaagtacacggttgaggaggcttgttagtcaagggaaacttgaaaaggtaccaaatggttacaaagtgaaaaaagaagcctcctcggggacaaagtcaccttcaccaaaagcaaaggatgtccggcctccacaaccacaacggcaatctccagcttctctctttatgactaatgacacattaaaggaagctgcggatactgcagcctacagagttgctgatgctgaaagtaaatcatatctggctgcagaagcagtaaaggaggcaganaaaatatcattgctggttgaacatagtgattcaatgttacagctagcaaaagatatatatgaacaatgttcccgtggtgaaattatcctcttggcttaagatggtcgaagtaggtctantaatagattcgttctgatgttggtttctaaatgtaaaattttgttgatccaatgaaatactatttttacatatntttttgtattttatcagattcctttaacatttttattccttaaaagtgcatggaaagtcatgtttatagtaatatcatcggtcccacaaattctttccggatttcgaattcaaaagtgtagcaataaaaactnattggtgttttttggcatgtaaaaaaaaanaaaaaaagggcggcccgtcttaaggtccaagttacgtacccgtgcatcgacgtctan

SEQ ID NO: 7057 - DNA, 782 bp, Glycine max
  misc_feature (782)..(782): n is a, c, g, or t
  Predicted polypeptide sequence is orthologous to G2343
accttgttggatcaccacaagcgcgcaattaaccctcactaaagggaacaaaagctggagctccaccgcggtggcggccgctctagaactagtggatcccccgggctgcaggaattcggcacgagggggacacagccaagaagatagtctgcaaggaaattttgaattccttgaaggatggcggtgctcataaggacacagccaagaagatagtctgcgaggaaaaattaaattccttgaaggaaggagaatcaaatggtgcataagtttgaaaaacttgtgtactgtgcacaagggttaacctgtcattgtagggctattttgcaggggtataaagtgggggtagttaaggttatactttattttgtattggcttcttggaatataaatacattataaccatgtggggttgttgcaggcatatgcttcgctattgaatctgatgtaaaagggtttttggtacccctggtccatttattagttatatatcatttatttcgccgattcaaaaaaaaaaaaaaaatactcgagggggggcccggtacccaattcgccctatagtgaatcgtattacgcgcgctcactggccgtccgttgaccacgtcgtgactgggataacgctggcgttacccatcttaatcggcttgcacacatccccctttcgcagctggcgtattacgtagatgcccgaccgatcgccttccaacattgcgcagctgaatgcgaatggaccgccctgtagcgcccttaacgcggcagttttgttggaccccacactgacn

SEQ ID NO: 7058 - DNA, 824 bp, Glycine max
  misc_feature (792)..(795): n is a, c, g, or t
  Predicted polypeptide sequence is orthologous to G2348
ctgcaagtccctctggacatccgataaaattggtaatgcacaaattagcaaccttggattaagctttccaatgtaataaactacctaatcatcccaataacaccagtttatttagtgttacaacaaatatgtaccaactcgaagacaagtacaaaaaaatactaatagttaaacaaacaccttctaacggatactgctaactcactaaccctaccaggatgaaggacggcaacacataccccaagacatacagcaaccgaaaccaacacaaaaatagctggccgaaaggtcaagaatcccctgcccaaacatcgacgcccgtatctttcaggcaactcttccatactcattataatatccctcttcaaaagtggtattctttccattttctcattagaagttggacttttcactttcagtactccccacttctcatctgctctcgactggataccctggctgttaattgcaactgatagcttgttatcttgggagcagccctgagcaagtataaagcctttcatttcagagtgcacaattatactttcacttttcggatgtttctgatatacggcatttctagcattatgtatgtgattcaggagttgcattatgtcaacatcacttgtcctattaattacaacattggatttcatgctttctgtcaagattatcaaatttggtaatatttttcccaaaatgattgttgaatcattgcatatcagaaagtccaacaaatggcaatatctttgaatttgtgaagctgtcatcactctgtcaaaattttctgannnngtgtccttaagcaaccatgctatatctac

SEQ ID NO: 7059 - DNA, 759 bp, Glycine max
  misc_feature (16)..(16): n is a, c, g, or t
  Predicted polypeptide sequence is orthologous to G2348
tttaaaccattggggnacaaaccgcggggttaccgtcactaaagggaacaaaagctggagctacaccgcggaggcggtcgttctagaactagtggatcccccgggctgcaggaattcggcacgaggcaatgttgtaattaataggacaagtgatgttgacataacgcaactcctgaatcacatacataatgctagtaatgtcatatgtcagaaacatcagcaaagtagaagtataattgtgcactctgaaatggaaggctttaaacttgctcagggctgctcccaagataacatgctatcagttgcaattaacagccagggtatcctgtcgagaacagatgagaagtggggagtactgaaaagtccaacttctaatgacaaaacggaaagaataccacttttgaagagggatattataatgagcgtggaagagttgcctgaaagatatgggcgtcgatgtttgggcaggggattcttgacctctcgaccagctatctttgtgattgtttcagatgctgttagtacttgggtatgtgttgccgaccttcatcctgatagggttagtgagttagcagtatctggttaggaagtgcttcgttaactattaatagtttatgcatatgacttatagtatggacatattggtagaacactaaattaacaggagttatggtgataaatagatagattattacatgtgaagcttattccaagtctgtaacattcgcttaacacatatacacgaactcaccagggact

SEQ ID NO: 7060 - DNA, 903 bp, Glycine max
  Predicted polypeptide sequence is orthologous to G2372
atccaaaaaaaataacataagaaaactattatccgcacttcaccttttggtttgtaaaacagttacacaagaaaaaaaaatcctttgcaacatcctccctcttaaccaatatggcaataaagtgcagaaatgatgccaaaaataagatactagggcctgtttggatacaaggctagaagtacttgacgggaaaaaaactctatttagagtagagaagctcccaaaaacacttctgacttgtattcaaaaaaaccttagtaaaattaagacagcaaaatatgcattaaaccaacaatggcacagtcatacactagaccaaataaaagaagttgcatttagaaatatcataaattgtctggcccaaatattgcggagttggtttagatccaagtttcatgaaacaaaaaagaaaacggcacaaactactgggtcaaaagggtggtcagcctccagcctgtttgaaacctgtacagctacttatatgcatgacatagtcacagctactttcacaagtaagaatcctcagctgttgagggctctttgacattggcattcatctcccgtgcaagtgcaaccggtaccttgcaaaccattttcaacaggctgttctgtctgaatgactgcaccaaatagttgaaatgaaacagacccaagttttcttgagttgccaacaaggtctgtgccacaggattggagactaccacgactatcaggtgacaattcatcagattgagagctgccaacatttacctctgtttccaatgttttcagccatggaaatgtgctcttcccaaaggaattacccatacacagacgagacatgtcagttggataattgcaaaatcttgatgcagaaaatgcatcatgcctggctccctgcatgccagcaggaaaagtaccata

SEQ ID NO: 7061 - DNA, 355 bp, Glycine max
  misc_feature (339)..(339): n is a, c, g, or t
  Predicted polypeptide sequence is orthologous to G2375
ggggaagcccctttactaaaaaggcaaggctccataaccatgccaggcaccaaaatcatgtgcactcagatcaagtgcaacaacaagcaccaccaccaagcaccatgatgagtagcactcaaatggttggaagcagtgctcacttctcgtaagtctgtcatggatcaactataccttgatctatctgccaccccaatatatgtttcacaacatattttaagtatatataattaggtcactgactctaattaattatattctaaatatatattggtgtagtgagtctagctattattaactttttaatgtgttttattctatgcctatttctggctctanaaaaaaaaaaaaaaaa

SEQ ID NO: 7062 - DNA, 890 bp, Glycine max
  misc_feature (5)..(9): n is a, c, g, or t
  misc_feature (589)..(589): n is a, c, g, or t
  misc_feature (890)..(890): n is a, c, g, or t
  Predicted polypeptide sequence is orthologous to G2404
ccccnnnnncccccccccccccccccggaggaatgcaactgcctagcagactactgccagcgcgcaattaaccctcactaaagggaacaaaagctggagctccaccgcggtggcggccgctctagaactagtggatcccccgggctgcaggaattcggcacgagccggcggtgattcgctcctccgccgattggcaaggaaagaaaacaagaaaaaagaagcacaagagaagcagcagcagcagcaagaacaagactttccatggtggggttctagaagggtccaatccagagtgcgtggattttcaagatgtttggtgtggccctggaattgggttctcaacagatgctgctgctgctgcctctgttgattgtgttgtggccaggaagaatgtctcttctgcaagagggaaaattgatgtggataagatcactcacagggagcgatcatcgtatgtgggaaggcgcactgaaaccttcacttttctggacagtactgatcctgacattttcacaccacgctctgcctctgactcttatggaactgcaacatactatcgtcatgttagagatccttcctctgatggttntgctgagataatgatgcttcaagggagtctactaatgggtggacaactaaattcacatgatcatttcaaagactggagacttgatgttgataacatgtgctatgagcaattgctagagcttggtgagagaattggtcatgtgaacactggggcttaatgaagatgagatgggacggaacataaggaagactaggcttcaatcttgggatgatacatcaaagcacaaagtagataagaatgcagcattttgtaaggtgagtagaagcatgaaatgagttggggagctaaattgtgacacatn

SEQ ID NO: 7063 - DNA, 747 bp, Glycine max
  misc_feature (551)..(553): n is a, c, g, or t
  misc_feature (658)..(660): n is a, c, g, or t
  misc_feature (676)..(678): n is a, c, g, or t
  Predicted polypeptide sequence is orthologous to G2404
aacgagaccataatataaaacttacaagtataatattgccgactcctccttaaggaagccaaaagtttaaaaatatgtaaagtaatgaatattgcttatattgcataagaaaaaactatacaccaatttaagggtaaaaaacatgaggatagtgccacttagtgtcgaaccacaacttcttgcttacaaactgggcagaaatttttatgctcaagccaatgttttatacactgaaaatgatagctgtggtcacacttcaatctccccagctcatcatctgattcatactcctcctgacaaacactgcactttttgtctagttgatgctttgatgtatcatttgaacttgaaggcttaactttccttatgttgagtcccatctcatcttctttgagcccagtgttgacataaccgattctctcacccagttcaagcaattgctcgtatgacatgttatcaacatcaagtctccagtctctaaattggtcgtgtgaattaaatcgtccccccatcattattcttcctcgaattatcattatatttacgcttcnnnctcatctgcttctaactcttcacttaagttaagaacccttttttctgaattgcagcatcgagccctttttccattcagtgccttttcagttttcactgcacctannnctcagcaagaccatcnnnggaaggatgtggaacatggcgatagaatctagcagtgccaaaaggctctaatccagggcgtgctgcaaa

SEQ ID NO: 7064 - DNA, 693 bp, Glycine max
  Predicted polypeptide sequence is orthologous to G2453
ttttttaacatcaaggaacacttaacaaatgaacatttatgaaaaccaaaaacataaaaacagaagaaagaacatttgtggtcctgaagactagttaaaggaactggtatgctggaaaggaaaggtgtcagataaaagtatcaattgtaaagcacttcctaaagtctcaaattgtcagctctcaagtctcaaccctacttaattcgttttcattaccaagagcatcttttcttaattaggaaaatgatttagtggaaaccataaagacagaaaatagtaatatagctagttatgtcacatatgctgagctttcttcattcaaactgtgtcgtttccaagatggaatttcttggcacctttcttccacggaaaccttgaacttcttcattgacctcagcatcagcagggtccactagtgagtcaagatcaacaagttgttctgtctggctacacctctcttcatctcctttgcaccactgagtttgggggaaattggcccaattttttgcagctgtactaaaagcttccttgtggctcatttcaggattttcagcctttagccttttaatctcctccttgatgaagcagttataagctgatggtgttcgctgtctcttctctgggggtttattcacaacatgatgactcattggaattatatcctcttcctcacaatcagaataggtcatcatg

SEQ ID NO: 7065 - DNA, 772 bp, Glycine max
  Predicted polypeptide sequence is orthologous to G2453
ggcgtggaagctttacgacatgacggaggcgcgcacttaaccctcactaaagggaacaaaagctggagctccaccgcggtggcggccgctctagaactagtggatcctccgggctgcatgaattcggcacgaggctccactctccagccaaaagaaagtagttcagaacaagatgctaacaagactttgaagagacataatgcatccatgatgacctattctgattgtgaggaagaggatgccattccaatgagtaatgttgtcaataaacccccagagaagagacagagaacaccatcagcttataactgcttcatcaaagaagagattaaaaggctaaaggctgagaaccctgacatggcccacagggaagcttttagtacagcagcaaaaaactgggccaatttccccccaactcagtgcaaagaagatgaagagagctgtagcagccagacagatcaacatgtggatcttgactcccaagtggaccctaatgctgtggtcaatgaagaagaaggtcaagggttacgtggaagaaaggtcccaaagaaatccatattggaaaggacaccgtttgaatgaagagagttcagcttatgtgacatagataacaagagcgtgattttttgtaacattaacgttgccacttaatccttgtgctaatgaagaaaatatgcttcttggaatgaaaactaattaggttgctgagagctgacattatgagaactgtaggagtgcaaaaatggataagatcatctgacacctctctagc

SEQ ID NO: 7066 - DNA, 781 bp, Glycine max
  misc_feature (1)..(2): n is a, c, g, or t
  Predicted polypeptide sequence is orthologous to G2455
nnaagagacgtagaaggggcgccaagctctaatgcgactcactatagggaaagctggtacgcctgcaggtaccggtccggaattcccgggtcgacccacgcgtccgaaacaaaagaagaaaagaaagaaaataatgtcaatggaaatgatggcaaccgaacgtgtttgttatgttcactgcaacttctgcaacaccattttggcggttagtgttccatacagcagtttgctaaccatagtgacggttagatgtggacattgtgccaatttgctatcagttaacatgggagcgtcacttcaagcatttccccctcaagaccctcagaaacagcttctaagctttgaagaaccaagcagctgcaaggaactgggatcatcatcttcaaaatgtaacaaaatagcgccatttcacgaggcagtagagcatgaacaacctaggattcctcccattcgtcctacagagaagagacatcgtgttccttctgcttataatcgcttcattaaggaggaaattcaaaggattaaggctagtaatccagatatcagccacagggaggctttcagctcagcagccaaaaactgagcacatttccctcacattcactgtgggttaaagaacttaaagctgggatggcacaagcaagaaaagttggaccagtgggaaggagcatgaaagtctaatggattctactgatgatataaatggaagcctgtgagtatgagcttggttttgtatgcttgacctaatcagtgagaaatatgaggtgatcaaatgtcttcc

SEQ ID NO: 7067 - DNA, 834 bp, Glycine max
  Predicted polypeptide sequence is orthologous to G2456
tgataacagactaaatgtgcgagaggcgtacgactcactattgggaatttggccctagaggccaacaattgtgcaccaggcaatgctcgtgtgttgtatgtccagctccatagaaaacacataaagttccgtctgcttacaaccgcttcatcaaggatgagatccaacgtatcaaagctgggaatcctgatataagccacagagaggcctttagtgcagctgcaaagaattgggcccattttccacacattcatttcggactcatgcctgataatcaacccgtgaagaaagctaatgttcgtcaggaagcagaggacgtgcttatgaaagatgggtttttcgcaccggctaatgtaggcgtctctccctactagaggtgtgtaagaatattaggggcttggagtattgttacccatgcatgtctctcattaagtaattgtgtactaggagttggtgttatgcatatgaatgttgtgcacttgtattagtacttgttggtgttaaaagttgttagtttatgtttacaatcaatgcaggaagggaatactgacgaagctagattagttcttctgaaaatgacgatggtttattgtctgatggactgggcctggaatgtaggaagctcaagttactatattcttatctgaggtcgtctgtgttttgtatacaaaaatagcgagaagtaagagaggagtgagatatcgagctgcatgaatatacatacacagaaagaagataatgagtgtgagtgtgcggagacatgttacatatgagtgcgaggaagtagtgagagtatgcgagagctagtacgctcataaacgagaatacgcacgc

SEQ ID NO: 7068 - DNA, 824 bp, Glycine max
  misc_feature (1)..(2): n is a, c, g, or t
  misc_feature (593)..(593): n is a, c, g, or t
  misc_feature (616)..(616): n is a, c, g, or t
  misc_feature (677)..(677): n is a, c, g, or t
  Predicted polypeptide sequence is orthologous to G2456
nnttgaggttcgccttgactatcatccggccaagcgcgctattaaccctcactaaagggaacaaaagctggagctccaccgcggtggcggccgctctagaactagtggatcccccgggctgcaggaattcggcacgaggcgtcctcgctgtatgaaccacacaacacattattcaattctctagggtaagtgttccttgcacaagcttgttcaagaccgtcacagtccgatgcggccattgcactaacctcctcccagtgaacatgcgagggttgcttatgccatctcccactcaatttcatttgggtcactctttcttctccccatctcataaccttctggaggagataccaaatccctctccaaattttctgatgaaccaaacaaatttaagtgcatcaaatgagttctctatgcctgctaggattgcagctgatgagcttccacgaccgatcatgaatagacctcctgagaagagacagagagtcccctcagcgtacaatcgctttatcaaggacgagatccaacgcatcaagtctgtcaatcccgatataactcacagggaagccttcagtgcagctgcaaagaattgngctcacttcccacacatccactntggtctcatgcctgatcagactgtgaagaagacaaatgtgtgccagcaggaaggagaagangttctcatgaaagatggggtttatgcttcggctaaatgtggtgtctcaccctactaatcaccagtctattttctctttcaagaaattatgcaaagaggaaaaatttcccaggtccaccaccttttgaagctcaacacgatctgattc

SEQ ID NO: 7069 - DNA, 1014 bp, Glycine max
  misc_feature (1)..(2): n is a, c, g, or t
  misc_feature (816)..(816): n is a, c, g, or t
  misc_feature (914)..(914): n is a, c, g, or t
  misc_feature (1014)..(1014): n is a, c, g, or t
  Predicted polypeptide sequence is orthologous to G2457, G2459
nngggaatggccatgaactagcgcgctattttaccctcactaaagggaacaaaagctggagctccaccgcggtggcggccgctctagaactagtggatcccccgggctgcaggaattcggcacgaggcagcgcgtaccttctgcttataaccagtttataaaggaagagattcagaggatcaaagccaataatcctgatatcagtcacagagaagctttcagtacagttgcaaaaaactgggctcattttccccatattcatttcgggctgatgttggagagtaacaaccaagctaagatggataatgtttctgaaaagcatttaatgccaagggctgcgctattgaataaatgaaggctatcttcatcatatcacaggacttgatcatgagtttcatttgagtctgtcaagtaaacaatgtccctgcctcataagggagttttaagggacaatcatctctatcttcttcgttagtggacttggtactacttactaccttggtcaatggatgttttcacttaatttgaagcataaacaaaaaaaaaaaactcgagggggggcccggtacccaattcgccttatagtgagtcgtattacgcgcgctcactggccgtcgttttacaacgtcgtgactgggaaaaccctggcgttacccaacttaatcgccttgcagcacatcctcctttcgccagctggcgtaatagcgaagaggcccgcaccgatcgctcttcccacagttgcgcagcctgaatggcgaatgggacgcgcactgtagcggcgcattaagcgctggtgggtgtggtggtacgcgcagngtgactgctacacttgccagcgccctagcgaccgctactttcgctatctccatacctttatcgcacgttcgccagctttcacgtcagctctaatcggnggctcctttaggtccgtatatgcttacggactcgactcataacttgataggtgatgttacgagtggctcgcctgaagacgtttcgcctggacgtgatccn

SEQ ID NO: 7070 - DNA, 952 bp, Glycine max
  misc_feature (5)..(12): n is a, c, g, or t
  misc_feature (34)..(34): n is a, c, g, or t
  misc_feature (39)..(39): n is a, c, g, or t
  misc_feature (45)..(46): n is a, c, g, or t
  misc_feature (625)..(625): n is a, c, g, or t
  misc_feature (711)..(712): n is a, c, g, or t
  misc_feature (752)..(753): n is a, c, g, or t
  misc_feature (761)..(762): n is a, c, g, or t
  misc_feature (775)..(775): n is a, c, g, or t
  misc_feature (794)..(794): n is a, c, g, or t
  misc_feature (802)..(802): n is a, c, g, or t
  misc_feature (827)..(827): n is a, c, g, or t
  misc_feature (835)..(836): n is a, c, g, or t
  misc_feature (859)..(859): n is a, c, g, or t
  misc_feature (919)..(920): n is a, c, g, or t
  misc_feature (922)..(925): n is a, c, g, or t
  misc_feature (927)..(929): n is a, c, g, or t
  misc_feature (931)..(931): n is a, c, g, or t
  misc_feature (933)..(933): n is a, c, g, or t
  misc_feature (937)..(937): n is a, c, g, or t
  Predicted polypeptide sequence is orthologous to G2510
ccccnnnnnnnnccccccccccaggtgtgatggnaaacngtacanngactatcccctccagcgcgctattaaccctcactaaagggaacaaaagctggagctccaccgcggtggcggccgctctagatttagtggatcccccgggctgcaggaattcggcacgaggattaatggagcaagagcttccacgcagtagcgtccccgacgacgccaccgccgccaccacgagctccgttgacaagcccgccactcctcacgccggaggcacccgccacccgctcttccgcggcgtccgcaagcgccgctggggcaaatgggtctccgaaatccgggagccgaggaaaaagtcacgcatatggctcggctccttcccggcgccggagatggcggcgaaggcctacgacgttgccgcctactgcctcaagggctgcaaggcgcagctcaacttccccgacgaggtccaccggcttccgccgctcccctcctcctgcaccgcccgggacatccaggccgccgcagccaaggccgcccacatgatgatggtccaggctgcctccgccgactcgccggagaaaagcagcagcattacctccgactgcgacggcagcggtggtgacgacttctngggcgaaattgagctgccagaactgctcaacggcaagtggtgggcctccgaccgccacgtaacgccgtggccggagactgagcttnncgcccagctgcccttcaccacggcgtgcttgtagtagttnngtataatnncatatgctcttcncatgctctcatgacttggntggtatantagtacatatattattgctcatatnattaagtnnactctctttgtgtctcttcacantaattaataaattctaattgtgatgatcaaatgtagtggctgtaaaaaaataaaaatatnntnnnncnnncncnatcnctctcacttcatctt

SEQ ID NO: 7071 - DNA, 787 bp, Glycine max
  misc_feature (1)..(1): n is a, c, g, or t
  misc_feature (633)..(633): n is a, c, g, or t
  Predicted polypeptide sequence is orthologous to G2510
ngagatgcgctgtagaagacgacgcgcagctctaatacgactcactatagggaaagctggtacgcctgcaggtaccggtccggaattcccgggctattatgtacattaaaatctacgaataatggagcaagagcttcaacgcaacagtgtccacgacgacgaagccgccaccaccacgagctccggcgacaagcccgccacccctcgcggcggcggaacccgacaccccctcttccgcggcgttcgcaagcgccgctggggcaaatgggtctccgaaatccgggagccgaggaaaaagtcacgcatatggctcggctccttcccggcgccggagatggcggccaaggcctacgacgtcgccgcctactgcctcaagggccgcaaggcgcagctcaacttccccgacgaggtccaccgtcttccgctgctcccctccgcctgcaccgcccgcgacatccaggccgccgccgccaaggccgcccacatgatgatagtccaggccgcctctgtcaccgccgactcgccggagaaaagcagcagcattacctccgactgcggcgacggtggcggtggagacgacttctggggcgaaattgagctgccagagttgctcaacgccaagtggtgggcctncgaccacgacgtcacgccgtggcccgagtacgagctcccgccccagcagcccttcaccactgcgtgcttgtagtttgaataagaataatgctcttcttcaagctccgacttgggtgtatattattatatatattagtatttgctcatatcataa

SEQ ID NO: 7072 - DNA, 787 bp, Glycine max
  misc_feature (340)..(340): n is a, c, g, or t
  misc_feature (787)..(787): n is a, c, g, or t
  Predicted polypeptide sequence is orthologous to G2520
gatgagcttgtacctgattacgccaagcgcgcaattaaccctcactaaagggaacaaaagctggagctccaccgcggtggcggccgctctagaactagtggatcccccgggctgcaggagagctagacgcgaaaagatcagtgagaggatgaaaattcttcaggatatagtcccgggttgtaataaggttattgggaaagcattggtccttgatgagataattaattatatccaatcgcttcagcggcaagtagagtttttgtcaatgaagcttgaagcagtaaattcaagactggcccccagaattgaagtgtttcctcctaaagattttgatcagcanacatttgatacaactggcatgccgtttgcttcccaagctacaagagagtatagccgaggttcatcgccagaatggttacatatgcaggttggaggtggttatgaaagagcaacgtagtctttgaaatcccatcacctgataataaatgcatataggatcattaatctctccatcagagctcccataaatcatatacctcaggtgttgtgtgttagtcctatagacacctcattccctgttttctacaagaagcatggagctgtggttggtttcacaggatcactaggtagtactcaagccacttcatttggtagtgtgttgggaaatgatgcattttccaatgttgtagttaggttgctgtactcttgcattcatacccttaaaaggaaggtagtttcttgggaaacaatgctggtgggctgaatacttcaggcttccattgtgtan

SEQ ID NO: 7073 - DNA, 1009 bp, Glycine max
  misc_feature (1)..(1): n is a, c, g, or t
  misc_feature (28)..(28): n is a, c, g, or t
  misc_feature (30)..(30): n is a, c, g, or t
  misc_feature (653)..(653): n is a, c, g, or t
  misc_feature (702)..(702): n is a, c, g, or t
  misc_feature (898)..(899): n is a, c, g, or t
  misc_feature (936)..(936): n is a, c, g, or t
  misc_feature (938)..(938): n is a, c, g, or t
  Predicted polypeptide sequence is orthologous to G2522
nccggccgtggagctggtgctgtaattncntatagggcgaattgggtaccgggccccccctcgagttttttttttttttttttttttaactcaatgtcaatctctttcaaataggatataaaatacacagtctgtatttaaccaagaacacgaaatcttcaaattaaaattcctcacagctacaaaaatatgagttcaaccctaaagtcaatcatgggtagataggtggcattttatcaaatttccaagagtcagctggcttctactctggtggtggtgcttaccatgctgtagttactactacaggaaaattagatgagtgaccatgaatctgaattatatactcagtactggcatatactaaataaattgtcacccgcgcattaaatcaatgtcaatatgggaattgcgcatatccaatggtcgcgatgcaggccaaggacttagagatgaggttggagtaagattttgatttggggaaatactattcactgcaactggattatgaaccgtctgatgatcagtctccatagcaacttctgcaccttctgaaccttcttttttctttatctttgtctttgatgcaccccatgaaaagctcccaagtatcacctgaactggacttgcagcaataagcacttcaccaactcctncaccgatgacacgaccatcaggactttgcagtgaaacacttaatgcacnagtcgatttgcggtgcaccactatcggcaaccagtaagagcctgaaggcacactatctcaaaacgcccctcatatgtacagtgccaccctgatgtgaggggtttacgagtgtacagtagaaacgggaccattggctgacaaatacatttagctcttagcccctgcttgaggaagggccgggatttggttcatgttnntcaccatggaatgggatagtttttaggtgaaccatcnanttgtaccaaacttatttccccaagagagccaactgtgtttttccaaacccggcgggccctttttgcggttt

SEQ ID NO: 7074 - DNA, 957 bp, Glycine max
  misc_feature (720)..(720): n is a, c, g, or t
  misc_feature (729)..(729): n is a, c, g, or t
  misc_feature (742)..(742): n is a, c, g, or t
  misc_feature (864)..(866): n is a, c, g, or t
  misc_feature (937)..(937): n is a, c, g, or t
  misc_feature (946)..(946): n is a, c, g, or t
  Predicted polypeptide sequence is orthologous to G2522
ccccccaggtgagccgttgaattgatagtctgatcgtgcttaccccaagcgcgcaattaaccctcactaaagggaacaaaagctggagctccaccgcggtggcggccgctctagaactagtggatcccccgggctgcaggaattcggcacgaggtctcgagttttttttttttttttttttactcatcaatgtcaatctctttcaaataggattataaaatacacaagtctatatttaaccaagaacacgaaatcttcaaattaaaattcctcacagctacaaaaatatgagtacaaccctaaagtcaatcactggtagataggaggccttttatcgaatttccaagagtcagctagcttctactctgctgttggtacttcccatgctgtagttactactacaggaaaattagatgagtgaccatgaatccgaattatatactcagtactggcatatactaaataaattgtcacccgcgcattaaatcaatgtcaatatgcgaattgcgcatatccaacgatcgcgatgcaggccaaggacttagagatgaggttggagtaagattttgattcggagaaatgctattcactgcgactggattatgaactgtctgatgatcagtctctaaagcaacttctgcaccttctgaaccttcttttttcctcgagaagcgtgggcacgcctgggtactaaccctcgacggcgacgacggcgacgtncaacaccgnctcacccaacccntaatgattcccttctctcacgcttaccgtctcgcatctaagcactcccggctcgtctcgtcacaccggcaccggcaaatcttctcaacggcttcgacttttctggcgcgcgcccgcgtttcnnnctcgcgcacgaccgctccgataatggggatcctcagcccgttttgcgcatctgtccttcatgccacatctngcataacgncacgctctgcc

SEQ ID NO: 7075 - DNA, 726 bp, Glycine max
  misc_feature (697)..(697): n is a, c, g, or t
  Predicted polypeptide sequence is orthologous to G2536
agtcatggttgatgtcatattttaatgagtcattctctgaggggtctttctttctttaaggtctcagcatgtgcctttgagttagagccaattaaattgttcccattccaattcccacaacggttcttggagttggacctcattattacttttatcattattattattattcacatcccaatttgtgctacttgattctctaacttctagcatctgagagtgtgagccatggagtccctcgaagtgtgaaatttcagaagaacacaatccatccacttttgcacgtgattctgatccatctttctctaatggtcgtcgatcaaatgctcgaaagctccccgatatgacatacacccgacacaagctgaattcccatctcaactgaggggtggattggttagggatatgaatagctctgtactcattcatcttccatttggtttttcttcccataggggccttccctttgtagaacaccatggatttcttcactccaatgactttgttatcagaagagtaaacatagccaggagaacctgttgctttccaatacccacaagctgtggttctgctgggtctccctcccctggcttccctctcttgaccgggcgaaaagaaaaaccattgctccgtgtctccacgacaaagctccccagcaaatgttggaaggttccaaggctcaacgccattgaagtcnataactgggataactctgtctatggctat

SEQ ID NO: 7076 - DNA, 928 bp, Glycine max
  Predicted polypeptide sequence is orthologous to G2536
atttcggtgaaatttgtttaatattagattgtcgtcgtatgaatgaagaatttgttcaaatctttgattcctaaggatttgcatgaagacggggagatattggtaccatagatcacaagatgaagactttgtgataatttatcagacaaattagccactatacacaactttataaagctagcaagaaatctaacaaatatttaaagtagttgttctgcatgcggtgcgacatacacaattaattaacataacctactacttattcagtcatcggtgtagctgagacttgagagtcaactttgttgtagcataccaacaaagcacagatagattggattggatgtgttcatggttctgatcccaagaacatatccactttctcccaatccaaaaaagggtcatcgttgttgtcaacatccatttgagtagcttcctcaccgtgaagagggggttggtcatggtctccggaggaagagctctctgctggtgaacacgttgcacttctctccaccattttatgatgataatcatcatatgatgttgaacccttttgttgctcttctacattttgagcacccgaatagctttctgtgtccctccttggcggtggtcgtctatcaaatgctgtcaaacactttgattttttgtacactcgtgggactagaggatgatgttttgatggcagtgtactcattcatcttccaatcggttttggttccgtttggagctcttccactatagaaaaccatagtccttttaattccgatgatgcgattatccgaagaataaacatgattaggagaccctggtgccttcccagtacctgtagttgtgagacgctttggtctccctcctctcgcttcactctcttgcctcggaaatgaaaaaaaccattgctccgtgtctctcatacttgcctctcctgaaa

SEQ ID NO: 7077 - DNA, 856 bp, Glycine max
  misc_feature (42)..(45): n is a, c, g, or t
  misc_feature (747)..(748): n is a, c, g, or t
  misc_feature (791)..(793): n is a, c, g, or t
  Predicted polypeptide sequence is orthologous to G2550
gcactcatagattgatgtagaataagagaagaagatcaaccnnnntttttcctctcaacctatacatgacaacaaactattgcatttcattttttttcgtttcctcaaataaatgccaagcatttaatatcccaaaaattaagttaaatataaaataaatgttcatttagcagcaggtcacataatcttctacgttatacagattgctcatctacaaaaccatgcatcattcattcacctacaacctttctacagcttacaacagttattaaccagggttatcattttatcaacatcaacatcaaatccattattctgatctacaagctggaacggtgatcatcagatatggtctcttcagaagaagtgtcactatcaatgatgatcaagttatccggtttgtggacacgttgttccagagacttgttcatcttcaccaccccatattttcttcttgaataggttgaatagtgagacccatttgacatgtatatctcatttggcgtcaaaccattgaaccaattttgaggcacaaagcatgacttaccagcactaaagcatcgatctgaagttcctggtatctcaggatgagaactcaacgaaatcgctgcagacatatttggttgaataggaggagtgttaactgcttctctgagccagtgaggcaaactatttgtcacagccgaacaattaaaggaataatcgttcgagtaagagttttccctagaaatgcccaagcttcctggnnaattgaaaaatcctaattcatacttgtctatattgttgtaagnnncctttctggaatgaatagttggcctatgactgtgtgcagtggtgttactttgaaaattatatc

SEQ ID NO: 7078 - DNA, 846 bp, Glycine max
  misc_feature (1)..(2): n is a, c, g, or t
  misc_feature (369)..(369): n is a, c, g, or t
  Predicted polypeptide sequence is orthologous to G2567
nnggggtgagccacattgtattacgcatctaatacgactcactatagggaatttggccctcgaggccaagaattcaagcctcagaagtatgatccacaacttcatcctgcacaaacctctagaagaagtccaccttctcagataatgaaaagggatgatgatgctcatagacatattttagcatggagcatgagacagacagatcttaaaactaggaaagtagaatttttttggtctattcatatgcaatgtgcctagttttcaaattttgtttcataggggagataacaggtgccttatcaagtgtaagtctcattgaatttttcttacttagtgcccccccccccccccccccaatgtaaatgtcanctgctgcctttaatgtgtatttaaatgccttgttgtaaaaaaaaaaaaaaagcttattccctttagtgagggttaattttagcttggcactggccgtcgttttacaacgtcgtgactgggaaaaccctggcgttacccaacttaatcgccttgcagcacatccccctttcgccagctggcgtaatagcgaagaggcccgcaccgatcgccctttccaacagttgcgcagcctgaatggcgaatgggacgccccctgtagcggcgcattaagcgcggcgggtggtgtgttacccccagcgtgaccgctaacttggccgcgccctagcgcccgctcttttcgttcttcccttctttttcgccccgtcgccggttttcccgtcagctcttattcggggctccctttagggtccgattaaggcttacggcacttgaccccaaaaccttgatagggtgtggttcagtagtggccatcccctg

SEQ ID NO: 7079 - DNA, 883 bp, Glycine max
  misc_feature (1)..(3): n is a, c, g, or t
  misc_feature (518)..(518): n is a, c, g, or t
  misc_feature (658)..(658): n is a, c, g, or t
  misc_feature (758)..(758): n is a, c, g, or t
  misc_feature (883)..(883): n is a, c, g, or t
  Predicted polypeptide sequence is orthologous to G2592, G2713
nnnccgtcgtatctcgtttttaaataccactcgcacaatccaccctcactaaagggaacaaaagctggagctccaccgcggtggcggccgctctagaactagtggatcccccgggctgcaggaattcggcaccaggttttaaggctcctcacttttcaaaggtttcagttgtgacatcctccaagtgacaagagtggaacattcattcctttagtggcactttggttatatattaaattctgggctgtgagtatattagaacaaatgtccttccgcagtatagttcgtgaagtaagggatggatttggaagcctatcaaggaggagttttgaggtaaggcttcctggccataacaggggcaagtcacgtagtttggtccacgagttgcaggatcagccaccagttatacagaacagccggtgggctagccttcctcctgagcttcttcgcgatgttattaatagattggaagcaagcgagagtacatggcctggtcgtaagcatgtggttgcgtgtgnctgcgtgtgcaagtcctggagagaaatgtgcaaagaaattgtcagcagtcctgaaatctgtgggaagattactttcccttgttccttgaaacagccctggcatagggatggacccatccatgtttcatcaagagagacanatctaagctgacataccacctcttccttgccttagccctgcctttgttgttgaaaaagggaagttcttctctctgcaaacggacaagaggaacacttgcncaagagttgtatatcaatggatgcagatacaaaatcagatctagagacctatatgggaaaatgaggctaattcttgggaccaggtattaattaggacccaactccttcaaaaaaggctttctttn

SEQ ID NO: 7080 - DNA, 1150 bp, Glycine max
  misc_feature (1)..(3): n is a, c, g, or t
  misc_feature (801)..(802): n is a, c, g, or t
  Predicted polypeptide sequence is orthologous to G2592, G2713
nnnggaaggcagcggggggtgaggaaataggattcatgcccactgactacgccaagcgcgcaattaaccctcactaaagggaacaaaagctggagctccaccgcggtggcggccgctctagatctagtggatcccccgggctgcaggcaacagtacctttgacttgtcaaaatgaggggacactggtattacgaaacaagtccccaaggtggcatgaacaccttcaatgctggtgtctgaacttcaatgggcgagtgacagttgcttcagttaaaaatttccagctggttgcttctcccaaaaatggagtttctgagcaggctcaggaaaatgtaattctacagtttggaaaagttggaaaggatgtattcaccatggattatcagtatccaatctctgcctttcaagcatttgcaatatgccttagcagctttgacaccaagattgcttgtgaatgattgctggcatagacagatgttaaccagtcgtgctgctgattggaattgcagaaacagtgatgcgggtcaaataccgactatagatttttctgcttttctatttagtacaaccaagtttcagaatccccctccccttccctttctttttatctattgtatatatggttgtttgtgtgcattatatttaaccagcgctgatttgatgttatgttttttgtgtgccagtttgcagacgaaaattcttctttttttttttttttggagttggagatgaacttgggtgggattgttttggagctttctgctggtttggttgatgctttgcttttgcaaaaaaaaaaannaaaaaaaaaattaaggggggccccgttccattcgccttatggattgttttaaccccctcttggcgggtttcaaatgggaattggaaaacttggttccacattaatgcttggcacattcccttcccattgctatatgaaaagcccaacgaacccttccaaattgcccactaattgaatgaacccccttacggcttaaacgcgggtgtgggtaccgcaggacacctacttgcaaccctagcccgttttgtttatccttttttccatgcgggtttccgaaactaaaggggctctagggcctattgcttcggccacccaaaactaggggagtcaaggcccccttgacgttcc

SEQ ID NO: 7081 - DNA, 926 bp, Glycine max
  misc_feature (583)..(583): n is a, c, g, or t
  misc_feature (652)..(652): n is a, c, g, or t
  misc_feature (754)..(754): n is a, c, g, or t
  Predicted polypeptide sequence is orthologous to G2592, G2713
ttcacttacaagcgctgctttatccctcactgaagggaacaaaagctggagctccaccgcggtggcggccgctctagaactagtggatcccccgggctgcaggaattcggcacgagcgcacctggaggaggctcatcgtcaaggagattgtcaagccacctcaattctcttccaacataaccttccccatctctctcaaacaggttcagtgctctttctctctattcaaattaaatcaattttgtttattttcttgctttaaatttggcagcctggcccgagggaacatctacttcagtgcttcattaggcgcaacagtgcctcacagacatattatctgtttctcagtttatctagtgccctagtagctgatgatggcaagttccttctggctgcacgcaagttcagacgccctacctgccacaatatatattatttccttgatgcagatgatatgttcagagaaagcaatgcctatgttgggaaaattgagatcaaattttttggggaaccaagtttacaatctacgatagaaaaagttgtttcactgagctggtggtgaattcaaaacaagttcacctangcccagggtcccaacaggcaactatccagttgctcacatctcatatgaactgaatgactatgctccagnggcccaaggagaatgcactggcatgatacattctgctctgtattgaccagaggtagcgagcagccatccagactgattctgtagtacagaaactcatccatnttcaacaactcactagtctgaaactcatattgagacagagcataaaaatgtgtctatgtggaacaggctgcagtgcatagccctgcatggtgctaactcttgcgatacattgtagtaaacttcactgctgtacagaaagacgctgctgcgaggatagtctcattgtatatgg

SEQ ID NO: 7082 - DNA, 913 bp, Glycine max
  misc_feature (82)..(82): n is a, c, g, or t
  misc_feature (127)..(127): n is a, c, g, or t
  misc_feature (729)..(729): n is a, c, g, or t
  Predicted polypeptide sequence is orthologous to G2592, G2713
acaaccaaacttcactcttactctcctctctcacctctcttttcctcctcctttttcttccttctctccagactacggaccnaacagaccttaagcaaacgaagcactaatcatccctccctttggntcctctcccctcggatctttatagggagctccaccgcgagggcggactccctacaactagatgaacccccgggctgcaggaattcagcacgagccctttccctggaggactcgttccggagcatctcgttatcaaagactctagatcattctattgagttcagcagatcgcgattctctgagattggggaatcctgcatcgaagatgatgatggcaagatgagacccttggttctgaaaaacaagcctccaagatggcatgaacagttacaatgttggcgccttaattgccgtggacgagtaacaattgccgctgctaaaaactttcagctgattgctgccacccaaccagctgctggtgcacctacaccatctcaaccagctccaccggagcacgataagatcattcttcagtatggcaaagcagggaaggacatgttcaccatggattatcggtaccctttatctgcattccaagcttttgcaatatgcttgagcagctctgacaccaaattggcttgcgaataagataaatcatgaatcacaagggttataagtgagctaatgaaacaatgatgatgatggtatatatccctttgattntctattctttatctatcttcattatcagtatcacgagagcaggcaattgtcgatactcagcttttgtatgactaaatagtaaccgcagtgcatctccgatgtaatagaatttagagcactattacatacaacgttgctatgtttcttctcaggtgattctaccacaaaccatctctcacactaa

SEQ ID NO: 7083 - DNA, 724 bp, Glycine max
  misc_feature (647)..(647): n is a, c, g, or t
  misc_feature (666)..(668): n is a, c, g, or t
  misc_feature (678)..(679): n is a, c, g, or t
  misc_feature (685)..(687): n is a, c, g, or t
  misc_feature (708)..(708): n is a, c, g, or t
  Predicted polypeptide sequence is orthologous to G2592, G2713
gtgttttttggttcaggagagcctaccataggaagaagcccattacactgcagggaagcaacacatagatagtttgctgcagagaagaaaaggaaaagcatataagaaaaattacattgagcacaggttgttctgtcctttacagttatactctggtgtaaaatgactccatgcagcttcacctcccagtgaataaataaatggagatagaatcctattgtctttgtaccacacctctcattgtcactattcacaagctagttttgtgtcaaaactagtcaagcaaatggcaaaagcctgaaatgcagataggggatatctatagtccatagtaaatatatccttgccaaccttgccaaactgaagaataatcttgtcatgatcagactgcgctggctgcgatgacggtgtaggagcaccggctgcaggtggctgcgtcgcagcaatcagctggaaattcttgacggaggcaacagtcacccttcctctaaagttcaggcaccaacactgcagctgctcatgccatcttggagatttgttcttgagaactaaaggcctaccctttccctgctcctcttcgttgcccgccacaaatatgtccgagaacctggagctgctgaactcggttgagttgtcaatcgatctancaaaggatatgctccggannnaatcttcganngagcgnnnaaggagctctggctggcccgnacagtgcaccaggctc

SEQ ID NO: 7084 - DNA, 1022 bp, Glycine max
  misc_feature (536)..(536): n is a, c, g, or t
  misc_feature (555)..(555): n is a, c, g, or t
  misc_feature (678)..(678): n is a, c, g, or t
  misc_feature (686)..(686): n is a, c, g, or t
  misc_feature (1022)..(1022): n is a, c, g, or t
  Predicted polypeptide sequence is orthologous to G2604
agctatgccttttgcataaactttgctgctaattatcccaagcgcgcaattaaccctcactaaagggaacaaaagctggagctccaccgcggtggcggccgctctagaactagtggatcccccgggctgcaggaggaaacattggtagaagaaattggagagagagagagagagagagggttggattggttttcttcttcctcttcctaaagagaatctaatctcaatcctcattacacacatatctacagatttcttcattcctctctcaatcttttctgttttcttttcccctctttgacatcctcgttttcgccgaaacaaaaacaactaagattttgttttttgttgtatttttcttcctgttgttatttgactcggttgtctgaatcagttgttgcagcagggtcgggagccacagctatgcagagccaagttgtgtgcaatggttgtaggagccttctgctttacccaagaggagcaaccaatgtctgttgtgcattgtgcaacacaattacctctgttcctccacctgngatggaaatgtctcaactntattgtggaggttgtaggacattgctaatgtacacacgtggagctacaagtgtgagatgttcctgctgtcacactgtaaaccttgttccaccagcatctaatcaagtggctcatgtccattgntggaactngccgaccacactcatgtatccttatggagctccctcagtcaaatgtgctctttgtcacttattactaatacaaacaatggaaggcttccaatcccctgccatagaccccatgggacaaacaatgctgggacattaccctctacatcaacattcatgcccccatctaaagttaaaacgggtgtgtagaaaatccaatgcttgtggatcaaggggggaaatggtggagcatatgttgtgttgcggtccaacgggtaagaattaccttattccactttaaaaggtcccgtcccgtcatggacgcatcccccattgctgccccgggaagaatttgtgggn

SEQ ID NO: 7085 - DNA, 886 bp, Glycine max
  misc_feature (1)..(1): n is a, c, g, or t
  misc_feature (12)..(12): n is a, c, g, or t
  misc_feature (17)..(18): n is a, c, g, or t
  misc_feature (65)..(67): n is a, c, g, or t
  misc_feature (71)..(71): n is a, c, g, or t
  misc_feature (326)..(326): n is a, c, g, or t
  Predicted polypeptide sequence is orthologous to G2604
nagtgacgaacngtcanngcactagtccgagtcgcgcattggctattactacacgggggcaaaannngaanctctaccgcggtggcggcctctctagaactagttgatcccccgggctgcaggttttccttcgcttttatttctctctctacttagtcagcagcaactggcaagttatcacaggacatgttataatctaatgtattttccccttccacattacataaatacaacttccactgaaaggccttaactcttagtctttcttattccttctggaatcctcccctttagtttcattcataaggggaagaagcaactcattntgactcttactttatcatctgctttaccatttgatttgctggcaccctcttcttcacgggagctgaaaaaaatgggagaaagtgctttgttctctgtgtagagtttggcagagaaagataacaacattttttagccctttataatgccagttccacttgccccatacccaacaccaccagctccatatacaccaccagctaatggtgtacagagtcaacttgtctgttctgggtgcagaaaccttctagtgttcccagttggagccacctctgtgtgctgtgctgtttgcaatgctgtcacagcagtaccacctcctggcacagaaatggcccagttagtatgtggaggtttggccattacttttaaccttcaatggtctaaccaatttctccggggggtgggcccggccccggaacaccaaaaggtttgggcttgggcccaaaatttggggtcttttcctctttgggtttttgtgcgggtttcccccccaaccccaccaaaccacccttttggtgtgggttttgcccaccacaaaaaaaatttgtactccccctcctta

SEQ ID NO: 7086 - DNA, 1054 bp, Glycine max
  misc_feature (1)..(1): n is a, c, g, or t
  misc_feature (754)..(754): n is a, c, g, or t
  misc_feature (840)..(840): n is a, c, g, or t
  misc_feature (853)..(853): n is a, c, g, or t
  misc_feature (870)..(870): n is a, c, g, or t
  misc_feature (906)..(906): n is a, c, g, or t
  misc_feature (920)..(920): n is a, c, g, or t
  misc_feature (937)..(937): n is a, c, g, or t
  misc_feature (947)..(947): n is a, c, g, or t
  misc_feature (1051)..(1051): n is a, c, g, or t
  misc_feature (1054)..(1054): n is a, c, g, or t
  Predicted polypeptide sequence is orthologous to G2649
ngggcgatcaaccgataaatgcccgtttgcattaaccctcactaaagggaacaaaagctggagctccaccgcggtggcggccgctctagaactagtggatcccccgggctgcaggcgagtttttttttttttttttttttggttataataagatacaaacttagaagaatattaatattaattaatctataccctccaacccacccccaatgttggaaaaataagaaaagttaccctacaataataagtcaagctttccaagcccatccatcatcatctacgttacacttggaaaaaatgatttttaatttattggatgattaccatagtttgatgaacctccaagtagcaaccctccacctgaagctgcatagacatcatgagaacgatccaccattggagatgaagatgaaattccatttctaccaccatcactttcacttgtaacattttcaccaacaccaccactcaaatgtaattcagataaattagggtacccttctttgtcctcaaccccttgatcatagagaaaccctttgaagacatggccaccaatcttcacaactgcttgatacgcatactcatcttccccaccatcatccactgatgttacacgaacacacttgaacactgctggtgcacgcacttgacttgtagtgactccttgaacccacatcttggggctacaaccaggtcaaactcctcggaggatgtatatttagaggtgagtatgcgaagagtttgagagcaacangcctaggttcttggcacccgagtggcccattgacccaccgacgaccgggcgcgcaccccttgactgctctccttcgcgtgagcggnaacagtgctcttnacgtgtgagcataaaanctatcttgcacacgctgcaactctggatacaactcnttgctgttcaagcnctgagtgctagcgcatncccaacgtangctagggactggtgtgcgcgaaactgtctctacttagtatttacgggatgtcattctctctgcgaggcggcggttgaagactatctgctccctgtggttatgtnaan

SEQ ID NO: 7087 - DNA, 764 bp, Glycine max
  misc_feature (1)..(2): n is a, c, g, or t
  Predicted polypeptide sequence is orthologous to G2655
nnaagtgatgctagtgtattaccccaagcgcgcaattaaccctcactaaagggaacaaaagctggagctccaccgcggtggcggccgctctagaactagtggatcccccgggctgcaggtgaacgagtaccttgccgtgcttagatccttgatgcctccttcttatgtacaaaggggtgatcaagcctctattattggtggcaccattaacttcgtgaaggagctggagcagcttctgcagtgcatgaagggccagaagaagagaacaaaggagggtagtggcttctctgactcttcacccttttctgagttcttcatgttcccccagtactcgacacgtgccacacagagcagcagcagcagcagcagcaaaggctaccctggcacgtgcgaggccaataacaacatggcacggaacccttcatcatgggccgtggcggacatagaagtgaccttggtggatggccatgccaacatgaagatactctgcaagaaacgaccagggatgcttttgaagatggttgttggtcttttaagtcttggtctcagcattctccaccttaatgttaccactgttgacgatatggtccttacctcagttagtgttaaggtagaggaagggtgtcagctgaacacggtggatgaaattgcagctgctgtgcatcaattatcacgcacagttcaggaggaagctgtgttcagctgatcatttaactttgaaatacttaaaggctacgtattgcaccatctttttttaaataatg

SEQ ID NO: 7088 - DNA, 772 bp, Glycine max
  misc_feature (3)..(7): n is a, c, g, or t
  misc_feature (746)..(748): n is a, c, g, or t
  misc_feature (750)..(751): n is a, c, g, or t
  misc_feature (753)..(753): n is a, c, g, or t
  misc_feature (760)..(761): n is a, c, g, or t
  misc_feature (764)..(766): n is a, c, g, or t
  Predicted polypeptide sequence is orthologous to G2702
gcnnnnnacctgctagcttgttaacttgtgagtataagggcaaaaaataccagtatactattatacaaggctctatggacatcaccatgcagtgtgcctgcaaatctaggttctggaggaaaaccattaaaattggctcattggtcagtatgaaaaatcaagaaacggaaaggaggaaacatctaatttcatcaactcctcaaagtcccattctcctgtggcagtggcagtggctaactcttgttgaaacaaattctccaccccatcatgagccttattttcacctatgccaatgttgcagttattaagaatactatttatgtcatcgtcaaagtaactgctgttagttgtttctctcctgctgcatgtagcattctctaggggaggaacaaacatatccccttctaccccgatatttacacttctcccaaatactccgttttctaaataacaagaacctaatttgttaacttcactttgcgaaaagcaaggaatacctgtgccttcgaagtaccctccagaagctggcatgtttagtccatgctccagcataggcaatctgtcaatcaaggtattgaaaactgtaccggtttgcattattgatggtgatggagatgaaccgaacataggaacaaagcctgcgtgttgattatgttgtgtggaaataaaccctcccatgttgaggtctttattactaggctcggatattgaggtctcgcttgcatttgatgagggtgagggtgagnnngnngnggtccgnngannncatatt

SEQ ID NO: 7089 - DNA, 995 bp, Glycine max
  Predicted polypeptide sequence is orthologous to G2717
cagaaggaatttgaacgaattcccattcatctaaacatctactttctataaacaaagtacatggacagagtgctaaggtaacgacagcactaaagaaattacaataaagattcaaacaatggttctatctacaagaaggatattccaagatccaaaaatatagaattaatctcctaataaaggtgaaaccagcatagtcacaagagcctccaatattatatgcaaaatatatagacaatgccagcaaatgatatttagctggctggctgtcctactcaatgccatggttcatctctcctcatgtctaattcttcaaacttccattaagtatggatcctctttggggattttctccctttcgctgatttcgttgtagcatctgcaaaagcttgtgcagcctccgcatcagcttctgctgcctcagcctcctttgctgcctcctctgcttctgcaatggcggcttctgcttcagcaactgctcgggcagcaaatgcagctgcctcttgtggagtcatagaccttatcttttctaactctaaatctatctgagatctagtaaggatgttggtctcatccctgtcaattttcatagaggctttctgcctccctttcaaatatagcatggatgagtttcttcttctgtcagaatatgctgctataggtgcaattctatacttgcgatttacctctataaaagctgcaatagctgtcttattagaaccaccattctccttcaagctagtgattgcatccattataagcttatccaaacttaaattagacctctttggaccaggaatatgcacaatatctctagaaacttgaagaggcttaacatcaacaatctcttcgtcacttggaaacacaggagtgatagccatggagttctcatcctgtctcgggacctgatgcacccttctgactgataacctagatttttccctagagctccatccatttgccatcacgctcagatttctccatttatcctatcc

SEQ ID NO: 7090 - DNA, 652 bp, Glycine max
  Predicted polypeptide sequence is orthologous to G2719
ggtaggttggaccatgcatacgtcagcgcgcattaaccctcactaagggaacaaaagctggagctccaccgcggtggcggccgctctagaactagtggatcccccgggctgcaggaattcggcacgaggatcgtcctccgcgtcagggacgccttgcgaatcaccgcttttacaatcgcactccccacagtctacttcactgcctcaaatcccttcatgccctcctcatcgatgcagaggaaaatgcgattgcgaaagtttctttcccgttagtttggtgggacgcgagaaagaggattatttgaaaggactgtggtaaccacaacaatggcggctacaaggtgtcatcggcgacgattccagtcgaatagagatcgaagactgatttttttcctttttcctttttttttaagttgctaggggaatctttggcattgcgaaattgcctgtaattactgattacctttgtttctgtcttgtgaattaatgagaacggggaagcagatatgaagaaatataaccttgcttggctcggcgctccctcctattgtcccgaccgccttcctcgcggggggccccgtacccaattcccctattgtttgccgtttcccccccctccctgcccgcggttttccatcctcccgctggtacc

SEQ ID NO: 7091 - DNA, 754 bp, Glycine max
  misc_feature (1)..(1): n is a, c, g, or t
  misc_feature (486)..(486): n is a, c, g, or t
  misc_feature (524)..(524): n is a, c, g, or t
  misc_feature (542)..(546): n is a, c, g, or t
  misc_feature (549)..(552): n is a, c, g, or t
  misc_feature (554)..(565): n is a, c, g, or t
  misc_feature (567)..(571): n is a, c, g, or t
  misc_feature (574)..(575): n is a, c, g, or t
  misc_feature (577)..(580): n is a, c, g, or t
  misc_feature (585)..(586): n is a, c, g, or t
  misc_feature (589)..(591): n is a, c, g, or t
  misc_feature (594)..(599): n is a, c, g, or t
  misc_feature (602)..(602): n is a, c, g, or t
  misc_feature (604)..(604): n is a, c, g, or t
  misc_feature (608)..(608): n is a, c, g, or t
  misc_feature (610)..(610): n is a, c, g, or t
  misc_feature (615)..(615): n is a, c, g, or t
  misc_feature (617)..(620): n is a, c, g, or t
  misc_feature (625)..(625): n is a, c, g, or t
  misc_feature (634)..(634): n is a, c, g, or t
  misc_feature (659)..(659): n is a, c, g, or t
  misc_feature (661)..(661): n is a, c, g, or t
  misc_feature (673)..(673): n is a, c, g, or t
  misc_feature (678)..(678): n is a, c, g, or t
  misc_feature (682)..(682): n is a, c, g, or t
  misc_feature (692)..(693): n is a, c, g, or t
  misc_feature (709)..(709): n is a, c, g, or t
  misc_feature (727)..(727): n is a, c, g, or t
  misc_feature (739)..(739): n is a, c, g, or t
  misc_feature (746)..(747): n is a, c, g, or t
  misc_feature (751)..(754): n is a, c, g, or t
  Predicted polypeptide sequence is orthologous to G2743
nggagcgctggtgaagcttacgccaagcgcgcaattaaccctcactaaagggaacaaaagctggagctccaccgcggtggcggccgctctagaactagtggatcccccgggctgcaggaattcggcacgagaacaacttgtccgtccgattggagaatcatgctcttattctacatgagcaggatactcttgaggatcttgctgatgcttctgggaccgaatttgagattcctgcaggttttgatgatcaggttgacattgatgatgccaatatgaggacttattggctgtgatctagagatattgctatgcacaatcagcatgatttgtgttcacaatggaaacaaatgtgcactgctggttcaactaacattagacttctagaaatagtttatgttttatagacaaactatttctggaagccctgtgaattatatgattgtggacttacaattttcttacatgagttcctgtacatccctttgngaccagatttcatttatataatgtgaatagttcagttntgtctaaaaaaaaaaaannnnncgnnnncnnnnnnnnnnnnannnnnaannannnnacggnnacnnnggnnnnnnacnanaggnanataanannnnggatnccggcaaanagaaccaaaaaaaaagaaaagaggncnggggggggcccncgccnccanccctctattnngggatatgacccctanggaaggggaggtaagggnggaagggaaaanccgcccnnccgnnnn

SEQ ID NO: 7092 - DNA, 999 bp, Glycine max
  Predicted polypeptide sequence is orthologous to G2754
gaagaaaataaactgttaaattaaggtttattgtatccaaaccaattcactttcgccactacacaagtagaatgttcaattccaactcgcaaaaaacatatccagagtagcttcatttctaaacatagttccgttagaagcatctacaaaaaatgaatgccatccagggcattaccaccgtgacataaaagaatgtttcaaaaagccattccatcttataccacaaaaagcaagttttttatactccggccataaatagtgacaagaaactagcagttaagagtagagagcatgcccccagtcgcagttggaatcaccacctcccaccccggccctttaagaggaaaggcactgactggagctttgaagttatcatcgtttgagtcgttgactataagatcactgcgatccaagagcttctccaggtcttcatcactaatatctgtatgtatctttttatcttcggctgtttcttcatcacgaagcaatgccaaaacatcatcttcctcaatttcatccatactggcaggttttgtacgttcttgatgaaattgtcctttctcaatcactacatgctcaagcttcaatttgctgaaagctcttttcaacatgcgaccctctatagattgggcagttgagagcctgtaaacatgaacaggtttagtttggcctattctatgacatctatccatggcttgtaaatccatttgaggattccagtcactgtcataaagaatgcatgtatcagctacagtgagattgattcccaacccaccagccctagtagaaagaagaaaactctacaattgctatttacatcattgaagtcctggatctgttgtttcctctcttccagtttcacactaccatcaatcctgcaaactgcaaagcctttttcactaaaaatataatccattatatctaacactttagtccactgactgaagataagaactttgtgaatccttgaaaataaacggtgcagcaatcgatcaagca

SEQ ID NO: 7093 - DNA, 938 bp, Glycine max
  misc_feature (29)..(29): n is a, c, g, or t
  misc_feature (34)..(34): n is a, c, g, or t
  misc_feature (40)..(40): n is a, c, g, or t
  misc_feature (42)..(42): n is a, c, g, or t
  misc_feature (630)..(630): n is a, c, g, or t
  misc_feature (692)..(692): n is a, c, g, or t
  misc_feature (808)..(808): n is a, c, g, or t
  misc_feature (854)..(854): n is a, c, g, or t
  misc_feature (886)..(886): n is a, c, g, or t
  Predicted polypeptide sequence is orthologous to G2754
ccccagaggcgcggggagtggagacgagncctcngggcangnaagtatcgatgcgcgcattaaccctcactaaagggaacaaaagctggagctgcaccgcggtggcggccgctctagaactatgtggatcccccgggctgcaggaattcggcacgagataaaatgatacatacagatattagtgatgaagacctggagaagctcttggatcgcagtgatcttatagtcaatgactttaacgatgataacttcaaagctccagtcagtgtgtttcctcttaaaggaccagggtgggaggtggtgattccaactgcgactgggggcatgctctctactcttaacagctagtttcatgtcactgtttatggctagagtttgaaaattttcctttttgtgggatgagatggaagggcttttctaaacagtctcatgtcacggtggtaatgccctggatggcattcattttttgtagatgcgtctaacggaactatgtttagaaatgaagctactctggccatgttttttgcgagtcggaattaaaaaaaaaaaaaaaaaaaaactcgagggggggcccggtacccaattcgccctatagtgagtcgtattacgcgccgctcactgccgtcgttntacaacgtcgtgactgggaaaaccctggcgttacccaacttaatcgccttgcagcacatccncctttcgccagcttgcgtaatagcgaagaggcccgcaccgatcgcccttcccacagttgcgcagcctgaatggcgaatgggacgcgccctgtagcggcgcattaagcgccgcgggntgtgtggtacgcgcagcgtgaccgctacacttgccagcgccctacngcccgctcttttcgtttctcccttcctttctngcacgttccgcggctttccccgccagctctaattcggggccttcctttaggt

SEQ ID NO: 7094 - DNA, 793 bp, Glycine max
  Predicted polypeptide sequence is orthologous to G2763
ggaaagagaaaaatagatgtatactatgcaattagaaaacaataaacagaaagaaagcttctttgggggcaagggtgaaagaaaacgagccaaataatgatgatgatgatgataaaaattaaaaaaattgacagacacatgacatggcatggcatacatacataaaggcctagagccaaaagtgtcttctatgacgagctaggtggcgcggaaggggaggcggcggcgccggaagaagaagaagaaccagagagaaggttaaagagagcgctcatggctcgaacctgcatctcaagcgcgggtatgtaatcaatggcttcttccaaaataaccggtaacggttctttacggcaaccgggaaccaagcgtgcgaggaacctcacttttctctgcacgcccggtgaacccttccccttcagccggtaaacgctgacccggggtttctttgaccgggttgggggcgttgtaagtctctgccgcttgtgtttggtgaacttgagcttgagccggttggtgaggatggctcggctccagcgcgtcatccccttggctgtcacggctaggactctgtcggcggcgtcgcgcacggctttgcctcggcgcggcggcggcgccaacccgagattcactctggctaaggcttggcgcagcttggaggagtagatttgttgctgcgcttgggatttccacttgggattgctctgatcctcttgccgttgttgctgctgcctcagctgcgctttcttcttcctccgtttcgcgtcacgtgaccggtccgtgttccgacagcaac

SEQ ID NO: 7095 - DNA, 897 bp, Glycine max
  misc_feature (1)..(2): n is a, c, g, or t
  misc_feature (26)..(26): n is a, c, g, or t
  misc_feature (691)..(691): n is a, c, g, or t
  misc_feature (766)..(766): n is a, c, g, or t
  misc_feature (783)..(783): n is a, c, g, or t
  misc_feature (823)..(823): n is a, c, g, or t
  misc_feature (864)..(864): n is a, c, g, or t
  Predicted polypeptide sequence is orthologous to G2763
nnccggcgagtagtgtctcgcatganttatcgcttgcgagcaacctaccctcactaaagggaacaaaagctggagctccaccgcggtggcggccgctctagaactagtggatcccccgggctgcaggaattcggcaccaggcgacgcgccacgccgcggcagggcggtgcgcgatgccgccgacagggtgctcgccgtggccgccaaggggaggacgcggtggagccgcgccatcttaacgaaccggctgaaggtcaagttcaggaagccggttcacaagaggcagaaggttgttgttgttgggccgggccggccaaagaaaaaggcccggttcagcgttctccggctcagggggaaaaccttacccgcggttcagaggaaagttagggttctgggccggttggttcccggttgcagaaaagaaccgcttccggtgattctcgaagaggccatcgattacatacccgcgctcgagatgcaggttcgcgccatgcaagctctcgctgacttactcttaggctcttcctccgcctccacctccgccaccgccgcgccgcctagttgatctcactttccggcgattatgccacgtttcatatattttttttccttacttttgttattatttgcctcgttttcaccctcactctactcggcttatgttaattgccaagtacatacaaaaaaaaanaaaaaaaaactcgaggggggcccgtaccccattcgccctatagtgagtcgattcgcgcgctcacttggcgcgttntacaacgcgtgactggnaaacccctgcgttaccaactaatcgccttgagcacatccncctttcgcaggctgcgtaattacgagagcccggacgatcgnctttccacaagtgcgcagctgaattgcaatgga

SEQ ID NO: 7096 - DNA, 485 bp, Glycine max
  Predicted polypeptide sequence is orthologous to G2774
ttttttaattttttttttctcagaagggagaaaagaaacttaattttatcaaagagtaagactagtacataattattgatgaatagaatttagtgttgtaaactatgataatagtagttacttttttttcgtttggctgattaaattaggcactaggtaattcaatttaaccgtaagcctaaaaaatgccccttttttgccttcagttgcatgtgcctatgatgacaaatcagaagcttagcaataaaattacaactctacaaaagttggtttcacctttgggcaaggtgagtcatcattgctaacccctaatggacaaaaactagatccttcatttcttactagcataataaacacctttaagaaagtgtggccttggctttctgaatatcctgcagactgacaccgcatcagttcttcaggaggcttctctttatatcaagcttcttcaagcacaaatccgggtacatatttgatcctcgtgc

SEQ ID NO: 7097 - DNA, 780 bp, Glycine max
  misc_feature (643)..(643): n is a, c, g, or t
  Predicted polypeptide sequence is orthologous to G2777
ggagggggtggttgagagactctgatcatgattacgccaagcgcgcaattaaccctcactaaagggaacaaaagctggagctccaccgcggtggcggccgctctagaactagtggatcccccgggctgcaggaattcggcaccaggaaacttttcaacctcgtggcactgataatggatcaagtccatctccaacactgctgtttgcttcaaaggttgacgagaaaaatattaccatctcccaaacaattcctgggagtacccagaatgtagaatctggcttgagctcagcaactacccccaagacaatggatcatcatgctggaatgatgaacaaggcttttccaattcctattccttcacagctaaatttcttcactccaacccaaataggtggtccaggtggagtagtatctcagctaacacatagatcagcatcagatgctgagaaaactaaatatcaaccttcagtggaatgtcagactatgactgctaccaatgaaaagctgaaagagaaagagctcactattgaaggtggtgccattagcatatcaagcgtttactcaaaagggttgttgcatacgcttacacatgcacttcaaagttcaggggtggatttgtcacaggctagcatctcagtgcanattgaacttggtaaacaagcaaacatcagaccaagtgtaccagtgtcatgtgtgctgctaaggatgggtacgttcattctaacaataaaagatgatgcgctctagagtgctgctccttgagggttacccagcagtaa

SEQ ID NO: 7098 - DNA, 831 bp, Glycine max
  Predicted polypeptide sequence is orthologous to G2777
tacttatatgatttagaaactaaaataattcattttattttgttggggtgagcctaatgatcccaacaaactaagaagacactgaatgtacagtcgatctcccccacgctggataataaagccagcagaagacataaaataccccttccaaaaattaattttaaaaagttaccccaaataattagtaagaattgtaataaagaaagaatgaatataacggtcgaattaacttctgcaagtctttagcttcttaactgcttggtcagacttcccagagctagcaactctagagcgcatcatcttttgattgttagaaggaactgcaccatccttagcaccacacactgacactggtacatttgatctgatgtttgcttgtttaccaagttcaatttgcactgagatgctagcctgtgacaagtccacccctgaactctgcaatgcgtgtgtaagcgtatgtaacaacccttttgagtacacgcttgatatgctaatggcaccaccttcaatagtgagctctttctctttcagcttttcattggtagcagtcatagtctgacattccactgaaggttgatatttggtgttctcagcatcagatgccgatctatgtgtgagctgagacactactccacctggaccaccgatttgggttggagtgaagaaatttagctgtgaaggaataggaattggaaaagccttgttcatttttccagcctgatgatccattgtcttggaggtagttgctgtgctcaagccagattctacattctgggtactcccaggaattgttggtgatggacttgacccattatcggtgccacgaggttg

SEQ ID NO: 7099 - DNA, 997 bp, Glycine max
  misc_feature (1)..(1): n is a, c, g, or t
  misc_feature (558)..(558): n is a, c, g, or t
  misc_feature (615)..(615): n is a, c, g, or t
  misc_feature (948)..(948): n is a, c, g, or t
  misc_feature (973)..(973): n is a, c, g, or t
  Predicted polypeptide sequence is orthologous to G2783
nacggttttttgattctattctgagattccgccaagcgcgcaattaaccctcactaaagggaacaaaagctggagctccaccgcggtggcggccgctctagaactagtggatcccccgggctgcaggaattcggcacgagaatggggcaataatgccaaatggggggcagagtttcaggttgaattgggcaacttttagtgctggtgagaggtcgcgccacgacgattctccagattacaccatatttgttggtgacttggctgcagatgttactgattatcttcttcaggagacatttagggctcgttataactcggtgaagggtgcaaaagttgtcattgataggctaactggccggaccaagggatatggctttgtaaggttttcagatgagagtgagcaagtgagggctatgactgagatgcaaggggttctttgctcaacaagacccatgaggattggacccgcctctaataaaacccccaccactcagtcccagcccaaagcttcatatcagaattctcaacctcaaggttcacagaatgagaatgatccanataatacaactatttttgttggtaattggatcctaatgtcactgatgatcatctgangcaagtttcagccagtatggagaattagtgcatgtgaagattccagcaggccaagcgatggtgggttgtccaattcgcagacaggagcttgtgccgagaggcacctttcgtgtgaatgggacccgttgttgtggtcaaatgtcgtctttcatgggggcgagtcttcaaacaaacaggcttaggcgatcccaaccccgggggaaatgtgtctggttctggtggatcccattggtgttgccaaggtttgaaaaatatgtatgctctgttctgggaggatcccacatttggatgattttcgggttctgtacaccccttagcaccgcaccaaagggnaaatttggaagaagtctttttcggnaacttgggaccctaacgatcggct

SEQ ID NO: 7100 - DNA, 777 bp, Glycine max
  misc_feature (8)..(9): n is a, c, g, or t
  misc_feature (710)..(712): n is a, c, g, or t
  misc_feature (717)..(719): n is a, c, g, or t
  misc_feature (721)..(721): n is a, c, g, or t
  misc_feature (752)..(754): n is a, c, g, or t
  misc_feature (773)..(775): n is a, c, g, or t
  Predicted polypeptide sequence is orthologous to G2784
ttgctttnntctaagcactgcgagcatgccttaatgttacattcaaaatcataaaacaaactatttgaggtctaacaatttaaatgaaatcttgtgcatgctctttgtgctcatgatatattgttcgtaaatcatactatttcaaattaaagtatgtagcaatagcataatacctaacatggcacgtttgcacaaattattttagacagaccacagataatttgaatttaatagtagggacgatatgttgtaatagttacaaatataattagggtacaaagatgcaaaccaatacataaagtaagtgctgatattgataacgttaatttcagtaaaattggagctcatattttgcaaaagaagatgaaatcttcagcatgtgattgattgttgttgcccatgtcttgtaacgacggaaatcatctgccatgtctagcttgaaaacgcctcctcttgttgttaaaacgatcagataacacgtatcagcttctgaacctttatacagatccgcatgcagagtcatcacaacaccctccctcttgcttttgaataggttatgcttcctcatcataagtacaaccttggcttcgctgtttaggattacagacactgatctaggcatatacttcccttcgggtgtttctacatataactcagcaccctgtgcaagaattgatctgcctttttcaaagtcaaaatctagatcattnnngtctnnnanggggcagatagggacgcccccattcaatctnnncttgcatcctgatcttacnnnaa

SEQ ID NO: 7101 - DNA, 783 bp, Glycine max
  misc_feature (7)..(8): n is a, c, g, or t
  misc_feature (10)..(12): n is a, c, g, or t
  misc_feature (18)..(19): n is a, c, g, or t
  misc_feature (586)..(588): n is a, c, g, or t
  misc_feature (608)..(608): n is a, c, g, or t
  misc_feature (622)..(623): n is a, c, g, or t
  misc_feature (656)..(656): n is a, c, g, or t
  misc_feature (658)..(660): n is a, c, g, or t
  misc_feature (675)..(675): n is a, c, g, or t
  misc_feature (678)..(678): n is a, c, g, or t
  misc_feature (745)..(748): n is a, c, g, or t
  misc_feature (750)..(750): n is a, c, g, or t
  misc_feature (755)..(756): n is a, c, g, or t
  misc_feature (773)..(775): n is a, c, g, or t
  misc_feature (777)..(777): n is a, c, g, or t
  Predicted polypeptide sequence is orthologous to G2789
acgaagnntnnnttaagnnagaaggagaatgaacagtgatgataataagagaaagtcgaagttaaaaataaaaaaagacacacaaaaataaaataagaaaaagaagaaaacaaagataaccgagaaaaaaaccatgaaagtaaaacactttgttaaaagggagggcgagcactgccaccccaataaccctcagccggtaattgaattgaattgagaagattctgaggcactccatggaaaagagaagaactatttggatctcccacaagctgttgttgttgctgttgcggctgcgattgtgattgttgctgagtccccgggattcctggggaccctaatccttcggtgccatgatatggcaccggagtttcctcttcctctaagggtagtctctcataagcagcattaccaaatgaagcagccatgatgaccacagggcctgaagccacaaggggtcccaccacacttccacctactacctgtccctgtccgccagccagatatatggctagtcctgacgccgctggcggagccggcggcggcaggaatgaaccggacagggacagaatctcgaaccttccgtgannngtcacgacggcacttggcgnggccggctgtcggnntgtgacgttggtgacggtgccacttccgctgancnnncagatgccacgctgncgncgcctcgcgaagcggtgacgctctccatgatgtcacagccgttggtgatttccatgacatgggatcnnnngncgttnncactgtctcttgtgatnnntnatgggt

SEQ ID NO: 7102 - DNA, 931 bp, Glycine max
  misc_feature (16)..(16): n is a, c, g, or t
  Predicted polypeptide sequence is orthologous to G2791
atgatgcccccttgantttcgcttgtaatttcccccgcgcgcattaaccctcactacagggaacaaaagctggagctccaccgcggtggcggccgctctagaactagtggatcccccgggctgcaggctgggcggtgcagctgctgtcgctccccttgttgctgatatgtactctgagggaggcggtgactgcatccaagccaacggcaacagtaacggcggtggggcccacgctccaaactccaacaccaaccaaacgtcagcgacaacaccctcaaacgacagcctaacgatgacggagcaccaggtagcgaaactaatggaagaagacatgggttccgccatgcagtaccttcaagggaagggtctttgcctcatgccaatctccctcgccactgcaatctccactgccacgtgtcacaccaggaacgttaccgttaacgttaaccccttgatcaatgccgccgccgccgcccagattccgacagccgccaaccccgctggtgacgggccgtcgtctccgagcatgtccgtgctgacggtgcagtccgccgtcgcggtcaacgacggctccgccgccgtgaaggacgctgcctccgtttcgaagccgtgatgacagcgtttgtgtgactttataggaaaaaaaaaaaaaaaaaaactcgaggggggggcccgggacccaattcgccctatagtgagtcgtattaacgcgcgcttcactggccgtcgtttttacaacggtcgtgacttgggaaaacccctgccgttaccccaactttaatcgtctttgcagcaacattcccctttttcgccaggctggcgttaataacgaagagggcccgcaactgatcggcctttcccaacaggttggccagcctgaattggcgaatgggacgcgcccctgtaaccgggcaataaaacccccgcgggt

SEQ ID NO: 7103 - DNA, 745 bp, Glycine max
  misc_feature (1)..(1): n is a, c, g, or t
  Predicted polypeptide sequence is orthologous to G2791
naagatgacaaagctacagacggtgcgtaattaaccctcactaaagggaacaaaagctggagctccaccgcggtggcggccgctctagaactagtggatcccccgggctgcatgaattcggcacgagggttttggagcttcggctccggctaacggtggcggttcgggtcagccgaagcagagggttagagccaggagaggacaagccacggacccacacagcatcgccgaaaggttacggagggagagaatcgcagagcgaatgaaggccctacatgaactagttcctaatgccaacaagactgacaaggcctccatgctggatgagatcatcgattatgtgaagttcctacagctccaagtcaaggttttaagcatgagcagattgggcggtgcagcagctgtggcaccccttgttgctgagggtggcggtgactgcatccaatccaaacgcagcaactcaaacgacagcctcgccatgacggagcaacaggtggcgaagctgatggaggaagacataggttccgccatgcagtacttgtcaggctatggtctatgcttgatgcctattatggtctgacaggcagtctcgcaagccggtgtgacctcttcatgaactgtgtatgggcctctatatccgaatgcctctctaactctgcttactctcgtgtataggagcaagcttctattataattacgataatcacgcgttaccggtaagtagtacctggacttgatagttacg

SEQ ID NO: 7104 - DNA, 796 bp, Glycine max
  Predicted polypeptide sequence is orthologous to G2830
ggtgtcggctgtagtaagcgcgagctctaatacgactcactatagggaaagctggtacgcctgcaggtaccggtccggaattcccgggtcgacccactcgtccggtgacttctggtgtgtatcatgtgggtgtgaagtggatgttaaaacttaaaagtctcacctttttggttcattggtgatttgttttgttacattggtctggaatctgaagatggttgttcattgttaggcattgaggtttctgagcattgattttgatttggtggataaagatgaaggatttctgtgggacacctggcactgttcttgggcttgttcttaggatgtcacagttccatatttccttcttggtctttggcttccttggataccaccgtcagttttcttaatttgactgccttttgaattgatgatacagactgaatgtgtctctttgcaccctatctttttgtgaaaagggtgacttttgagacaatttattactatatgaagtgacctctgctgagtatatactatgcatatggtcgtaattagcgaggtattctgctctagattgtgatcctatttgagttctatatagagtggactgttatgtgaactacagatgctatattcggcgctacattattatggtcatctctcttcttatatatcgtggttatttgtcgtgtaatcttacttgtgacgcttcagataggatgatatttatatgacctatatggcagtggatattaagtggggtagatcattctgtgagatcctatatgtggaacaatacaacgcgaacaactag

SEQ ID NO: 7105 - DNA, 763 bp, Glycine max
  misc_feature (11)..(13): n is a, c, g, or t
  misc_feature (19)..(20): n is a, c, g, or t
  misc_feature (623)..(624): n is a, c, g, or t
  misc_feature (650)..(652): n is a, c, g, or t
  misc_feature (674)..(676): n is a, c, g, or t
  misc_feature (690)..(691): n is a, c, g, or t
  misc_feature (700)..(703): n is a, c, g, or t
  misc_feature (724)..(724): n is a, c, g, or t
  misc_feature (731)..(735): n is a, c, g, or t
  misc_feature (746)..(748): n is a, c, g, or t
  Predicted polypeptide sequence is orthologous to G2834
taaaccggctnnnaaattnncacaaacccgaaagttatatcttcacaattaagagaaacatagatattaagttattacagaaccaatggtagtaccattgttataaaagattgtcagaactagattctcctccagatttgaaagatccaggcatgacaaaagagaacgaaccttctgggtcatcaaatagaggtctggtgaattcattaaactcaccaaagttggcttcaaagttcaatgatgagaaataattgataggatcatcgctatcgccttttacatccatggcatttggaacttcatttgcatttgaaggatttgatccaaaagtgaagttcatgctctgcaccttactgttgttctctttgctatcatgaatgggtgcctcagctacccctgcccctttagtgtcatccaaaggaatggctggtgcatgcccttggaaaagagcaatgtgcccaaaaagcttgtctttcctagaaaatgttgtgccacacgaacagagccatttatccttaccacagtgtttttcatgagtttttagatcagccatgactgagaacttcttggtgttgcacctactgcaagtgtaactcttgtcacaatgcgtccttttgtaatgnnttttgacacataagatcgtcttcagnnnctggaacttcttgtgatccttnnngcgcttgcagccannataggggcnnnnatacctcttgataggctttgntgatgcnnnnncttttgtgcgnnntggcaagcgctgctg

SEQ ID NO: 7106 - DNA, 707 bp, Glycine max
  misc_feature (8)..(10): n is a, c, g, or t
  misc_feature (597)..(599): n is a, c, g, or t
  misc_feature (620)..(620): n is a, c, g, or t
  misc_feature (622)..(622): n is a, c, g, or t
  misc_feature (635)..(636): n is a, c, g, or t
  misc_feature (642)..(643): n is a, c, g, or t
  misc_feature (648)..(650): n is a, c, g, or t
  misc_feature (664)..(666): n is a, c, g, or t
  misc_feature (673)..(675): n is a, c, g, or t
  misc_feature (678)..(682): n is a, c, g, or t
  misc_feature (699)..(700): n is a, c, g, or t
  Predicted polypeptide sequence is orthologous to G2834
acttaagnnngcaaactttaatacaaacatgtatttattaatagggggcctaccattaaccgttactttgattcgttagattaatttaatttcatagatcatatcctacaatcatccacaccatattacctctcacaagtcttttccccagttaaccatatcgttgatcattgttcgttgtcgcatgccaatgatgcttaacactgaaaataagttttttggtgtccagcaaagaccatggtgaaatgggcatcaaagattcaagattcgactagaaaggtgcacctttagagaatggtgtggctgaggagctcgacgttgaccgttctcatgttagtttgaaagttgcaatcggaataagatgcactaacagatttagcaactgaagtcgatggtgtgtgtgaagaaccacttcaaattgagacactgcccaatgatgtactcatgagattggtgcgacaagaagcacttatcagtgctctcaaattagagatgccacacgaaatagtactatggaggagaggccaagtggaagtgcatgtgctgactgcgttctcaggaaaagacaagttgttcgaccacattgcaccatttgannnccataatattgcttggatgangngttgctacaaggnntctttnntgatnnngggtttatctatgnnngcttttnnngannnnncaccggcaacgatgcanngttcatc

SEQ ID NO: 7107 - DNA, 785 bp, Glycine max
  misc_feature (591)..(592): n is a, c, g, or t
  misc_feature (768)..(773): n is a, c, g, or t
  Predicted polypeptide sequence is orthologous to G2834
ctgttaattttaatccctcaacaacataaagacataaatacaaatctagcaatagaatataatatgaatacagtatttcctaaaaatagatatgcaaagtcaattactaggaaaacctaacacttcctttaaacagtagtcatcaatggacccaaaatcatcaaagaacccttccggcaattcttgattcaaaaggcaattatccgattcaaattcactttcattcatcaacatcggatcttcgtcatcctccaccacttgtttccctttaccctcttcgtcacacgcgagagcaggcgcgtggccatcaaacagcgcaatgtgaccaaacaatttgtcctttctcgagaacgtggtcccgcacgtgcacttccacctggcctctcctccgcagtgcttcgcgtggctcctcaaatccgagagaaccgagaagtgcttcttgcggcaccgctcgcacgtgtacatcttcgggcagtggctccgcttgaagtggttcttcacgcaaatcaccgatttcagcggccgaaaccgccggtggagcttgttccggttgcagccttcgaacggacacgaaaaccgcgtcgcgcgccnntgcgcagtggtctccgaaggcttcgccagcgcctccaccgtcttgaactgttctccgtgcgcgcgcatgtgcatgcggaggttcgagtcgcgccggaagcctttcgcgcagatctcgcagaagtgcatgtgctcggcgaggatttctatggcgtcgagctccacgattccgctacnnnnnntcgaagtcttcg

SEQ ID NO: 7108 - DNA, 990 bp, Glycine max
  misc_feature (835)..(835): n is a, c, g, or t
  misc_feature (937)..(937): n is a, c, g, or t
  Predicted polypeptide sequence is orthologous to G2851
agtgaaaataactaaagcttgatttccgtgaattaaggagtcttaacaagggcttgcaaatatataacttgactggcagcatacattttattcaggaattgcgtatagcatcatgagcaatcagccttaattaggttttgcagcagattgactgctaatgatgttatacaatctccatgaatatattttctctctctgtatgctgcatatgataacctattaatagtaagttaagcaatctaccgaaatcccccaccaaaagcaggagcccaatagtcagctccattgtcacttccaacttgcagcgtgcatgacactggaaccaagcataaccctctactcctcaggtctttctttggttcttcttgagaatcctgctcactagctgctttcctcttcaaacagttttcattcagcaactgaccggggtcttcagggaatatacaattgttctctccttgaacggattgttgctgtctcatgtttcctgatccactgcccaagtatggtaagctaagggcctcaatttgactctgaaggaatctgatatagccaatagcttctaataagacagaagccgtgtcagtctttccgaatggggaaacgagttgatgaagggcggtaattctgtcacctaatttctccttcctaaccttgaaggtcgattgagttgtgggcggttgaaccctagctttcttgaatgccccaccagttgcagcgctatcacactctgaggatggatctggtggaggaggcctcgcatcggagttattgttagagaaatccaacatgctgctgctgaaacttgttacacatgatttgggggaagaagcangcactatttgagaccatgttggctttgctggttgaaactcttcgtttccatgcccatacgcatagctgttcaccgagctttcttgcttaaaacatcacatangagcacttggagcctggcttaacatttgttgctcccagttctcccaacttcta

SEQ ID NO: 7109 - DNA, 939 bp, Glycine max
  misc_feature (58)..(59): n is a, c, g, or t
  misc_feature (61)..(62): n is a, c, g, or t
  misc_feature (66)..(66): n is a, c, g, or t
  Predicted polypeptide sequence is orthologous to G2851
ccccccccccccccaagaaaaaaaaaaaaacgaaaaaagagaatataggaaggaatgnnanngaantgcaaggaaaccataacacaaaaggccacaaaactgcacctccaccgcggtggcggccgctctagaactagtttatcccccgggctgcaggaattcggcacgaggggacatcaagctaagaaagggaaagagaaagatcacagaaagagaattcatctttctttgcgaacagctaaaaacctcaaagggaaagaaggcatgaatagaggtgttcttcagagctcaccagtgcaacaaatgatgactggaaaccctaactggtggaacatcaatatcaatagcatggctccacaagctcctcctttcttgtccactcctaacaactttcctatcccttgtgctcccacttctcttccctttccttcttggcatgagaatcaagatcttccagagtcatggagccagctacttatgagtggagtggtggatgaacaaggtaaggctgggatgggtcagtttattcagactaagaagttggagagctgggaggatcaaatgctaggtcaggctccatacgcttctcttgttgatgttaaacaagataacttggttaacagctatgcatatgggcatggaagcgaagaacttcagtcatcacagccatcctgctctccacaatcatgtgtgacaacaagttgcagtagccacatgttagacgtctacaacaataagacagatgcaacggcatccccaccagatctatcttgtgagtgcaacagcactgcagctgctgggcactgagcacactagtgtcaaccctatgctacaccctaactgcgttcacgctaggaggcaaagtatgctctatatatccgtcctccatcactgatctcacactgcgacgccactctacctacgcatgtcgtcttattc

SEQ ID NO: 7110 - DNA, 931 bp, Glycine max
  misc_feature (1)..(3): n is a, c, g, or t
  misc_feature (719)..(719): n is a, c, g, or t
  misc_feature (923)..(923): n is a, c, g, or t
  Predicted polypeptide sequence is orthologous to G2851
nnncctgatggggggtgagtgagaatgagagtctcactcagagtacggcgggcgcgctatttaccttaactatccggaacaaaagctggagctccaccgcggtggcggccgctctagaactattgtttcctccgggctgcaggaattcggcaccagagctgttgaatgacaatggcctgaaaagaaagggagctccaaaccaggacgcaaaagataagccaagggacttgaagagtagagggctgtgcttggttcctgtgtcatgtacccaacatgttggaaatgaaaatggagctgattactgggcaccagcatatggaagtggattttaacagcatggaagacatcttatggatgatataacatcgtgagcagtctatctgtaattaatgaaaaggctgattgctcacgatgctatatgccattcatgatgatttggccaattgaaaaaaaaatcttatccattatgatgtattgtctctaatctaattaggttaacacaataagttattaataagtgttgtcaaaacattaattaagatgtaattttcgtctttctaaacatgcattttcagaggtagcatatattaatatcctgcttttgctatgaaggatgattattgataattaacactctgtcaatgttaattttgttaagatcgctcaaaagaattaaaaatatctcgaggtggggccctgtacccaattcgccctatatngagtcgtattacgcgcgctcactgtccgtctttatacaacgtcgtgactggtaaactctgacgtacccacttaatcgcttgcatacataccctttcgcagctggctaatacgaagagtccgatcgtacgccttcctacagttgcgcatctgaatgcgattggactcgcctgtacggtgcataatcgcgggaggggtgtggtatnctcactta

SEQ ID NO: 7111 - DNA, 881 bp, Glycine max
  Predicted polypeptide sequence is orthologous to G2854
aagggatacaaaataaaattcgcatagaatggcataagaaacttcttagctatatcctattcgcatagaatggattcagccaagtttgttctccacgatacaataaaagagaagcaaccaaaacgagtatcttagcaatagcatagcattacagaagaaaacggaaaaaattggtgcccaacttcttagctatatcctatttgctgctgttgctggggaggttggtaattcgcatacccaggataactgccatacatattggggtcctgtccagcaggggcataaccataattttcatagcccccctgagcatatccgtagtatccaccaccactaccattccactggtttgcatctggttgagcctgtttgtttgaaggacttcgcccccatgaaagcctaacattttgtccgcctagaagtgtgccattcaaaacccgcagtgcctcttccgcacagctccggtccgcaaattggacaaatccacatcgcttgccagctggaatcttcacatgaactaactctccataatgcccaaaaacttgtctcaaatggtcatccgtgacgttaggatccaaattgccgacaaaaatagttgtattatttggatcatgctcgttctgtgccccttgaggattctgatatgatgcttttggctgagactgagtgctagggtttttattagaggctggtccaattcgcatgggccttgttgaacaaagaaccccttgcatttcagtcatagctctaacctgttcactctcatctccaaacctaacaaaaccataaccctttgtccgtccagttagcctatcaattacaactttggccccccttattgagggatatcgtggccgacagcaacggaattcgatatcagg

SEQ ID NO: 7112 - DNA, 928 bp, Glycine max
  Predicted polypeptide sequence is orthologous to G2865, G2934
agacagaaactgaatccattttattgcagaaaagctacaaaaggaattgggatagagttcatttttgagttgtacgattttactgtcttcttccctcattcttcacaaagaaagcagcagagtccaaatcaaagagaaaaaaggggacagttgccaatgtaaaatttgcaagcaaactcatccaaacaaagtctatcaagttagaaaagtctaaaagagaaattctatggtagcctgagaaatttaaggttttagtactgatattttttttaccaatagttaaacgagcttccatttaatgaatctctctttctccctctctctttttcacttctcaaactcattcaactattaatccaaaaaaataacaatactaaaactcttagattttttctatagtaccatagttagagtagctctccgtttaaaatgcatgctatgggtaaatttcctgttattagccagattgtgaggctagctagcttcaacgacaaaatcaatcagagcatctaaaggttgaaaatgctttggaaactttctttctcagctcagatggatctacactgttggaatggttcacctcacactgcacactgtggagcaatctgccattgacttctgttgaaaagaaactaacaacttcaagtccttcttcagtcaaaaactgtagtaactttgaaattttaggcttttcctctctgaagacactggtgatttctattcccataataccatttttctcgtggacagtgaagttgcaagatgtatgcaagccctcatggttattttccatattattggaatgattggagagtttcttcagttcatctctcttggcaccaagctctttgatatgtttctgcatgtgctttatgtaattcactgcctcgttcatgtggtcagatatgaacgctttcccttgatgaac

SEQ ID NO: 7113 - DNA, 879 bp, Glycine max
  Predicted polypeptide sequence is orthologous to G2865, G2934
ggacaaacgtctgtgtttccctaattcaaattttgtcataagtatcagaaccaaaggtacaattattacagcaattgacgaggaagaaacgataatggatgaacaacattgtaattcttgatggttatcatgatgcgaaagtaagtaatgccagtgtatatacaacaggaaattcaaattttatgatgcgactattgaaaaacaactactgtaagaactaaatgcagaagcgtgcacacaaaacattgaacagtaccatgaatattatccatgagtttgatctaacttccatgaaaatagataaaaatgacctcgtgctcgtggagtattgcgcgaatggaataatcaactagctaccctttgtacttcaccaacaattataccagataaataacaagtacaccgctgtacaaatcactcaagttaatagtatatacgatcagaaacatctccaaataatatatcttcccaagatttcaattttcatgttcaggcaaagtctcttgcaaacttattgcctccgttagctttatttgcaattcggagtaatcagcgccagtcatattcaaatgatttggatcctctgatcgtatagtgtgtatgaatcttccatctcttctgattgaagtagtgctaaccacattaatcccttctttaagcagaatgtccaacactcttgacatgggaaacacacttttcccgaagctgtaaccgcacataatctcaagtcctcccgggaaaggatgaacagaaaccaagggtggaagatgagtagtgctactgctagagctttcattctcagaacaaatattactcttcaattagacaccttcactaactcatccctctttgcttgcaaatgcttcaccttattttgga

SEQ ID NO: 7114 - DNA, 749 bp, Glycine max
  misc_feature (5)..(6): n is a, c, g, or t
  misc_feature (593)..(595): n is a, c, g, or t
  misc_feature (653)..(653): n is a, c, g, or t
  misc_feature (655)..(656): n is a, c, g, or t
  misc_feature (658)..(659): n is a, c, g, or t
  misc_feature (670)..(670): n is a, c, g, or t
  misc_feature (674)..(675): n is a, c, g, or t
  misc_feature (697)..(702): n is a, c, g, or t
  misc_feature (704)..(707): n is a, c, g, or t
  misc_feature (715)..(716): n is a, c, g, or t
  misc_feature (739)..(742): n is a, c, g, or t
  Predicted polypeptide sequence is orthologous to G2865, G2934
cgttnntatcatgtgtaaatttcaaaaagcaaagacagctgtgaagggaaggaaaaagcaaattttatctacacatgttttgtctttctcttcctgacaatggaagctgaaggttccaaaccaaagagtcaaaggggttccaaatatatacggtgcaagcaaactcacacaaccaaaattacgaaccagttagaaagggcagatacatgtgttatgtgttaatttccagtccacaaagttactcagaacatctaagtgatggaattacattggaaaatttccttctcagctcagatagatctacactgtcggaattgtcaacctcacactgcaaactgtggagtaatctgccattgactttggttgaaagacaactaacaacttcaagtctctcttctaacactagtttaagtaattttgaaagtggaacctcttcctcactgaatccactaatttcaatccccacagctccaccactattctgatggatagtgaaaccactagatacatgcttgcaattctcatggccttcaggggtggaatttatggagggtttcttcttcagcttatccctcttgtcactcaactctttnnnattcttctgaaggtgatttatgtaattcactgcctcgctcatttgatcagatatggancnntnncccttgatganccgnncagggacaaggcatctaacagnnnnnngnnnnccacccanntcttgcctcctttgcctttccannnncgtatca

SEQ ID NO: 7115 - DNA, 999 bp, Glycine max
  misc_feature (65)..(68): n is a, c, g, or t
  misc_feature (70)..(72): n is a, c, g, or t
  misc_feature (75)..(77): n is a, c, g, or t
  misc_feature (918)..(918): n is a, c, g, or t
  Predicted polypeptide sequence is orthologous to G2898
tttccttcgataaaaaatataggatatggatgtattctctaagcacttgaacaggtcggggtatnnnnannnccnnnaagagaacaactacaagcaatacatacgagcgacggtgaaagtaacgctcactaaagggaataagcttttttttttttatttttttttgaacatctaaatacaacaaatttttttaacatatgacacacagaaattataggtttcagcaaggacagaaaaaagctgatgataactgaatgtacaactgttagtccaagtagtttcagttaatacagatccaacctagtaagaaaaataagggtggctttactcatcaaactctgattcatcatcagtttcgtcaaactcgccattttccattttcttgataaattctgccattgcgctatcaaattcttcacgtgttgttggtgctatatcatagaatggtaccttctcctcataagtcattgttttccacttctctccacatgccttgccaatatcacgcattgactttacatctggatttgctcttgaaattctttacgaaaatcctccaagaagtagaagaaagctgcaggaggtttcctgggtttcatagcatcaaactttagtttgttcgctagaattcttggcctcgagggccaaatttcctatagtgagtcgtattaaattcgtaatcatgtcatagctgtttcctgtgtgaaattgttatccgctcactatgccacacaacatacgagccggtagcatatagcgtaaagcctggggtgcctaatgagtgagctaactcacattaattgcgttgcgctcactgcacgctttccagtcgggaaacctgtcgtgccaactgcattaatgaatcggccaacgcgcgggagaagcggattgcgtattgagcgctcatacgctagctcnctccatgactcgctgcgcttggacgatcgatgcagagacgggctgtacttacttcaaggcgtactacggtatcctcataac

SEQ ID NO: 7116 - DNA, 884 bp, Glycine max
  misc_feature (832)..(832): n is a, c, g, or t
  Predicted polypeptide sequence is orthologous to G2907
gagaattaagattgctaatttactataacaatcaaagtgagacagttgatcacctaactctgctgtgaaattcaaagtcatacaatgaacaatgaaagctaacttctaagttgctgtaggcatgaaaatatcttcgtccaacaatgcttcaagatcgttgaggtcaccgaattctctcggttcttctgaattgttataactgctctcatgctttacctgattttcttggatctcagttacaacattcaacagcctatggtattggtctcttgcctctggatactgaaccattgacttcaccctagctagggctttctgcaacctttgctctgtttgcttcctgccttcttttaagacatcatagtcatcatctgttgaagatacatcttgtatcatagttccctcagaattggcctccggtttaaatccacgcaaaccactaccttttcgacgccaacgtaaaataaccttctccaagattccaacggaccaaattatcttcccacagcttttcctgacctggtgacctctcacgtgagcctgaatttttactatgcgttgtcgaatcattaaaaattctcttcttcccttccaactgcggaatttgttttggattcgtactgcagcagcatggacaggctcatcacgtggtccagacttgtgtgatttcatattcatttttacaagtgaaagagcacgttcatcagataatccaagtttgtcatcatcatattccttcagttgttttctctgaaatgattgcattctgaaaacttgatgaatacgagctgcagcgtgggtggcattacgcactgcagccaatgaatctttncatgacaattcatatgataaaccatcaagatcattaactcgacagcaacggg

SEQ ID NO: 7117 - DNA, 940 bp, Glycine max
  misc_feature (799)..(799): n is a, c, g, or t
  Predicted polypeptide sequence is orthologous to G2913
gactaacaatagacactagttttctcttttgaaaagaaaaaaacaatagttctgtagaccacagtccagtggaccattatccacaacaatatgcacgtaaaagtcaacagattataaaaattttctaagccattctttcgcctccacaaacgggtaccaatgagattctatggacgtccaacttctgaggtctgcctaagcttcatcttctctttgtactccgtcaattctctcttgtacctttctttgtctcttaagccaatgttctgataaaccattctttcttctgggctaagactgttccatgactggccaatcattttggtaaactccctttctctgtttgggtagagagttttgagagtgtaatgcttttcagcaaagaagaagttatagccactcctattcggctttggataattggggtcccaccttcttttgtttttcttcctacgaccagaacggtgaggtttgcggttgattggtacaatggcactctcatgttttggaatcgatggtggaggaaccaattgctcaggatggtaaagcacccctctaagaacctccgaaccaagcttcacggacactaaataaccacagtcaaattttccctcgatggttccatttcctgaaaggcatgaagtatcttcagcacgagattcaggactattatccataggcttaggcgaatattccacaatagctaattcaggtctccacgaagggctgttgccggaaaatgcatctgctgatggagtgtagataggaccccgagctttaaagaagtgaacttgttcantatgataaagaagactaaagtagtgtttcctgagtacaaaagaagcgctggtggtggtagctgcgaacttgaaaacactaccaactttccctcacttcttctctgcaactaccttctcgtagccacttcttctcgtaactt

SEQ ID NO: 7118 - DNA, 892 bp, Glycine max
  misc_feature (28)..(28): n is a, c, g, or t
  misc_feature (892)..(892): n is a, c, g, or t
  Predicted polypeptide sequence is orthologous to G2964
ccgtggatttgatggactctctggcttngattccgccaagcgcgcaattaaccctcactaaagggaacaaaagctggagctccaccgcggtggcggccgctctagaactagtggatcccccgggctgcaggaattcggcacgagctctttctctctccaaaatctctctccctcccaccgttatttagggtttggcagatctcgatccgtcacaatggacgttcgcaagcgcggaaggcccgacgtcaaccttaacggcgccgttaagaagaccaagcaagaattggagtccttatcaagtggtgtaggaagcaaatcgaagccatgtaccaagtttttcagtactgctggctgcccatttggtgagggctgccacttcttacattatgttccaggtggttacaatgttgttgcccatatgatgaatttaaaacccgcggctcctccaccaagaaccgttgctgcaccaccacccatcccgaatggtttgctccatctgctgttaaacccgcatatgtaacaaattcaatactgccgaaggatgcaaatttggtgacaagtgccattttgcccatggtgaatgggaacttggcaaacctattgctccatcaattgatgatcatcatcatcatcgtcctttgggacctccagcaggtggtcgtatggctggtcgaattgagcctcctcccgctatggctggtagctttggtgccatttctaccgccaagatcagtgtagaagcttccctggctggagctatcaattgggaagggtgtgtgaactccaaacagatctgtcggcaaacaagagccaaactttcaatcgagagcacgaatcgatccaaatcttagaacatttgacctgagggaacttttgacagattaaggaagan

SEQ ID NO: 7119 - DNA, 815 bp, Glycine max
  Predicted polypeptide sequence is orthologous to G2969
caagcaacacagttaaacagaaatttatctaaaaaacagtcttacatacagcacattcagtttctatactataatgtgtcaatttaatgcacataatttcgtgcacaagggtccaagaacccggattatgcaaaaagaagcatctcatagctacaaaatacttaacaaaattaaaattacaagccatcatgaagctcacatcatcatcacaaccgtcaaattcatcacacactatacacaatcacaaagcaaggaagcacagccctaggattaaacaccaaaagctcctcctcatcaaggcgggtgtagaccccactctctccactcgccatcaccgaatcaaaccctccgtcctctttttccacctcatccgaatccgatccgacccgacccgcaatcacccgacaaacaagcattgcccgcttcacattcatgaagcggaactcccgctctatgtcctcggggatcgccacgtgtgcccgccaactagtggacagcgtggcgatcccgtcgagtttcggggaaaacccggacttaataattccgcaaatgttacaaaactgctgcgaacaaatcgcggaatccccgttgtgtcccaagtcgcataaaaaggtcgagcagtggaagcgcatgagctcgtttccgtcggcgatgcagcgctcgtcgcggcggcgcgtatgggcgccgtgacgcgccgccttggacttcacggcctcgcggtactcttcgaatttggagaggatcttggggctgttgtggatcttgagaatgcgggttatggttgggaatggcttggattcgggccaacccgattt

SEQ ID NO: 7120 - DNA, 962 bp, Glycine max
  misc_feature (729)..(729): n is a, c, g, or t
  misc_feature (772)..(772): n is a, c, g, or t
  misc_feature (808)..(808): n is a, c, g, or t
  misc_feature (918)..(918): n is a, c, g, or t
  Predicted polypeptide sequence is orthologous to G2981, G2982
aaaaaaaaccccccccccccccccccccccccccccgagagtgttgatcggctgcttgaaggcgacgccaagcgcgcaattaaccctcactaaagggaacaaaagctggagctccaccgcggtggcggccgctctagaactagtggatcccccgggctgcaggaattcggcacgagcagcaacaatatgatgagaaaaacatccgccgaagggtctatgatgctctgaacgttctcatggcaatggatattatttctaaggacaaaaaagaaattcaatggaggggccttcctcgtactactgtgaatgatattgaagaactaaagacagagcgtcttgggctcaggaatagaattgaaaagaaaacagcctatctgcaggagcttgaggagcaattcgtaggtcttcagaaccttattcaacgaaatgagcagttatatagctcaggaaatcctcccagtggaggtgtatctttaccttttattttggtacagacacgtcctcatgcaactgtggaagtggaaatatcagaagatatgcagcttgttcattttgatttcaatagcactccttttgagctgcatgacgacaattatgttctcaaggcaatgaaatttggtgagagaccactggaagataatatgacacataatcttactgatggaggtgaaggttctagcatgtcaggcttgtgtcatgccgcagctcctacaattctacatgtgtcanacaggcctacaacatcactcctctccctgcatactaaaggcangagttaaagcagagcattactctgtacggtatcatnatatcgtgtctatgtaaaagcatgttcgtatattttgtagagaaatttgctgcagctgatagaccgtcataatacgtattcatcaggtcagcccaagtcattctggaggntagaagcagatcgggatatccttctttgctaaggggagactttg

SEQ ID NO: 7121 - DNA, 943 bp, Glycine max
  misc_feature (1)..(2): n is a, c, g, or t
  misc_feature (639)..(639): n is a, c, g, or t
  misc_feature (650)..(650): n is a, c, g, or t
  misc_feature (707)..(707): n is a, c, g, or t
  misc_feature (921)..(921): n is a, c, g, or t
  misc_feature (925)..(926): n is a, c, g, or t
  misc_feature (928)..(928): n is a, c, g, or t
  misc_feature (930)..(932): n is a, c, g, or t
  misc_feature (939)..(939): n is a, c, g, or t
  Predicted polypeptide sequence is orthologous to G2983
nnaagtgcgtttaaaattaccccctgggagcaatcaaccctcactaaagggaacaaaagctggagctccaccgcggtggcggccgctctagaactagtggatcccccgggctgcaggaattcggcaccaggtgcatcagttcacacgtggattaatctgggagcacgaacctttcctcacacttggctgcaagagattacgccctcttgctcccaagcttcccaacaccaaaactatcactacccctttcgatctcaagagcttcatcaggcccgaaagtggccccagaaaacccgtttcctctgacgacactaagaaggatccaccttcaccccaaggccagattgaaacgcacccaggagggacacggtggaatcctacgcaagaacagataggcatattggagatgttgtacaaaggagggatgcgaactccgaatgctcaacagatagagcagatcactgtccagcttggaaagtacggcaagatcgaagggaagaacgtgttctattggtttcagaatcacaaagcacgcgagagacaaaagcagaagcgcagcagccttgcatcttctcatagtcctcgaactcccacaattcacagtgttgtactttggagacaacaagggggggagtggangagaggacacngaggagatagtcgtacaaggagagtgcaggagatgggattgactgcttgaagaacanacatgcatcaactgtgaacagaggacatagactcttgacttttcattgacccgaaggcgattgaagggggtggtgatgctttaatatattttacttggctagtcgaatcgagtgataatggatggatgtgtaatatgcttactttctttttttgatgggaagaaggaacagggcttgacgctcttctttatgtttccgcttgaccaaaaaaaanaaannanannnaaaaaanaaaa

SEQ ID NO: 7122 - DNA, 920 bp, Glycine max
  misc_feature (1)..(1): n is a, c, g, or t
  Predicted polypeptide sequence is orthologous to G2989, G2990
naatgttcctacgtataatcaacggtcacgtagagggaataagctttttttttttttttttttcttttcaagaagaagaagaagacccattagttccactcccgttagtcccactatcattctcgtactcgttcacatcatgggaagcgagattgtggttgtggttgttgtcgccgctaccgttaccattaattccgctgtgttcatgtccatgttcggggacatgaacaccggttctaacggtggcactcccaacagctccatccagagaaatcccgttggcgctgacactcagagtgctaccgttaccgttgttaaggttgtcttttttcgcgagagtgttcttgttgttgtgcatccacactttgagaacccctctttcgacgccaatttccgtgcagaactccttaaccatttcaatcgtcgcgcttgtgcatctttcacccaactttgtcggcgaactcatgcatcttctccttttgttcttgggtgaacttcgttcggaagcgtttacgcgagtggttgtgcgccggtgccggctcgccggtgttttcccgcgcgacggagatgccaccgtcgtcggagagggcgaggagcatgtggtgggcggaggagtaggatgagatcgtcgcgcggatgcggagtctgactccttgctactggtccgtgtagacgtgatgcggtggtgtgctgcactctagctgcattctggtcttacgccataattctatatgagtctattatatcgtaatcatgtatagttgttcctgtggacatgtatctgtacattccccaacatacatccgatcctaagttatgcctggtgctcagagtactactccattcatggtgtctcctgccgtttcatctgataactgctgcagcttataatgattgctactaccggtaagtgttcggta

SEQ ID NO: 7123 - DNA, 405 bp, Glycine max
  Predicted polypeptide sequence is orthologous to G2989
attttttttttctctcccttcaacgcaaaaacacacacaacccttagtaatcatcatgtcctctcctctcttcttgccctcatcattagaccctcgctttcatcatcaccaccgcatcttttacctcccaccaaccgcaccaaagccatcatcctcctccgcctctaacatcaccaccacaacaacaagaacaagaagaaagagaagcaaggagagagagaagggttagaagggtgaagaagcatgtcttcactcaagaagaagaaaccctattacccgcttccgttaattcctatctagtactactactttacttctgattcaaaagggtgatcttcttcttccaagcttatcaattatcatgcatatgctactttcttctctcttctcggggaattgaagcgt

SEQ ID NO: 7124 - DNA, 854 bp, Glycine max
  misc_feature (1)..(4): n is a, c, g, or t
  misc_feature (376)..(376): n is a, c, g, or t
  misc_feature (854)..(854): n is a, c, g, or t
  Predicted polypeptide sequence is orthologous to G2993, G2994
nnnnaagtgcattgcagtgagaattctactccagcgcgcatttaaccctcactaaagggaacaaaagctggagctccaccgcggtggcggccgctctagaactagtggatcccccgggctgcaggaattcggcacgaggagaactcatcatcatcatcttcatgttcaaactatctctaccgagagtgcctccgcaaccatgcagccagcctcggtagctacgctaccgacggctgtggggagttcaccctggacgtggacagcgtctcgtccccctccctccagtgcgcagcctgcggctgccatcgcaacttccaccgcaaggtcacgtgccccgcggtggaaggagggttgcaggccgtgactggagggagtngggacatgatggagtactccgggggcggagacgtgggaagaataacggagatgggagagaggagtggcggcagcaagaagaggttcaggacgaagttcagtgctgagcagaaggagaagatgctggggttcgcggaaaagctggggtggaagctgcagagaaaagaggtggatgatgagattgagaggttctgtaaaagtgtggtgtcactagacaggttttcaaggtgtggatgcataaccataagaacaactccaacacttctactaattcttctgctaatctctcttctctcactcagtcatgatcctgcacttcccctaacttaattagagagagagtgtgtggcgtgagagaaagatgcatgctcttaataattgcttattgttctctagctcgaggctggaaggcacagtaacgagaattcacactccctggtgctgcctatatcgtcacaaatgaacacaactacttggcn

SEQ ID NO: 7125 - DNA, 372 bp, Glycine max
  Predicted polypeptide sequence is orthologous to G2997
tttttttttttttttttttttttttttttttttttttttttttttaagggaaagggagaaccctagctggatctccattaatgaaatttcaaattacatttttttccctcaccgaacggaaagaacgagagaaagaattatactattataacaacaatgggcgaaattagggtttcttaccaagagtgctctggttatggggcatccaaactttgagaacgtttcgcttcacatgggtctcagcacagaactgtgccacagcagattcatcgggcttcgggattctccaccctagttgttccgcgaatgcgagcatcttatcctttggttcctgggtgaacttcgttcggaaccgtttttggcgctcgtgca

SEQ ID NO: 7126 - DNA, 415 bp, Glycine max
  misc_feature (392)..(399): n is a, c, g, or t
  misc_feature (401)..(401): n is a, c, g, or t
  Predicted polypeptide sequence is orthologous to G2997
gctcgcattcgcagaacaactagggtggagaatccagaaacacgatgaatctgctgtggaacagttctgtgctgagatcaatgtgaagcgaaacgttctcaaagtttggatgcacaataacaagagcactctcggtaagaaaccctaatttcgcagattgttgtgataatagtataattctttctctcgatctttccgttcgatgagagaaaaatgtaatttgaaatttaattgatggagatcaagctagggttcttcctttccttaatttttaatttcagcttattctagcgttgcaaagtaaggatgattaaagtgcatgattaggttaacatgtactacgattgtacattaattgcgaattaatgatcggtgattagtttgtctgtaannnnnnnnanaaaaaaaaaaaaaa

SEQ ID NO: 7127 - DNA, 704 bp, Glycine max
  misc_feature (38)..(40): n is a, c, g, or t
  Predicted polypeptide sequence is orthologous to G2998, G2999
gaagttatagctgctgtcaaaattaatgtatctatctnnntatagctagctagcttcctctgcttgaataatatatatgcacatctaaatctacaattattattcacttaaaaattaatctgatgtttctttttatttttatttctttccaaacaacaaggaagtctagaaaaaagaagaaagagttttgtaggctaggcttacatttgctgcttcttactactagttgtttgcttgttattgtgcatccaaaccttaaaaacctgtctcttgacacccacttgagaacaaaactgctgtacctcctgctcattgtgtttgtggatcttccaatcaatcttgtcagcaaactccatcatcctatccttctggtgctgagagaacttagtcctgaacctcttcttgctggaagagagtagtggtgcatgctgctgcactgatattaactgtgctcctccagtgttggactgaaacatgttgagatcttcacttgatgactcagctgggcccccaaaggccatcatcactggggagaccaagcttgttggtgtaaccaatctatgatggagggaagatgaagagggtgtagggtagtgaaggtgaccgttgtgcttgttggtgtagtagctgtggtaatttggaacatgtgtttgcggttgtggttgtggttgcggtcgtaattctccttcaacttcttttctgtg

SEQ ID NO: 7128 - DNA, 1234 bp, Glycine max
  Predicted polypeptide sequence is orthologous to G3003
ttcattctttttgccttgacatgaatcaaaaccagcttcagccccttcctctccttagtagcttcttaggttcatctcctgaagaatctttgctacaaaaccaaaatgaaaatcctaatgcatgccatgctcaagttgaggatgttacagtggccttacacataggcctccctgaccattcaagtggctccaattccaccaataatcatggatttgtgaatgccacaactcaagttcctaacaattactggataccaactcaggagcagatcctcattgggtttagccatttctcttgtcctgtgtgccacaaaaccttcaaccgctacaacaaccttcagatgcatatgtggggacatgggtcacagtatcgcagaggcccagactcactgaaacgaacccatccacggcccttgttggaccttccatgctactgttgcgcaagagggtgcaagaacaacatcgagcacgcacgtgccaagcctctgaaggattttcgcacgcttcagacacactacaagaggaagcacggttccaagcccttcacgtgccgcaagtgtggcaagcctctggccgtgaaaggtgactggcgaacccacgagaaaaactgtggcaaacgatggctttgtatctgtggttctgatttcaagcataagaggtcacttaaagaccacataaaagcctttggatttggtcacacccctttttcttctttttctgatggtatgtaattaattaaacatgcatggcacaaaacttattatatggctcctttagtgttgttggttgtacagtttttcaatcagaattcaagtttcaacttcatattttgcataattatttaacgcaaattttaattatgcaagttatcgaggtgtgaaactgactttgatcgaagaacggtacaaacatgcactttattataacgacttatcttgtcttaatttctagtacttagacaatttaagggtgatctctatgttgttatcaattaataatgaagaggaatgagtttttcttaagttatgttactgtgttagcatttaaatagagaggaataagaagggagacagggtaaagaaactgagaatttgattccaatttattgattccctggttgccttttctgcttcaatatatgtaattagtttgttctgtgtgtgattaaaaagtgaacaaattctgaaatctcaatggacttcttcttatgctagaaaaaaaaaaaaaaaaaaaa

SEQ ID NO: 7129 - DNA, 698 bp, Glycine max
  misc_feature (4)..(5): n is a, c, g, or t
  misc_feature (587)..(589): n is a, c, g, or t
  misc_feature (595)..(597): n is a, c, g, or t
  misc_feature (613)..(616): n is a, c, g, or t
  misc_feature (651)..(653): n is a, c, g, or t
  misc_feature (655)..(656): n is a, c, g, or t
  misc_feature (684)..(687): n is a, c, g, or t
  misc_feature (694)..(697): n is a, c, g, or t
  Predicted polypeptide sequence is orthologous to G3017
ctgnntagtcagatatttattagaaacacttccatcgccactagtagtacagagaaaattaaagtacaacgtagacacgtagatattttgtgaatgaaatcctgggacacggtttaatttccagccccagcatatacacaaacaactaacacaagatgctcaaattttctgctagatcttgatttagtattaacaaattagaaaaggtcaagcattctgaaatactaaaacgcccttcagaacgaccaacttccagaacaaagtttttctcgttcagcaaagttgtgtttgaattgtgaagtatgatttcttggattcatgatctttttgggattcatctttgagatgaaagaatggcatcaatggcttgtctcacttgagaaatgtcaggggcttttccaccttggactggccaaaattcatcagctgccaacaccttcacttgcaactgaagaaacttaacataactaattgctttctccaacattgtgaccaaatcaaccttggaaccgttggggaccagttcttgtagtatcttaagccgctcacttattctctctcttctattcttggcagcaacactttgnnnatcctnnnatgggtttgactttgnnnntgctgctttacttgcacttgtgcatggcttcttgnnnanngtaacttgcatgttctctcccataaaannnngcttttnnnng

SEQ ID NO: 7130 - DNA, 655 bp, Glycine max
  Predicted polypeptide sequence is orthologous to G3021
ttttttttttttttttttttttagcttcttcaataactaatttatcttgaatttaacatagtttatggctcaattaattgtggaaatgcaagacatagaaattaactaacgcgtgtgtggcacagaaactgaagagcgttcacctgcatttgcaaacagcttatgtaactctcaagctctgaaaccatttgttcatcatcacacatctcttctcctccgggtatcaaccttctcagcttcttccactggttgctgatgtcctcatcctccttatcatcatcttctctggctaaatcccttttcatttctgacatgtccttgcacttagactttgagctagggtttgaagagaaatattccattgggagtacaacttcatttttgtcataagcattctttgatgatgaaccttcaccagcctcatcattttcaagaaagctagtgcttttagctgcattgacatgaacgtcatcgctttgaagcttatctttaaggccgttactccatgcaaatccttgtgctgacaacaccattgccatgtccacttcatacttgacagcattgttaatatcatcacaatgccttctatcttcttccacagaactcttttcctttatcttcaccaacgctggaaccaaatgattcaaataattcc

SEQ ID NO: 7131 - DNA, 762 bp, Glycine max
  misc_feature (56)..(57): n is a, c, g, or t
  misc_feature (62)..(62): n is a, c, g, or t
  misc_feature (762)..(762): n is a, c, g, or t
  Predicted polypeptide sequence is orthologous to G3021
ctgcccccccctcccccccccccccccccccccccccccccataaccccggaaacnntacangcaccggtctggcagctctttacgactcactctagggaaagctggtacgcctgcaggtaccggtccggaattcccgggtcttcccacgcgtccgctgaaatgaaaaggggtttgatagaagatgatgatggtggtggtgatgaagatgaagtcatcaagggccaattgaagagcctaagaaggttgatacctggtggagaagagatgtgtagtgaacaaatggtgactgagctacaaagctatgtaagctgtttgcaaatgcaggtgaacattcttcagtgcctcgctgagacacattgaatattgattcatatatgatgctttaatttgccttttccataaacccgttattactattatgtatgtgttccacatataatatatattgtcaattatcaaagcaactatatatttaaaaaaaacaccccccccctcgcagatcagcaagaaaataaatagatattagtcactatctacaaataataaataaataaaagggcggccgctctaaaggatccaagttcaatccccgtgctagcaacggaatatctctttatgaggtaacctaataccattctactggccgccgttctacaacctcgcgaccgggaaaacctctgtgcgttcccccacttaaattggtctgtggagaaaatacctcctttatggcaaggttgggccgcgctgtataaatgctacn

SEQ ID NO: 7132 - DNA, 726 bp, Glycine max
  misc_feature (723)..(723): n is a, c, g, or t
  Predicted polypeptide sequence is orthologous to G3021
gggtggttggacagttatgaccatgattacgccaagcgcgcaattaaccctcactaaagggaacaaaagctggagctccaccgcggtggcggccgctctagaactagtggatcccccgggctgcaggaattcggcacgaggcaaaagaagcttagagagcttcagggagcagttcctgggagtgagggaatggacatgcacactttgttccaaagcattgaacaatacatacttcaacttgaagctaaagtcacggtcctaaggtgtttgtccaatttgtatggagtatagaaggagacaacaacactcctaagcactcaacctatttagaaactacatctgggctctaaagaaagggtgaaggtaaggttaacaccattaccgggcttctttcattggggcgtggagggaataataaggttgtattttatttcaattctataatctataataaaagttaggattatccttttaaaaaaaaaaaaaaaaaactcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgccctttccaacagttgcgcagcctgaatggcgaatgggacgcgccctgtagcggngct

SEQ ID NO: 7133 - DNA, 401 bp, Glycine max
  Predicted polypeptide sequence is orthologous to G3032
cctcgtgccgaatcactaataatctagcacttgacaagttctccgatgaattgaatgagaagctctgggatgatggaagctctgaagatgatgctggtgaggaagtaattgacaacccctcagcatatgaaatattagaagtatggaaggaaatgagagaggaggatgggagtttgttgcactctgaacttgcttgtggctagtgattgtgagttgctttagtgtttaacatatgctagctgaactgtgaacagggataggaagatgtagcaattttatcgtaaattagcttgttctgatcaagtatagtgatatctggtacgatgttattggaacaagagaatgcaattaaaacttgtaaatgttagcaaactttcccttggtcaaaaaaaaaaaaaaaa

SEQ ID NO: 7134 - DNA, 933 bp, Glycine max
  misc_feature (713)..(713): n is a, c, g, or t
  misc_feature (753)..(753): n is a, c, g, or t
  misc_feature (804)..(804): n is a, c, g, or t
  Predicted polypeptide sequence is orthologous to G3055
gttaaagcgtaggcccattacgtgagccgctctattcctcacttctgcaacaaaagctggagctccaccgcggtggcggccgctctagaactagtggatcccccgggctgcaggaattcggcacgaggaataatgttttgtaggtttcagggaatgaatgaagggttgctaagatagtgttctggtttatgagatttggatgagtgctttggttggaaacgtcgtaggaaaacctgctgtaaatatacttggcatcagctaagtggtgagccgattagttgtttgtattttgatttcatgatttcatttcttcttttccccttcttcttctttgtaggataaaattgtgaaatgaaattcgtgtatatagtcaaaaaaaataataaaacaaaaaaataaaaaatttttaactaaaaaaaaaaaaaaaaaactcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtgttgttacgcgcagcgtgaccgctacacttngcagcgccctagcgcccgctcttttcgctttcttccctcncttactcgcacgtacgccggctatcccgtcaagctctaaatcggtggctcnctttagggatccgatttagtgctttactgcaccccgacccccaaaaactggatagggtgatggtcacgtattggccatcgtcctgatgacggttttcgccctttgcctggatccacgttcttattatga

SEQ ID NO: 7135 - DNA, 812 bp, Glycine max
  Predicted polypeptide sequence is orthologous to G3059
acaaagaatactttctctttggttgcttggattgggatcatctgacgtattatgtatgtaacattcaaaaatcaaaatgacgggaagaaaaaagaaagacacgacgaggactactgacccaagaatcctgctcgatctacatctcatattgcggcaagcaagcctcctatatttgtattttgtattttttgacccatacttttcatgagaaaagtaattattttttggccggtggttgtccatgtttgtaattacacaatgaagaatattatgtaccaattacgtttactcgatccagcagactatatatgggatcttatctttcgagcttcattgatctgggcttaggctgtgatacgacagctttctcttgttcagtaagtgcatggcggaaatggcatctatggccatatgggcacacaaccccagcaaggaccattctgcagacttcagttttgtagcgtgggtggcggatcactgggcgaagctccccaataccatgagcaaattggcagtggtctccatatggacatgttccagtttcctgccacttattacacagctcagtcttgaacatcccttggttatacactatcatttcaagaggctcttcctctttctgccctccacgcacatataccttttgaacgggttcaggtggagtggcggaggcgcgtgggcgagtggcgcctttgttgcgagtggcattgctgttattgggggcgagagcagcggactgagccgtcttcaagtagccattggacctcacagaaatgctcttagggagcgagaacctctccaccgacagcaac

SEQ ID NO: 7136 - DNA, 1182 bp, Glycine max
  misc_feature (1)..(2): n is a, c, g, or t
  misc_feature (7)..(7): n is a, c, g, or t
  misc_feature (422)..(422): n is a, c, g, or t
  misc_feature (532)..(532): n is a, c, g, or t
  misc_feature (534)..(534): n is a, c, g, or t
  misc_feature (541)..(541): n is a, c, g, or t
  misc_feature (589)..(589): n is a, c, g, or t
  misc_feature (633)..(633): n is a, c, g, or t
  misc_feature (702)..(702): n is a, c, g, or t
  misc_feature (706)..(706): n is a, c, g, or t
  misc_feature (856)..(856): n is a, c, g, or t
  misc_feature (861)..(861): n is a, c, g, or t
  misc_feature (863)..(863): n is a, c, g, or t
  misc_feature (867)..(868): n is a, c, g, or t
  misc_feature (870)..(870): n is a, c, g, or t
  misc_feature (912)..(912): n is a, c, g, or t
  misc_feature (1013)..(1014): n is a, c, g, or t
  misc_feature (1036)..(1036): n is a, c, g, or t
  misc_feature (1039)..(1040): n is a, c, g, or t
  misc_feature (1054)..(1054): n is a, c, g, or t
  misc_feature (1060)..(1060): n is a, c, g, or t
  misc_feature (1078)..(1081): n is a, c, g, or t
  misc_feature (1083)..(1083): n is a, c, g, or t
  misc_feature (1085)..(1100): n is a, c, g, or t
  misc_feature (1102)..(1102): n is a, c, g, or t
  misc_feature (1116)..(1116): n is a, c, g, or t
  misc_feature (1128)..(1128): n is a, c, g, or t
  misc_feature (1141)..(1141): n is a, c, g, or t
  misc_feature (1145)..(1146): n is a, c, g, or t
  misc_feature (1165)..(1166): n is a, c, g, or t
  misc_feature (1170)..(1170): n is a, c, g, or t
  Predicted polypeptide sequence is orthologous to G3060
nnggggncgagtgatcttcagctcgataaactctcactaaagggaacaaaagctggagctccaccgcggtggcggccgctctagaactagtggatcccccgggctgcaggaattcggcacgaggttgcagctctgcctcatgtacctaatgggtctgcaccatctgccgttaagacccgcatatgcaacaagtttaatactgctgaaggttgcaaatttggtgacaaatgccattttgctcatggtgaatgggaacttggcaaacacattgctccatcatttgatgatcatcatgccatgggaccccctggagcaggtcgtcttgctggtcgaatggagcctccgggtcctgccgcaagttttggtgccaattccacagcgaagatcagcgtagaagcttccctggctggagctatcattgngaagggtggttgtgaactcaaaacagatctgccgccaaactggagccaaactttcaattcgagagcatgaatctgacccaaatcttagaaacattgaacttgaggaaagntntgagcanatcaaggaagcaagtaacatgggtaaggatttacttttgaccctgcanatgtctgcaccacctaaaacaaccccggtggtccttgtgcaccntgctctcatggaagcaaatttaagacgaagctgtgtgagaattttgcaaagggtctttgaccgtttgangatnatgcacttttgacaatgagcttctgaaattggtaaatcaggagtatgaactttctagtgaagccactagaccagggtataatttatgtggcatgtaatttagcagactgaggaccctttcaattatagtttgtggtagtgttagcacccnggggngnttgnngngggaatgatttttagtattaaaccactatttaaaaaaaaaanaaaaacttgggggccgccccatcccttatagagctaccgctctagtgccgtttaacggggatgaaaactgtacaattaagctgaaatccctttcccgtggnntaataaccacctgcttcaagtngcnntagaaggccctcgnttgtanatatggggggtgaccacnnnntnannnnnnnnnnnnnnnntnttctttttttcttntctttcgtccantatgggtttgtangtcnncccaaaattgaatgggcanncgcntacgctagtagg

SEQ ID NO: 7137 - DNA, 1154 bp, Glycine max
  misc_feature (1)..(3): n is a, c, g, or t
  Predicted polypeptide sequence is orthologous to G3060
nnnaagcggaggtagaatagaatcttattttgacctgtccacgccacgcgcgcaattaaccctcactaaagggaacaaaagctggagctccaccgcggtggcggccgctctagaactagtggatcccccgggctgcaggaattcggcacgaggcgaaggtcggtcccttcccacacatatataacatactgactggatgaggtaagaccagagaagttccgttccgacacgtgacgttcattctgtctgttggaactgttggccttttagggttagggtttcggtttgtggatctattgttgcctctgcgatggatcgcaagaggggaaggcctgaagctgccttcaatttcaatggcggcgccaagaaatcgaggcctgaaacggactcctttccaactggtttaggaagcaaatcgaagccatgcacaaagtttttcagcacctccggctgtccatttggtgaaggatgccacttcctgcattatgttcctggtggctttaaagctgtctctcaactgatcaatgttggtagcaatcctgttactcctcaagttgggagaaaccctgttccaccatccttccccgatggatcttctcctccagttgttaaaacccgattgtgcaacaagtttaatacagctgaaggttgcaaatttggtgacaaatgtcactttgcccatggtgagtgggagcctggcaggcctacagccccatcatatgaagatccccgggtttgggacaatgccaaccacagggtaagtgccagttgagccccccattcactcaaggagcggtgccgctttggaacttgctccgtcaaaaataagacaaggcttcttactgggcctgcatggaaaatggtgcacctcgaccaatttgcgggcaaggacctactttccataggaccggacccgaccaaccttaaacatcgcctgaacggtttgatcatcaacacccggccatgtcaagagtttcaaatgtatttgctttggcccaagaaagttacttcgactttgcctacacattaaaatagttgcaaacttgcaaggctggcttgggaaggtacttccaggactgaaatgccagtgatggatgttatattttacgggtgaggcaaattcagttcaattaaacgtcaatgccggacattag

SEQ ID NO: 7138 - DNA, 990 bp, Glycine max
  misc_feature (5)..(5): n is a, c, g, or t
  misc_feature (37)..(37): n is a, c, g, or t
  misc_feature (42)..(42): n is a, c, g, or t
  misc_feature (51)..(52): n is a, c, g, or t
  misc_feature (54)..(57): n is a, c, g, or t
  misc_feature (59)..(59): n is a, c, g, or t
  misc_feature (71)..(72): n is a, c, g, or t
  misc_feature (193)..(193): n is a, c, g, or t
  Predicted polypeptide sequence is orthologous to G3061
ccaanataaaaaaataaaataataaaaaacaaaaaanaaaanaaaaaagtnngnnnncncgaatttcaaanngcatgattcgtggcagagcgtgctagagaacacctcactcaaagggaacaaacagctggtagctccacctgcggctggctggttcggctctcagatacttgctgcgatcccccgcagggcntcgcaggcaagtgtcgggcacgtagtgtctatggtctcatcttgctcatgacttatatgggtgcactgcgcttcaatcagcgtatgacatcatgttctcttcacacaacctcggcctccacgctatcacaaatgttcgtctttctgagatgttgatcgctgatgcaggtcaagcgaagttgcgttccaagtctggaaattaaagcacattcctaaccttttgttctgatgaaatggacggagctccagctggataaaattgttgggtgcaacaccctgatgaattaaggaaaaggatcaattgttttattcaccagaaacattcacccaagtcagtgtgatgatgcttgaacgaacacattaacagttgccggagctgtaaatatgacccattatgtttattatcttaataaaataaagtactaaataaaattgattccttgtatgtcacaaattccaagtggttgatcttttgttatttgtataagtttcggtgtgtacatggaatagcgtcggtacgaaagggcaagttgctgtacaataaaagggtatttattgtgaaaaacacaaagaaacacacaaaaaacgacactccgggttttgttgtgtgttttttgttgttgtggagcagcgaataaatgtccacacaaagcttgaatcacgcggctaccacatacgacatgtggggagacaacgtgccccttgtatctgtccactgatgatcgcgtgtcactcggacgagtacacgaccactcagggtaacggccaaacagacacgccacaacacgccggttcgtt

SEQ ID NO: 7139 - DNA, 749 bp, Glycine max
  misc_feature (1)..(1): n is a, c, g, or t
  misc_feature (12)..(12): n is a, c, g, or t
  Predicted polypeptide sequence is orthologous to G3067
nttggatgtctngttagaatcacccccagctctaatacgactcactatagggaaagctggtacgcctgcaggtaccggtccggaattcccgggtcatgagctgagtgttggagacccatcaagaaaaattgtggagatgatatttcaaaaagcttggtttaacaaatcaaagccagtgaagaaggtcagaacagtcctcagggtgagttactcagaagaagtccttgaaaggtttgagaagtatagagaatatgtcaagaaggtggcctctgagcaaaatccaaggaatccaaggagcgcagttgatgggaacgaactgttgcagttctatggtactacaatgagatgttttcaaggaaaatctgctaagaaagttcatgatctgtgtaaagatccatcttgttatctttgtcaaataattcagtttaatttcaacacacgatatgccgagattcacttgaatacaagtgacaaagagtcgagaaacagaacaactgccactgccagagtacataatgtgaaaaaagctgcaataatttgcaggataattgctggaactgcagtaaatgaagttgatggtgaatatgaaaggtctcactcaactggggttggagaaatgcagtttcccctaacatagtttgtagtaaaagatccccagtctattcttcctggttttgtataattttcagctaccatgtatggtcgtgtaaattgccgatatcctatgatttttgtgaggcgtgtcatga

SEQ ID NO: 7140 - DNA, 884 bp, Glycine max
  Predicted polypeptide sequence is orthologous to G3074
agaaaatagttatatagttatttgcagcaatattaaacaaagtttgcatgcaaaaatttaactcaatctagaattgtgatatacattgtaggcctaaaagtacacgaagctaacattactggtcaaggggaagataaatcagctccacatacaaaccagattaatgaaaaggggcattcagatctttcttcagccaacaacatggtacatgcattgacagctagtggatactcataatcataacactagtatgtacttattctacagttatcatgatgaacttttcactaatctaatcaccaaagactaataatatttacccctcctcttcatcatagtcttcctcctcctcttctagtggcctaccaagttgtgcaagctgcagtgaatcaatggccatcttgtccacatcagaaagtgaccaccccggaatttcttcatgcttgctctctgttgggggttcaggcaatgaggcatcaggttcaggcaccgaggcggaggcatcagcttctgcactagcctttttgtcatcgttttcattcgtgatggcattcagatcaatgttccggagggaatccgtgcttacaacaggaacaacgggagctgcaatattctcctcctttggtatctcctttgactcagaaccattatccattgctatacttgtgtttgtattttgtgggttgctcggctgaacagaagtgcaaggctcagattcagcatcttgatgatatgtctctctatttaaaggtggtcgccctcggccacggcctcttcctctacctcggcctcttcccctaccagtactgccagtgtggcccaactcaagcatcttgctccctctagcctcttcatcgctgtcattaccatcatcaccaatagct

SEQ ID NO: 7141 - DNA, 704 bp, Glycine max
  Predicted polypeptide sequence is orthologous to G3075
cttttcattttttttttttttttttttttttttttttacgggaataggattactaaaataaatacaatatggaaacttaaagtacagcattactcatcatgatgcatgtttccattacaaaatgttacatgattaaataaagtataagcttatattctccactagcttgctttaaattttttaacttcctccttttcctgctgcacttctctctcttaatgcatcctcagcttttactctctcaggaacaaaatcagagagaaagtcatatctcctttgcttacttacaacatgtgctaggtgatcatagctgaggcatttcttgcggtcctgagcacaaaaggcataagcgtcctgcgtgaactgctcaaggaacttttcctgcaatgaaaaggaggaaaacgaagaaggatagagacatcgaaaaagaggagaagaagacgcaaggaatagaaaacctaccacagtgttgttgatggcaaacaatgcttcctgagaaacacgcatttcgggatcttcgcccttaatcatcgtcctgatgcgattcatcggaaacacgttcattttcgcctcttctccgtttccttctgctgctactccctttttggatccctcgtctcgctgttttgaagtgccgttgctgagcttggccttcttaatcttcttcttgttctcctcttgtgagattctttgttcttcttcgt

SEQ ID NO: 7142 - DNA, 940 bp, Glycine max
  misc_feature (39)..(44): n is a, c, g, or t
  misc_feature (53)..(53): n is a, c, g, or t
  misc_feature (60)..(60): n is a, c, g, or t
  misc_feature (64)..(64): n is a, c, g, or t
  misc_feature (67)..(68): n is a, c, g, or t
  misc_feature (727)..(727): n is a, c, g, or t
  misc_feature (795)..(795): n is a, c, g, or t
  misc_feature (885)..(885): n is a, c, g, or t
  Predicted polypeptide sequence is orthologous to G3083
aaagtatcccccccccccccccccccccccccccccccnnnnnnccccagtgnccaaacngganaannaccaggtggtggaccgcgccccccaccctcactaaagggaacaaaagctggagctccacagcggaggcggccgctctagaactattggatcccccgggctgcaggcgtcagcgacatccaatgcgacactgtgaaggaggagaatgcaataacggaggagctatcagagtggcaggacagtgtgagcgagatgatgggcccaggtgcgaacatcaacgacaagatcggacggctggtatgcatcataaagaaagcagatgatctacggctgagaaccttgcggagtgtggtggggctactgtcgccgcagcaggctattgagttcttgattgcatcggcggagttgctagttgggatacgcggttggggattgaatcatgaccgtccacgtggcagatgaaagtggaattgagtttaggccacaatttctctattttgattgaaattcattgtggccttaaaatgattgtgtattatttattactagttactagaactagaacagtccttgctgaacaaatatttctttctgctgattaaaaacaacagtccttcgctattaggctgcagcctaatccaaaaaaaaaaaaaaaaaactcgagggggggcccggtacccaattcgccctatagtgagtcgtattacgcgcgctcactggncgtcgttttacaacgtcgtgactgggaaaaccctggcgttacccaacttaatcgccttgcagcacatncccctttcgtcagctggcgtaatagcgaagaggcctgcaccgatcgtcctatccacagttgcgcaggctgaatggcgaatgggacgcgcnctgtagccgcgcatttagcgcggcgggtgtggtgttacgcgcagcgtgacgctaa

SEQ ID NO: 7143 - DNA, 929 bp, Glycine max
  misc_feature (1)..(2): n is a, c, g, or t
  misc_feature (28)..(28): n is a, c, g, or t
  misc_feature (527)..(528): n is a, c, g, or t
  misc_feature (578)..(578): n is a, c, g, or t
  misc_feature (644)..(644): n is a, c, g, or t
  misc_feature (730)..(730): n is a, c, g, or t
  misc_feature (902)..(902): n is a, c, g, or t
  misc_feature (924)..(924): n is a, c, g, or t
  Predicted polypeptide sequence is orthologous to G3091
nnaatcttaatcgtactccagcgctcantaaccctactaaagggaacaaaagctggagctccaccgcggtggcggccgctctagaactagtggatcccccgggctgcaggtcaaaataccccaccataagacaaacccaaaggaatagcaacgtcaattatggtgggaggtttcaatggagaaggtgttgtgagagaaaaagaggaagaagaagaaaacaacaagtggccttcatggctgcagccacttctcaagacacgtttctttgttcaatgcaaagtccacgcggattcccacaagagtgaatgcaatatgtattgcttggactgtgtgaatggagccctttgctctgcatgtctctcttcccacaaagaacacagaataattcagataaggaggtcttcgtaccatgatgtgataagggtgtctgagatacagaaatttctggacataacaggtgtccaaacttacattattaacagtgccaagattgtgttcttaaatgaaaggccccaacctaggcctgnnaaaggggtcaccaatacctgccaagtctgtgagcgcagccttcttgattncttcaacttctgcttctttgttgtagattgttggaacctcaaaaagttccgaataaaaaaatgtangtgagcagatggtgaagaatcagtacggtataagaaatatgcagtgcagaagaaatcacagcttacacctcacacacacacagtgntaatcagactgcagagagaaaagatccataagtcatggtgagctatatgatctatgtgataggttctgactacatcatatattatgaaagatcgagtgtgtaccttctagtgacctagataaaattgtctattatgatgaacttgctgcatgagcggtgacttgttatggtngagaatgcaacagatataactnaaggg

SEQ ID NO: 7144 - DNA, 1274 bp, Glycine max
  misc_feature (594)..(594): n is a, c, g, or t
  misc_feature (749)..(749): n is a, c, g, or t
  misc_feature (777)..(777): n is a, c, g, or t
  misc_feature (964)..(964): n is a, c, g, or t
  misc_feature (1121)..(1121): n is a, c, g, or t
  misc_feature (1155)..(1156): n is a, c, g, or t
  misc_feature (1162)..(1162): n is a, c, g, or t
  misc_feature (1181)..(1181): n is a, c, g, or t
  misc_feature (1197)..(1197): n is a, c, g, or t
  misc_feature (1242)..(1242): n is a, c, g, or t
  misc_feature (1267)..(1269): n is a, c, g, or t
  misc_feature (1271)..(1274): n is a, c, g, or t
  Predicted polypeptide sequence is orthologous to G3091
ggggggtaattttttttaccaccgtttccatgacaccgccaagcgcgcaataaccctcactaaagggaccaaaagctggagctccaccgcggtggcggccgctctagaactagtggatcccccgggctgcaggaattcggcacgagggaaaaggtgtcacaaacacttgtgaagtctgcgagcgtagccttcttgattctttccgcttctgttctcttggttgcaagattgttggaacatctaagaacttccagaagaggaagaagcagtcaatggcaatgtcatcagattctgaggactcgtacagcagcaacagcgtccatggtcttaagaaaaactgcaaagtccagagcttcacaccatccacaccacccccaacttcggttaattacagaacggccaagagaagaaagggaataccacaccgtgccccaatggtgggactaatcatagaatattagtgatagtgggtatttttaggctatttgctataatgctcttaggtagtataaaaatactactatactaatgcgagtgtttcgacgtcgtttcatcaaaatccaatactcgagctttcctagggcaggtattggngagtgtcaccgtccttctttctttttttctgtagtgatttctaagcgtttgtatatatagaaagtccaatagaactggaaaaggctgaagaggtagaaataagacacctatgaaatagttgatggtgcagtgatcaaaagattggcatgtagcanaattagcaaagctcttttcaaccttagntaaagtgatgatggttgataaagacttataggggtttggtttctaagggaaaatataccttaatttttgggggtgagggatatggaataatgggttaagtaaggtggggaaaaggcccaatgaaaaggcccttttgggaaaaaggggggttgctctatatattggaaaaagaaaaaaaaagtgtttnattatccaaattttcctttttctcttttcatcggggaaaaattagagaaaatttccaaacttaggaaccctggtctaggggggaaatcgtccgggcccagggtaataaactccaattaatcaggggggccgcccacccgttaattggaaaggttgcnacaaacccttcaacaatgtgggttgggaaacaanncttggntctaaaaaaaaatgccccncctataaaaaaaaagnttttttggccccccgtccccggggaatatttagggcggggttttncccctatgggggactctggaaaaannnannnn

SEQ ID NO: 7145 - DNA, 928 bp, Glycine max
  misc_feature (654)..(654): n is a, c, g, or t
  misc_feature (721)..(721): n is a, c, g, or t
  misc_feature (737)..(737): n is a, c, g, or t
  misc_feature (741)..(741): n is a, c, g, or t
  misc_feature (761)..(761): n is a, c, g, or t
  misc_feature (766)..(766): n is a, c, g, or t
  misc_feature (789)..(789): n is a, c, g, or t
  misc_feature (818)..(818): n is a, c, g, or t
  misc_feature (820)..(820): n is a, c, g, or t
  misc_feature (853)..(853): n is a, c, g, or t
  Predicted polypeptide sequence is orthologous to G3091
cccggtgtgttgatccccggtcgctgactaccccaagcgcgcaattaaccctcactaaagggaacaaaagctggagctccaccgcggtggcggccgctctagaactagtggatcccccgggctgcaggaattcggcacgagcttggttgcaagattgttgggacttcaaggaacttccagaagaagaaaaagtcagcggcaatgggatcagacacagaggattcttcgtacagcagcaacagcagccatgggaagaagaacagcttcacaccgtccacaccgcctccaacttctgttaattacagaacggccaagagaagaaagggaattccacaccgtgccccaatgggtgggctagtcatagaatactagaaattaagttagtagtaactttaggttatttgctataatgccccctgataaattttacctcaaaacgcaactttctccgtgcagtttcacccgtcacaacacactcgagctttttgctgtaaaaggccggtgctggaattgtgttcccttctctgttccttgttaatagcgtttgtctatataggaaaaatccaatagaagtgaaaaaaaggttgagaaagtagaaaaaaaataagaccatggatctgtgaaatagtttgagagaaaaagatggtgcagcanaataagccaatgttccttttcaacccagtacaggaagatgaggaacatttatagggttgttctagangcattataacgtagtntttngggggtgtggaatagtgctntgggngagaacgtgaacatgtactcttncaataggatggattgttatgggatgtganantaatatagtctttatgatttctaaaaaaaaaanaaaactcggggggggcggtcccaatcgccctattagtatgataccgcgtcacttggggcggtttacacgcggact

SEQ ID NO: 7146 - DNA, 753 bp, Glycine max
  misc_feature (1)..(1): n is a, c, g, or t
  misc_feature (549)..(549): n is a, c, g, or t
  misc_feature (553)..(553): n is a, c, g, or t
  Predicted polypeptide sequence is orthologous to G3094
nagagactgaggatcacgccaagcgcgcaattaaccctcactaaagggaacaaaagctggagctccaccgcggtggcggccgctctagaactagtggatcccccgggctgcaggaattcggcaccaggcagaaccaccttggcttgcactgccaccaccgaaattgtgagaaagaagaggaccggcggctccactttccggccaccgtgccggccggcgtgctcgccagtctcggaaatctcagcgggtctcatgaaccggaggaaagggaacccccagcgggccccactctattgaagaacttgcgagagagggtgaggaggttcttttgaaatgaaaacaagaaaaaatactttatcaaatattattattctaaatattgttattattatggagtttaaatctggggttggaacttggaacttactataccttacaggggaagaaaaaaataacctcctagttttgtagagagtatcaccctctgctttgttgttgcagctatgtatctatctacccggtttgttagaatttattttgaggtttaanaaanaaaaaaaaaaaaaaactcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccaggctggcgtaatagcggagagggcccgcaccgatcggccctc

SEQ ID NO: 7147 - DNA, 940 bp, Glycine max
  misc_feature (1)..(1): n is a, c, g, or t
  misc_feature (16)..(16): n is a, c, g, or t
  Predicted polypeptide sequence is orthologous to G3111
naggtgccggggtcangccaggattctgctaagctctaatacgactcactatagggaaagctggtacgcctgcaggtaccggtccggaattcccgggtcgacccacgcgtccgggctccgccggggacccgtcgccggctccggctctggtgccggagaatcgccggcgacggcgaacaagggcctcaagaagaaagtggtgaattcactgccgaagttcacctacgccggcggcggcgaccggtgcaagtggtcggagtgcgcgatttgcctgacggagttcggcgccggcgacgagatccgggtgctgccgcagtgcggccacgggttccacgtggcgtgtgtcgacacgtggctcgcgtcgcactcctcgtgtccttcgtgtcgcgcgcggtttgccggtaccgcgcgctgccataagtgcggccattttccggcggtttccgcagccgccgcatcggagtccaaggccgtcggcggcgacaatgctgccgatagcactgcgaatgcgaatcgtaataatgttattattacgaatggatttagtaattacgggttcttgccttgaaagctgttttagtaattacgagttcgcatgtaagtatagataaaattaagtgcttctttcatcatactatactgttcctcatgtgtgatgtatgacgaatttacgaataccctccttcttttgtatttgtatagagtcaactctttgcgcggcatcgataacaaatttagacttgatcatgtcattgacataagaataaaaagagaaaaaaagaggaaaaagggcgcccggtcttaagatccagacttacctcgcttccatgcaactctaactcttctatattgacctatatcaatcacctgccgctatttacacctgtaacgtgaaaaccctaacttccaatgtaatctcgttatacaattccccttgcaa

SEQ ID NO: 7148 - DNA, 945 bp, Glycine max
  misc_feature (23)..(23): n is a, c, g, or t
  misc_feature (945)..(945): n is a, c, g, or t
  Predicted polypeptide sequence is orthologous to G3111
ccccagtgaaaaaaatttaccancattgttcggttgccttactaagggaacaaaagctggagctccaccgcggtggcggccgctctagaactagtggttccttcgggctgcaggaattcggcacgagtctctctctctctctctctctctgttcactctcactttttgttttcacctcctcctaatttccaagcacactttctttgtttcttatttcttcctgtctcaattataagtaaaagaaaaacatatttttaaggagattactgggacagctagatgacgcgagcgttcagaattctcgggtccgcggacaacgccacctcgctggcagcggtagcggcgccgccggaggcggtggcgcttgagtacgaacttctgggtgattctcgcggggctcctctgcgccctcatctgcgtggtggggctggtggccgtggcgcggtgcgcgtggttccggcaaggctccggcggcggaagctctccccggcaagccttggcgaacaagggcctaaagaagaatgtgctgcagtcgctgccgaagttcgcgtacgtggacagcaaccccagcaagtgggtggcgacatcggaatgcgcgatctgcctcgccgacttcgccgcctgcgacgagatccgcgtgctgccgcagtgcggccacggcttgcacgtctcctgcatctacacgtggcttgggtcgactctacttgccctactgtcgcagatattgccgcgaccagtgtcagagtgtggcgtttcccgcaccgtggcgtacttcagacgcctcgaccgacccgaatgagttacgatagatacacgcccctagatcatattacaaattatgacacccgatgcgctgcatacagtgacgtactcgacatgttcgtctcatgggatggtgctgcgaggactataggcgcttattactctcgatcagctgtgcacttn

SEQ ID NO: 7149 - DNA, 783 bp, Glycine max
  misc_feature (664)..(664): n is a, c, g, or t
  Predicted polypeptide sequence is orthologous to G3967
aggatggctgtgccagggtcggcgccagcgcgcaattaaccctcactaaagggaacaaaagctggagctccaccgcggtggcggccgctctagaactagtggatcccccgggctgcaggaattcggcacgagtttattcatacccctatttgtaaagacccctgtgatagaagtaaaagaaaaaatcagtgtgaaaatagtaggtgccttgatcctgggcagacatctacttcgacttctgaggattcatcccgctcaaaattcagcaaaaaaagtgagagaacttcatattcaaatgaagcatcaggatgtacctttgaaaaagctaccacaagtctcccatttgatgcttctgatctagccaatttcttaactatggacaggcatataggatttaattgcagtgcccaaatttttctgagatcgaggcttgcagagaagcaacagttatgtttctctgtagtatcactactatggcagaagttgattggatctcctgaaactcaaccttgtgcagaaagcacttctgctcaacaggggtggagacaggttgctgatgcattatgcaaggttgtatctgcatctcctacgaaagcagctatggcagttgttcttcaggccgagaatgaattgcagccatggattgccaaagatgacaatctangtcagaagttgtggagaatcaatcagctgattgtataattgataactgaactattgatgaatcatgataattttgaatcattactaattgtggcaagtgcatcagatttactactacca

SEQ ID NO: 7150 - DNA, 806 bp, Glycine max
  misc_feature (618)..(618): n is a, c, g, or t
  misc_feature (650)..(650): n is a, c, g, or t
  Predicted polypeptide sequence is orthologous to G3967
tggatctcgattatgaggggcgggggtggcgcgcgcattaccctcactaaagggaacaaaagctggagctacaccgcggaggcggccgctctagatctagtggatcccccgggctgcaggaattcagcacgaggacaagttcctcagctgttgatcttccggaaattataggtgcaaccccactacagcctcccgtgctgtcatggaatttgtacatacccctattgaaggtcctggaatatcttcctcgtggaagcccatcataggcatgtcttatgaaaatatttgctgctacagtggaagctattcttcagaggacatttccacctgagtccactagagaacaaaacagaaaatcaaaatacctagctggcatatgctttggctctgcctcaaaaaacctggccgtggcagaacttcgtacaatggttcattcactcttcttagaatcatgtgcatatgtagagcttgcttcacgcctactttttgttgtcttaactgtctgcgtcagtcatgaagctcaattcagtggaagcaagaggccaagaggagaagatcactattcatctgaggatatcattgatgacttacagacatctgacaaccatgaagaatcanagaataggaaattgaagacgcaaggtcctgtngcagcatctgatctaatgttctggctgcgctaggcgctatgctgtgagcctcagttgtcacctttgatttcacgggggaaataatcatttagcttccaataacgctgcagatatagtccagcctgatgactaaatgcatcttctatgatttgcgga

SEQ ID NO: 7151 - DNA, 818 bp, Medicago truncatula
  Predicted polypeptide sequence is orthologous to G28, G22, G1006
ggtagagagagaactagtctcattgcttccacaaacggtagactttagatccaaaataccactactctttcctccaaaacatggcttcaaccaccaaagactcagatttggaatatttggaacacattcaacaataccttctttttgatgattctagcatgctgaaatctcatcaaccttttccaagccctaaaagtgacaatgatttagacacaactgtagaggcgcgtgaagtaagcatgcctcctgtatggaagcggtacaagggagtgaggcgtaggccatgggggaagttcgcagctgagataagagatccaaaaaagaatggtgctagagtttggcttggaacgtatgtgactgaggaggaagcagctttggcttacgacaaagctgcttttaagatgcgaggccgaaaggccaagcttaattttccccacctcattggctctgatgtgtctacatctgagccagagaggggaggtggttttgaaaagggaatcacccgagccttcttcttcttcatcggagggaagttgtgagtcagtgtaccagggttgaagaggaggaggggcatggttgacctacttaacaaattagccaagaatagaagccaagtagccaccgggtggttggcgttgaaaaggcctcacaagcaaatgattttgagcagtgggtgaatgagttgaatgattgcactctaatctagagctcatagtgtaggtgcatttattttattttttcttctaatttgggcagtttcctaatatttttttcatcacccttttgatattaatcaaaggcgtgatgttaagcaaaac

SEQ ID NO: 7152 - DNA, 837 bp, Medicago truncatula
  Predicted polypeptide sequence is orthologous to G481, G482, G485, G1364, G2345
atacaaacataatattcagggttccgacgatatgtccgaaactccggcgagtcctggcggcggcagccacgaaagcggcgaacacagtcctcgttccaacatccgtgaacaagaccgtttccttcctatcgccaacatcagccgcatcatgaaaaaagctcttcctgctaatggtaaaatcgctaaagatgctaaggaaaccgttcaggaatgcgtctccgagttcatcagcttcatcaccagcgaggcctctgataagtgtcagagagagaagaggaagacgattaacggtgatgatttgctttgggcgatggctactttagggtttgaggattatattgatcctcttaagatttaccttacaagatacagagagatggagggtgatactaagggctctgccaagggtggagacacatctggcaagaaagacgttcaacaaggttctaatcctcagcttgttcatcaaggttctttctcacaaggtgtttcctacacaaattctcagggtcaacatatgatggttcctatgcaaggtccagagtaggtaataagccaattgatcttctcacagtggttgcggtgttttcagttcggtgctggtagagctttactaaatgccgtcggcataattgaatgtatttcatgtaatgttaatactggcataagacacattggttcttgtgtcctgattttttttctctctaaaattatggtttgtatataatgtgtggagtaaaattatttatttcaaagttacatttggtagtgctggacccatggtagtcttgattccttctggcggctttggcaaggcttttagaattaggtagctga

SEQ ID NO: 7153 - DNA, 577 bp, Medicago truncatula
  Predicted polypeptide sequence is orthologous to G481, G482, G485, G1364, G2345
gggttttagttttagggtttatgcgccatggcagatgcaccgaaccaatgcgaagaaagccacgagagtggtggtgaacagagtccacgtggctcttcttctgcttcacgtgaacaagatcgttttttgcctatagctaacattagcagaatcatgaaaaaagctttaccttcaaatgggaaaattgctaaggatgctaaagatacgatgcaagaatgtgtttctgaattcatcagctttattaccagcgaggcaagtgagaaatgccagaaagagaagagaaagaccattaatggagatgatttgttatgggctatggctactttaggatttgaagattatatagaaccacttaaggtgtacctagcaaggtacagagagttagagggtgacagtaaaggatctgttagaaacagtgatggatctggtagacgagatcaagttggcggtcctccaggtcaaaatgctcagtttgttcatcagggttctttgagctatattgattcccaggtgcatccacaacatctggttatgccttcaatgcaaaatcatgaatagattagatgcttctcctcac

SEQ ID NO: 7154 - DNA, 718 bp, Medicago truncatula
  misc_feature (652)..(654): n is a, c, g, or t
  misc_feature (674)..(676): n is a, c, g, or t
  misc_feature (680)..(687): n is a, c, g, or t
  misc_feature (705)..(707): n is a, c, g, or t
  misc_feature (709)..(714): n is a, c, g, or t
  Predicted polypeptide sequence is orthologous to G481, G482, G485, G1364, G2345
cccgggcctgcagggaaactcctaccattcccgttcccaattccccttcgccggcgccaccaccatcaccaccgccgacaccactctcctccctcacacaccaccacaaatccttcagtacaacgttcttcaatttcacgcagaaacttagtcaactaaattgtatcctctctgaacacgcaactgccgagactaatcctttgttctggtagacactactcaagagtaaaatcacatcaacacttcaattccaggattctggtgagttttttccgaatacagttattaaattttgcaggaacccgagtcaacgcaatccgagttgaatccgtgactcgccggcggtgaactttgattcgagttttacgtcagaaagttcacgatggcggactctgacaacgactccggcggaccacacggcggaggatcaaacgctcacggaagcgagatgtcaccacgagaacaagaccgatttcttccaatagcaaacgtaagcaggatcatgaaaaaagcactaccagcgaacgcgaagatctcaaaagacgcaaaggaaacagttcaagagtgtgtttcagagttcatcagcttcatcaccggcgaagcctccgataagtgtcaacgtgagaagcggaagacgatcaacggcgatgannngctttgggcgatgacgacgnnnggannnnnnnngtatgttgagcccgtgannngnnnnnncacg

SEQ ID NO: 7155 - DNA, 844 bp, Medicago truncatula
  Predicted polypeptide sequence is orthologous to G867, G9, G993, G1930
taatacatacactcttcttcatacttacttcattctccttcaacaacaaaaatacaaagttagttataaaaatatatatatatatttcaattcaaactttgctagttattaacagaataacagaaaaaatggaattaggaggaagttccacagatgaaactgtcacaagcaatgactctctttcggcgaacttatctacaccgccgccaacgctgaactcactaagccgcgttggcagtgctgctagctccgtcgtggatccagaaatctacggcgtctccggtgaggcggagtctcgtaaacttccatcgtcgaaatacaaaggcgtggtgccacagcctaacggacgttggggagcacagatttacgagaaacaccagcgtgtgtggcttggtacgttcaatgaagaagacgaagcagccagagcctatgacatagccgccttgagattccgtggaaaagatgctgttacaaattctaaaagtctcactggcgttggtaacgacgccgacgaaggtgaaactgagtttctgaattcacattctaagtcggagattgttgatatgcttcggaaacacacctacgatgacgagcttaagcaaagcatgcgtgacatgagcggtggaagacagcggcgtaacggagaattgaatggtgcggtttcacgtggcgcgtgtgatgctaaagcgcgtgagcagttgtttgagaaaacggttacgccgagtgacgtgggggaaagtgaatcggttggtgataccgaaacagcatgcggagaagcattttccgttgaatgcagttgctgttgccgtcgcatgcgaccgaatctcgacggctgctgcggcgg

SEQ ID NO: 7156 - DNA, 548 bp, Medicago truncatula
  Predicted polypeptide sequence is orthologous to G867, G9, G993, G1930
gtcaaagttacgttctaacaaaaggatggagccggttcgttaaggagaagaatctgaaagccggtgatacggtttgttttcaacggtctactggaccggagaagcagctgtttattgattggaaagcaaggaagaatgttaatgaggttgggttgtttgttccggttggaccggttgttgagccggttcagatggttcggttatttggggttaatattttgaaacaactccctggatccgatgttaatagtaatggtaatgttattgctgggttctgcaatggaaagaggaaggagttgaatatgtttacttttgactcttgcaagaagcctaagattattggagctttgtaacattacgttaactttatattttttgttttttgagtttttgtgactgataatatgaaagaaatggatctcaaacaaagaaatgagagatccatggagatggtactgtagttgcaagttgcaaagagtaaattgtatattacttaattagaagaagaaaaaggaagacggtgaaagtaggtgtaacaaaactgtaca

SEQ ID NO: 7157 - DNA, 515 bp, Medicago truncatula
  Predicted polypeptide sequence is orthologous to G1274, G1275
cgcgggacttgctaggtagctagtcccccgtaaataatggcacttttgcattatttgtgtgacactgtagctatgtgtgtgtgtctgaaagagagagattctgtgcactgggactgttgatcttatcaggaactactacaagtgttcaggtgaaagatgtggtgttaagaaaagggtggaaagggatagggaagattcaagctatgtgttaacaagctatgaaggtgttcacaatcacgaaagcccctgcaattcatactgcaccccagtgtctttggtgtattccaatgaatggccacagcagaacccttctgcaacctcttcttccaattaatgctaagttaatcatatagtataagtatatgtgtgtgtgtgtatatatatatatatagctagctgctcttaataaaaggctaggaaggtttgatcgagttggtaagttgtattggctatcttcctgttatctaatcatagttattttctgctaataaaaaaaaaaaaaaaaaaaaaaaagt

SEQ ID NO: 7158 - DNA, 824 bp, Medicago truncatula
  Predicted polypeptide sequence is orthologous to G1945, G2155
tcacccttttcaactttctcatcatgaatgtcaaccaatcggtgaagatgataacaacaaccaccagcggcggcgttgctaccactcagaaacctaacacctccggcgacggtgcaactatcgaggtttctagacggccgagaggacgtccacctggctcaaaaaacaaaccaaaaccacctattatcatcacaagggatccagaaactgtgatgagtccttttattctagatatttctggtggaaatgatgttgttgaagctatttcagagtttagtcgtcgtaagaatattggtttatgtgttttaactggttcaggaactgttgctaatgttactcttcgtcaaccttcaactacaccaggaaccaccgttacttttcacggccgttttgatattctttctataactgccacttttgttcctcaacaacacggtgtttctccggcgattccgagtaacttctcgatctctcttgctggacctcaaggacagattgttggaggaattgttgctggaaatttgatagctgcagggacggtgtttgtgattgcttcttcgttaataatccgtcgatcataggttgccgttggaagaagatgaaggtggaaactcggtgtctggtggtggtgaaggaaactcgcagaatgtttccggtgcggtggacagtggacaagtcagggtggtgggtggtgagtcctgtgggatgttcgatgtacaactgtcatttgccgtcgtcggatgtgatttgggctccgtctgctagacccccaccaccttactgatatcatcatcattcacattttcataaacctttgttgcaaa

SEQ ID NO: 7159 - DNA, 794 bp, Medicago truncatula
  Predicted polypeptide sequence is orthologous to G1945, G2155
atctaaaaataaaaaacttaaccaatcttcctagaaaacgttacacccaaaccatgaagaacaaagaaaaaaaaaaagccacactcatactacaactacaaaaaaaatatcaacaaaaagtgatgattaatatatcagaaatttgttcttgccgttggagcccaaatcacatcagaaggaagctgagagctatacatacacgactctccaccagaaagctgcggcggcgacttctcttcatagccgccggagactgagttattcctcacatcctcttccaaaggtaatctatgataagaaggattgttaaaggaagcagcaatgacaaacaccgtaccggcggcaagcaacggaccgacgacaaaccctccaacgatctgaccctgaggtgcggcgagtgagattgagaattctttgttcatgggtggtgaggattctaacggagagaagaacgtggcggagattgaaagaatgttgaaacgaccatgaaaagtaacggtggtgccaggaggaccagaaggttgacggagtgtaacgttagctacagtgcctgaaccggttaatacacataaaccggtttttcttctgttactgaaccgggatattgcttcaacgacgtcgctgccttctgggatttcgagaatgtgtgggctcatggcagggtcggaggagtgattgattatgatttgtgattgggctttaggcttgtttttggagccaggtggacggcctcttggcctacgacaatttcaatggtggcgccgtcgttacaggaaggtttgtttgggctgggc

SEQ ID NO: 7160 - DNA, 638 bp, Medicago truncatula
  Predicted polypeptide sequence is orthologous to G3
ggcacgaggttgagacacaatatatatggtacagcaaagcgaatcaactaggaggatcatggaagaagaaagagattgttgttcaacaataataagaaacatagaaagcaacaacaaacctcaagagaaacacaacaaacaacaactagagaaaccatacagaggaataaggaagagaaagtggggtaagtgggtagcagaaataagagaaccaaataaaagatcaagaatatggttaggttcttacatcactccggtagctgctgctcgtgcctacgacaccgccgtattctatttaagaggtcctacggctcgtcttaatttccccgaattattgctcgaagacgacgaagaaaacaaggacggttctattcagcaaggtaacatgtctgctgatttaatacgcaaaaaagctaccaaagtcggtgctagagttgatgctcttcaagcggctcttcaagcttcttctcgttctgattccgatcaattcaacgctgatgtgaaacctgatttgaacaagtttccagaacctgaagattattaatgctttttcacttagaggtttaatattattgatatgatacttagtttctctctgtaatctttaatatccatcatctattaatcaacccaatatt

SEQ ID NO: 7161 - DNA, 827 bp, Medicago truncatula
  Predicted polypeptide sequence is orthologous to G4
caattggggtataacaaagtttcaaccttttttcaagagagagaaaaaagatgtgtggtggagctattatctccgacttcattccagctgcggcggcggtgggtggttcccgccgtgtcacagcggatatcctctggccgaatttgaggaggaaaccaagttcaaggaaaccttttttgcttgacgatgatttcgaggctgggttcagagagtttaaggatgattctgattttgatgaagacgaggatgaagatgatgatgaagggttgttggtcggtgtcaaaggtttcacctttgcttccaataagaacaacaaatcttctaagtcctttgttcgtggatcaagtgctgcaaaatctgttgctttgaattcaaaccagcaagctgaaaaggattcgaagagaaagagaaagaatcagtataggggtatccgtcaacgtccatggggaaaatgggcagctgagatccgtgacccaaggaaaggagtccgtgtctggctcggaactttcaacactgctgaagaagctgcaagagcttatgatgctgaagctaggagaatccgtggcaataaagccaaggtgaatttccctgaagaggctccggttgcttcctcaaaacgtctcaagaaaaatcctgaagatgcagccctgttgaatgataatctaaactctttcaagccgaacggaaaccaaatgttcaatttcagtgaaaatatggagaactactattctccctatggatcaggtggaacagaaaacattggttaacaaccaatatgctggacatcggagcttcttccggaaacggagtgcagcttacatctgctg

SEQ ID NO: 7162 - DNA, 804 bp, Medicago truncatula
  Predicted polypeptide sequence is orthologous to G4
gtggtggtgcaattattctccgacttcatctcaactgcggcggtggtgggtggttcccgccgtgtcaccgccgacatgttgtggcccaatttgaggaaatccagttccagaaaaccgtttttccttgacaatgacttcgaagctgagttcagagagtttaaggatgattctgatttggatgatgatgatgaagggttgttggtcggtgccaaatgttttacctttggttcaactaacaacaaatcttccaactcctttgttcgtggatcaagtgctgcaaaagttgttgcatcgaaatcaaacgagcaaggtgaaaaggaattgaagagaaagaggaagaatcagtataggggtatccgccaacgtccatggggaaaatgggcagctgagatccgtgacccgagaaaaggagttcgtgtttggctcggaactttcaacactgctgaagaagctgcaagagcctacgatgctgaagctaggagaatccgtggcaagaaagccaaggtgaatttccctgaagaggctccaaatgcttcctcaaaacgtctcaagacaaattctgagacacagctgttggacaaaaatctgaactctttcaagtgtgaaaatatagagaactactattccccagtgaatcaggtggaacagagaccattggttaacgcccaatgtgctaatgtcggaccctttgctggaaacggtgttcagcttgcatcttctgatgttactgcatatttcagttcggagtattcgagcaattcatttgattatcctgatctatgttggggtgaaacaagggcccga

SEQ ID NO: 7163 - DNA, 741 bp, Medicago truncatula
  Predicted polypeptide sequence is orthologous to G5, G974
actaatataatactatattctcattctaataatttgaaatacaaataatagaattgaattacatcaataataatgtaccataatttgaccaaatagactatggaccattacataaataagacctaagccaaagtcattctccttagccaagcaagtaaaaaagccagctgactaaggtagacagatttacaacatattgacatagtaataataataataataataataacaataaataattctccaaattcctagaagaagaagaagcactacaattttcaaaaactcaaattgtagtagccactaataaaccctacaccaaattcatccatcatcatccatatttcaaagagaagcccaatcaatctcataagaaggaaatttctgcaaattaaattgttcaaaaccattttcccattgtggctcagcaaattcaccaaaagtaagatcagaaagtggagaagaatcatcagaaccaccttcactatgtgaagacaaagaagaaccacattcaacaacaaccttgttggtattggtatttgttgttatcatcattattattttcaacaacaaccaatggttgaggttgaagggtgagcttcaacctctttcttcaaactcttctttgaacccttcccttgtttcttgttcttgacattatcactactattgggtggtacctaaactctcacaaatagcatcaagtttagcatcaatagatgaatgcaaaaccttaaactc

SEQ ID NO: 7164 - DNA, 683 bp, Medicago truncatula
  Predicted polypeptide sequence is orthologous to G5, G974
gcacgagttttttactacaatatttatattcaataatatgaaatgcatgtagattacatctctactaataataatatgaacatacataactaagattctcctccaaggcaaagcaagaaaaaactcagctttgaaccaaggtaacaagagattataatacaataatatcctacaagggtagcactgcaattgtcaaaaattccattgcagtagccaccaacctaagaaactaaaacctatatataatataattatgcatgagatgagatgagatgagacccttaactagaaaataaaaaattacatataaggacacaaactaaaaacccttcacagagaatcccaatcaatctcataagaagggtacttgagcaaattaaaattttctgaatcaccctcccactgtggttcaccaacatcaccaaaagtaagatctgaaagtggtgaagaaccttcagaaccttcactctcagtaatcactgaaactgcttcaaccttacaacactcctctggctctgaatccttcttcaaatcatcaacagactccttagaaaccacctttgaagaggctttcgccttcgacgccggcatcttcttaggcttctcagccttcccctgtttctgcatctcagctaaaccttcacaaatagcttgaagcttagcatcaacagaagaaggaagag

SEQ ID NO: 7165 - DNA, 789 bp, Medicago truncatula
  Predicted polypeptide sequence is orthologous to G5, G974
ttttgtcttcaaaattttcaagagcttttagattgttgttcttcaaattttattttactcccccttctgtcacaccccgcttctctgaatccctttctgtttaatcatctgtctttcaatttatgatttttgggtttgtcttttaatcaaattaaaaagtcacaaacttagaataatttttcgaaaaacaggtgttttttcagaatcgagatccagaatatttacttgtacattttttttttttatcagtcacaagggttatttttgatcccttaaggctctttttaattttttttgttttaatccaaggatttaaaggattgtctatttaaaatccatttaatcctttttttttagtgttaattaataattaattaacctttgttcttcaattttattaagacacaggttataatttttcatacaaattatggcagctatgatgaattattacagtaacatgcaacagtttcaatttcatgactcagatccatttagaggtgaattaatggaagttcttgaaccttttatcaaaagtccttcttcaacttcaacttcaccttcatcttcaacaccatcaccttcttattcttcttctctctcttcaccttctttctacacagagcaaaacttcataggctttgctcaaccatcttcttctttttcttctccttctcttcttggtctcaaccacttgacaccatcacaaatcaaccaaatccaagtacaaatccaacaacaaaacttcaccatgcaacatcaacaaattcaacagcacaacaacgttgt

SEQ ID NO: 7166 - DNA, 812 bp, Medicago truncatula
  Predicted polypeptide sequence is orthologous to G8
ttatgttcttacataatgtcttgaatttattacacttaaattatcaaagctcattaggattctaaccaatacgtttctctctttccggaaatcagggcttatgacaaagcagctctaaaatgcaatggaagagaggctgtgactaacttcgagccaagtacatatgaaaatgagatgaaaccgggagctattaatgaaggtggcagtcacaatcttgaccttaatttgggcatggcgactccaggacatgaacccaaagaaaacaaaggatattgtcaatttcagaccgtcccttcttacaacatgcatcctggaaggaatttaaagatggagactaatgttaattcagttattggtgacccgtctttgaaaaagctggttgtaactgaacagcgtcctcccatgtggaatgccacgttttctagtttctttcccaatcagcaggaaagggcagagagaattggcattgatccttcaaaaggacaccccaactgggggtggcaagggcataatcaaggcactgtttccccagtaccacaattctcttctgcagcatcatcaggattctccatttcagctacctttccaccaaatgcaatctttcaaacacaaccaatcaactcaattccccagtcactctgtttcactcctggtagcaatgcatcatctcaatactattaccaggttaagtcctcacaggcaccaccatagcctatattctgtatttgtaataataatacaagatatatgaatggcatgacgcaacaagcttttgcgttaaaactcaattgtataattcagttaggatttga

SEQ ID NO: 7167 - DNA, 740 bp, Medicago truncatula
  Predicted polypeptide sequence is orthologous to G12, G24, G1277
acaacatgattataagagtctctctctctctctcccaaaaaacccaataacataacagtttcttttactctagattttcatgaagattcactctctctctctataacaaactcaaacaaagaacaagagagagagaaacatggacggtggaagaggaaaaggagagagaaagagaaacggtggtggtgttggtgttgatggagagagaagatacaaaggaattcgtatgagaaagtggggaaaatgggtagctgaaattcgagaaccaaacaaacgttctcgaatttggttaggttcctattctacccctatcgccgccgcaagagcttacgacaccgccgttttctacctccggggaccatcagctcgtctcaatttcccagagctactcaacggtgaaaacaacgcggttgttggtggtggtgatatgtcggcggctactattcgaaagaaagctactgaagttggtgctagagttgatgctcttcaagcagatgttaatcatcatagtcatagccatagtcataatcataatcatcatcaccttcagcataaccggaaccagcatcatcgtgttatgccggttccggagttgcttgaaggtgatggttctggtgattttgctgagagagttgatttgaataagattcctgaaccagagagttctgatgagtgggatgttaattgatattggaaggaaaaaagtttgaagaatcgattaaaaaaagtgattcttcttc

SEQ ID NO: 7168 - DNA, 653 bp, Medicago truncatula
  Predicted polypeptide sequence is orthologous to G12, G24, G1277
gtgttttccgggtgtgaaaggaatctctcttattgttccatccggttggcaactgttttataagttttcattttcataatcataatcatagcatatatgagtatatatatctctcaaagataagataggaactagctatattatatagtttaattagttacatgataggtattaggtaggtagggtatggaagaagaagatagggaatattgttgttcgatgaattcaagaacaaccaatagccctatagctatagatcataaaaataacaataacaataaggggatgaaaaaagagaaaaaagctatgaaaccatatagaggaataaggatgagaaagtggggtaagtgggtggcagagattagagaaccaaacaaaagatcaagaatttggttaggttcttacataacacctattgctgctgcacgtgcttatgatactgctgtgttttatcttagaggtccttctgcaaaccttaattttcctgaattgttgttcaaagatcaacaagaagatgaagaaaatctacaacaacatgggaatatgtcggctgattcaataaggaaaaaagctgcacaagtttggtgctaagagtttgatgctatttgaaactaattctctaattaatcatcatcatcatcaatcatgtttcc

SEQ ID NO: 7169 - DNA, 856 bp, Medicago truncatula
  Predicted polypeptide sequence is orthologous to G19
gtgatacatcaagcaatactcatcatcatcaaagaatgtgtggtggtgctatcatcgctgacttcattcctcgccgtgacggccgccgtctcaccgcctcggagctctggcctaactcatttggccaacagattgactcctcaaacttcggtttttctcatactgctgctgatcaacaaccacccagcactctcaaaagatcacagcctcccaaagttaatgaacgagttgagaagccactgaaaaaacagaggaagaatctctatagaggaattcgacagcgtccatggggaaaatgggctgcagagattcgtgatccaagaaaaggagttcgtgtttggcttggtacattcaacactgctgaagaagctgctagagcttacgacaaagaagctcgaaaaatccgtggcaaaaaagctaaggttaattttcctaacgaagatgatgaatataccattcatgctactcgtcgctacaataataatcctccaccgattcgaccacagaagcttcctctatatcatcaacaacactatcagaagaatctgaacttggaatttggttatgatctgaaccaaactgacacaattcatgctatcaatactggttctggtggtgatgagaattctttatttgggtctggttcagtttcagagggttggtttttctgtgatggagttcaatgggtggttccaatcagaatgaattcggttattttgggtgggtgttgtgaatgaacatgaaaaagagaaagagaaagtggtagaacaagaacacatgttgttgaacaaagctgagctgaattagcaaaaatgaggtacaagaattgtctgatgaattgttggcatacgaggat

SEQ ID NO: 7170 - DNA, 454 bp, Medicago truncatula
  Predicted polypeptide sequence is orthologous to G21
actctgtccttatacacaatagtctttgtcctcaaccaaccacttccttgtcttcctacattattgcctcaacctcttctaattcatcctcctccttagaagaagaagaagaagaagaagaagctactaacactaaatgcaaagaaaagaaaaagaagaaagtgggaatggtgaataaagtgaatgataggaagaataatccaacgtatagaggagtaagaatgcgtcaatggggcaaatgggtatcagagattagagagccaagaaaaaaatcaagaatttggctcggaacttttccaactcctgatatggctgctagagctcatgatgtggctgctcttactatcaaaggctcttcggcttacctcaattttcccgaattagctgccgtgctgccacgtgcagctagtgcctctcctaaagacatccaagttgcggctgctaaagcagccgc

SEQ ID NO: 7171 - DNA, 819 bp, Medicago truncatula
  Predicted polypeptide sequence is orthologous to G38
cacacatctctgttttcttcgtcatttttctcatcccaatatgcacccttctttttcgcattgattcttctttctttgaagctctctcaggagcgcttccaatttctcacacctctttactcagtgctacttggattgaattgcatatgttggcgaaagcttgtgaaaagggggatggatctaagtccctgggtaagatactggcaagatggagggaatataatgcccaacttgatgccggcaatgatgcgaataagcctgttcgcaaagttgcagccaaaggatcgaagaaagggtgtatgaaaggtaaaggagggccggaaaactcccggtgtaattatagaggtgtgagacaaaggacttgggggaaatgggtttctgaaatccgtgagccgaatcgagggagtaggctatggctaggtacttttaccaccgccattggtgctgctcttgcttatgacgaggcagccagggcaatgtatggttctcgtgcgcgtctcaactttcctaatgtttcggttactagattctctgatgaatctccaaacgattctccagatgcaaatcacttggcagtatcaacaaataccgagtccatgataataccagataactcagggataggagtagaagacagtaatgatatggaaccaacttccttatgcttaagtataaagcaggagaatgaggaaggtgagtcggagataaattaatcggttccttgttgatgatgtacattttgcttacagggattttgaaatggcatgaatatttagctcttgtacttgctaatgatcaacttaggaagtatgaatctcg

SEQ ID NO: 7172 - DNA, 776 bp, Medicago truncatula
  Predicted polypeptide sequence is orthologous to G38
cctcgttcgcttcaaaaacccaacacactcacagaaaaacaagagataaacaaaaaccctaaaatcgttcttttcttcacaaattcaactattgttaagcagattgttgactgttactgttgatttacttggaaattgaaagatgggtgctcctgcttatgatcaatgttttaatgtttctcttgcgccattggaattatcgaaaaagaggaaaactaggagtagaggaaaaggaactaaatctgtggctgagactctagcaaaatggaaggaatacaatgagaagctttatgctggtaaagatgatggtaaaccaaagcgtaaagcaccggctaaaggttcaaagaaagggtgtatgaaaggtaaaggaggacctcaaaactcggagaataagtatcgaggtgttagacagaggacttgggggaaatgggttgctgagattagggaaccaaatagaggaagtagactttggttaggtacttttccgacggctcaagaagctgctcttgcttatgattatgctgctagagccatgtatggtccttctgcgcgacttaactttcctgatatctcagattatagatctattcaggaatatttgaaggattcttcagcagcagctgctagctgttgttcttcggtggcaacaacgcctgcgacatctgagacacaactgtgtctagtcattctgaggtttgtgctattgaggatggtaaggagatacctaggatacctgttcatatgaacaacactggtgatgttttgtataaagggta

SEQ ID NO: 7173 - DNA, 841 bp, Medicago truncatula
  Predicted polypeptide sequence is orthologous to G43, G46, G1419
atactcatggctaattttgaagaagcttcagctctaaaacgcatcaaaatgcatcttcttggtgaattttctccacttccatctcctatttcaacaccttgctttgattttgattttgattttgaatttcaaacaatcccaaacatatctcaatctgaatcaaactcttccacttctgattcatcaatctctttggatcattatttaactaacctccttgaaacagatacacaaattcctctgtttgaatttgacacaaaacctcaattaatggaacatgagagccctaaagctctaacatcatctcatcatgttaatcaacctcaacgaacagtagagaagaagcctaaactgagccgaaaaccatcgctggaaatcgctctaccgaagaagactgagtggatccaattcggtaaacctgatccaaaaccggaggtggttgttcagaaaccggaagttgctgagaaacaacactacagaggtgttagacaaagaccatggggaaaattcgccgcggagatccgtgacccgaacaaaagaggttcaagagtttggcttggaacctttgaaactgctatcgaagcagctaaagcctacgattcagctgctttcaggctgcgtggctccaaagcgattctcaactttccacttgaagtcaacgcagtcgcagcatcggcggaaaccaccgtggaaggcaataagaaacggtgccgtgaagaagaagaagaagaagaggaagaggtggtagaagtaaaaccggtggtgaaaaaggaaaaaataacggaatatgatatgaactgttttaaagagatgccgttaacgccgtctttttggactggtt

SEQ ID NO: 7174 - DNA, 773 bp, Medicago truncatula
  Predicted polypeptide sequence is orthologous to G43, G46, G1419
caagtaacaaatacaaatactcatggctaactttgaagaagtttcagctcttaaacgtatcaaattccatcttctcggtgaattttctccacttccatctcctatttcaacaccttgctttgattttgattttgattttgaatttcaaaccaaccaaacagcatctcaatcagaatccaattcctccacttcaatctctatgaatcaatatttcactaacctccttgaaacagatgcacaaattccactgtttgaatttgacacaaaacctcaaatgatggaacatgagagccctaaagctctaacatcatctcatccttttagccaatctcaacgaaccacagagaagaagcctaaactggctcgaaaaccctcgctagaaatcgctctaccgaagaaaactgaatggatccaattcagtaaaccggatccaaaaccggaggcggttgtccagaagcctgaagcagttaagaaacagcactacagaggagttagacaaagaccatggggaaagttcgccgccgagatccgtgacccgaacaaacgaggttcaagagtttggcttggaacttttgaaactgctattgaagctgctaaagcctacgattcagccgctttcaggatgcgcggatccaaagcgattctcaactttccacttgaagtcaacgcagccgcggcgacggagaccgcagtcacagcggtggaaaccaccggtgacggcaataagaaacggtgccgtgaagaagagaaagagaggtggtagaagtaaaacc

SEQ ID NO: 7175 - DNA, 678 bp, Medicago truncatula
  Predicted polypeptide sequence is orthologous to G43, G46, G1419
taacaaactaaaaattaattttaaatacattcaactaataattctaattaaaacagttcttgctaatattattttaacattttaattgattatgagtgcttaaccaacaaagaaaaaagaattactagttactaaaacaaacttgtacagcatcaccagcacctatgaacttgaacttgaacatcttgtaccttcaatttcactttctcttctccttttcctaccacaactatttggcttaggatcacaaacaccagcttccaaaggaaaattcaatatagctttctgacccctcattctgaaagcagcagaatcataagcttttgcagcatcaatttcacagtcaaatgtacctaaccaaaccctacttcctttccttgatggatcccttatctcagctgcaaatttcccccatggccttctccttacacctctatatcttcttgtctcatcaacacattcttcttctttcttaaccttctttgatgacaccatagtagttgctattgctacttcatctttgatttcctttgaaggggttgtttcctttgaagatgaagtgtgagtgaagaattccatgtcagctattaaatcatagttttcaaggaaagtgaagaaagtgctgtttttctgaatatatgaagagaaatccaattctggtaaagggtttttcagttt

SEQ ID NO: 7176 - DNA, 821 bp, Medicago truncatula
  Predicted polypeptide sequence is orthologous to G44
ggtctaaatttagcacactcctctcttaagtcttaatcctcttcaaaaaaacagaacaacctcaatttagaagtatggaacaaaacatagaattcactttttggtcctcaaacaacctagaaattcaaaattcaatttctcaaagcaataacatgaaacaaacacaaacccattttcaaatccctcaaaccactttctccaaacctccaaggtcatcctcaaacctaagcaaccgcaaaccctccttgaacatcacaatcccttctataacaaaacctctcccacaacaaaacatagtaaaaagtgaaaacaccaacaccaaagaggataataagcactatagaggtgttagaagaagaacatggggaaaatttgctgcagaaatccgtgaccctaatagaaaaggatcaagagtatggcttggaacctttgatacagccatagaagctgcaaaagcttatgataaagctgctttccagatgagaggaagtaaagccatattgaacttccctctagatgttgctactgattctgtagaatcatcactttctaactgcatcaaagttggtaagaaaagacaaagagatgaagggaactgtgttgagattaataataataataataatattaagcaagttaagaaagaagaaggggttttagctgctcctttgactccttcatgttggaaagggttttgggatactgatgttatgggaactatcttcagtgttcctcctttgtcacccttatctccactcatgggattttaagattaattaattaagcccttgtaataaaccaagttgtttggacttcggtga

SEQ ID NO: 7177 - DNA, 849 bp, Medicago truncatula
  Predicted polypeptide sequence is orthologous to G129, G136, G140, G146
actacataagctttgcaaaatatggagctaccaaatgaaggtggagaaggatcttctcaaaagaaaatgggaagaggaaaaattgaaatcaagaggattgaaaacactaccaataggcaagtcactttttgcaaacgacgcaatggattgttgaagaaagcttatgaattatccgttctttgtgatgccgaagttgctcttgttgtcttctccactcgcggtcgtttgtatgagtatgccaacaacagtgttagagcaactattgaaaggtacaaaaaagcatgtgctgcttccactaacgcagaatctgtatctgaagctaatacccagttttaccagcaagaatcatccaaattgagaagacagattcgagatattcagaatctaaatagacacatccttggtgaagctctaggatctctaagtctcaaagaactgaagaatcttgagggtagattggagaaaggtttaagcagagttagatctagaaagcatgagactttgtttgctgatgtggagttcatgcaaaagcgggaaattgagctgcaaaaccataacaattatctacgggctaagatagcggaacatgagagagctcaacaacagcaacataatttgatgccagatcaaacaatgtgtgatcagtccttaccttcatcaccagcatatgaccgaaatttcttttcggtaaatctttctggatcagatcagcagcagtatttcgcgtcagaccaaactgcgcctccacttgtgtgatcatatatatgctggaaaaaggcatggacgttgtgcaacagtcctgaaacccgttataatctacctgaatagtgcatgagtgtgtctatatag

SEQ ID NO: 7178 - DNA, 708 bp, Medicago truncatula
  Predicted polypeptide sequence is orthologous to G131, G135, G155
ggcacgaggaatatatagatatgatacaatcatatgtatatcactatttattaagtttcagcaatatttatattacagtctacccctgaagccatattcatatatatagtttttgtatatatatgtaattagtctttatcgctaaccacccatgtttatatatatatttaagaggaaatgttgaatatatgtaatagttttaactcattaataggactaattaagcatccaaggtggaagatgggcgttgccatgggtttgactttcttcattatttcctccatcatctctatcttcaagggaaccaatattcaatgtctccaatgattgaggtacaagaactgtggaggctagattcatatcctcattttgctgctcaagttgggccagtgccttctctttctcctttatctttgttgtaagcaatttgtttttttcttggagggccttatcttttttactgagctctgaaatggattcatacatgagttggttcttccttgatctaatctgtttgagagcagaatcaagttgatgctccaaatgctgaagctctttcatacttaggccatcaagttcttcacccataaaattcctttgatttttctgaatgacttccaaccttgtcttcaaccttgcatgttctataatccaattttcattttgtggctgatcatttgcaacatgctgcctctctgcatatgaata

SEQ ID NO: 7179 - DNA, 1161 bp, Medicago truncatula
  Predicted polypeptide sequence is orthologous to G131, G135, G155
ggcacgaggcaaaaaacttgtccagaagaagaaagacccataaattaacattctctaagctataatagaaaggcttttaagcatatttctggggtttgttcccttttacttgtttgggtttttcttgggaaaaaaagatatagctagaagaagtaatttaggtataataatataattaaagaaaaaacaatttcctaaaacaaacatcacttaacatgggaaggggtagggttcagttgaagaggatagaaaacaagatcaatcgtcaggttactttctctaaaaggagagctggacttctcaagaaagctcatgagatctctgttctttgtgatgctgaagttgctttgattgtcttctcccacaaaggaaagctctttgaatatgcaactgattcttgcatggagaagatattggagcgctatgaaaggtactcctatgcagagagacagctagttgcaaatgattctgagtcacagggaaactggactattgagtatacgcgactgaaggcaaagattgatcttttgcaaagaaactataggcactacatgggagaagatttgggatcaatgagcctcaaagagcttcaaagtttggaacagcagttagatactgctctcaaactcattgctacacgcagaaaccaagtcatgtacgagtccatttcagagcttcagaagaaggagaaagtgattcaggagcagaataacatgcttgctaaaaagatcaaggagaaggaaaagattgcagctcagcagcaggcacaatgggagcacccaaaccatcatggagttaatccaaattacttactacagcagcaacttccaactttgaacatgggtggcaattaccgtgaggaagcaccagaaatggggaggaatgaacttgaccttaccctggaaccattgtatacctgccatcttggatgcttttgatgaaaaccttattaaaggtggatggtattatcaatatatatatttggctctatgttttgtagtttccctattttgaagacgctaatagtgtactgtaagcttaattataaggtcctaagtggaattaagcttttctatgtattaattatttatatagcttaaaggcaagtcctgtaatgtaatgacattcgagctgatcaagcattgacttttacgatcaaaa

SEQ ID NO: 7180 - DNA, 665 bp, Medicago truncatula
  misc_feature (619)..(619): n is a, c, g, or t
  misc_feature (624)..(624): n is a, c, g, or t
  Predicted polypeptide sequence is orthologous to G131, G135, G155
gcacgagccaaggagctgcggtgtatgtgctcaaagcccttcattatttcaaattaacattcattcattttcatatcatcataaataataacaaaatataattcaaattaaacttttcttatatatatatactatactatactatatatatatatagtgtacgcacctacctaactcctcctcctccaattcatgttgtgatttcaattccaaccaaaaataatggggaggggaagagtgcagttgaagaggattgagaacaagatcaatagacaagtcactttttcaaagagaaggtctggtttgttgaagaaagcacaagagatctctgttctttgtgatgctgaagttgctctcattattttctctactaaaggcaagctttttgaatactccagcgatccttggtacgttttcttctttcatatatataagtttattttattattattattattattatttcaaattaacttaataataatgatttctctccttctacatctaaatccaaacatcataatttctgtgtgactattgatagatcttgctgaaatttgtctactatatgccacacatctctacctatatgcctgttttctgtaaatattttatttgngctgncaatttttcttccattggacgggatttccccttcaattttt

SEQ ID NO: 7181 - DNA, 619 bp, Medicago truncatula
  Predicted polypeptide sequence is orthologous to G134
ggaagaagaagctagaaaagaagatgggaagaggtaagattgagatcaagaggattgaaaactcaagcaacaggcaagttacttattcaaagagaaagaatggaatccttaagaaagcaaaggaaataagtgttctttgtgatgctcaagtttcccttattctctttggtgcttctggaaagatgcatgaatacatcagcccttctaccacgttgattgatattctggacagataccagagagcctctgggaaaaccctatgggatgctaagcatgagaaccttagcaatgaaattgatagaatcaaaaaggagaatgatagcatgcaaattgatctcaggcacttgaagggagaggatattacctcactgaattacaaagagctgatggcccttgaggaatcccttgaaaatggtcttactggcgtccgtgacaaaaagatggaagtgcataggatgttcaagagaaatggaaaaatcttggaggatgaaaataaggaactcaattttcttctgcaacagcatatggcacttgaaggtgtgggaaacatgcatggacaatggatttaaccacatcatgaggtccatcataagggatttggtttgcaaatgcagtttga

SEQ ID NO: 7182 - DNA, 676 bp, Medicago truncatula
  Predicted polypeptide sequence is orthologous to G137, G145
gtcctagcatgctcaagacgcttgttaggtaccaaaaatgcagctatggtgcagtagaagttaacaaacctgccaaagagcttgagagcagttaccgtgagtacttgaagctgaaagcaagatttgaatctcttcaaaggactcaaagaaaccttcttggtgaagacttaggtccattaggtaccaaagatcttgagcagcttgaacgccaacttgattcatctctcaagcaagtcaggtccaccaagacccaattcatgctggaccaattagctgatcttcaaaataaggagcatatgttggtagaagcaaacagatctttgtctatgaagctggaagaaatcaatatcaattcaagaaaccagtataggcaaacatgggaagctggtgatcaaagtatggcatatggtaatcaaaatgctcactcacaaagcttctttcagcctttggagtgcaatccaacattgcagatagggactgattacaggtacagtcctccagtagcatcagatcagctaactgcaacaactcaagctcaacaagttaatggatttattcctggatggatgctttgagctaagctcattatttctctatttgcataaaagcaaaagacaaaaaaatgccttttggttttgacattgttgtaaatgctgcatgtgcttctttctggtta

SEQ ID NO: 7183 - DNA, 611 bp, Medicago truncatula
  Predicted polypeptide sequence is orthologous to G154, G627, G1011, G1797, G1798
tttagacacaaccctttattcctcctatcccttccttggttcattttttcttttatttttccaatttggtgcaaatctgcttccttttgttgctgcaaagaaaaggaaaaaaaatggtgagaggaaagacacaaatgaagcgtatagagaacgcaacaagtagacaagtaacattctcaaagagaagaaatggtttgttgaagaaggcctttgaactgtcagtgttatgtgatgctgaggttgctcttattgttttctcaccaagagggaggctttatgaatttgctagctctagcattctagaaacaattgaacgataccgcagtcataccaggattaataatactccaacaacatctgaatcagttgaaaatactcagcaattgaaggaagaagcagaaaacatgatgaagaagattgaccttcttgagacttcaaaacggaaactcttaggagaaggtttagggtcttgttccattgatgaactacaaaagataggaacaacagtgtggagaaaaagcataaacaaaattcgagtcaaaaagactaagggtttttcagggagcaaattgatcagtctaaaagaaaaggaaaaagccctagttgctgaa

SEQ ID NO: 7184 - DNA, 744 bp, Medicago truncatula
  misc_feature (603)..(604): n is a, c, g, or t
  misc_feature (606)..(606): n is a, c, g, or t
  misc_feature (660)..(662): n is a, c, g, or t
  misc_feature (680)..(685): n is a, c, g, or t
  misc_feature (703)..(704): n is a, c, g, or t
  misc_feature (706)..(706): n is a, c, g, or t
  misc_feature (712)..(716): n is a, c, g, or t
  misc_feature (718)..(718): n is a, c, g, or t
  misc_feature (724)..(724): n is a, c, g, or t
  misc_feature (726)..(729): n is a, c, g, or t
  misc_feature (740)..(741): n is a, c, g, or t
  Predicted polypeptide sequence is orthologous to G154, G627, G1011, G1797, G1798
cccgggctgcgggaacctgtattggcttctttgagggttgagataacaaaagattccattcttttcttccactaaatatttgtcagttcagatcttaccctcaaagagagttcataatggtgagaggaaaaactcaaatgaaacgcatcgaaaatgagtcaaacagacaagtaactttctcaaagagaagaaatggactgcttaaaaaggcctttgaactttcagtgctttgtgatgctgaagtcgcactcatcgtcttctctaccacagggaaactctatgagttttctagttcaagtataagcaagacagtggaacgctatcaagggaaagtcaaggaactggttctcagcaccaaaggaatccaagaaaatacacagcatctaaaggaatgtgatatcgacacaacaaagaagttggaacacctagaactttccaaaaggaagctgttgggagaagaattgggttcatgtgcttttgacgaattacaacagattgaaaatcaacttgaacgtagcttaagcaaaataagggcaagaaagaatcaattgctcaaggagcaaattgaaaagctaaaagacaaggaaaggttacttcttgaannantaaacgcttatgcaagcagtgtggaattggacaaatgattgtttaataaacaannngaagtgtgcatgacgagnnnnnngagacagaattgttcatnngncgaccnnnnnangaatgntnnnngagctgaaccnngca

SEQ ID NO: 7185 - DNA, 777 bp, Medicago truncatula
  Predicted polypeptide sequence is orthologous to G184, G186, G916
gttgcagatcaagcaaatacagaagctacaatgagaaaagctcgtgtctccgttcgtgctagatcagaagcttcaatgataagtgatggatgccaatggagaaaatatggacaaaaaatggctaaaggaaatccatgtcctcgagcatactatagatgcactatggcagttggttgtccagttcgcaaacaagttcaacgttgtgccgaggacaaaacaatattggtaacaacatatgaaggaacacataaccatccactaccaccagcagctatggcaatggcatcaacaacttcagcagcagcaagcatgttactatcaggatcaatgtcaagtgcagatggaataatgacaccaaatttattagcaagagctattctaccttgttcaacaagcatggctacactttcagcttcagcaccatttcctactgttacattagatctcacacaaaattcaaacccaaatccattacaatttcaaagacctcaacatgcaccatttcatcaagtacctagtttctttcaaggacagaatcagaattttgcacaagcagcagcatcactttataatcaatcaaaattttctggtcttcaattgtctcaagaagttggttcttctcatttaaccacacaagcttcaacccaacaacaacaacagccttctttagctgactcggtcagcgccgccaccgctgctatcaccgccgatcctaatttcaccgctgttctcgcagccgctatctcctccattattggtggtggccatgcaaacaat

SEQ ID NO: 7186 - DNA, 711 bp, Medicago truncatula
  Predicted polypeptide sequence is orthologous to G184, G186, G916
tttaccttctaaacaaccatcttctactcataccaacgatagaatgtttcctattctaggatttcctgtcaaccttacccgtaacaccaacggcgaagacgggggtgaccggaaaataaccggtgaagttgatttcttctctgaaagaaacaaaccatcaccttcacatgaacacaaccaacatgttaaatccaacatcatcaaaaaggagattgtttcaaccgatgaaaagccttccacttctaatatccatgttaatactggtttacaacttgcaaacaccggaagtgatcaatctgtagtggatgatggagcttcatctgatgctgaaaataaacgcgccaagactactgagcttgcacaattgcaagtggagcttcaacggatgaattcagagaacaaaaagctgaaagagatgctaagtcatgttaccggtaattacacggctttgcagttgcaacttgtggcattaatgcaaaagaatcaccacactgaaaatgaggttgttaatgcaaaagctgaggagaaaaaccaaggtgttggtggagcaatggtaccaagacaatttcttgagataactaatggaacaacagaagtcgaagatcaagtatcaaattcttcatctgatgaaagaacaagatcaaacacacctcagatgaggaatagcaatggtaaaactggtagggaagatagtccagaatcagaaacaca

SEQ ID NO: 7187 - DNA, 804 bp, Medicago truncatula
  Predicted polypeptide sequence is orthologous to G184, G186, G916
ccccaaatccaaattggcaatatacgagtgaagcttgatgaagcaaagaaggagaatgaaaatttaagaggtatgctaaatctggtcaacgatcgatgcaatgttcttcagaatcgtttacttttggctatgcatatgcatcaatcatcttcattgtctcaaaataatcacaacttgctgctgaaggaaaatacacaagatgcggggaaatcagtgttacctactcggcagttctttgatgagccttcaccttcaaattgtagcaaaaataatggatttgccatagtggaaaacaatgaaaacaacatgggaagaaatcttgcatgtgaatacattaatgaaggtgaaataaatagcaaaatagaggaccaatcatctgaggttggatgcaggagagctagagtgtccattagggcacgatcagattttgcatttatggttgatgggtgtcaatggagaaaatatggacaaaagacggccaagggaaacccttgtccacgagcctactatcgttgcagtatgggaacttcatgcccagttcgaaagcaggttcaaaggtgttttaaggatgagagtgtgttcatcacaacctatgaaggaaccataatcatcaactttcaccagcagcaaaaccaatagcaaacctaacatcatcagcactcaacacatttccttcctacctcatccacaactttacaacaatatggcaacaatctaacaaacacattcctcttctctttcacattatctcccaccaactcaaatgctatagctactttcctctcatctccaacatgcccctac

SEQ ID NO: 7188 - DNA, 767 bp, Medicago truncatula
  Predicted polypeptide sequence is orthologous to G184, G186, G916
gtagaacttcaataaatgctcaagataataagcgtgccaagactcaacaggtcagactgatcaattgcaagaggagcttggtcgtgttaatgcagagaaccaaaagctgaaggacatgcttagtgacatgaacagtagctacacaaacttgcataaccgttttatatccttaatgcaacagcaacagaaccaaaccacagaacatgatcatattgtcaatggaaaagctgtggagaaaggagatggtgtggtggctagaaagttcatgaatggtccagcagcagaagtagatgatcagcaagagcctgaaccatgcacacctcagaacaatcataaagagcctgatccggacgcatcagaactagtacaacttttggaccgaagtcagcttcccagattaaacccctccaacgctgctgatcaagccaatgcagaagccactatgagaacagcacgagtctcagtccgtgctagatcagaagcccacatgatcaatgatggatgccaatggcgaaaatacggacaaaaaatggctaaaggaaacccttgtcctcgtgcctattatagatgcacaatggctcttggttgccccgttcgcaaacaagtgagtcttattattctgatgaatcaatgtgtatagttctaatagtctaatactagctattattgcttctacaaaaatggtactcgtttactctcatattatgtgtctcatttgaaacattctaggttcaacgatgtgcggaggacagatcaattttgataac

SEQ ID NO: 7189 - DNA, 470 bp, Medicago truncatula
  misc_feature (16)..(16): n is a, c, g, or t
  misc_feature (66)..(66): n is a, c, g, or t
  misc_feature (421)..(421): n is a, c, g, or t
  misc_feature (433)..(435): n is a, c, g, or t
  misc_feature (441)..(441): n is a, c, g, or t
  misc_feature (443)..(443): n is a, c, g, or t
  misc_feature (445)..(445): n is a, c, g, or t
  misc_feature (447)..(448): n is a, c, g, or t
  misc_feature (451)..(452): n is a, c, g, or t
  misc_feature (458)..(458): n is a, c, g, or t
  misc_feature (464)..(464): n is a, c, g, or t
  Predicted polypeptide sequence is orthologous to G189
cctcgtgccgaattcngcacgagggtagaaagagctttggatgatccatctatgttggtagttacnttatgaaggcgaccacaatcactccctctctatggttgaagctaataatctcatcttagaatcctcttgaactgaattgaattgaataatcttcatttctcatctcaaatatactcactctttctcatgccattaactcaaggccagcacaactttttcatctcaaaggagattgattactaagggtggtgttcctttttcttgtacaatattggattcctttaacttttcttgttctcttcacaaactccaacaatgtgaacccatcgagattagtattatttattttcaaagaaaaaagtggagatggtggatttggtaaaaagaatagaaagaattgagtggggttttagtnaaaaaaaaaaannnaaaaanananannaannaaaaanaaaaanaaaaaa

SEQ ID NO: 7190 - DNA, 624 bp, Medicago truncatula
  Predicted polypeptide sequence is orthologous to G190
ccggcgcatggcggggatctcagtccacaaatgggtatgaggacttcattcctgcccctcaaatgcaaaatttggccagtcctgatgtccaaagaggtatgcacaatcgacaaagctatcctgctcagggagcatggcctctgaatcagaagtttagcaacaatccctccttggcgtccggtaagccagcacatcctgcagaccaaatttatgatcctttttcacctacatctgctgcacctccacacctgaaaggtaatcctggaaaatgagggaattgaatatggctacagatacgaaatactgacaaatacgaaatgaggtgatactaatttcatagattagtaatgggcatgggtgtaagatcatgttatttctaagcagaaagtttggttgtctccctttgatgacttattgtattccttattaaaccgacctttcttttctgaatgcccattgttgatgattgattaggaattgagtttcattatagattttttttgaagaataatgttagatattttgctatattcaaacataactttgccagaatataatcatattttcactttatgtaaaccatgtaccattctttaggatatttcacagctgtcatgtttgaat

SEQ ID NO: 7191 - DNA, 350 bp, Medicago truncatula
  Predicted polypeptide sequence is orthologous to G194
ctgggtttcccttcaaagaatatgaatgctactttttctcaagacagaccactttgtaatccaagggttcaggacaatggccttcttcaagatgttgttccttcacatatgttcaaggaggagtagatcattcatcactgtacatcataccactgcttctgtctcatttcttatgttgattgatcactttttgtagctagttagatatatagataggagacttagatgaggagtactccattagtgatgatcatatatactggtaatcttttttgcacagataagaaagccttaattatcattggtatttaatatcagtttgatcaaaaaaaaaaaaaaaaaaaaaaaaa

SEQ ID NO: 7192 - DNA, 666 bp, Medicago truncatula
  Predicted polypeptide sequence is orthologous to G194
gcaccagcttttactacttactattaccacaagagcgtgttgtctacaaatgaaggatttggatttgtgcatttgagatatcatatggagaagaaagacatgggtctaagtgtgaagagtgaggatgttgttgattcctcctcatctttgctaaataatggttatcaattttcaagcgtgtttgatttctgtgaggttgaaaggagttcttctttagggtttatggagttacttggtggtcatgactatagtcctctccttgatgtaccacaactatcaaccatgtctactgttaaggcttcatctgacaccactggaaaagagtgttctgaggttttgaaccagcaacaacctgcaactcctaattcttgttcgatttcatcagcatctagtgaagcagtcaatgataataaaactcttgttgaccaagcagaagaagatgaagaagaagaaaagcaaaagacaaataaacagttgaaaacgaagaagacaaatctaaagagacagagagaaccaagatttgctttcatgacgaaaagcgaggttgatcatctggaagatggataccgatggagaaagtacggtcaaaaagctgtcaaaaatagcccttttccaaggagctactatcgttgcaccactgcttcatgtaatgtcaagaaacgtgtg

SEQ ID NO: 7193 - DNA, 655 bp, Medicago truncatula
  misc_feature (642)..(642): n is a, c, g, or t
  Predicted polypeptide sequence is orthologous to G194
cacatatagatcaaccaaccctaccttatctatctaaatatctctctcaaacattgatgatggagaaaaagggtttgaatatggaggattatgcgaatattggatctttccctagctactcatttccaagtgtttttgatttatcggaagaaaggagcttcatggagttactgggtgtgcagcagaacatgaacaactatagtgatagtttacttgatttgcctgtggttgtaaaggagccacctttggagagtgatgggaatggaaaagagtattcagaggttttgaatagtcaacaacaacctgctactcctaactcttcatctatttcatctgcttctagtgaagcaatcaatgatgaacacaataaaactgttgaccaaactaataatcaactcaacaaacagttgaaggctaagaagacaaatcagaagaaaccaagagaagctagaatcgctttcatgacgaaaagcgaggtggatcatctggaagatgggtacagatggagaaagtacggtcaaaaagctgttaaaaatagcccctttccaaggagctattatcgttgcaccagtgtttcatgtaatgtgaagaaacacgtggagaggtctttgagtgatccaaccattgtagtaacaacctacnaaggaaaacacac

SEQ ID NO: 7194 - DNA, 651 bp, Medicago truncatula
  Predicted polypeptide sequence is orthologous to G196
gcacgagctggtgccgctggtgccgcaaatattatatttaacttcttattttcctcttaaatctaaaaatctcagatcacaattgcagctgcaagaaatcatttgaatttaaggtagctatggacagtaatgcctcccccaaacttgagtcagagacatctttagagctcaaaccagaatctcaagtatctaagaaacggaaaatggttgagaaaacggttgtgactgtgaggattggagagaatgttagcaaggtgaagaatgaaggacttccttcagatttttggtcttggaggaaatatggacaaaaaccaatcaaaggctctccatacccaaggggatattataggtgcagcacatgcaagggctgttcagccaaaaaacaagtagagagaagcagcacagatgcttcattgctcatcatcacctatacttcaacacataaccatccagatcccactgccctctcctccaccacaaatttagctcaacaaccaaaagaatccaaaaccgaaacaaccaaagatctcccagttacttctaaggaagaaaaccaagaacaaaaacaggtagaagaggagattaacagtaataagagcactgtgagtagtagtgatcaagttacaaatgaagaaaattttcattacttac

SEQ ID NO: 7195 - DNA, 730 bp, Medicago truncatula
  Predicted polypeptide sequence is orthologous to G197, G255, G664
gaacaaaacaaacacaaatttctcaatatcctattatcattcaaaatttcaaaagtgaaacaaacatacatagaaaatagaacaacaaaagttacttaactcaaatatgggaagatcaccttgttgtgaaaaagctcatacaaacaaaggagcttggacaaaagaagaagatgatagacttatatcatatattagggcacatggtgaaggttgttggagatctctccctaaagcagctggcttactccgatgtggtaaaagttgtcgtctccggtggattaactatctcaggccagaccttaaacgtggtaactttacagaagaagaagatgaactcatcatcaaactccatagtcttcttggtaacaaatggtctttgatagctggaagattaccaggaagaacagataatgagataaagaattattggaacactcatataagaagaaagcttttgaatagaggaattgaccctgctactcataggcctttaaacgaagtttctcattctcaatcacaatctcaaactcttcatcttcaaaatcaagaagctgttactatagctgtagcagcatctacatcaactcctacagctacaaaaaccctaccaacaactatatcttttgcatcatccattaaacaagaacaatatcatcatcatcatcatcatcaagaaatgaacacaaacatggttaaagggttggtgttagaacgttgtcctgatttgaat

SEQ ID NO: 7196 - DNA, 523 bp, Medicago truncatula
  Predicted polypeptide sequence is orthologous to G197, G255, G664
gcacgagggtaaagtctaaaaatactcaagaacgatagtgtagcttacttgttaccgaggagagtgtggagttttatgatgagttgatcttcttgttgggtgaaatttccacgtttgaggtcggggcgtaggtagttgatccaccggagacggcaactcttaccgcaacggagaagaccagcggcttttgggagagagcgccagcatccctcaccgtgagcagccgctcatcttcttctttgctccatgctcctttgtttatgtgacctttctcacagcaaggggaccttcccatatcgatcaattctatctatatttgatgatcactcacttctttgcttcattgattcagagtgaatgaatataaaaaacatcgattgatgtatgtattgtatttatatatggtattggtgttggttggttcgtaattaataacgactctatagatgctaatattctagtgcagcagcataataatactatatagcaatatttattctaaaaaaaaaaaaaaaaaactcga

SEQ ID NO: 7197 - DNA, 806 bp, Medicago truncatula
  Predicted polypeptide sequence is orthologous to G206
aactaaactagcttgtgagagcacaaataattcatctcaatttcaagatggttagggctccttgttgtgaaaagaaaggattgaagaaaggtccttggaccttagaggaagatgaaatcctcacatcatacatcaataaacatggacatagcaattggcgtgccctaccaaaacatgcaggtttattaagatgtggaaagagttgtagattgagatggattaactatttaaaacctgatattaagagaggaaattttacaaatgaagaagaggaaactatcatcaagatgcatgaatcactggggaacaggtggtcagccatagcagcaaaattacctggaagaacagacaatgaaataaaaaatgtatggcacactcacttgaagaaaagattattgaataccaataataaccaaccaaattcaaataccaaaaaaagagtgtcaaaacaaaaaatcaaaagatctgattccaattccagcactttaactacagcatcaaattgcactttttctagtgatttttcatcacaagaaaaaaatttggacaatagcatcatttgtgaagactcattggtgacaatgcctgaaattgatgaaagcttttggtcagagacagtaattgatgatgaaattagttccaccatgccatcaaattctatgacagtttcaaatgatttaccagatcaacaatgcatttttaataattccgtggaaaaattttcaaaacccttttgataatgatgatgatggcatggattttttgtatgatgtgttcatcaaatcaggagaatcaacagaattgcc

SEQ ID NO: 7198 - DNA, 797 bp, Medicago truncatula
  misc_feature (8)..(8): n is a, c, g, or t
  Predicted polypeptide sequence is orthologous to G206
ctgattcnccaagctcgaaatttccctcactaaagggaacaaaagctggagctccaccgcggtggcggccgctctagaactagtggatcccccgggctgcaggaattcggcacgaggacaagaccaactttgtagagacaaacacactcactcattgaatttgagttcaccttgtttctcaaaaaataattaagatggcaagaactccttcttgtgacaaaaaaagtggaatgagaaaagggacatggactgctgaagaagataggaaattaattgcttatgtcactagatatggttgctggaattggcgccaacttcccaagtttgcaggtctttcgaggtgtgggaagagttgtagattgaggtggttgaattatctaaggcctaatatcaaaagaggaaactttactcaagaagaagaggagttgattatcagaatgcataaaaatcttgggaatagatggtcaaccattgcggccgagttacctggaagaacagataatgaagtgaagaactattggcatacttccctaaagaagcgagttgaacacaaccaaatcacaaatattgaagaaaccaaatcgaaagacattgaatccacacaggatagggatatttcctttctacaagttacccctccagctagttcccaaaccctagatatcactggcccattttccccactttcttcatctagtgaattctcttctacagattattcagatcacagtaccacttatgtggatgatttttggttttctagatggatttatagactacgtgggtgaaaaatcttg

SEQ ID NO: 7199 - DNA, 671 bp, Medicago truncatula
  misc_feature (615)..(615): n is a, c, g, or t
  misc_feature (626)..(626): n is a, c, g, or t
  misc_feature (671)..(671): n is a, c, g, or t
  Predicted polypeptide sequence is orthologous to G206
gaccaatataactcacaatttgtagaaacaaaacacactcactctctcactgaatttgagttcacttgtttaacaaaaacttattgctcaaatggctagaactccttcttgtgacaaaattagtggaatgaggaaagggacttggactgctgaagaagataggaaattaattgcttatgttactagatatggtttctggaattggcgccaacttcccaagtttgcaggtctttcaaggtgtgggaagagttgtagattgaggtggctgaattatctaaggcctaatatcagaagagggaactttactaaagatgaagaggagttgattatcagaatgcataaaaagcttgggaataaatggtcaaccattgctgccgagttacctggaagaacagataatgaagtgaagaaccactggcacacttccctcaagaagagagctatagataacattgtcacaaatgaagaaactaaatccaccaaatcaaaagacataattgaatccacacaagggagagatatatcgaattaccaaattacccctccagatagttcccaaatctcaaacaacaatggccctttatccccattttcatcatctagtgaaatctcttncacctcttcanatgattttgggtttctggattcatttataaaagatgtggatatan

SEQ ID NO: 7200 - DNA, 651 bp, Medicago truncatula
  Predicted polypeptide sequence is orthologous to G206
taactctcatcttgtagagacaaacacactcactcattgagtttgagttcacttgtttctcaaaaaataattaagatggcaagaactccttcttgtgacaaaaaaagtggaatgaggaaaggaacatggactgctgaagaagataggaaattaattgcttatgtcaccagatacggttgctggaattggcgccaactaccaaagtttgcaggtctttcaaggtgtgggaagagttgtagattgaggtggctgaattatttaagacctaatatcaaaagaggaaacttcactcaagaagaagaggagttgattatccgaatgcataaaaagcttggcaatagatggtcaaccattgcggccgagttacctggaagaacagataatgaagtgaagaaccactggcacacttccctcaagaagagagctatagataacattgtcacaaatgaagaaaccaaatccacacaagggaagatgtgtatccaattaccaaattacccttccagctaactcccaaatctcagacaccaatggccctttatccccattttcatcatctagtgaattatcttccacatcttcagatcacaattccactgctttggatgattttgggtttctggattcatttatagaagatgtggatgaaag

SEQ ID NO: 7201 - DNA, 661 bp, Medicago truncatula
  Predicted polypeptide sequence is orthologous to G206
gttctctctaagattattatatatagatctaacggcactcatactaagaattggtaggagtaagacaagctattaccaaccagactctatagagaatatggtgagaaccccttattgtgacaaaaatggactaaggaaaggcacatggacacccgaggaagacaaaaagttgattgcttatgtaactaggtatggctgttggaattggcgacaattacctaaatttgcaggtcttgaaaggtgtgggaagagttgtagactaaggtggttgaactatctaaggccagatatcaaaagagggagctttagtcatgaagaagaagagactatcatcaaacttcatgaaaaattgggtaatagatggaccatgatttctgcaaatttaccagggagaacagataacgagataaagaactactggcacaccaccataaaaaagactcttgtaaagaataagtcaaacaccaaacgtggaacgaaaaaagccaaagactcaaattcaaaaaatcaccctacaatggaaaaacccaagaaacttggagaaatgttagagaacaacagtgatttcaatattacgagtccaccatcttcacaaccatctacaagtgcatcctcttgcatatcattaatggacactgcagctactactacaatatcatat

SEQ ID NO: 7202 - DNA, 403 bp, Medicago truncatula
  Predicted polypeptide sequence is orthologous to G206
aacttatataaagagaaatagaaatctcctaaatttccacttcctcatgatggttgacctgatttaatgaatacatcgtaccaaaattcaatttcttcactaatctgacttgaaccatgatggtccatattttctcctaaagtatcacaagaggttgcattgtaaaatcctgaccctacagtgtttggatccttgcttgagactaaaccataattggaaataactcttttttcaccgacactactataaccatcacttgcttgtgcctcatccaaagtatatgaataagaggtattgacattgtacacttcacttttttgcacctttttcttcaaatgtgtatgccaaaagttcttcacttcattatctgttcgtcctggtaatcttgctgcaattgcagacc

SEQ ID NO: 7203 - DNA, 798 bp, Medicago truncatula
  Predicted polypeptide sequence is orthologous to G206
agtacatcatttattggtattacaatcaaactctaaccttttctcctaattaaagaaaaaataaaaaaatgtctaagacttgttgtttttcacaatatacattgaaaataaaaatcaatgtttcccttgtaatccctctttacatagagatagattacatatcattaccttggagacaatgatcacatcacatatttttcttgtcacattcaaactgaaattaccacgttgcaatgaaactcatatcttcatatcacataaagataagaatttgaatctcgttgtcaatgtgagagaatctctttactgaatagcgtacactattagtatatgagccgagacctgctctgatagaccgtacccaattccaacttgtctaaacttttagttgtcaaaaaaaattggagttactatgtttttttgaactttctattaactcaaaactcaggcaattctatttgatctccagtcctaataaatatatcataccaaaaatccatgccatcatccatgttagaattataatcttcatgactttctggaagaatttcatcagggtattgaagtggcaacatttcatttgagattgttaatgaacttgatttcatatcagttgaagtttcatccaatgctgctgcttctgaccaaaaactctcatcaattacagccattgtttcttccatagactcaatgtcttcactttttatatccttttcttcaccactgtgacagatgaaaaatcactagaactagtagtgcatgcaaatgctgattctgatttgtggtatgtgctttgaa

SEQ ID NO: 7204 - DNA, 688 bp, Medicago truncatula
  Predicted polypeptide sequence is orthologous to G207, G227, G230, G242
ttttacgcctgaagaggatgatactataatcagagcccatgctcgatttggaaacaaatgggctacaatagccaggcttttatcgggccgaactgataacgctattaagaatcattggaactctactttgaaaaacgtaagtgttcttctattatgattgatgattctgaatctccaccgttgaaaagatctgttagtgctggtgctgctattcccgtttctactggtctttatattaacgccaattctcctggttctccttctggatccgatgtaagcgagtccagcgtacctattgtgaacactcatgtaaactctcatgtttaccgacccgtgccaacgagaaccgtcgcgcctctaccactcgtagaaacgacgtcgccttcgaattcgaatgatcctccaacttcgttatcactttcacttcccggtgttggtgttgattcttcttctgaagattcaaaccgtgtaactgagcctgtcaacactgcaccaccacctcctccgccaccaccgccaagcgcgatccctttgatgccggtaatgaccacggctgtacctgttccgatggcggttccgatgcaacaatcgggatcggtgatgccgtttagtttagtgcggagttgttgagtgtgatgcaggagatgattagaacagaggtgagagttacatggcgggattggagcac

SEQ ID NO: 7205 - DNA, 805 bp, Medicago truncatula
  Predicted polypeptide sequence is orthologous to G207, G227, G230, G242
aatggatcggatcaagtcctggagccccgaagaagacgaatccttaacaaaactcgttgatcgttacggtcctcgtaactggtcactcatcagccgtgctattcctggtcggagtggtaaatcttgcaggctgagatggtgtaatcagctttctccacaagttgagcatcgtgctttttctcctgaagaagataacatcattatcagagcccatgctcagttcggtaacaaatgggctactattgcccgtttgttatcgggccgaaccgataacgctatcaaaaaccactggaactctacgctgaaacggaagtgctcgtctttcatcggttccgatgatcgcgatttcaatcctcagccgcttaaacgctctgcttccgtcggtgctccggggagtccttctggttctgatttaagtgattctggtgttcaacaaactgtttttcgtcctgttccgattcgtttgcctgtggaaactacatcggagccggagccagtaacggtaccggaggcggttgaggaggatgacggtcctttaacttcgctgtcgctttctctaccaggtgtggatgctgctgcggcggtgctggttagtcctgctccgataaccgctgtaactgccgtaacggtttcagaagaagctggaattggagcgttaaatttgagtggtgaatttatggcggttatgcaagagatgataaagaatgaagtgaggagttatatggaagagagaaatggaatgtgttttcaaggagttgataggcttagaaatgtttctgctaagccaattgggattacagggttg

SEQ ID NO: 7206 - DNA, 690 bp, Medicago truncatula
  misc_feature (659)..(659): n is a, c, g, or t
  misc_feature (674)..(674): n is a, c, g, or t
  Predicted polypeptide sequence is orthologous to G207, G227, G230, G242
atcatatcaaacattcactattactatatactcaaataataacgctatggatttgaatatgaattttgaagctattaatagaagctcttcaacaacaacatcatcatcagactcatgttcctcagaaacaaaccaaaacaaactagacagaatcaaaggtccatggagtgcagaagaagacagaattttaacacgactggttgaacaacatggagcaagaaactggtcactcatcagccgctacataaaaggtcgttccggcaagtcatgtcgtctccggtggtgtaatcagctgagtcccaccgtggaacaccgtccattttcttcacaagaagatgaaacaatcatagcggcgcatgctcaatatggtaaccgttgggctaccattgcaaggcttttacctggtagaactgataatgctgtcaagaatcattggaactctacgcttaagcgtagagcgggttgtggtggttctgttacggttgctggaggtggcaacgaaggtggtcagtttacttttccgttggaagatgatccgttgaccgcgttgactcttgctcctccggggaatggtgtggaagatagggaggaaatggttggtgatcatcggtttccttcgccggaaaatgttccgactgagttttgggatgtgatgagangtgttattgcaaganaagttagggaatatgt

SEQ ID NO: 7207 - DNA, 706 bp, Medicago truncatula
  Predicted polypeptide sequence is orthologous to G214, G680
ggccttcttgattcttggaaggaggtgtctgaagagggacgacttgcctttcgggctctattctccagagaggtgttgccccaaagcttttcacctcctcatgatttgataaataaggataatcagatggacaacatgaaggataacgagcaaaaaacagaccacaaagatcaccttgagagcaagaaatgcatttgtaattgtgaccaggcacagcaaaacctaccatttgtacaaaataacaatgaggagggatttctaaccatgggtcttggacaaggtaaacttaagactcgtcgaacagggttcaaaccttacaaaagatgtttagtagaggccaaggaaaacaggggcggaacggcttgcaaccaagttgaagagacgggtcccaagaggatacgcctggaaggggggacttctatttgatgcttgatatatgcatgcaatcacgcaaagaaaatctttgagttttgtgcatcatttctaactacctcttggtgtctgtattgttaattttctaattcggcagctcatgaaacttgtcgtgtaggtgtgtgtaccatattaaattactacctacgttcttttactttcttggaccgatgctactgcagttaaaaattccgataaaatagccttagagaagaaacatgaagtactgtttgagcattgaaaatttaagtaatttatgatcatccatcattct

SEQ ID NO: 7208 - DNA, 681 bp, Medicago truncatula
  misc_feature (562)..(562): n is a, c, g, or t
  misc_feature (599)..(599): n is a, c, g, or t
  misc_feature (675)..(675): n is a, c, g, or t
  Predicted polypeptide sequence is orthologous to G217
gcaccagagaaagcaagacgttgcaaggaataaaattgcagagaggcaagatgccccagctgctattctgcatgccaacaagctgaatgacccagaaacagttagaaagagatcaaaactgatgcttccaccgcctcagatttccgatcaagaattggatgaaattgccaagttgggttatgccagtgaccttgtgggcagcgaggaactcaccgaaggtagcagtgctacccgtgctcttctccctaattatccacagacacccaaccaagccaagactcctttaagaactcctcagagaacaccagctagtaaaggagatgctatcatgatggaagctgaaaatttggccaggctgagggagtctcagacaccacttttaggaggagaaaacccggagttgcatccttcagatttctctggggtcactcctaagaaaaaggaaattcacactccaaacccgctgctgactccctctgcaaccccgggaagtgcaggccttactcccagaagtggtatgacaccggcaagggatggtttttcttttggcatgactccgaanggaactcctctcagggatgagctacatatcaatgaanatatggagatgcgtgatagtgctaagctcgagctacggagacaagctgatatgaaaaaaagtctgcgctctggttnagcagc

SEQ ID NO: 7209 - DNA, 280 bp, Medicago truncatula
  Predicted polypeptide sequence is orthologous to G230
gcacgagtgaagaatgaattgtttaaagttaaagcaatagagcttaaagaggaaggaaggaaggctataagtgttggtggagattgtgaggttaccattcagaagctaattcaaaagtggaaaaataatgtcaacaatatttgaggtgttgtattttttgttcaaaacattgagagtgggtttttgtttttattttcatcttttttgatatgcagattctaggaattaaacattggttattccattagctttgatcaaaaaaaaaaaaaaaaaaaaaaaa

SEQ ID NO: 7210 - DNA, 658 bp, Medicago truncatula
  misc_feature (370)..(370): n is a, c, g, or t
  misc_feature (457)..(457): n is a, c, g, or t
  misc_feature (518)..(518): n is a, c, g, or t
  Predicted polypeptide sequence is orthologous to G234
cttttcttgaaaactcataccaacaaacatgggaagagctccttgctgtgacaaagccaatgtcaaaaaaggtccatggtcacctgaagaagatgctaaactcaagtcttacatagaacaaaatggtactggtggaaattggattgctctacctcagaagataggacttaagagatgtgggaaaagctgtcgtcttagatggttaaattatcttagaccaaatattaaacatggtggtttctccgaagaagaagacgacattatttgcagcctctatgttagtatcggaagcaggtggtctatcatagcagcacaattaccaggacgaacggataatgatataaagaactactggaacactaggctgaanaagaagctccttgggaaacaaaggaaggagcaacaagctcgccgagttagcaacatgaaacaagagatgaaaagagaaacaaatcanaatttgatgatggcggctttgggtgtcaatagtatgagttcagcaccatattggcctgcanagtattctgttcatcctatgccagtttcaaattcatccataatttgattatgatacgaacaatcaaacatccttcacaagtttaatgaacattccaaacccctttttccatggtgagtaatacaattacaaacaatggtg

SEQ ID NO: 7211 - DNA, 661 bp, Medicago truncatula
  misc_feature (370)..(370): n is a, c, g, or t
  misc_feature (562)..(562): n is a, c, g, or t
  misc_feature (581)..(581): n is a, c, g, or t
  Predicted polypeptide sequence is orthologous to G234
gagaggtccatggtcacctgaagaagactccaaactcaaagcttatattcaacaacatggtacaggtggtaactggatagccctgccaaagaaaatagtaggtctcaaaaggtgtggaaaaagttgtcgtcttagatggctaaattatcttcgtcccaaccttaaacatgggagtttctccgaagaagaagataacattatttgcagcctctatgtcaatattggaagcaggtggtccattatagcagcgcaattaccaggacgaacggataatgatataaagaactattggaacacaaagttgaagaagaaacttttaacaaagcaaaggaaggagcaacaatctcaagctcgccgagttttcaaccanaaccaagagatcaaaagagagagtggaaattcggtatggcctattggatttatcggtcaaactccaaattattggccaacacagcacaattcctttcccaatattccagtaacaaatccttcttccatccaaaactataacctcaaggaagttgaattctatgatgatcatcaactgcagccagtaaatgcnaacaataattgtcaatatncatgtgacatttacttccaacaagaccaattgtattgtccttctacaatgaacagcataaactctgcagggttgacctat

SEQ ID NO: 7212 - DNA, 688 bp, Medicago truncatula
  misc_feature (153)..(153): n is a, c, g, or t
  misc_feature (668)..(668): n is a, c, g, or t
  Predicted polypeptide sequence is orthologous to G249, G1322
cactacttctctcactctctctctttttctctctcttcaaaaaatataatggacaaaaaagagtgcagttcttcacaagatcctgatgtacgaaagggaccatggacaatggaagaagacttgatcttgatcaactatattgccaatcatggngaaggtgtttggaactccttggctaaatctgctggtcttaaacgtaccggaaagagttgcaggcttcggtggctaaactatcttcgaccggatgttagacgagggaatattacacctgaggaacaactcttgatcattgaacttcatgctaagtggggaaacaggtggtcgaaaattgcgaaacatctaccgggaagaaccgataatgagataaagaactactggaggacaaggatccaaaagcatatcaagcaagctgagaactctcaatctcaagaacaaggttctgatattcaaataaatgatgataataataataatcaacttataggaagcacaagccaaatttccaacattgctgaacctatggacacaaatattatatcaccaccctcttaccaaggaattttggaaccatttccacctcatcatcagttccctacaatctctgatcaatcaggttgttctaactactggaccatggaaaatctcttgtcacttcactactaaatggngattaattaagccaataata

SEQ ID NO: 7213 - DNA, 676 bp, Medicago truncatula
  misc_feature (86)..(86): n is a, c, g, or t
  misc_feature (104)..(104): n is a, c, g, or t
  Predicted polypeptide sequence is orthologous to G254
gcaccagatcaaataccaaacactgcgaacaaaacaaagacaagagcaacagtaaagtaaactacaccaacagacacatacacgcngagataatcgaaattacnggttttggttatggtatctataaaccctaatccaacaccacaaggtttctacttcttcgatccttcaactatggctcttcccggtgttaacaatcttcctccaccacctccgccgccatctactaccgccgccgcagcatctaccgttcctgaggatcctaataagaagatccggaaaccatatacgattactaaatctagagagagttggactgatcaggagcatgataagtttctagaagctcttcaattattcgatcgtgattggaagaagatcgaagcctttgttggttcaaaaacagttatccagatacgaagtcatgcacagaagtattttctcaaagttcagaagagtggaacaagtgaacatgtacctcctcctcggccaaagagaaaagctgctcacccataccctcaaaaagctcccaaaaacgctcctactgcatccccccaagtcatggggacattgcaaccttcatctgcttttgttgacccaacttacatttatagcacagattcatcatctgtgcttggtacaccagttactaatctgcctttatcatctctgaatt

SEQ ID NO: 7214 - DNA, 705 bp, Medicago truncatula
  misc_feature (568)..(568): n is a, c, g, or t
  misc_feature (668)..(668): n is a, c, g, or t
  misc_feature (691)..(691): n is a, c, g, or t
  misc_feature (703)..(703): n is a, c, g, or t
  Predicted polypeptide sequence is orthologous to G256, G666, G668, G932
ccaagacagggttgtcaagatgcagcaaaagttgcagacttagatggactaattacctaaggccaggaatcaaacggggtaaccttcactgaacaagaggagaagatgattatccatcttcaagatcttttaggaaatagatgggctgcaatagcatcataccttccacaaagaacagataatgacataaaaaactattggaatactcatttgaaaaagaagctaaagaaatcacaaacaggtaataatgctgaatgcattaattttgaagaagaaaaattttcagcatctcaaagaattccaagaggtcaatgggaaagaagacttcaaacagatattcaaatggccaaaaaagcacttaatgaagcactttcaccacaaaaattatctcctaacttttctacttcaaaccctacaaatagtaacctcattttcttccactaaagaaccaggtcaatcgttttgctatgcttcaagtgcagataacatagcgcgtttattaaagggttggatgaaaaatccgattaaatcatcggtaagtactaattcagttggtgacacaaaattnccttcaacaaactttgattctgcttctagtagtggaacaaaggggtgaaatattggtctgaacatttgaatctttgtttggttttgaccctttaaagtcnttggagtcatcgaattctgaatnttctcatcaggnct

SEQ ID NO: 7215 - DNA, 822 bp, Medicago truncatula
  Predicted polypeptide sequence is orthologous to G256, G666, G668, G932
attttggtatttccattcaagaactggacctggaaattggagatcagttcccaccactacaggtttgatgagatgcagtaaaagttgcagacttagatggactaattatcttagacctggtatcaaaagaggtaatttcaatgaccatgaagaaaaaatgataatccaccttcaagcgcttttaggaaatagatgggctgccatagcttcctatcttccagaaagaacagacaatgacatcaaaaactattggaatacacatttgaggaaaaagcttaagaagattaatcaaacaggtgatgaaaatgaagtagaagaaaactctattcctcaagtaaaaggtcaatgggagagaagacttcaaacagatatccatatggcaaaacaagctttgtgtgaggcactttctcttgacaagccaacacctattttagctgaaaatcaaacatccccttatgcatcaaacaccgaaaacatagctagattactcgaaaagtggatgaaaaaacccgaaaattcagtcgagacaacaaattcaggaaactccattatggtagtaacaggatccggttctagggaaggaggacagaatactatagcatgcaaacaaaaagatcaagcatttgattctttggtgagttttaattcattaaattctgattgttctcaatctgtgtcggtcgaagaaaaaatttcttggcaatggattcatgcttttttcaatatcaaagtaagccaaaccaggaaactcaagaccctctcatgtttatggagaaattggccttttgatgatgaggctgctcagtggcatgaagatctaat

SEQ ID NO: 7216 - DNA, 817 bp, Medicago truncatula
  Predicted polypeptide sequence is orthologous to G259
atatgatttccaatatttgattatgactttaattttcagaagctgtataaacttatgttttcaggcttctattgtaacatatttatttatatttctatttgcatgattgagacaacaaaatgcttgcgttttcactaatctcagctctagtccttttaatccttctttctccttgttgaacatccaatctcaccccaaacagcattggccttttatcattatctttagcttcctcttcttccatttttttggtatgaattgagaccaaatcaagtagttccttacacttccttttcatgcttgttagctcagaattcaacaccacattttccttcttgagtcgcttgttttcatccactagattagtgtaacctgaagttgatgaggttgatgacgatctttgatcttcatcagaatcttggttttgtaccgtttgttgttgcttgttgctccaggccttccttctccgaatctcggatagtaactctctttcacctttcttaaatctttcattgcaaaactcccatctacttgttgcaactttacgaaatccataagtattgagctgccgtacaaagctagagaagttgctatgcttgaagagtgttggaaggatatcacgagcaaactccgccggctgccacaccacaaacgccgttccttcatcgttccacgatatcacaccatcgggttatcggatcctcaaccaacatgtatgtcttcaacaagaaggggtgatggagtgcactttcttccacattccaataatcccttctcactaataaccactccttccatttttttctatttctatttc

SEQ ID NO: 7217 - DNA, 829 bp, Medicago truncatula
  Predicted polypeptide sequence is orthologous to G261
gctactattatcttttctttctgattgcacttcctgtgcttccgatgcaccaggatcctcagtcaagaactgctcccagaatacatcattaaccccagttgctgcagtggtgattctcgcaggttgttcttttagtgcaacagcctcaagagcagcagaagctggttcaacgttcatgtcaatttcaggtgacttaggtcgaacttcaccgtctagttgctgagaagatatggacaaactatcagcacagcatgtagattcatctaaatccatgtttgaatgagtgtgaacgaaattgccgccaacttcatgtgcaagagtctcccaaaatgccacggatgcctcaagttgatccaatctctcggtgtttaacgtcaaagtagagttatcctctgcattttccctgggcaaagctacagaagtctccatagcatcttcaacactagcttcattattaaagcaaccacttctcgccggcaaccttcgttttctctccatggcttctgccagtggcaagagatttacagcaatcataggtttctgcagtgcttcagaaacagaggacaacatcttttgttgcttatgttccaatttttccaactgatctttcgaacaatgcatttgaatctcatacgtttcccaatcatgctggtatctgttcgtctccatgaggagttgttctctatcctgtttcagcttctctatttcatcaaccatactctgcctttcagactccgttagaggggcttgtgcttgaagattatgcagagaatgactatgaaccggcttccgtctatgaatattcttcataagatgtggttgccccctt

SEQ ID NO: 7218 - DNA, 485 bp, Medicago truncatula
  Predicted polypeptide sequence is orthologous to G264
taggataggtttaagttttttaggaccttcaacgctttattttaatattatcgcaaagagagggcccgtagccaaaattgatgatgtttttccaactgatgggcttactgtaagtcccggtagtccttttcaaaatgttggagaatttgaaatttattacacaaatgaatataatgcagaatatagtaatgaatctggaatgaaattacttggtaaacttaagtttgattggccaggcttggggtttaatagatctgttacctttaagttatcattttgcgaaatggaaattaccgcaactgcaacaaatgatttaaccggtcaaaattatctcacgtactttgagataaatacagaaaactaatatctattatacacaatatttttagttttataaattgtttctttaatttctttactatgacaagatttatatattaaaataaaagttctgtttttaaaaatccaaaaaaaaaaaaaaaaaa

SEQ ID NO: 7219 - DNA, 789 bp, Medicago truncatula
  misc_feature (75)..(75): n is a, c, g, or t
  misc_feature (166)..(166): n is a, c, g, or t
  misc_feature (178)..(178): n is a, c, g, or t
  misc_feature (203)..(203): n is a, c, g, or t
  misc_feature (260)..(260): n is a, c, g, or t
  misc_feature (283)..(283): n is a, c, g, or t
  misc_feature (295)..(295): n is a, c, g, or t
  misc_feature (304)..(304): n is a, c, g, or t
  misc_feature (317)..(317): n is a, c, g, or t
  misc_feature (329)..(329): n is a, c, g, or t
  misc_feature (355)..(355): n is a, c, g, or t
  misc_feature (367)..(367): n is a, c, g, or t
  misc_feature (424)..(424): n is a, c, g, or t
  misc_feature (439)..(439): n is a, c, g, or t
  misc_feature (448)..(448): n is a, c, g, or t
  misc_feature (475)..(475): n is a, c, g, or t
  misc_feature (482)..(482): n is a, c, g, or t
  misc_feature (495)..(495): n is a, c, g, or t
  misc_feature (520)..(521): n is a, c, g, or t
  misc_feature (531)..(531): n is a, c, g, or t
  misc_feature (535)..(535): n is a, c, g, or t
  misc_feature (537)..(537): n is a, c, g, or t
  misc_feature (571)..(571): n is a, c, g, or t
  misc_feature (578)..(578): n is a, c, g, or t
  misc_feature (586)..(586): n is a, c, g, or t
  misc_feature (607)..(607): n is a, c, g, or t
  misc_feature (613)..(613): n is a, c, g, or t
  misc_feature (618)..(618): n is a, c, g, or t
  misc_feature (620)..(620): n is a, c, g, or t
  misc_feature (627)..(627): n is a, c, g, or t
  misc_feature (634)..(634): n is a, c, g, or t
  misc_feature (637)..(637): n is a, c, g, or t
  misc_feature (642)..(642): n is a, c, g, or t
  misc_feature (655)..(655): n is a, c, g, or t
  misc_feature (671)..(671): n is a, c, g, or t
  misc_feature (674)..(675): n is a, c, g, or t
  misc_feature (688)..(688): n is a, c, g, or t
  misc_feature (703)..(703): n is a, c, g, or t
  misc_feature (710)..(710): n is a, c, g, or t
  misc_feature (717)..(717): n is a, c, g, or t
  misc_feature (721)..(721): n is a, c, g, or t
  misc_feature (723)..(723): n is a, c, g, or t
  misc_feature (737)..(737): n is a, c, g, or t
  misc_feature (740)..(740): n is a, c, g, or t
  misc_feature (752)..(752): n is a, c, g, or t
  misc_feature (756)..(756): n is a, c, g, or t
  misc_feature (765)..(766): n is a, c, g, or t
  misc_feature (777)..(777): n is a, c, g, or t
  misc_feature (781)..(782): n is a, c, g, or t
  misc_feature (785)..(785): n is a, c, g, or t
  misc_feature (787)..(787): n is a, c, g, or t
  misc_feature (789)..(789): n is a, c, g, or t
  Predicted polypeptide sequence is orthologous to G264
tgattacgccaagctcgaaattaaccctcactaaagggaacaaaagctggagctccaccgcggtggcggccgctntagaactagtggatcccccgggctgcaggaattcggcacgaggccccccctttttttttttttttttttttttttttttcactttcaagtntacaataccggngaaaaccattaaaagcttgaacgtntacaacactaccaaacaactaattcccaatgcatgtttcagtctaaaaagtcaaacntatttttacatgacagtagtaanacaaacatattnttgaacgtntacaatattcagngaatctcacatnccaatagtaagtgtcccaaaacagcntgctcaaagggngaaattatccatgttcttgatgttactggaaattccatgaactgaccgccctttttnttgctcactatttgnaattgctcnatagttggatattgcctcttcattgtntgaacancctggtctttcantaaggaaattttcccaaaacacatnnttcactccgngccnancagctgctttgacttggacgttacctgaagcctnctttggnggagctanattgatacccttattacccanattttnggttngnggaaacnccaattncanattcngggggggcccggnccccaattcgcccctnttnngagccggtattanaattaactggccgtngttttanaacgtcntggncngggaaaacccctgncgnttcccaacttantccnccttgaaannatccccctttncccnngcngngn

SEQ ID NO: 7220 - DNA, 811 bp, Medicago truncatula
  Predicted polypeptide sequence is orthologous to G264
aagttcaacatacctgtgaaaaccattcaaaacttgaatatataggagtatgtattcaaaactgcatagtcactttcaagtctacaataccggtgaaaaccattaaaagcttgaacgtctacaacactaccagacaactaattcgcaatgcatgtttcagtctaaaaagtcaaacatatttttacatgacagtagtaagacaaacatattcttgaacgtctacaatattcagtgaatctcacataccaatagtaagtgtcccaagacagcatgctcaaagggtgagattatccatgttcttgatgttactggagattccatgaactgaccgcccttcttcttgctcactatttggaattgctcgatagttggatattgcctcttcattgtctgaacagcctggtctttcagtaaggaaattttcccaaaacacatcattcactccgtgccgagcagctgctttgacttggacgttacctgaagcctcctttggtggagctagattgatagcctcattagccacatttcggtttgaggaaactccaatttcagattctttaccatcagcgttaactcttgactctgccaaattgccaatttcctgacagtttatttggggcgacctggccgagtatgaattcctattgaattccaatgtacaagatgccagagttaaatttagttggcaggatatatgactatcgcctttctcagtactcggctccagagagtgaagattgggcactcagtagttgtttgctcttgtgataacacgaatccatgttaaagtgaaagatgcccagtatctgca

SEQ ID NO: 7221 - DNA, 678 bp, Medicago truncatula
  misc_feature (532)..(532): n is a, c, g, or t
  misc_feature (622)..(622): n is a, c, g, or t
  misc_feature (673)..(673): n is a, c, g, or t
  Predicted polypeptide sequence is orthologous to G268
cttcttctctcctccttctccagaagatcaccaacaacaacaaccaccaccaccaccacctccacctcctcttcaaccaactccaaaacccttccgtataccacccttacccccacaagagagaattggtctaatagacgaaaatggtgtcatgacagacaatttcacagtcagcaacaacgatgacgatgaaacattgttaaattggagcttgaacattaccaacaacaatagtgatacgaattttgtggtggaggaggtgaagaaagtgaagaagtataagatttgtaaggatgtgagaatggtggattatataccttgtttggataattttgaagagattgccaagtttaatggaagtgaaagaggggagaaatatgaacgtcattgtccggaacaagagaagggtttgaattgtgttgttcctcggcctaagggttacaggaagccgattctttggcccaagagtagagatgagatttggttcagtaatgtaccccatacacgtctggttgaggacaaaggtggccanaattggatatcaagaaagaaggataaatttgtttttccaggaggtggaacacagttcatacatggagcagataaatacctggatcagatntccgagatggttcctgacattgcatttggttcaacacaagagttgctttanacatc

SEQ ID NO: 7222 - DNA, 626 bp, Medicago truncatula
  Predicted polypeptide sequence is orthologous to G268
ccgccgtcggattcggtggagaaattcgggatcgtgaacgagaatggaacaatgtcggaggagtttgaaattgggagcttcgatccagcgatggtggatgattgggttaacgaaacgcaagttgagaaggaaggttctgagagtgttacgaaatttgcgatcaagaaatttgggttgtgttcacgaggtatgagtgagtatataccttgtttggataatgtagaagcgattaagaagttgccatcgacggagaaaggtgagagatttgaacgacattgtcctgaagatggtaaaaagttgaattgtttggttcctgctcctaaagggtatcgtgccccaattccatggcccaaaagcagagatgaggtatggttcagtaatgttcctcatactcgtctagttgaagataaaggtggccaaaactggatttccagagacaaaagataagtttaaatttccaggaggcggtacacagttttatacacggcgcggatgaatacttggaccatatttctaagatgattcctgaaattacatttggtcggcatattacgagttgctctttgatgttaggctgtggtgtagctagttttggtgcgtacttactgcaacggaatgtcatcacc

SEQ ID NO: 7223 - DNA, 604 bp, Medicago truncatula
  Predicted polypeptide sequence is orthologous to G268
aaggcatgattggtgtttgccatttgatcatacccaagaacatatgatctgctacatgcagcaggtctcttctctgctgaaaaaaagaggaaaaaatgtaatatttcaaccatcatgctcgagatggatcggatgctaagaccaggtggttatgtgtatatacgtgatgctgtacgtgttgttagtgaacttgaagaaattgcgaaagcaatgggatgggtgactacccgggatgatgtaggagagggtccatatgcaagcttgaaaatattaaggtgtgagaaacgcttctgaagccaatgtaacatggtttaattggtaaggattcggctcatatcatacaagaatatgattttgaatgtgactggtctaccttggttatctcctgagactcaactcacctaaactatagttcaattgtatgaatagcgtagagattcatatactggttcacgcaaacagaaaatggtgatctctgtataattccagaaaggtgaagagttagttccatacttcgcaccaatgttgaatccctactaatgggttttctagaagaagttactttgtatctattgatagtttaatttttttacattgatatccc

SEQ ID NO: 7224 - DNA, 672 bp, Medicago truncatula
  misc_feature (648)..(648): n is a, c, g, or t
  Predicted polypeptide sequence is orthologous to G270
ttcggcacgagctcaaccccaaacactcatcttctctccattcccttcttccacacctcgcaagtttcaatcttttcaacctctcaaatcccccacaaaccgcaacctctacaaaattctctcttcatcataccaaaatgacaacaacgacaacgacgaagaacacatcatcggagattgtctggttttcgaagaaggcattttcgaagaccccattttcccaacatccgacaacaacctcgtaaacaacaaaaaaccgaaaccaatttcaaagaagaaaaaacagacagtgataaagtccgagaatcttgttcctggtaaatggaaagaagttcaagcagggataaacataacgaagaaagaacagcctaagatagctcaagagattgagtttaatagtaaagaagaacggcgtaagatagctcaagagtttgagtttaatagtaaagaagaacggcgtaagatagctcaagagtttgagtttaatagtaattttatgaagaagaaaagtgggttggttcatttgagggatattgattcgaacgagtataaagcttataaagaagctaaattggctcagttgacgcctttggttcttgataagggtccgagtttttgttttgctgagaaaagaaggaaagagaatanatgaattgagtgatgagagggtaa

SEQ ID NO: 7225 - DNA, 656 bp, Medicago truncatula
  Predicted polypeptide sequence is orthologous to G274
aactattagggaaaatagtggcacatagagaggggtgtttttattcttgaatgcttcattctaaattgttaattaatttaacaccaaaactgatttgtaacataaacttggagcaagttatgtgaacccctcactctaccacagttgtgataatgaatcaaaccatatgaactctgtgactattgtttgtatatagaaaagtagtagcagcttaaggctaggagtgcaatttcttcaacttgtttttcactgattattgtgttgatgtggagtttccatcagtaacccaatactgtttgacagcaattagtactttctcgggaacaagaggaccatcttcatgatcaaccaatttcatattccatctcattcctccgattaacttctttaccttaattaacacatcgacttcgtcacggattatgacagcgccttctggtcgcaatatccgatccatctcgagaagaatgtcttctgtattgcatttatcctggtacaaactgaagaggccattagcatgaatgagatcatatgttcttggatatgtggaaaagccttcacaccaatcatgatagatgccaatcagtcctcgctcatatatcacaccgagcgtacttttttcagctatagtaggcacaacattcatgacccatgac

SEQ ID NO: 7226 - DNA, 804 bp, Medicago truncatula
  Predicted polypeptide sequence is orthologous to G274
ttttagtgtgatctactataccagacctgggatctctattctctcttttcaaggtttgatcgtttgaaagaggttagaaagaaaactgcggggttaatgggttctaaaaatgccttaccgggcaacagagcacgaaggcctttgtcaattttcgctgtgcttgctctgtgttgtttgttttatcttttgggaacatggcaaagcagtggttctggaaagggagacagccttgcattgaaggtaaataagatgcaggcgacaacagactgcaacattgtaccgaatttgaattttgaaccccaacacaaatatgtagaaattgttgagcaatccgaaccgaaagctaaaatgttcaaggcatgtgatgtaaaatatgctgattatacaccttgccaagagcaagaccgagcaatgacattccctagagaaaacatgatctatagggaaaggcattgtccacctcaagaggaaaaattgcgttgcctcattcctgctcctgaagggtacacgactccttttccatggcctaaaagccgcgattatgcctactatgctaatgttccttacaagcatctgacagtggagaaggctaatcaaaactgggtgaaatttgaagggaatgtgttcaaatttccaggtggaggaaccatgttccctcaaggagccgatgcatatattgatgagcttgcttcggttattccaatcaaagatggtactgtcagaacagcattggacactggttgcggggttgcgagctggggagcgtacttgctaaagagaaatgtgctagctatgtcatttgct

SEQ ID NO: 7227 - DNA, 674 bp, Medicago truncatula
  misc_feature (622)..(622): n is a, c, g, or t
  misc_feature (655)..(655): n is a, c, g, or t
  misc_feature (659)..(659): n is a, c, g, or t
  Predicted polypeptide sequence is orthologous to G274
ctgaacatgattgacgctattgaatcatagggttttagagtgagacttttcactgactcattcagcttctcttactcaaccaaacaccaaacaacaaaaacatcatcatagtttggttcctagatcttctcaaccattgcttcctccaacatcatatgatcggttctatatggctaaaccaagttcatctggtagtagaactagaagctttgtgcagatctttatagtagttggtctatgttgtttcttctacatattaggtgcatggcagagaactggttttggaaagggagatcttttacaattggaggttactaagaaaggtgctggttgtgatattgttccaaatttaagctttgattctcaccatggtggagaagttggcaaaattgatgaggttgattcaaaacctaaggtatttaagccttgcaaggctcgatatatcgattacacgccctgccatgatcaacggcgtgccatgaccttttctagacaaaatatgatttatcgagagaggcattgccctcgtgaagaagagaagttacattgtttgataccagcaccgaaagggtatgttactccatttccatggccaaagagccgtgattatgttccatatgcnaacgcaccctacaagagtcttacagttgagaangctnttcagaactggatcc

SEQ ID NO: 7228 - DNA, 795 bp, Medicago truncatula
  Predicted polypeptide sequence is orthologous to G274
acactccatgtcaagatcaacggcgtgctatgacgtttccgagagaaaacatgaactacagagagagacactgccctccagaggaagagaagttacattgtatgatcccagcaccaaaagggtatgtaacaccttttccatggcctaagagtagggattatgtcccttatgctaatgcaccttacaagagtctcacagttgagaaggctattcagaattggatccaatatgagggaaatgtgtttagattccctggtggtggaacccaatttcctcaaggtgctgataaatatattgatcaactcgcatctgttattcctatcaatgatgggacagtgaggacagcacttgacaccggttgtggggttgcaagttggggtgcatatctttggagcagaaatgttgttgccatgtcgtttgcaccgagggactctcacgaagcacaagtacaatttgctctagaaaggggtgtacctgctgttattggtgtttttggaaccataaagttgccatatccatcaagagccttcgacatggctcattgttctcgctgtttgattccatggggagcaaatgatggaatgtatatgatggaagttgatagagttctaaggcctggtggttattgggtgctttctggtcctccaatcaattggaaggtcaactacaaaccatggcagagaccaaaggaggaacttgaggaagaaaaagaaagattgaagaggttgctaagaaactttgctggggagaagaagtctgagaaagctgaaatgcaatttggcaaagatgacgaca

SEQ ID NO: 7229 - DNA, 730 bp, Medicago truncatula
  Predicted polypeptide sequence is orthologous to G275, G837
acttctgttggagttgaatagattattgcgacctggtggtttctttgtatggtctgctactcctatttatcaaaagctgcccgaagatgtagaaatatggaacgaaatgaaggctctaacaaaagcaatgtgttgggaagtggtgtctatcagcagggataaacttaataaagttggtatagctgtatacaagaagccaacttctaatgagtgttatgagaaacgttccaagaatgagccttctatatgtcaagactatgatgatcctaatgccgcctggaacattccattgcaaacttgcatgcacaaagcgccagttagttcgacagaacgtgggtcacaatggccaggggagtggccagaaagactgagcaaatcaccttactggttatcaaattctgaagttggagtttatggaaaacctgctcctgaagattttactgctgatcatgaacactggaaacgtgtagtgtccaagtcttatctaaatgggattggcattcagtggtccaatgtgcgcaatgtcatggacatgagatcagtttatggagggtttgcagcagccttgatggatttgaaaatttgggttatgaatgtggttccggtagactcaccggacacacttccaattatttatgaacgtggtctgtttggcatatatcatgattggtgtgaatcatttagcacatatcccaggtcctatgatctagttcatgcagatcatctgttt

SEQ ID NO: 7230 - DNA, 795 bp, Medicago truncatula
  Predicted polypeptide sequence is orthologous to G275, G837
aagacgagggtaagaaaacagaggatgaaggttccaatacagaaaataacaaagatggcgaagaggcgtctactaaggaatctgaatctgatgagagtgaaaagaaagatgaatcagaggagaacaacaagtctgattcagatgaaagtgaaaagaaatctagtgactcgaatgaaacaacagatagtaatgtagaggagaaggtggaacaaagccagaacaaagaatctgatgaaaacgctagtgagaagaatacagatgataatgccaaagaccagagttcaaatgaggtattcccttctggggctcagtctgagcttctaaatgaaactacgacacaaactggatcgttttctactcaggcagcagagtcaaagaatgaaaaggagattcaagagtcctccaagactgggtacaattggaaagtttgtaatgttaccgctggccccgactttatcccatgccttgacaactggaaagtgattaggagtcttcgcagcactaaacattatgaacatcgagaaaggcactgtcctgaagaacctcccacctgccttgtctctcttcctgaaggatataagtgctctattgaatggcctaaaagcagagaaaagatatggtattacaatgttccacacactaagcttgctgaagtaaggggcatcaaaattgggtgaaagttacgggtgagtatcctacttttcctggtggtggaacccaatttcagcatggggcacttcattacattgactttatacaagagactctgcctgacattgcttggggcaaacgcac

SEQ ID NO: 7231 - DNA, 654 bp, Medicago truncatula
  Predicted polypeptide sequence is orthologous to G275, G837
ttttctttcgttcttcatgccctacaacacaatgcagagataactattctctctcagatctgcttctttcataatagaattccactttttgataagtgacaacatggcgcaagcgagatatagtagaatagacaataaacgatctccgtcgagttactgctcaacggtgacgattgttgtgtttgttgctctatgcttggttggtttatggatgatgacgtcgtccgtcgttccggtgcaaaatgtagatgagtcgactaagaatgaggtgaaaggacagagcgaggcgaaggatcaggcaactgacatcactaatagcaatcctcagaattttgaagataagaagggagatctgccccaggaatctaccaaggaggataacaatgctaagcagtccgaaaacaaccatgttatgcccaaaaagcaggaagagaaatcggatgaaaagcctgaagataagtctcctgaagataccaagatgacatatattgatccaaatcagaacaagaagacatctgattcggatgagagcaataacaaatctgtttctgatgagagcaaataaacaaatccggttctggcgaggacaacaagaagtccgatttctgacgtgagtgagaagaagtccaattctgatgagagagagaaaaaatc

SEQ ID NO: 7232 - DNA, 682 bp, Medicago truncatula
  misc_feature (586)..(586): n is a, c, g, or t
  Predicted polypeptide sequence is orthologous to G280
cacaatctcatttctcttaaaattttctatctctcttagaatatttttctctcaatttttttagctcttttttcctcactattttcaagcttcaatggctactcaagaggttaataagcctctttcacttcctccataccctgagatgattatgaaggcactggaagcactgaatgaaccaaatggttcaaacaaatcatcaatttcaaactacatagaatcaatctatggagaattaccagaaggccattcaattgttcttgcaaatcaccttaaccagatgaaggataatggtgaccttgtttttgcaaagaacaactacatgaagcctgatccaaatgcaccaccaaagagaggacgtggaagaccaccaaagccaaaggatccattggctccaccaccagctgctgttctgtccccaccaaggccaagaggtcgtcctcctaaggaccctaatgcacctccaaagacccctaagcctgcttcaagtggaagaggaaggggtaggccaaagaaggttcaaaggactgagaatgtttcaaatccaagtggtggagatggtgatggtgctggtgctggtgctgangttgatgatgatgatgctgctccaagtgttgctgctgttgctgttccaactactagtggaaggggaaggggtaggcctcctaagttaagcctcaaa

SEQ ID NO: 7233 - DNA, 867 bp, Medicago truncatula
  Predicted polypeptide sequence is orthologous to G291
tcatcttcggcgatagcacaacaaacatgggaattagagaacaacataatcccaatggaaactccttcagacgattcaatcttccactacgacgaagcaggacaagccgaattccaacgcgataagccatgggcaaacgatcctcactacttcaagcgtgtcaagatctctgcactcgctctactcaagatggttgttcacgcgcgttctggtggaacaatcgaggttatgggtcttatgcaaggtaaaaccgatgctgattcaatcatcgttatggatgcttttgcgctacctgttgaaggaactgaaactcgtgtcaatgctcaagctgatgcttatgaatacatggttgattattctcagacaaacaaacaggctgggaggttggagaatgttgtggggtggtatcattcacatcctggttatggttgctggctttctgggattgatgtttcgacacagatgttgaatcagcaatttcaggagccgtttttggcagttgtgattgatccaacaagaactgtttctgctgggaaagtggagattggggctttcaggacttaccctgaaggttataagcctgctgatgatcctatttctgagtatcaaactattcctcttaataagattgaagattttggtgtccattgtaaacagtattattccttggatatcacttactttaagtcttctcttgattcacaccttttggatcttctgtggaacaaatattgggtgaatacactttcatcttctcctttattgggcaatggagactatgtagctggaccaatctcagatttagccgaaaagctagaacaagcagagaatcaattggcacactcgcgtttcgggccactggtagca

SEQ ID NO: 7234 - DNA, 756 bp, Medicago truncatula
  Predicted polypeptide sequence is orthologous to G307, G308, G309
gtgctcatgcattttacaacttatcttctctcttagttttctcacacatcactttctttatttctttctcctcttttttcactctctcctagcttaaactcaattataaacacacacacttctttagatgctatcatacttcaactttgcttccacagactaacgcttataagttcaaaaactgtgttttaagttttgaattctatggaaatagtttcagattcttcttctccatcaaagacaaaagacatcgatggcctcctcgccaatgtcggctacaaagtccgatcatctgagctacatcaagtagctcagaatctcgaacgattagaaagtgcgatcgtgaactcatccagcgacatttctcaattcgcttcggatacggtccactatgatccctccgacattggcaattgggtggacaatctcctctccgaatttgaccacacggcctctttaccctacgatttctctcaacttccagatctctcagcaccgccgccacaacaccaccaccaccaatcttcttcgacagttaataatgtcgaagaagattctgcaataaaacttgtccacatgctgatgacctgtgcagattccgtgcaacgtggtaaatcttcattggctggctcgctaatcgaaggcatgcaagggtttgtggcaaacatgaacacaaactccggcatccgaaaagtcgcgggatacttcatcgacgctttgaaccgtcgcatcttcggtcaaaacatgttagccacc

SEQ ID NO: 7235 - DNA, 831 bp, Medicago truncatula
  Predicted polypeptide sequence is orthologous to G307, G308, G309
ctcccattcttctaaacttcaaaccataaactcaaaaaaccccattttgctatgacccaactcaaattctaaatcaaaatctattcacttcaccaatttaatcaacaaattatagaaagaaaaaaaaaatgaagagagaacaccaagaaagttttggtgggggtgtgattagcaacaacaacaaaacaaacaccaaccaccttaacagcagcaaaaacatcaactttggtgaatgttcatcaatgcaaaacacaaacacaaaacaaaacatgtggagagaagaaaaagaaaccaacggtggtggaatggacgagttgttagcagcattaggttacaaggttcgctcttccgacatggctgatgtagctcaaaagcttgaacagcttgagatggttatgggtagtgctcaagaagaaggtatcaatcatctttcttctgatactgttcactatgacccaaccgatctatattcatgggttcaaaccatgctcactgaactcaaccctgattcttctcaaatcaacgaccctttggcttctttgggttcttcttctgaaatcctcaacaacactttcaatgatgattctgagtatgatcttagcgctattcctggaatggcagcatacccacctcaagaagaaaacacagctgctaaacgaatgaagacttggtctgaaccagaatctgaaccggcggtagtgatgtcaccaccgccggcggtggaaaatacagaccggtggttcttgttgcacacaagaaactggtgttcgtcttgttcatactttaatggcttgtgcagaagcgattcagcaaaagaatctgaaacttgca

SEQ ID NO: 7236 - DNA, 693 bp, Medicago truncatula
  Predicted polypeptide sequence is orthologous to G307, G308, G309
catcatttaactcaaccagatgaattatttatcctccacctcaatttagaaccatggcatattacaaatatgagaaaattagcaatttgtgacaagcaaacccctcaaaaatctatctatggctacataataagaagaacaagtcagagatattgagcacgcaaaatgattaagggtacaaaaatactactaaaagaaggagaaatatacagtatgctaagtgagctacaatgcttgttttgttcatatttgctagttaaccaagttctccattcttcaacaatcaaaacgcagtgtttcagcatctaacaaaggcacagcttgccaagccgaagccgcaatcaaaggccggctatgccaacccaaagtcaagctaccttgattctcttccacgcaataaccctccgctgaaaacagagtcaacaacatactcgcttgcttaaaagcattcgaacccaaatgcaacggtctgaacccggctttaccaagccgctccttccacttaaccaacggttcatgtctctcaactcgagcaggtccttcgcagcacaccacgttgcatatctctctttgtaaatacatctcggccatagctttatctggttcaaccggacacgctttcagcgagtcaaaacggtcgagtataatgcatgcctccgtgaaccgttccataaccgttctcgtatggttcgc

SEQ ID NO: 7237 - DNA, 760 bp, Medicago truncatula
  Predicted polypeptide sequence is orthologous to G307, G308, G309
atccaaaaaaaggggttgtgtgcaatgtgcaaatatgcaaaaaggaacgagttgaatcagtgcgaaaccaccactgagttagcggcggcgagtttccaagctgaagttgcaatcaaaggcctagtgtgccaaccaagcataagacacccatcattctcttccaccttgtaaccatctccaccggcgaaaagcgctaacaacatactcgcttgtttgaacgcgttagatcccaaatgaaccggagagaatccagccgaattaaaccggttcctccactggttcagcgtctcatgacgttcaacccggtccgttccttcacacgccaccacgttgcagatttgcttccctagatatacttctgacatagctttatcttgcggttcaaccgatgaaccctccagcgagtcaaacaaagttgaataatagtgaagtgactcggtgaaccggtctagaaaagccggtccgttgtgatttgcttcttgttcaacaacggtgacaatctccggccgaatctgacgaataacagaaaacactttctccaacgcgccgggacgcgcgttgagtttatgaagctcaaaaacagagttaaccgcaacagattccgtttccggtgaccggagttcaagcatcgaagcatcaagatcagctaaactattagcaacaaaaccacgatactcaaactgaacatgaatcgtttgtgcaaattgagcaagcctccacccaacttgttgaagatgatctgagttatccgacgccggag

SEQ ID NO: 7238 - DNA, 582 bp, Medicago truncatula
  Predicted polypeptide sequence is orthologous to G314, G2699
tttttttttttgttcatggaaacaaaatacactgattaataaaaacaaaatctaaaaacaccataaagacataaacataacatctcatctacttatttactcttaaaaaatacaataaaaactaaccaaatattattaaaacccaaagactaaatagaaaaacaataactttattattcatagaatacaaaaagaggcaaaaatgttgaactagttaagcaggtaaccaagcagaagcaaaaacaacattatggcctttccaagtaagcacaatatgctcatcttctttcttcaatccccatccagcagcatgttcatcaagcatagctttcacctcaccaacacattcctcaccaaatccaatcccttgaaaattagcatttctcattctttgttcccatttgcttataggttcaactctctcaactctttgaacaccttcatgagctatcacattttcaatcttccaacaaatatctgcttcataccattgcctttgcttacttccacgcggtagaaatgtgtccacggtatcataaggtatccatagataattaaatgcggaccttaaatctactaacc

SEQ ID NO: 7239 - DNA, 839 bp, Medicago truncatula
  Predicted polypeptide sequence is orthologous to G324
cgtcatcttcatcttctcaaaattcgacaatccctaaccctaatttacaacatggaatttcagattctctttcccctttactccaccactctctcggatctctccagatccacgatcttccaggtccatcaaatcctgctgcagaaaattctggtgtgccctccgaaaaggtgacggaattagagtcttcaagtggtatgaagacacctcagcgaaactctagaacacaatctaggagtcactcaggaagacggacagttggatcttcccaatatgaggggaagacaacaggaacagtttcttctcatagaaaccaacagactaccgggtctgtatattctcaaggaagcaccccattggcaggaaggaagtctcaaatggcaaatgccaatcacttgctcaattttcagtatgatccaatatcccgttctcaacaaaggggtcctcctcctccccctccagcaaggaggcagaggaagacaagaccatacaacaaagatttgtttttgcaggccaatttcaaattcatggtgctagattctggaaattattcaccggactcaatggatccagataaaatgttgcagtgggaagatattatatgcgtgacatattcgaccccctttccagttcagtgtccaatttgtttggagcatcccctgtgtccccaaataacctcatgtggacacattttctgttttccatgtatactacaatacttgatgttgggtgaagaggatcacaaaggtgatcgctggaaaaggtgtccgttgtgctttgtgacaatatctgtcaaggatttatatacactccacatcacaaatgtcaaacagtatcaa

SEQ ID NO: 7240 - DNA, 662 bp, Medicago truncatula
  Predicted polypeptide sequence is orthologous to G328, G2436, G2443
tttgaacttccttaacactgtctgtccaaaactgacaaacaaaccattcatcactccctctctccacaaatgttggagcaagatttcctcaccaccacctcagccacagccactgtaaggtctgcgggaacgtgggcacgaacatgtgacacgtgccgctcggccccatgcgcggttttctgccgcgcagactcggcatatttatgtgccgcgtgtgatgcacgcatccacgcggcaaaccgtgtagcctcgaggcacgaacgcgtctgggtctgtgaggcctgcgagcgtgccccggcggcttttctttgtaaagctgatgctgcttctctttgctccacttgtgatgctgatatccactctgctaaccctcttgcaagccgccaccaacgtgtcccgattcttccaatttccggttacctatacggtcctccggccacccttttaggtgccgaagatgaaggcttcgtccgcggtggttgtgaggtggaggaagaggaggatgaaggtgttgatcatgatatggaagatgaaaatgaagcagcttcatggcttttgttgaatcctctaaagaacaacaataacaatagtaacaacaacattagcaatgatcataatcaagtggctaataatggatatttgtttagtggagaagttgatga

SEQ ID NO: 7241 - DNA, 707 bp, Medicago truncatula
  misc_feature (667)..(667): n is a, c, g, or t
  Predicted polypeptide sequence is orthologous to G328, G2436, G2443
ggattcagttacaatggtggttctattagtcaaagtgtttcagtttcatcaatggatgttggtgttgtaccagaatcaaccatgacctattcaagacctccaaaaggaacaattgacctattttcaggtccttctattcaaatgtcttcccatttctctccaatggatagagaagcaagagtcttaaggtacagagagaaaaagaagacaagaaaatttgagaaaacaattaggtatgcttcaaggaaagcctatgcagaaactcgaccgcgtataaaaggtcgattcgcgaagagaacagatgtagaagctgaagttgatcaaatgttttccacatcactaattacagaagttggatatggaattgttccctctttctgaaatgatacaaaacaaaatggtcaggggacaaagtgcacatttgaattgacggtgagtttgacataatcacctcgtatcaccgtcaattttgtataagctacatttttggagcttcaacaaaattactgtaattttgtcaaacagaccgtgctttcaaatatacactaaggagaaggttgagaaacatgaccaacagaaaattgcaaccatgttttactattaccaagtctttctactaatactgtatttttgatataatattattatttgcagttgcactaattanatatatgctttattatcttgttggtggcttttgatgcgac

SEQ ID NO: 7242 - DNA, 712 bp, Medicago truncatula
  Predicted polypeptide sequence is orthologous to G346
ttgcctgctactagctggctcttgtctctcaacaagtacacaaacgtgaaaagctgtgatggaggcccttggttctgtggacgacctcttggatttctcatctgacataggtgaggacgatgatgatgacaaacctaagaaagcctttccttcactcaaaccagaatgcagtgatccaccttcgctcaatccattggccctggatgatcccatcaattcactttctgaggaggttgcagaagaggagcttgaatggctgtccaacaaagatgcatttccggctgttgaaacatttgttgacttgtcctgtattcaaccggatcttttgaagcatcaaatgacatccccaatgctcgagaacagcacaagcagcagcaacagcaataacagttccaacagcattaccctcttaagtggctacaatcacatgaagttccctgtccgtgcacggagcaagtctcgtagcaagcctcgccttggccttgctgatgcctcaaacctgcaattcccatggaaacaaccgagtaccaaaacttccaaagagaaagtgaaacaaaccccaaccatcgggaggaaatgtcatcattgtggagttgatgatactccacaatggcgtgcaggtccaaatggcccaaagacgctttgtaatgcatgtgggggttaggtataagtctggccgacttgtacctgaataccgtcctgcaaatagccc

SEQ ID NO: 7243 - DNA, 842 bp, Medicago truncatula
  Predicted polypeptide sequence is orthologous to G347
tttcttttcctttatcccatatcaacgttttcttcttaaaataattattattatttatttttttttttaattattttctggtttgacttcgttgtctgaatcgcttgtcgcagaacacggtccaggtgccgcagctatgcagagccaacttgtgtgtaatggttgtaggaacacgttgctttaccctagaggtgcaaccaatgtttgttgtgcattgtgcaacacaattaccgctgttcctccacctgggatggatatgtctcaattatattgtggaggctgtaggacattgttaatgtacacacgcggagctacaagtgtcagatgttcttgttgtcatactgtaaaccttgctccagtatcaaatcaagtagcccatgtcccttgtgggaactgccggacaacacttatgtatccttatggagctccttcagtcaaatgtgctgtttgtcactatattactaatatcaatatgtccaatggaaggcttccaattcctggtcatagacctcatgggacaaccgactcgggaatgttaccttctacttcaacgtcaatgccccaatctcagagccaaacagtggtggtagaaaatccaatgtctgttgattcaagtgggaaattggtgagcaatgttgttgttggtgttacaacagataagaaataacgcagccatgatagaaggtacagtatatgacacattatcacagttgctgttaccagaagatattgcatgtgtatatgtatatcatattgcagcctccaatagtttcattcaaatgaatccttcctttttcgatgtaagggttagacagatatcagtatatgtatatgtatatgga

SEQ ID NO: 7244 - DNA, 876 bp, Medicago truncatula
  Predicted polypeptide sequence is orthologous to G351, G545
ctcatctcaaaaatttcaatacctatctctttctatcaatggctctagaagcacttaactcacccacttctactacccctaaattcaccttcgatgaaccaaatcttccatggactaaacgtaaacgttctaaacgttcacgttcatgcactgaagaagaatatctcgctctttgtctcatcatgcttgctcgtggccacaccaaccgccacgatttcaatcctttgaatccaccaccaacaaccattgacaacaacaacaacaacaccaaactcagttacaaatgttctgtttgtaataaagagttttcttcttatcaagcgctcggtggacacaaagcaagtcaccggaaaaactccgtcggtggcggtggtgatgatcatccatcaacttcctcagctgctaccacaagctcagccaacacaaacggtggtggtgttagatctcatgagtgttcgatttgtcataggtcgtttccgacaggacaagctttgggtggacacaaacgttgtcactatgaaggtgttgttggtggtggtgcttctgctgtaactgtctctgaaggtatgggatccacacatagtcatcaacgtgatttcgatctgaatatcccggcttttccggagtttgctaataaggttggagaagatgaagttgaaagtcctcatcctgttatgatgaagaagaaagctcgtgttttcgtggtgcccaagattgaaattccgaattttcagtgatgaattatttgagatgtagatttacttttagtgaaagattagtagacaagtttattttatttcttatttggaaaatttttaggattatatgattttgtataaagtttgggttgggggattcaaaaaaaaaaaaaaaaaa

SEQ ID NO: 7245 - DNA, 827 bp, Medicago truncatula
  Predicted polypeptide sequence is orthologous to G351, G545
taatcacttactctctcaaaatctccttttgcttctactttcacttgcgtaacgctaactaagtcttcttgagtgttcttttttcatcatctatggctatggaagcacttaactcaccaaccaccgctactcctttcacaccctttgaggaaccaaatctgagttatcttgaaacaccgtggacgaaaggtaaacgttcaaagcgttctcgtatggatcaatcttcatgcactgaagaagagtatctcgctctttgtctcatcatgcttgctcgcagcggaaacaacaacgacaacaagactgaatcggtgccggtgccggcgccgctaaccaccgttaaactcagtcacaaatgctcagtctgcaacaaagctttttcatcttatcaagccctaggtggacacaaagccagtcaccggaaagctgttatgtccgcaaccaccgttgaagatcagaccaccaccacttcatctgccgtgactaccagctctgcatccaacggtaagaacaagactcatgagtgttccatctgtcacaaatcctttcctactggacaggctttgggaggacacaagcgttgtcactacgaaggcagcgttggtgccggtgccggaagtagcgctgtaactgccgcctctgaaggagttggatcgtctcacagtcaccaccgtgattttgatcttaacctaccggcttttccggacttttcaaagaagtttttcgtggatgacgagggttctagtcctttacctgctgcaagaagccctgtcttttcagcttgaaatccttctcattactgatcaatatagatccatgttatggtatta

SEQ ID NO: 7246 - DNA, 770 bp, Medicago truncatula
  Predicted polypeptide sequence is orthologous to G351, G545
gaaacgatcaaaacgaccgcgtattggtattggtaacccacccactgaagaagaatatcttgctctctgtctcatcatgctctcacaaagcaacaaccaaattcaatcatcaccgttgaagctcaatcacaagtgcagtgtttgcaacaaagcttttccatcttatcaagcacttggtggtcacaaagccagccaccgcaaatcttcatcggaaaaccaatccacaaccgtcaacgagaccatctctgtttccgtctcaaccagtaagatgcatgagtgttccatttgtcacaagagttttcctaccggtcaagctcttggtggacacaaacgatgccactatgaaggagtcatcaacaacaaccataatcataataacagtaacagcagtggaattacagtctccgacgccggcgccgcgtcctcctccatcagccaccgtggatttgacctcaatttaccagcgcctctcactgaattctggtctccggttggattcggcggtggagattccaagaagaacaaggttaatgttaatctcgccggaatcaatgaacaagaggtagaaagtccgttgccggtaacagccaaaaggccacgtttattttctggtgaagacaatgatgaaacggtgtagtttactgatacaccgttatttgatggattgaatttgtttgcttattagttcattgaatatgaagaatcgcacatattcttctagctagctaggtttcttcatttcttggttttattttaaattggattagggt

SEQ ID NO: 7247 - DNA, 679 bp, Medicago truncatula
  misc_feature (627)..(627): n is a, c, g, or t
  Predicted polypeptide sequence is orthologous to G355
ggcacgaggaaaaactttcaagacactgcaaatttcatctcactcaaacactaaaacaaactttccttaatttttcaagtgatggcaatgaagagacaaaggagcaatgaaggcatagattatgcaaattgtttgatgctactatcttgtccacaacaaaaaagctatgaaaatggtgaatatgaatgcaaaacgtgcaacaaaaaattctcatcttttcaagcccttggtggccatagggctagccacaagagaatgaaactagctgaaggtgaagaactcaaagaacaagcaaaatctcttagtttgtggaacaaaccaaaaatgcatgagtgttctatttgtggtatgggattctctttgggtcaagcattaggaggacacatgagaaaacatagagctgttataaatgaaggggtttcttccatcaatcaaattattgaaaaatttccagttttgaagagattgaatagtaagaggattatggggctggacttgaatttgacacctctagagaatgatgacttgatgtttggaattaagtcaccaccaacaccaattccactttctttgttttgatcaactttacatttttaacattttcttgacacatgtattctttcaatnttttgtgccaaaattcgttgattcttattcttatagtcttacagataatata

SEQ ID NO: 7248 - DNA, 664 bp, Medicago truncatula
  misc_feature (586)..(586): n is a, c, g, or t
  Predicted polypeptide sequence is orthologous to G355
atctcatacattaatacccatgatgaaaagacaaagagaaaacgaagaaaaagagagcatagatttagcaacaactctaatgttactatcttctcgtataacccaacaaaacaaaacatattctccagttgagtttgagtgcaaaacttgcaaccgtaaattctcatcttttcaagccctaggtggtcacagggcaagtcacaagaagctgaaacttcttgattcagaagaagcacacaaagtgaatattcataataataagcccaaaatgcatcaatgttcaatttgtggacaagaattcaaacttggtcaagctttgggtggacacatgagaagacataggattaataatgaagggttttcatcttcttcaataaattatcaagtgatagcaaaatcttctcctgttttgaaaagatcgaatagcaagagagttatgatcatggaattggatttgaatttgacacctttagaaaatgacttgaagttgttgtttggaaacaaggcacctaaagttgacaattctttgttctgattttagtctcactaactttttgtacattataattctttcaattatatttgnttgtagtaacatttattgggttatgtattttaaaaaatatttatgatttattgcatttcatcggacttgtaattaaat

SEQ ID NO: 7249 - DNA, 547 bp, Medicago truncatula
  Predicted polypeptide sequence is orthologous to G361, G2826
caatcatctgctctcatcaccgggacaagttatgatgcctactgctcctccgtcgtgggtttacatgccaccacgtgctgcaccacctccttttcatgtctcagtttcacatggttgtgcttttccatcgcaaaacaacagtaacaatggtaatagttatagtattataacgggtgcaagatctgctagtgcaggtgtgttaccgtgtgttagtggtgtagggaattcttcacccacattgtcaactatgggctcacaaatacagagcctggcccagtttgggaaacttgatgggccatctttgagtaggttctcaaaaggagatgtggggcccaactttgatgaaggatttggtttagatttgcatcttagcctagctccaccgtgatcgatcaacttagttcagctcgactcttgttcaggaaatccattcaaaatggactcgattcaaaaattcatgcagtaaagaatctcgatcgttgatttaaggttaaatgatctagattgtactattaaattgatctggtcgattgatttagatccaata

SEQ ID NO: 7250 - DNA, 798 bp, Medicago truncatula
  Predicted polypeptide sequence is orthologous to G361, G362, G370, G1995, G2826, G2838
gtatataattgccaatggctatataccataaaataaatacaccataattaagaattgtatatattaatgtctgaacaatcattggtcagtaggggcaaagtcatgacaagccaactcaaatgaatagtgaaattttttcttctaatttccttttccttgatgtttgagaattgttcataatcaaacaatatcaaggaaaacaatgaaactattactttggatcctataccaaactacgaccttttcaaagagcttcttattgtatttgactgcaaattaagacctagttgaagatctaaagctttactatgactttggtttgaagaaggcttatcatcgttggagaaagtaaacatgcaagtatcttgttgggaaggagaaacatgagaaggaagagaataccaactagagttagtatcatgaacattttttgacttgaaactaatttgagattcttcactcaaagagaattcagaattataagaagaagggtcataaaaccaatgagtatgatcagaaccatggtaagaaaaaccatgatgatttttttgaaaaggttgcaagtaatagtttatgctagctttcctagcttgaagttgcaatctttttttcttcaatctttctttcttgtgtgcattttgatggcctcctaatgcttgtgaatttggcaattctttgaaaacatattgacactcaaattttctctcatcttggtctttagatgaatttttttctggacattttatctcctcagatgaattgagttagaggaatcacacttcatctcctcatagactc

SEQ ID NO: 7251 - DNA, 769 bp, Medicago truncatula
  Predicted polypeptide sequence is orthologous to G363
atgaacctattgatcattttatgactgtccatgaagggatttgaactcggtactgaagttacatagtcaagctcttaccacttgatcgaaccgacacctcataaaaatggtttacccctgtttgcatcatctctcaaatcttatagcttcagtgtaagatcaggagatgcagatgcttgaggtggaggaggtgccattggaacaaaactagaatttgaagtttgaggatatcctatattaacaactcctccttgatccacctgtctaaaacttccgggccaaaagctacctacatcatcatcttcaacgtaaactagcgatccaaaatggtttctatcaaatttcgcagcagctctcatatctggagctctcattgatgatgatggttgcatatgtctttgatgcattgcagaatgagcttcaacaccgagggaccgaaaaggcgaaccatgaagaggtagagaagcaaggcttgtatacctttcggtgaacattcccattcgcattgcacgtttagccatcgtcctctcccttttgtgagcgttctgatgaccacctaatgcttgcgagctatagaacttcctcttgcagtaattacaagagaatatccttggagttaccgatggcgaagcatgaacttcagcagctcctacttcgctactagcatcacttgaacccattaactcggcttcactcgaactgaaattgagtgtcaagtcaagggtcataggatctagatcttggggtgcttctgactgattttcaggtt

SEQ ID NO: 7252 - DNA, 834 bp, Medicago truncatula
  Predicted polypeptide sequence is orthologous to G363
agagtaattacaaacatgatttatatatatagtagacatacatagatgctctaaatttgtcttcctagagctcttatagaacaagaaaaatagagtaaaatatcaaagcatagatttgtaataatagcattaaccctttcaaagtttcaatgttaattcaggtgctgaattctcaatgtcaaccaatggtttcacattcacctcactaaaacacatatttgaactctgatgagtattactacctcccttagtaacctgatggaaactaccttgccacatcagttctgtctcatcgtcctccaagaatatcggatgaccgatagatccttgtttgaatcttacattgctttttatctcaggactaggccttattgttggcggcgaaaaaccatggtgtagtgaagagtgtgtctttatacctaatgccctgaaagaaccattgagaggcagagatgcaagacatgcatacctctcagtgaatagtccaattcgcatagctcgctttgctaatgttctttctctcttgtgtgcattttgatgaccaccaagtgcctgagagctgtaaaatttgcgccgacagtaattgcaagagaaaactctttggatggtaagttcattgctgctctcactggtgcttgagaatgagattcctgttgaatctcgaacaaccaagtcattgttgttgaaattgagtgttaagtccagtgagatggaatctgaattggaaaggctgttactataggaacccttgtagagtttcaatttggtgggtgggatatagtggaagcaacatggctacctacatcagattcatattcttctgtggcctctact

SEQ ID NO: 7253 - DNA, 743 bp, Medicago truncatula
  Predicted polypeptide sequence is orthologous to G374
ataaaagaatctttttttgtttttattatttgactttaaatttctgtcatgtttttcagggaactacaaggtttttatttactataattcctaacttcaggaagattttgctgtcggcttttgaatgtcctcattgtggtgagaggaataatgaagtgcaatttgctggtgaaattcaaccacgtggttgctgttactcgctaagtattcctgcaggcgaaccaaagatgctcgaccgacaagtggtaaaatcagagtctgctaccattaagatacccgaactcgattttgagattccaccagaggcacaacgtggtagtctgtcaacgcttgaagggatactaatgcgagctgctgaggaacttcaggcccttcaagaggaacgcagaaaagtggctccagagacagctgatgcaatagatcaattcttggcgaagttgcgagcctgtgcaacagcagagtcacccttcacgcttattcttgatgatcctgctggaaacagtttcattgaaaatctgtttgcaccatcacctgatccatcattgactatcaagtattatgagcgaactcctgagcaacaagcattactgggatatgtcgccgattctacacagaatgaaggtgctcatgctggagaaaaccgtgtcgccaggagagcagggggacatccacatggggtcagtcgggcagtagctggtcatcgagccattgcacagagtaatagtgtagcaatcgcagatgcc

SEQ ID NO: 7254 - DNA, 624 bp, Medicago truncatula
  Predicted polypeptide sequence is orthologous to G380
agacacccgccgtgtatcttgtaaacgaaaggcagttgaaggaaatggtggacaatcttcagacggtggaagttctagctatagccagcatacagttggcagtgcttggaatactcttcctactcaggattatgcagggagcaattttaaccaatctgcaccggcagaacaggtgaatgcaagacttggcctgagtgtcggggacggatcttctgaaaccatacctgggtcaactgttgcaggaagctcggaaagcttccacagaaattttcgtttgaggataaatccttcaagccaacaaatttctcttcctccagccacattctcacatgggagtgtgatcagaaactctagtgttccttcatctgctccaatgttgcaaaggtaccaccctatcaataatcctctggacttgaggtcagtacaaccagtaaatgtgatgcatcctcaaagcgaacctcttctggttcatgttcctgcgttaccgaggagtgcgcaatccatcaggtggagtggtggttctagctcaacaaacaaccattcgtcaaattcagttttaggcttagatagggatactcaaccacatgaggaagcaggctcaagagctatggctagaaacatttt

SEQ ID NO: 7255 - DNA, 769 bp, Medicago truncatula
  Predicted polypeptide sequence is orthologous to G384, G385
tctacaaacgagtgtgatttctttgattaaataagttaattctcaaaagaagggcttcttacaaacggtgaaacagtacaggattatgcctacccctacccgagcatatctgttccaacataaatcgtcaccatgttggaagggaggcagaatgcctctatgaagtttgacagggatttgagctataaccctacacagtctgagttagacttagaattagcaatgataatgtccctgtcttcacaagaggcagccacatatgctgctcaagcatttgctgaagtggaagcccttctagaggaagctgaagaggcaacagaggagaggaggctgatccaaacacttgaagggaggaatagtgtgataaagcttgctgatagaatggtcaaaatgttttgtgaatgcttaacaatgcctggtcaagtggaattgaaccatttaactcttgatagcattggtggggtttagagtctctcttcgcgataccaccgacaatgatacaagccagccaaatggcactgttgtaactgctgctaccactctttggctccctctgcctgctcagaaagtttttgaattgctcaaagatcctacaaaacgatcacagtgggatggtctttcttgtggaaatccatgcatgaaatcgcacacatttcaaatggaccctatcatggaaactgcattttcattattaagtcattcatccctactcagaggcaaatggttattctgcaggaaagtttcacatctccggtggggtcatatatta

SEQ ID NO: 7256 - DNA, 768 bp, Medicago truncatula
  Predicted polypeptide sequence is orthologous to G384, G385
ttggtgcaaaacgttggattgcaaccctagatcgacaatgtgaaagacttgctagtgccatggcaacaaacattcccacggtcgatgttggcgtgataacaaaccaagatgggagaaagagtatgttgaaactagctgaaagaatgtgtataagcttttgtgctggagtgagtgcctcaacagcacacacgtggacaacactttcgggtacaggagctgatgatgtaagggtcatgacccgtaagagtgtagatgacccaggaagaccagctggcattgttctaagtgctgcaacttctttttggcttccagtgccaccaaaaagagtttttgaatttcttagagatgaaaactcaagaagtgagtgggatatcctttccaatggtggagttgtccaagaaatggcacatattgctaatggaagagatactggaaattgtgtttctctacttcgagtgaatagtgcaaattcaagccaaagcaacatgttgatattgcaagagagttgtacggatacaacagggtcatttgtgatatatgcacctgtagacatagttgcaatgaatgtggttctaaatggaggggatccagattatgtagcacttcttccatctggatttgctatactaccagatgggacaaccacaaatggaggaaaggtgttggtgaaactggacatgggtggtggatctctattgactgttgcatttcaaatattggtcgattccgttccaacggcaaaactttctcttggatctgttgctacgg

SEQ ID NO: 7257 - DNA, 684 bp, Medicago truncatula
  Predicted polypeptide sequence is orthologous to G386, G707
aattatgataaaattgtgtcatattccactattcctttcattgatgttttttcaactaggggaaacaaacaagagtcaatacccgaaccacgatccttgccttgtgttaaggaacctaaccctaaaaagatagatatccttaccaccatgcaaggaacctttttctttttccatgagtggttcgttcttgactcaaacacaccccaaatcccaccaattacatttttacccttttctttcatccattaccaaaacaacaacaacaaaaacaatagcaatagtagtagatatagaaaaacaaaaaatttaagaaaaaccacttaagtcacgtgactcagctttcacattgaagtgctgctttgattttctgaacagtgcatgaaatgagattgttcactgtttcaactgactccacggtgagttttgctgtaggaagactattcacaaggatttgaaacgccaccgttaaaagggacccacttacacgcgcctcgccacctccatttgcggtcgcatcgccattctctagtccacgtgacccaggaccatcagggacgatggcaaagccggagggtagtaatgcaacataagctgaatcgccaccattcatgacaacatgcatagctggaatatcgaccggcgcatagacaacaagcgaccccgcttcggcaatacatgtttctt

SEQ ID NO: 7258 - DNA, 801 bp, Medicago truncatula
  Predicted polypeptide sequence is orthologous to G390, G391, G438
cgttgctgggaaatgatggtgttgaagtgtaaccttgctgtgaactctctccaacaagtttttggggtccaattattcatccatgtttccaacatttggaggtggtgtcttgtgtgccaaggcatcaatgatgctgtgaatggatttgtcgatgatggtagttcgtatagaggggcatgcattctccccagaagatgttgcactggcacgtgatatgtatcttttgcagctttgcagtggaattgatgaaaattcagttggcgcatgtgctcaacttgtgtttgcgcctatagatgaatcctttgcagatgatgccctcttactgccttctggttttcgagttattcccttggatcctaaatcagatggtccaaccacgtcaagaactttggatttacttgaaggatctaggaatgctcgtccatctggtgaaggtgctggttcaaatggatacaaccttaggtctgtccttacaattgcattccaatttacctttgagaatcatttgcgcgacaacgtggcttctatggctcgccagtatgtgcgtagcgttgtggcatcagttcaaagagttgccatggcaattgcgccctctcggccaggtactcagctagggccaaagtctcttcctggttcgccagaagctcatgctttagcacgatggatatctagaagctacaggatgcacactggtgccgagctttttagagtcgagtccgcagcgagtgatgcaatactgaaacaactttggcaccattctgatgcaattatgtgctggtctgtgaaaacaaatgcatctcc

SEQ ID NO: 7259 - DNA, 647 bp, Medicago truncatula
  Predicted polypeptide sequence is orthologous to G390, G391, G438
gatctttgcgatttcacaaagttgtagtggagtggcagctcgagcttgcggtcttgttagtttagaacccacaaagattgcagagatccttaaagatcgtttatcttggtttcgcgagtgtcggaacctagaagttttcacaatgtttcctgccggaaatgggggaaccattgagcttatttacacacagacatatgctccaacgacgctagctcctgcccgggatttctggactcttcgatacactacaactttggacaatggcagtcttgtggtttgtgagaggtccctgtctggttctggcactggccctaatccaactgctgctgctcagtttgtaagagccgaaatgctcccgagtggctacttgattcgaccatgtgatggtggaggttcaatcatccacattgtagaccacttaaatcttgaaccgtggagtgtgccagaagtactacggccactttatgaatcaccaaaggtggtggctcaaaaaatgaccattgcagcacttcgatatattaggcaaatagctcaggaatcgagtggtgaagtggtatacggattaggtagacagcctgctgttttgcgaacatttcagccaaagattgagcagaggcttcaatgacgctgtaaatggattcagtgaa

SEQ ID NO: 7260 - DNA, 535 bp, Medicago truncatula
  Predicted polypeptide sequence is orthologous to G390, G391, G438
ggactagacatgcttgaaactactctagttgctcttcaagatattatgcttgataaagttcttgatgaagctggcaggaagattctttgctctgagttctctaagattatgcaacagggttatgcatctctgccaggagggatttgtgtatcaagcatgaataggccagtgtcttatgagcaagccattgcatggaaagttcttaatgatgatgatgccaatcactgcttagctttcatgttcatcaactggtcctttgtctgatggagaaaccataatcaagaaacctaactttatatctatatctatatctatattatattatattatattatatgaagatatatattaagttattttcagttcttcaactacctgatactatttaaagacagttgtactaattttcagctttgttttatgcgccttttgaactattctaatgctcctctatgactatatatgaatatcctttaaatatttaaaatgcagttttatgtttgagtataaaaaaaaaaaaaaaactggagggggc

SEQ ID NO: 7261 - DNA, 426 bp, Medicago truncatula
  Predicted polypeptide sequence is orthologous to G390, G391, G438
gacctgacatctgcccttgatattggtcccgctggaaacaaagctgctaatgattgttctggaaattctggctgtatgagatcagtgatgacaatagcatttgaatttgcttttgaaagtcatatgcaagaccatgtagcatctatggcacggcagtatgttcgcagcattatatcgtctgtccaaagggtagcattggcactttcaccttctaatttgaattcacaaggtgggctcaggacaccactgggtactcctgaagctcaaacacttgctcgttggatcagcaacagttataggtgcttcttgggtgctgagctacttaaatctaataatgaggggagcgaatcattactcaagtccttgtggcatcacactgatgcaatactctgctgcactctaaaggcattgcccgtgttcactttt

SEQ ID NO: 7262 - DNA, 483 bp, Medicago truncatula
  Predicted polypeptide sequence is orthologous to G390, G391, G438
tttatttgaatcgacccatcatttattccacttccatcaggtttgtcattgaatggcatttgtgggcatacattcttctcattggaacgctgaaaaaataactagaaacattttcaaacttaattgtgctttctattgatttctcttcgttcttatttggcagggttttgcatgccttcaaggtggtctttgtctctcaagcatggggagacctatttcatatgaaagagtagtggcttggaaggtgctgaatgaagaagagaatgctcattgtatttgctttatgtttgtgaactggtcttttgtttgacattgtttttagacaataggactccaagtggtgttaaagaggaagcactcttattaagacatgttcttttgcttgctattttgctatattcgctgcaaaaacttggattgcatgtaaaaactacttatatattagcctatgttacatttcccttaaaaaaaaaaaaaaaaaaa

SEQ ID NO: 7263 - DNA, 921 bp, Medicago truncatula
  Predicted polypeptide sequence is orthologous to G394
tcaagattctcttcaccttgttctaggtttatctttgaacacttctactactccaaaggaaataactaccaccacccccatgaatccctattccacctccaacgagccatccttaacgttaggactctctggtgagagttataaccttataagtcacaaacaagctaccaaaggttatggtgaggaactttgtagacaaacttcatcacctcatagtgttgttaattcatctttctcaagtgggagagtactgcaagtgaagagggagagagatgaagaagaagaagaagtagaagaagagagggtttcttcaagagttagtgatgaagatgaagatgctacaaatgctagaaagaaattgaggcttaccaaagaacaatcactattgcttgaagaaagcttcaaactacacagcactctcaatcctaaacaaaaacaagctttagcgagacagttgaatctaaggccacgacaagttgaagtatggttccagaatcggagagccagaacaaagctgaaacaaacagaggtggattgcgagttcttgaaaaaatgttgtgaaacattaacagacgaaaacaggaggctcaaaaaggagttacaagagctgaagtcattgaaagtagcacaacctttgtacatgcctatgcctgcagccaccctctccatctgcccgtcttgcgaaagactcggccgcgtcgccgacggtggtggtggttccaataagatcactgccttcactatggctccaaatactcatttctacaatcctttcaacaatccttctgcagcatgttaaacaaaaaaagaacaaatatgtcgagtatagtacgtatttcccacaaccattgtatttttttggttgagggatatatacgttttgctaagctagggaaacgtacgttgtaattagtttagcta

SEQ ID NO: 7264 - DNA, 742 bp, Medicago truncatula
  Predicted polypeptide sequence is orthologous to G394
atctctctctcttgagttatcttgatgggtcttaataatcaagatgctagtaacaactcaggccttcaacttattctaggcttagctcttactcttaccaaacaagacacaccaccatccaacaacaacgttacaaagccttattcctcaagtaatcataacaactatgaagctgaaccatctttaacgttgggtttatccactaagagttactatgaagaacctcttgatttttctacacaaacaaattcacctcatcacagcgttgtttcctctttttcaagtgggagggtgaagagagaaagagatgttagcagtgaattagaaatggaaacaacggagatggagagagtttcttcgagaatcagcgatgaagatgaagacggtgccactgcagctaggaagaagcttaggctcaccaaagatcaatctgctatgcttgaagaaagcttcaaagaacacagcactctcaatcctaaacagaagcaagctttagccagagagttaaatctaacacctcgacaagtcgaggtctggttccagaaccgtagagccagaacaaagctgagcaaacagaagtggattgtgagttcctaaagaaatgttgtgaaacattaacagaagagaataggaggctacaaaaggaggtgcaagaattgaaggcactgaaactagtaaaacccttgtatatgcctatgccagcagctacccttactatgtgcccttcatgtgagagactagg

SEQ ID NO: 7265 - DNA, 942 bp, Medicago truncatula
  Predicted polypeptide sequence is orthologous to G409
tctcacacacacacacacactcatcacaaaacctcgccggaaaactccctttccggccaccagcgttctccttcctccggtaaacccttcagttcaaaactgaatcccttcaaagaccaccggaatcggtggtttttatcttacagtgcatgatgggatcttgcatatgtccgttagaaactccagcaaggttgctttggacaacaagtttcttccgtcataagttaatgatcttttaatccacaaaccatcatagaaatatttctataaaaaaaaataccaagtttggaatttgaaagaaaaaatatatatatatatcattttttgtttctgattctgaaagattaatagtattaagagaacaaatttagcacaacctttaacgtgaagttttgaagtttgaagttgaaaaaatggagtctggtcgtctttactttgattcttctgcttgtcgtgggaataacatgaacatgctgtttcttggaaatgctgatcttggttttcgaggaaggtcaatgatgagcatggaggaaggctcaaagaggagacctttctttagctcacctgatgaactgtatgatgaggagtactacgaggagcagtcaccggagaagaagcgccgcctcacttccgagcaggtccatatgttggagaagagctttgaggaagagaacaaacttgagccagagaggaaaacccagttggccaagaaactaggattgcaacctaggcaggtggctgtatggtttcagaaccgtagggctagatggaagacaaaacaacttgaaagagattatgatgttcttaagtcttcctatgattccctactttcaacatatgattccattaataaggagaatgagaaactcaaatctgaggtatttaactacatatgtactgtataatcaaatatgtgcatttatagtagttatgattaaaatc

SEQ ID NO: 7266 - DNA, 852 bp, Medicago truncatula
  Predicted polypeptide sequence is orthologous to G409
tcgtgcaggtggaagactattcagcttgagaaggattatgattctcttaatgatggttatgagtctcttaagacagagtatgacaaccttctcaaagagaaagataggttacaatctgaggtggcaagcctaactgaaaaggtacttgaaagagagaaacaagagggaaaattcaaacaaggtgaaagtgaaacaaaggaattcttgaaggaaccaacaattaataagcctttggttgattcagtttctgagggtgaaggatccaaattgtcaattgttgaggcttctaataataataataataataacaaacttgaagatattagttcagcaaggagtgacatattggattgtgaaagtccacgctacactgatggagtgttagagacatgtgattcttcctatgtatttgaacctgaatatcaatcggacctatcacaagatgaagaagatcacaatttattgcctccttacatctttacaaaacttgaagatgtgaattactccgacccgccacataattcaacaagttatggatttcaagaggaagatcatcatcaagctctttggccttggtcttattagatatgatatgatatgatgcatttatctttctttctttgtaatatgcatgtatcttttcattgtgtttattagtatttaccctttttgtgcaaagtgagtgagtactgtactaagttgtgtgcgtaataaagttagagcaatggcaagttgaaaacatttcatttcatacccgaaatgggtgtggctcttgtaagatagaaatggcggcttttataccccattttgttgcattgtaaattaatgaacttttggatctaatcaacattt

SEQ ID NO: 7267 - DNA, 735 bp, Medicago truncatula
  Predicted polypeptide sequence is orthologous to G409
gtttacttctctctctttcacaaaacaaaatatttctaactctcaactctccccaaccccctctctaccctcttctctctgaccttctgcccatctttgaaaactcacaagtaaacactcaaccttctctgccctccaattaattacttctgacacccccctttaatatttctcccagtaatgggtatgatctctcctcactcccacaattcccacattatagtaatcctcaacacctgcttctttcgtcataaattctagatcaaattcaaccctttgaaaatcaacatattttttttttacttcttatggggtatgtatgattgtgaccctttaatctaaaactctcttgtaaggctccacacataccaacctacccaaaagttctttccctataaggctgttcttatggcaggtggcaagctttttggtggttctaatatgtcacttttgcttcaaaatgaaagactcccttgtacttctgaagtccttgaatctctttgggttcacacccctgcttcttttcaaggttcaaattcagtggttaattttgagaatggtggtggtagcaacagagtggtaacagatagacccttctttcaacaacttgagaaagaagagaattgtggtgatgaagattatgaagcatgctaccatcaacaaggaaagaaaaggaggctttcaagtgaacaagttcaatttcttgaaaagagttttgaggtagaaacaagcttg

SEQ ID NO: 7268 - DNA, 832 bp, Medicago truncatula
  Predicted polypeptide sequence is orthologous to G419
gttgttaagaaagagagagagagagagagaaatataaagaaaaaaaaaagagtatatgatagcatggaggtcatcatcaataccctctctagctagctatctcatcttctatttctgagcaactatatctcatctttcttccacactcatgctcccctcataatataaattaattcacttaatttatatttgaaactatagctagatatattgaagtttgaaaatttttattcatggctagacaactttgtcatgaagatgacaaaacatcaagtggtggattttgttacaacccaacgattcaaacacaaatccaaggttttgtgtccgatccagagatgttcaatctcacaacagggatggagatgataggtttttccaaacaacatcttcaacaacatagtactgacacaacaaactctgtcatgtggaaaacaaatttctcaggaaaactaagtcaacaacatgttggtccttcctcttcttcaaaaaccatgaatgataatttctatcatcatcaagatttcactgtttctgatacaacaagtagtgatcagaatctaaacaacatggttcatcatgattcatcttcacatcatcagtggcaacaagttgatgattcatctttaagatgtgttttcccttgtgaaggtaatgaaagaccaagtcaaggactttcactctctcttagttcaacaaacccttccctctattggtttacaatcttttgaactaagacatactactaatcatcatttgcaagatcaagggtatcaaggtcattttcttctcaaaaactctaagttcttacttccagcacagaaacttctca

SEQ ID NO: 7269 - DNA, 734 bp, Medicago truncatula
  Predicted polypeptide sequence is orthologous to G419
tataatattttattattgtaaatttattaattgaaagtttttaaggtgacacatgttatttaattattaattaattgaaaagcaggtatcaaattggtttattaatgcaagagtgagactatggaagccaatggtggaagaaatgtatttggaagaagagaaagagcaacaaagaaacacgacaacctcggacggaggaaacaatattaatcatgaagaggataatcttaatgtacttcaaaaccaatctcaaactcaacctcacgaggatcaaaagccacgactccttcgaatcgattctgaatgtgtctcgtctatcatcaacaatgatcataaaaatgatgctaataataagaatttgaatcatcatcaattagccgcggatgcgtttggctcggttgatattgatttttcatcttataatacgcatcattcttcttctgacatggttgctgcttacacaagtggtgagagtttccaccaaggtggcagcagtggtggagtgtcattgacgttagggttacaacaacatggtggaaatggagttagtttggctttcccaccaacatcacagagtccaatgttctataccagggaccaaattgaagaaccggttcagtactctcttttggatggtgaaggaacaaatattatgccatacaggaatctcatggggacacaatgctacatgactgggcatatacatggccaaggtgggtgaataaatgtataaa

SEQ ID NO: 7270 - DNA, 804 bp, Medicago truncatula
  Predicted polypeptide sequence is orthologous to G427
tttctttctctttattatccacacccaacttttccttcaccatgaatcaatagatatatttatatatatatattatggcgtatcacaaccaagacaacccactccaccatttcacagaacaacaacaaccaacctccgatcctcaccactctttccaaactgcacctaactggctcaacaacgcccttcttcgcaacctcgacaccaacgtcaacgccactgccaccaacaacaacaacggttcccaatcctccggtcaatggctctctcgtcctatcctccaccgaaaccatagcgaagtcatcgacgacgtcaccggcgccggcatgaaggcggaggaaagcggcgaggcaacggcggagggagtgatgaactggcagaaagcgaaacacaaaggtgaaataatggcgcacccgttgtatgaacagcttctatcagcacacgtgtcgtgtttaagaatcgccacgccggttgaccagttgcccaggatcgatgctcagctggcagagtcgcagaatgttgttgccaagtactctgccttaggacaacagggcatgcttgataacgatgataataaacaactcgaccacttcatgtcgcactatgttttgttgctttgttcgttcaaagacagctccaacaacatgtccgagtccatgcaatggaagcagtaatggcttgttgggagatcgaacagtccttacaaagtctaacaggagtttcaccgggggaaggtacaggagcaacaatgtctgaagatgaagatgagccagtagaccgtgatgttaatctgttttgatggaa

SEQ ID NO: 7271 - DNA, 697 bp, Medicago truncatula
  Predicted polypeptide sequence is orthologous to G427
gagatattgagttgacagaaacagctttatctcttttaacccttttcctgacctctctctcgcttccatctcctttaatagtaatgatttcataccttacacactttctctcttctttgttttaaaataaataaatgcttttgattctccctctttctctgcgcatgtaaaatctttgtttctatcagaagtggctcagaaagctttgtctcagatccctataatacatactattacacaaacacaaacaccgataataataacaatacatcaatccatatagatagatagatagagtggtcctcaacctcatcacttttttctcctttaattaatactaacaacaactttacttcagaaatgcaagaaccaagcttagggatgatgcagggtagtggtggtggttacggcggagatggtggcggtgagaacagacaactgaaggcggagatagcaacacatcctttgtatgaacagcttctgtctgcacatgtagcatgtcttcgagttgctactcctatagatcagttaccattgattgatgctcagttatctcaatctcatcatcttctacgatcttatatctctcaacaaactcattctctttcgcctcatgatcgtcaacaactcgacaacttcctcgcacaatatttgatagttttgtgtacattcaaagaacaacttcagcaacatgtca

SEQ ID NO: 7272 - DNA, 798 bp, Medicago truncatula
  Predicted polypeptide sequence is orthologous to G427
gtcctcaaaattccctcttatcttcttaaccctgcttaatttgtgtttggacatcactaaaaaataaatggcttttcacgagcatcttcaacaagaaatagctttccagcgtttcacagaagaggaagatgaagaaagagcatcgtggctcaacaacaacaacaacaacgcacgtcaacagaatttcatgcaaatggaaccagaaagaagggaaaaaagcatggatcggaaccaccggaatgacaacaattgcgaaacggaagaattaagagaatacaaagcagagatactaggacatccactctatgatcaattattatctgctcatgtttcttgtctcagaattgcaacaccggttgatcagcttccaaggattgatgctcagcttcaacaggcacaacgtgttcttcaaaaatattcttctgttggaattggaaatatggatcccaaggagcttgatcactttatgacacattatgttcttttgctgtgtgccttcaaagaacagttgcaacaaccatgtccgtgttcatgccatggaggcagtaatggcttgttgggatcttgagcagtctctgcaaagcttgacaggtgtatcttcgggtgaaggaacaggagcaacattgtcagacgatgaagacgagcaggcagagagtaacgctaggttatacaacgaaggaagtagccttgacggtgttgatacccttggctttggtcctcttgtcccacagagactgaaagggtcttgatggaacgagttaggcttgagttgaacatgagctgaaacaggttacaggg

SEQ ID NO: 7273 - DNA, 811 bp, Medicago truncatula
  Predicted polypeptide sequence is orthologous to G427
cgacgatgttaccaacaacgttaacaacgacagtgacggtaacggagcttctaattttctaaaccttcaacaaacttccgacacagtgcaaaccaccggtcaatggcttgcacggtcgattctccaccgtcaacatggtgaagtaatcgataacgtcaccatggccagcgaagtagaacacgaattagctaatatgaaaaacgacggtgatagtgacggacttggaggaaagagtgaggtggcggttgttggagatggaggactggtgaactggcagatggggaggtggaaggcggagattatggcacatccgttgtatgaacagttgttgtcggcacatgtggcgtgtttgaggatagcaacgccggtggatcagttaccgaggattgatgcacagttagcacagtctcagaatgtggtggccaaatactctgcttttggacagaacatcggtgctggagtagatgacaaagaacttgaccatttcatgtcacactatgttttattgctgtgttccttcaaagaacaattgcaacaacatgttcgtgtccatgcaatggaagctgtaatggcttgttgggagatagagcaatccttacaaagcctaacaggagtttcacccggagaaggtacaggggcaacaatgtctgacgatgaagatgaacaagtagacagtgacgcaaatctatttgatggtagttttgatggcggtgcagataacatgggatttggccctcttataccaacggagaatgaaaggtccctaatggagcgcgtaagacaagagcttagcatgaattgaaacatggtt

SEQ ID NO: 7274 - DNA, 785 bp, Medicago truncatula
  Predicted polypeptide sequence is orthologous to G427
aacaaaactagcttcctctgtaatataaccagtacatatcatttcttagcaatggttggtataaacataaatttcgatttaacattcatattccacaacacgagtttcatgtttttcactataattaagttcttgccctatcaaatgtcccaccatatactgttgcatagaatgaaaattttggatagattttttcttttccatctttgtttccttgttcaaaacaggggccgaatcatatgaaactctggttacttgtttcacctgcgccactactcttgcgtttggttttggagccagtggaagacgaaggattagtatgccaattcctttttctttgattaatgaaccagttatttatttgctttaattgaagtcctgtttcctggaccaacctagccttgtcttcttcagtaggataaggccatttagagtgtgattgccaccaagctttcaaaagggaggtggtgtcacccgggagctttcccgctcttctcttccgtagaatttcttctcttatgtccacaatcttactcttgtaaccctgttttagctcgtgcttcaactcctgtctcacacgttccattaaagatctttcactttcagtaggaacaagaggaccaaagctgagactatcaccaccatcaaggcttccttcatataagtttgcattgctctctgcttggtcatcttcatcgtccgacattgttgcaccactcccttcaccaggagatacaccggtcaagctttgtagagactgctccagctcccaacaagccataaca

SEQ ID NO: 7275 - DNA, 1161 bp, Medicago truncatula
  Predicted polypeptide sequence is orthologous to G431
attcattcaatggagggtagttctaatggaagttgttcttatgttatgggtgcttttggagaaaacagtggtgggctatgtcctccaatgatgatgatgcctttagtcacttcatctcatcataatgctcatcatccaataaattccaataacaacaacaacaacaacaacaacaatactaatgcaaacaacacaaccggtcttttccttcctatccctaattccactaacaataataacaatcactacaccaactgtaataacaacacctcttctatcatgcttcaaaataaccatcaaaacactcctggtttaggttactatttcatggacaacatcaacaaccatggaagctcttcttcctcttcttcttcttctgtcaaatccaagatcatggctcatcctcactatcaccgtctcttggaagcctacatcaactgtcaaaaggttggagcaccaagtgaagtggtggcaaggttagaagaagcatgtgcaactgcagtgagaatgggtggagatgcagttggatcaggttgtttaggtgaagatccagctctagatcagttcatggaagcttactgtgagatgcttatcaagtatgagcaagaactttccaaacccttaaaggaagctatgctttttcttcaaaggattgaagtccagttcaaaaatcttacagtttcttcatcttcagataatattgcttgtagtgaaggtggagataggaatggatcatctgaagaagatcatgttgatctatacaacaacatgatagatcctcaagcagaagacagggaattaaagggtcagcttttgagaaaatacagtggatacttaggcagtctgaagcaagagtttatgaagaaaaggaaaaaaggaaagcttccaaaagaagcaaggcagcaattgcttgaatggtggagcagacattacaaatggccttacccatctgaatcacagaagctggctctagcagaatcaacaggtcttgatcagaagcaaataaacaactggtttattaatcaaaggaaacggcactggaagccttcagaggacatgcagtttgtggtgatggatccaagtcatccacactattacatggataatgttctcaccaattcatatcccatggatctatctaacaccatgctctagaaattc

SEQ ID NO: 7276 - DNA, 707 bp, Medicago truncatula
  Predicted polypeptide sequence is orthologous to G440, G864, G1421, G1750
caacctccgtcgtcacgcgccgccacagcaatttccgcggggtaagacaacggccttggggaaaatgggctgcggagatccgtgacccgatccgaagaaaacgtctatggctgggaactttttctacggcggaggaagccgccgctgagtacgacagagtggcagtgatgttgcatggttcaaacgcggttacaaactacccaataactcaggtggaggttaaaacggagatcgaaaaggattttgaagtgacgccgccggtgagcagcggaaacagcgacagaggtggttactccgacgctttgtcgtcgccaacgtctgtattaccctacgactgtgattcgacgccgtttgacggtttccgttacgtagacgtggacgcttttgggtttcacatcgacgcgccgttaagtttaccagaagttaacgttccgctgacatgtcatcagaagttggaaaaagaagagaagtttgaagagtttgatcttgacgagtttatgacgtggccgtattgaaaaatcttgagggcttatttgtctttttgagaaaagaaaagggactgtttggtaattatgctgttttgttgctggttgtgtaattccgaagatgccctcagttgaagttttgttgtgcttattggaagagtgtagagtttcgtgccgaaaaagaaactatatttgtgtgtatttaatttggaaataaattta

SEQ ID NO: 7277 - DNA, 810 bp, Medicago truncatula
  Predicted polypeptide sequence is orthologous to G440, G864, G1421, G1750
taacttaggacaaaaatatcttcatagtgttggagaaagataatcttatcttacttactctagtgctctacactcttggtcacaagggtaatttaggaattccatcaagtacaaacagaacacgacaaaaacctcaatattaacgacaaagaccaatatacccttagggtttaacttggccatgtcaagaactcgtccaagtcaaactcaccaaactcttctttttctttctcgaacggaacaaagttaacatccgttaaatttaacggcgcgtcaatatcaaagccaaacgcatccacagctccgtaacgtaaaccgtcaaacggcgtttcgccgtcgcagaaaggtagaacggatgtcggagaagcaaaaccgtcgccggagaaaatctcaggcgaacctttaacgcttttcttgtcggaggcatcgtttggaaagttgacggcggcgacttttggaccatagatcttcgcagcggcggcgtcgtaaacagcggcggcttccttctctgtgttgaaagttccgagccagagacgttttctttgaaacgggtcacggatctctgatatccaccgacccgaaggtcttttgcgaacaccacggaatatgctccggcggttagaaccgccggagttttttgtgggtcgttttctgggtttatttaaatgggtcgggttaatggagcaagatgaagaagaaggtgaagttgcttgagaatcagtgagagaaaggaattgcatggtgatgttagtgatttccttcttcactcttcgtggggtttcatcgtcgccggaggatctgaaatcggtg

SEQ ID NO: 7278 - DNA, 576 bp, Medicago truncatula
  misc_feature (546)..(546): n is a, c, g, or t
  Predicted polypeptide sequence is orthologous to G447
ggcacgaggcaacaaatgagcttggaaggggacttaggttataatattccaatcaccaatcaagcttgtagtggatcagaaagtggcaatgcatggagagcacagtatgatgataactctgcagcttcatttaatcgataagcgcatcgagtattcacattcttcggcattcaacttgtacacatttagggagatggttaaatctaacttaacccttgaaaatttcttcttcttgcttctttctatagaagttagaaatattcattgcaaaagatgcagttcatagttcatacataactgcatccgggttcgcgtccgcacactgcttttaatggtgagaaaaaagcttagatctttagatgttccaagaacagattcctttactacaaaatgttacttcctactttagaacatgctttcttgtagcagctagtgcttgattaggatttcctttactcattttttttccctctttttggaaagtttcagctgcatgagtcagctggtgtataatttattaagatgtatgattaacaatcagtctanaagaatatatattatttacaccattgtaaa

SEQ ID NO: 7279 - DNA, 666 bp, Medicago truncatula
  Predicted polypeptide sequence is orthologous to G447
ggcacgagggtcacacacaactctagggcaataactccccgtcaagtgtttgaaattcctcatacgcttcaaaactcactgctcgaggctaattctatgaaccatcagatgacagatcatagtagccagaacaatgttcagttctcccatccagccaagcaacaaaagcttcaacatcaacaacagcaaacacaacccggctcactgtctaaaatgtctagtcatgttggacttccttctgcaactactgctaatcagttatctgcttccggttgcagtatacggactgtagcaactgggacagtgccatcggtaaatactgatcatgctccatcttgttctacttcgccttccacaaataactgtgttggtgcgcttcctccagtgaccacatcccagatccttatgagcacaataggggatgacgttgctcagtctgctgtgaccatcttgagtcaaagttctaatgcaaatgtggtaaaatatgcacagccaaattatgatgttaagccttgtttaaacatttccgaaaatcacaacccagtgaatttttaccctcagacttgcttgaatggtgctgctatccagacagattgtttggatacgtcgtcttctacaacttcagtttgcctttctcagagtgattcacgctttcatcagactgac

SEQ ID NO: 7280 - DNA, 524 bp, Medicago truncatula
  Predicted polypeptide sequence is orthologous to G447
tagctgatattggtgtgttaacacttaagttggatgatttagaacgtggtcttaaatattataatgataatgttttgaaatcaggccagaaagatattgaaattgttccaatgtttgaagttgatgatcctgtggttattgaatggcgtgcaatgactgttgtgctactcgatgtaattgcggaaaagattcgagagaaccttggtctgaataaagaacaattaagtttagcgcaagttcttgaggcaggaacttggaaggccggaagagagatcgcaaaatctttacgcccgattactcgtggtccaccaatcgcaatcaaatccgatggaacggttttttagagaatattggtttacattgttgtcttattattagttgtaaattataaatgtctagtatagaggtgaattttctgtagattatatttacataggttttttatttatatatttattgaaatttgcattttataataaaattaatttaaatgatttgatgctgtaaaaaaaaaaaaaaaaaaa

SEQ ID NO: 7281 - DNA, 690 bp, Medicago truncatula
  Predicted polypeptide sequence is orthologous to G447
gccccttctgcttttacagatggagatgccccatcatgctcaacttcgccgtctactaataactgtcagacatcacctccaaaccctctgaaaagaaatcaaccagacacatttggcgggccttcaatggttgaaaccacgaataatctgatgcaggagcttcaaagtaagtctgatatgcagagcaaacatgaattacacggcgttaaaggacccgacaagcaaaagcacaaaggtgcaatcaatgatcatatggaagcttcttccggaacatcgtatggtattgatcctggtaacatccaccagaacttcccactttctaacttctacatggatggtgatgtacactcgcaacaaccaagaagtaatataccatttgcttctaaccttgatggattaacacctgatcctttgctctcaagagggtatgattctcaaaaagatcttcaaaacttgttatctaattatggcggtgctcctagagacattgaaaccgagctgtccactgctgatattagttcacagtcgtttggtgtaccaaacatgtctttcaagccaggatgctcaaatgaaattcctattgccgataccggagttttgaataatgggctatggtctaaccaaaatcaacgaatgcgaacatatactaaggttcaaaaatgtgggctcagtcggaagatgtatttgatg

SEQ ID NO: 7282 - DNA, 776 bp, Medicago truncatula
  Predicted polypeptide sequence is orthologous to G450, G456
caaatcacactgaatgcttagagagagaaagaaaaatttagagagagaaaaaacttgataatggaagttgttgcagggatgaaaaaggaggaaaagatggtgtttgatgaaactgaactgaggttaggacttggattgccagggaaaacaacagaagtagtaaggaagagaggtttttctgaaactgagagtgaaagtgaaacaaacactgtggatttgaagcttaatctttctactaaggaaggagcaacagatccacaatttaagccaaaggagaaggctcttctgctctctgattctggtgccaagcctcctgctaaggcacaagtggtagggtggccaccagtgcggtcattccgtaagaacatgtttgctgcccaaaagagcaatgaaggatcagaagaaagtgaaaagaagaatagcaataataatccaataagctttgtgaaagttagcatggatggagcaccttacctccgtaaagtagacctcaagatgtacaagagttacccagagctctctgatgccttggccaaaatgtttaactcctttaccacaggaaattgtgaatcccaaggcattaaggatttcatgaatgagagtaataagttgatggatctattgaacagctccgactatgtcccaacttatgaaagacaagatggcgactggatgcttgtcggtgatgtaccatgggagatgtttattgattcatgccagcgtctacgtatcatgaaaggaaagggaagccattggactcgcaccaagagccatgg

SEQ ID NO: 7283 - DNA, 640 bp, Medicago truncatula
  misc_feature (616)..(616): n is a, c, g, or t
  Predicted polypeptide sequence is orthologous to G450, G456
tgaattgttagagagagaaaaagtgttatatataattaagagagtgaaaaactcatcatggaagttgttggtatgaagaaggagaatatgggatttgaggaaactgagttgagacttggaattggatttcttggaaataatggatcagccacagctactgaaggagttgtaaggaagagaggattttctgagactgaaactgatgatgatacaactactatggatttgatgcttaatctttcctctaaggaagctactgctgaggtagatccaagtgatataaccaccaagactttgcaaaaggagaagacccttttgcctgcagatcctgccaagcctcctgcaaaggctcaagtggtgggttggccacctgtccggtcgtaccggaagaacatgttagcaatgcaaaagagtgaaagttgagaagaacagcagttccaatttcaatgcaattacatttgttgaaagttagtatggatggagctccttaccttcgtaaggttgacttgaagatgttcacaagttactcccagctttctgattccttaggcaaaatttcagctccttcaccattggcaactgttgaatctcaaggaatgaagatttcctgaatganattaatttgatggatctttttaaa

SEQ ID NO: 7284 - DNA, 525 bp, Medicago truncatula
  Predicted polypeptide sequence is orthologous to G450, G456
aactgtgaatctcaaggaatgaaggatttcatgaatgagagtaagttgatggatcttttaaacaattctgattatgttccaacctatgaagacaaggatggtgactggatgcttgtcggtgacgtcccatgggagatgtttgttgaatcatgcaaacgtttgcgtatcatgaaaggaaaggaggctattggtatagcaccaagagctatggaaaaatgcaagaacaggagctagacttgctggtcgcacttgttcgccacctgctccatcttttgtcatattttggtacctgcaggatgttcagtatagttaatttgtgtaatgttatatggtttttattttttgataaaattgttatatggtttgttatacatatataatgtttgaaacaaaatacaatgagagtcttaagtgctgattactttaaacagaaacaataaacgactcccaaattatgttgttagatttggctttcttatatattatctatgatttcctatttaaaaaaaaaaaaaaaaaaaaaaa

SEQ ID NO: 7285 - DNA, 836 bp, Medicago truncatula
  misc_feature (380)..(380): n is a, c, g, or t
  misc_feature (489)..(489): n is a, c, g, or t
  misc_feature (564)..(564): n is a, c, g, or t
  misc_feature (583)..(583): n is a, c, g, or t
  misc_feature (594)..(594): n is a, c, g, or t
  misc_feature (630)..(630): n is a, c, g, or t
  misc_feature (632)..(632): n is a, c, g, or t
  misc_feature (646)..(646): n is a, c, g, or t
  misc_feature (652)..(652): n is a, c, g, or t
  misc_feature (657)..(657): n is a, c, g, or t
  misc_feature (676)..(676): n is a, c, g, or t
  misc_feature (682)..(682): n is a, c, g, or t
  misc_feature (691)..(692): n is a, c, g, or t
  misc_feature (696)..(696): n is a, c, g, or t
  misc_feature (699)..(699): n is a, c, g, or t
  misc_feature (707)..(707): n is a, c, g, or t
  misc_feature (738)..(738): n is a, c, g, or t
  misc_feature (747)..(747): n is a, c, g, or t
  misc_feature (751)..(751): n is a, c, g, or t
  misc_feature (756)..(757): n is a, c, g, or t
  misc_feature (759)..(759): n is a, c, g, or t
  misc_feature (765)..(767): n is a, c, g, or t
  misc_feature (769)..(770): n is a, c, g, or t
  misc_feature (786)..(786): n is a, c, g, or t
  misc_feature (788)..(789): n is a, c, g, or t
  misc_feature (803)..(803): n is a, c, g, or t
  misc_feature (817)..(819): n is a, c, g, or t
  misc_feature (822)..(822): n is a, c, g, or t
  misc_feature (832)..(832): n is a, c, g, or t
  misc_feature (835)..(835): n is a, c, g, or t
  Predicted polypeptide sequence is orthologous to G450, G456
tgattaccgccaagcctcgaaattaaccctcactaaagggaacaaaagctggagctccaccgcggtggcggccgctctagaactagtggatcccccgggctgcaggtcgagtttttttttttttttttttggaagcaatcacataataataataattaaacaaggcaaacctacaatagtatataggtggttaagtttattgcttcttgtcgattacaaatacttaaaattaaagtttgaatctatatacgaacaaaacaaaaacagtgaagacacatccaaactaacactccaatccacaggtagtgcttcatatatcttttcatataggtccactttggtacgggacttcgatataggaggatatgatatgtatttanaccaaattcagcttcggtttttgcatttctccattgctcttggtgcaagtccaatagcttctgatcctttcattatgcgaagacgcttgcatgatccaacaaacatctnccatgggacatctcccacgagcattcagtcgccatccttatcttcataggttggcacatactcagagctgttaanaagatccatcaacttgcgncccttcccaanagttgcgcaaccctgaatggcgaatggcaaattgtnancgttaatattttgntaaaantcgcntttaaatttttgttaaaancaactnattttttanncaantangccgaaancggcaaaatccccttataaatttaaaagaanaaaccgaanatanggtcnnantgttcnnncnnctttggaaccaagaancnnctattaaaaaaacncggactccaaccgnnnaangggcgaaaanccnt

SEQ ID NO: 7286 - DNA, 923 bp, Medicago truncatula
  Predicted polypeptide sequence is orthologous to G451
tatattttctaattgaattagagggttttgccttagcaagatggaattcaaggcaactgagcttagattgggattaccagggacagatgaaaaggatatgaaaacaatacatggtagtgttgttaagaataacaaaagacaattacctcaaacttctgaagaatctgtttcaatttctaaggtttcaaatgatgaccagcatgtggagagttcttctgctgcccctcctgccaaggcaaagatagtagggtggccaccaattaggtcttacaggaaaaacactttgcaagaggctgaagttggtgggatatatgtgaaagttagcatggatggagctccttaccttagaaagattgacttgaggatctatggaggttatccagaacttctcaaagctctagaaaccatgttcaaattgaccataggtgagtattctgaaagagagggttataagggatctgaatatgcaccaacctatgaagacaaggatggtgactggatgctagttggagatgttccatgggacatgtttgtgacttcctgcaaaagactaagaatcatgaaaggcacagaagctagaggtttgggttgtggtgtatgagaaacaactgaatttttcctatgactatatgcaagaaaaagagttttggtgtttaggaaagtcaatctttcaattgctggagctaatggattttgaatcttgatttggaagggagatggaagatactttctacataaactttgtcaacatgtttttttggttattttagcatcttgaagtgatgctatatgctatattgtttgttatttccactgaacattttcaataacattttcagaaatttgcatcaaagcaactttgtatacttatagagaattagaattagaagagtcatgggttgttttgtatcaatatataaaat

SEQ ID NO: 7287 - DNA, 647 bp, Medicago truncatula
  Predicted polypeptide sequence is orthologous to G451
tacaacacttggtatactacactgtattaatcttgcatcaatacaagaaaaaactcggattaacaatataatacatattagcacccttctctatctctttcatttgatagcaaatctgtatgagatggctcatttgaaacatagaaaaaaaaatcagtagaaataattaacagcatagaatagcatctcttcctagatgctaaagtaaccagaaattaatcaatgttgaggaaactaagaaactgcactgtatcttacatttcccttccttagagcacaacttcagatagatatgtatgctgatagcagcatagcatacactacagtgattcaaaaatccatttgtgtagttcttccgataacacaagcagaaaggttctttgttttttcccttcacaccaaaacacttgacttttcatactaactttgctgtttttggttgattctcaaacacctctagcttctgttcctttcatgattcttagtctgttgcaagaagtcacaaacatctcccatggaacatgtccaactaacatccaatcaccatctgtatcttcatatgtaggttcatattcagatccttgataaccttctttctcagaataattacctatggttaacttgaacatgctttccaaagctttgag

SEQ ID NO: 7288 - DNA, 678 bp, Medicago truncatula
  misc_feature (527)..(527): n is a, c, g, or t
  misc_feature (581)..(581): n is a, c, g, or t
  misc_feature (626)..(626): n is a, c, g, or t
  misc_feature (630)..(630): n is a, c, g, or t
  misc_feature (637)..(637): n is a, c, g, or t
  misc_feature (650)..(650): n is a, c, g, or t
  misc_feature (652)..(652): n is a, c, g, or t
  misc_feature (656)..(656): n is a, c, g, or t
  Predicted polypeptide sequence is orthologous to G451
catctattctctttcacatcccaaaagaatttaacagatttcagaattgatctgtagagttttggatttggatttgaaggtgaatttattaaggtagcatcaaagaaaaaaaatattaccaagaaaaatggggagctatattgaaacagagttgattattaatcacaaggacacagaattaaggttgggattgcctggaagtgatgatgaacaatcatgcaatggtggttctattgttagaagcaacaagagatctttttcacctgaaacaagtgttgaagaagagtccatttctaagagctctggtgattctaattccacaaccacaagtgatcgtgatcatgaccaagactctgtccaacctacaaaggtacaagttgttgggtggccaccaattagatcttttaggaagaatagtttacaacaaaataaagtggaagatggaaatggaatgtatgtgaaagtgagcatggctggtgcaccttacttgaggaaaatagatctcaaagtttacaagagttactcanaacttcttaaggttttggaaaatatgttcaagtgtacatttggtgaatattcanaaagagaagggtacaatggatctgaatatgctcctacttatgaanacanggatggngattggatgctantngganatgtcccatggaacatgttata

SEQ ID NO: 7289 - DNA, 844 bp, Medicago truncatula
  Predicted polypeptide sequence is orthologous to G470
gcggtttacgaatctccgacctaagatcctttgtcgggtcatcaacgttatgctaaaggcggagccagatactgatgaggtgtttgcacaagtgactttggtaccagagcccaatcaagatgaaaatgctgttgagaaagaagctccacctgctcctccgccgagatttcatgttcattcgttttgtaaaacgttgaccgcatctgataccagtactcatggtggtttttctgtacttagacgacatgctgatgaatgtcttcctcctctggatatgtcaaagcaaccacctacacaggaattggtggccaaggatctgcatgggaatgagtggcgttttaggcatatttttcgcggtcaaccgcgtagacatttgctgcagagtggttggagtgtttttgtcagttctaagaggctggttgctggggatgcatttatatttctgagaggtgagaatggggagcttcgagttggtgtcaggcgtgcaatgagacagcagggtaatgttccatcctcggttatctctagccatagcatgccatcttggtgttcttgcaactgcctggcatgctgttttgactgggaccatgttcactgtttattacaaaccccggactagtccagcggagtttattgttccgtatgatcaatacatggagtctctaaaaaataattatacaataggcatgcggttcaaaatgaggtttgagggtgaagaggcttctgagcaaaggtttacgggtaccattgttggaattgaagattccgactccaaaagatggccaacatctaaatggagatgtctcaaggttagatgggatgaaacatctaacatacctcgtcc

SEQ ID NO: 7290 - DNA, 616 bp, Medicago truncatula
  Predicted polypeptide sequence is orthologous to G478
aaagaaagaaagaaagaaagaaagaaagtctctctctctctctctgagacatagttatagttatagtgagagagagtgtgtgtgataatagacttaatgtacacgccattacattacacactgttttctctgaatcaaatgaaatgagttagatagatggatggatagataaagtctctctccccaaccataacttttcagcaaattaggtactttttttctagagagacatgttggactatgaatggggtaacccatcaaacatcatgcttaccggaaatgaagacaactccggtgcagcagccaccgatcaagcccaccgtcaaatcttcgaccactatgcttctcaagctatgttatccgacaactaccttaacggacctggtggtggacccaccatcgacataaacagtggtgattttactcatcaccacaaccagtttagcccacacaaccagcagcaccataatatccatcagtccttcttcgacccacgggcttttcatggagggtcatcaactgcttcttcttaccctccacctcaaccacaaccctcctccttccatgctctcccttgaccctcttcctggtcatggacatagcccctggattcctc

SEQ ID NO: 7291 - DNA, 620 bp, Medicago truncatula
  Predicted polypeptide sequence is orthologous to G478
atttaatacaccaagttgcaagaaatagacccaataagagaccaagagtacccactgccctatcacttcaaggtcacactcccccagacaaatagaaacaagaatcccccaacagccatacaaaatagaatagaatatgcccaacccattttatctttctcaatttaataatccatccaaacatgtacatcaaaaaccaccaattaatttagctaatcacctacataacctaacattatcttcttcttttttccaaattcttaatcatattaaccataatcattctcatgattcatgtatcatattatcctctctagtccctccctagtctctcctatttatattatattatcctctacttaatttattgattttctattatttttcttgggtatatttccaactttgccctcaatttacaaaccaagtcaaccaagaaaaaacttgaccaaactaaattttcaagcaacactgataatgctatccccacccccaccattatacttccctgcagccatggttttaaaagtcgatgatgaagccgatgacgatgaatggccgctgctttccggtgaatgatcctccgatggaaggtgaagttgcagtttcaatggacatgg

SEQ ID NO: 7292 - DNA, 673 bp, Medicago truncatula
  misc_feature (513)..(513): n is a, c, g, or t
  misc_feature (584)..(584): n is a, c, g, or t
  misc_feature (629)..(629): n is a, c, g, or t
  misc_feature (663)..(663): n is a, c, g, or t
  misc_feature (666)..(666): n is a, c, g, or t
  misc_feature (669)..(669): n is a, c, g, or t
  Predicted polypeptide sequence is orthologous to G483
acgaagggggttttcctccgtcatacaaactagttaatacctcgtcattgattttttttagcttcatctctctctctaccctatccaaccaccgcctcagcgtccttcttcaaatctcctccaacatccaaactgctttcagccaagatgtagatccggcctcaggtggtgcttgcgtcgcttctcgacgacaccacctttccttcctgtcgaatccaaactttcctttttcaaccctcgccgccggagatgagtggtttgttgtgtgcttcgtctccagtgatctattgctccatatcctcttggttcgtcgccgttcttgttcgttgtcgtatgcaagttggtgttcttgagttgttggttggggtttcgaagacaaggtcgaactgatctgtttcgccggttgtttggggtcgaggtcgtagctggtgccacgctgttcttcatgtcatttttcgggtggctttttgtttgcgacggcggtttgtgctttctgttttgtttgtgtgttgngatatttgtttgtttgatgttttcgttttgatacaggaagatgaagttggtggtggtttgatccggatggntttatgataatcttaaatcttgattatcttgatttaggatctggntacaaaaagttctatttatctgtgtggatttgantcnacngggt

SEQ ID NO: 7293 - DNA, 756 bp, Medicago truncatula
  Predicted polypeptide sequence is orthologous to G484, G2631
cttgttttcatcaataaattcatcttcttcaatcatgtttcttcatcctcctagatcttcaattagttgatcccttctttcttctcttttttcttatcctcaatttcaatcgattaatcataataataatacaaagatggagcctatggatattgttgcaaaatcaaaggaagatgcttcgctacctaaagcaacgatgacgaaaattataaaagagatgttacctccagatgtgcgtgttgcaagagatacccaggatttgttaattgaatgttgtgtagagttcataaacctcgtctcatcagagtcaaatgaagtatgtaacagagaggaaagaaggacgattgcacctgagcatgtattgaaagctttaggggttcttggatttggcgagtacattgaggaagtttatgcagcatatgaacagcacaagatggagacagtggcaacttggcatatattgtgtcttgtgggcaaggcaacctaaagatacagatacctctcagtgtgaggtcgaggggatcatatccattgtagaagggcccgtaaaacggtattccgaaggcaaataaactggacagcaagactctataaaaggtgccaagtggagtggcgcagctgagatgaccgaggaacaagcattagcagagcagcaaaggatgtttgcagaggcacgtgctagaatgaatggagggaccattacttccaatcaaccagatgctgaccaaagtttagagaactaactttagggtcttt

SEQ ID NO: 7294 - DNA, 792 bp, Medicago truncatula
  Predicted polypeptide sequence is orthologous to G484, G2631
gtttaatcatttgttaaatctttttttttggtagtgaattatttgttacaatcgaaatagctgtcaggctcgtgcaagaagctgttagtgtgtagaagatccaaaaagcaaataaaataattacatgtcattctaaacagaagagggtcttcatgaactctcactaattcatcgataaaatacaaatggagagagcacatccacattggccagcaaactagtgaataatttttgtacacaatcgagctcacaggaagcacgaacaggagtcagaggtgctcctcctatgtgctccaatatagcagaggtccttcctagctaatcttattttggtcaccatctggctgtttaggagcaatggccccaccattcatcctagcgcgggcctctgcaaacatcctttgttgttctgctaatgcttgttcctcagtcatctcagctccattgctccatttaccagcttttaaagtatcttgcatggtctccagcttgtgttgttcgtatgctgcataaacttcttcaatgtactcaccaaatccaagcacctgtagagccttcaatacgtgctcaggcgcaatagtccttttgtcctctctgctacatacttcattggactccgatgagatgagatttataaactctacacagcactcgatcaataaatcctgggtgtctctcgccacacgaacatcttgcggtaacatctccttaattatttttgtcatcgttgctttaggaagcgaagcatcttccttcgatttgccaacgatatccatgggatccataatttaa

SEQ ID NO: 7295 - DNA, 836 bp, Medicago truncatula
  misc_feature (100)..(100): n is a, c, g, or t
  misc_feature (237)..(237): n is a, c, g, or t
  Predicted polypeptide sequence is orthologous to G489, G714
ctgcaggccattatggcgggatcatcacgtacgagaacattccgaaacgtgcttctgtggcgttcgacaaacttgaacactctcgtgcaatcatctctcngcaagcatcacccactcaacaaaagaatggatcatcaaggtcatggccaaaacccaaatatgggtgttgttggtagtggacaaatggcccatatggtctaatccataccagccaaaccctatgactgggtcacctgngatggttgttccctctgttgggactattcaacctggtggtcaaccagatggaactcagctgggacaacatcagcttgcttatcagcacattcatcagcagcaacagcagcagcagcaacaacaactccagaccttttggggaaatcagtatcaagaaatcgagaaggtaactgatttcaaaaaccacagccttcccttggcaaggatcaagaagattatgaaggctgatgaggatgtgaagatgatatcagctgaggcgcctgttgtatttgcaagggcgtgtgaaatgttcatattggagttaaccttgcgttcttggaatcacactgaagagaacaaaaggcgaacccttcaaaagaatgacattgcagcagcaatcacaggaactgatatctttgatttcttggttgacattgtgcctcgggaggacttgaaagatgaagtgcttgcatcgataccaagaggaccaatgcctgttggagggcctgctgatggaattccttattgctatatgccacctcaaaatgcacagcaagctggaaatcctggtctcatgatgcataatccaaacatgtatgctccacagtctcatccgtaca

SEQ ID NO: 7296 - DNA, 784 bp, Medicago truncatula
  Predicted polypeptide sequence is orthologous to G489, G714
tagaagtctgcaagtacataatatatatcatccgaagaccataaggtttaaacccatattacattttacccagcttaattaaacataaagataagttattactggcatattatctacataatagtctgcaatgcaagtaaaccatctcagctacagtttctgatcgcaccaatggaacagtttcacccccacccccattgcagttccctgcaatcttaacatccacatctcagcatctagtgatctggagatggtggtcgctgttccggaggctgtggccacatttgtggtgccatgtagggatggggctgctgagcatacatgtttgggtccatcacaggcttgcccattatgacaccagcagttccaacttgggaggcatgctgaggtggcatgtagcagtaaggaagagcatcagcaggcccagcaacaggcattgttcctcttggaattgaagccagcacttcatctttcaggtcctcacgaggcacaatgtcaaccaggaaatcaaagatatcagtcctagtgattgcagcagcaatatcattcttctgaagtgtcctccttttgttctcctcagtgtggttccatgagcgcagggttaactccaatatgaacatctcacaggcccttgcaaatatgacaggtgcttcagctgatatcattctaacatcctcatcagccttcatgatcttcttgatccttgccagaagaaggctgtggttcttgaaatcagtaaccttttcgatttcctggtactggtttgaccagaaggattgcagct

SEQ ID NO: 7297 - DNA, 666 bp, Medicago truncatula
  Predicted polypeptide sequence is orthologous to G502, G519
gcacgaggcaaacattaaaaatttagaaagaaaaacacgttttgttttcttcatcaattgttctttctttgttttatcattattatgggagttccagagagagatcctctttcacagttgagtttaccacctggtttcagattcttccccactgatgaggagcttcttgttcaatatctatgtcggaaagttgcaggacatcatttttctttgccaattattgctgaaattgatttgtataaatttgatccttgggttcttccaggcaaggcgaattttggtgagaaagaatggtatttcttcagtccaagggacaggaaatatccaaatggttctacaccaaacagagttgctggttctggttattggaaagccacaggaacagacaaaattatcacaactgaaggtagaaaagtgtggcataaaaaaagcacttgttttctacattggcgaagcaccaaaaggaacaaaaactaattggattatgcatgagtatcgtcttcttgacgcttggcgaaaacacaatcttggtagctcaaaacttgatgattgggttttgtgtcgaatatacaagaaaaactcaagctcacaaaaggaaattccaacattttcaagcaaagaatgctgcaatgcttcttcgccttcatcgtcgtcccaagtggatga

SEQ ID NO: 7298 - DNA, 809 bp, Medicago truncatula
  Predicted polypeptide sequence is orthologous to G502, G519
acaactttcaactcagaactagcagagcaaagaacatcatcaacaacaattatcttcttcaataacatagtcaacgtttcaacctttcagtcaaactagtattaacacaaagaacaagaacacaagaatgcaaggtgaattagaattaccacctggtttcagatttcaccctactgatgaagaattggtgaatcactacttgtgtcgcaaatgtgctggtcaatctatttctgttcccgttgtcaaagaagttgatttgtataagtttgatccatggcagcttccagaaatgggttaccatagcgagaaagaatggtattttttctctccaagggacagaaagtatccgaacggttcgaggccaaatcgagctgctggaagtggttattggaaagctactggagctgataaaccaattgggaaattgaagccgatggggattaaaaaggcgctagtattctatgccggtaaagcccccaaaggagttaaaactaattggattatgcacgaatatcgtcttgccaacgttgatagatcagccggaaagaaaaacaacttgaggcttgatgattgggtgttgtgtagaatttacaacaagaaaggcaagattgagaaattcaatactagtaacacgccaaaggttcaaaattattatgaacatgaagaagtagaagaacatgagatgaagccagaaattcaaaagttggggaattaccaactgtacatggacacttcagattcagttccaaagctgcacacggactctagcagctccggtgggcacgtggtttcaccggatgtcacgtgcg

SEQ ID NO: 7299 - DNA, 827 bp, Medicago truncatula
  Predicted polypeptide sequence is orthologous to G502, G519
tgcaccgtaggttcttcttagtattcttcatttcataaactagggagaaccatacatacaatatagattgattaaattcaaaaatcatcaaatcttattagcaagcaaattcagtttagcaattatagctgaaaaaacaatggcatccgagcttcaattgccaccgggcttcagattccatccaacggatgaggagctcgtgatgcactatctctgccgcaaatgcacgtcgcagcctatcgccgttccgatcatcgccgaaattgatctatataaatatgatccttgggacctcccaggtatggctacttatggagaaaaggagtggtactttttctcgccacgagacagaaaatacccaaacggttcaaggccgaaccgggcggctgggtctggatattggaaggcaactggggcggataaaccaataggtcatcctaaaccggttgggatcaaaaaagcgttggtgttttacgcgggtaaagcacctaaaggtgataaaaccaattggatcatgcacgagtatcgtttagctgatgtagatcgctccattcgaaaaaagaacagcttaaggttggatgattgggtgctttgccgtatttacaacaagaagggtacaattgagaaacaaccaagcaacagtgttgtcaaccgaaaaactgaacattctgaaattgaagacaggaagccggagattgtgacacgtggggggcggtcttccgccacatccaccgccgcaaactacggctggaattagggattacatgtattttgatacatcagattcgattcctaagctgcacaccgattcgagctgttcggaacag

SEQ ID NO: 7300 - DNA, 787 bp, Medicago truncatula
  Predicted polypeptide sequence is orthologous to G502, G519
cgacgcgaatgcaaggagcattagagttaccacctggcttcagatttcaccctactgatgatgagcttgtgaatcactacttgtgtagaaagtgtgcttcccttccaattgctgttcctattatcaaagaaattgatttgtataagtttgatccatggcatcttccagaaatggctctttacggtgagaaagagtggtattttttctctccaagggatcgaaaatatccaaacggttcacggccgaaccgggctgcgggaaccggatattggaaggcgaccggagctgataagccgattggaaagcctaaggcacttggtataaagaaagcactcgttttctatgctggcaaagctcccaaaggaattaaaaccaattggatcatgcatgagtatcgtcttgctaatgttgatagatccgcttcaaaaaataaccacaatttaagactcgatgattgggtgttgtgtcgaatttacaacaagaaagggaagattgagaaatacaatgacacaaaaccaccaatgttttctcaatttgagaatgagacaaagcctcatatcaagatgaacatgaacggccaggatgatcaattgtacactgacacatcagattcggtgccactgtttcataccgactcaagcggttctgaccacgtggtttcaccggatgtcacgtgcgataataaggaagttcaaagtgagcccaagtggaatgaatttgttctgggctcagacccagtttcagcctttgattttcagttgaatcttatggatgatgctgaagatga

SEQ ID NO: 7301 - DNA, 495 bp, Medicago truncatula
  Predicted polypeptide sequence is orthologous to G504, G1425
cgactggttcgcaacaaccgaatctcccgcctggattccgatttcaccctacagatgaagagcttgttgttcattacctcaagaaaaaagcagcttcagctcctttaccagtagccatcatagctgaagttgatctctacaaatttgatccatgggagctaccagctaaggcaacgtttggagagcaagagtggtatttctttagtccaagggacaggaagtatccgaatggagctaggccaaacagggctgcaacttctggttattggaaggcaactggtaccgataagcctgttttaacttctggtgggacacaaaaagttggtgtgaagaaagctttggttttctatggtgggaaaccaccaagaggtatcaaaaccaattggatcatgcatgagtataggcttgctgataataagcctaataataggcctcctggttgtgactggggtaacaagaaaaactctctcaggcttgatgattgggttttgtgcc

SEQ ID NO: 7302 - DNA, 1688 bp, Medicago truncatula
  Predicted polypeptide sequence is orthologous to G521, G2887
cggcacgagaatcaattttctctctttcgatttcatagtaacacacttgttacgttattgtaatcgttttctgagttacgaggtttcgatcaattttttttccgactgaggttgtttgttcgctacgacaacaaacaacctcggtgttggattctgtaattttggtattgatttgatttgattcgatggctataccgaaattggttccggggtttcgattctctccaactggagttgaattgatcaaatatttcctcaaaaggaaagtgatggggaaaaaggttcttaacgatgtcattgctgaacttgacatatacaaatacgcaccttgggatctcccagatttatcttatctccaaaatggggatttagaatggtatttcttctgtcccattgagaagaagtatggaaatgggtcgaggatgaatcgagctacggaaatagggttttggaaagctactggtaaggatagagctgttcaacagaataatcaaactgtggggatgattaaaacactgatatttcatactggaaaagcacctcgtggggatcgtactgattgggttatgcacgagtataggcttgaagataaggacctagctgataaaggaattgttcaggattcctacgtaatctgtaaggtatttcaaaaggaaggtcctggtcccaggaatggtgcacaatatgggagaccatttaatgaggaagactggagtgatgatgaagtaggaacaccgtttgctgagccggctgcactagctcccactttgcctgtgacatctaatagttttgttctaaatgaccagaatctccatgctattggatataatggttcaatatccatgccatgtcaatccggattggtgccttctcccgatccagcaaattcatgtcaaacaggattaccgccttctcctgaccctgcaaattcatctcaaataggattgacgccttctccagatcctgtgaattcatgtcaaacaggatttatgtcgtctcccgacccttcaaattcatgtcaaacagggtatatgccgtatcctgattctgcaaatgaatgtcaaataggatttatgtctcccgaccctgcaaattcacatcaaacaggattggtgctgtctccccctgaccctgtaaattcacatctaacaggtttggtgccttctcccgaccctgtggataattcatatctagaaaatcaagctgttaatactgataacattttatcaatgcttgatatgttcaacgacaacgacatattgcctgaggaaaacattgctgaaggtgcactatcaaccgacttttttgaggtttgggagacctggattgcctgggacctgttggccagaatgctgactttagcacatacggtatggcttctacgggtgatgactacttggatttcatggagttgattgatctagactccgagatgttctggcagagtgctgctgaacctaagttggacccaaaataaagaattttcattggtccttttggcatgatattttctgacgactgagcgtcggacttaatactttggcactattgctgcagtgctggccagaaggtgattcggtcattggcacatagacacattgtttgaatttgtctgcctttatatatattttagtggttaataaataactgaagtaagtaatgtattattgtgaaaaaaaaaaaaaaaa

SEQ ID NO: 7303 - DNA, 843 bp, Medicago truncatula
  Predicted polypeptide sequence is orthologous to G525
cttttatatataattcttctctgtttcatcactaaaacctttgatttgaggttttgaacaaggttttagaggttgacccttttggttaccttgatcaagatggaaaacgtttcagtcttatcaaataaggaagatgagaagatggatttgcctcctggatttcgatttcacccaactgatgaagagcttataagtcattacctctacaaaaaggttattgattcaaatttctctgcaagagccattggtgatgtagacctcaacaagtctgaaccttgggatttaccatttaaagcaaaaatgggagaaaaagaatggtactttttctgtgtgagagacagaaaatatccaactgggttgaggacaaacagagcaacagaagcaggttattggaaagcaactgggaaagataaagaaattttcaaagggaaatcgttggttggtatgaagaaaactcttgttttctacaaaggaagagcacctaaaggagaaaaaagtaattgggtcatgcatgaatatcgacttgagggtaaattctctgttcacaatcttccaaaagctgcaaagaatgaatgggtgatttgtagggtttttcagaagagttcagctgggaaaaaaacacatatttctggtataatgaggttggattcacttggtaatgaatttggttgttctgttttaccaccacttactgattcgtcgaattcaattgggaaaatcaaacaattgaatgattcagcttacgtgtcctgcttctccaactcaattgatgttcaaagaaaccaaggaggggatcttgattcattcaacaactcaatttatggtatttcttcacataatcaa

SEQ ID NO: 7304 - DNA, 726 bp, Medicago truncatula
  Predicted polypeptide sequence is orthologous to G526
ttttgttgtgaaagattttcatcttgaaaatcctgtgtagaaaaaatggaagaaccaattgttgttaacaaaggtgaagatcaaactcttgatcttcctccaggtttcagattccatccaacagatgctgagataattgtttgttatctcactgaaaaggttaaaaatagcaaattcagtgcaactgctattggtgaagctgatttgaacaagtgtgaaccttgggacttaccaaagaaagcaaagatgggagagaaagaatggtactttttttgtcagaaagatagaaaatatccaacaggtatgagaacaaatagagcaactgaatctggttactggaaagctacaggaaaagacaaagagatttatcacaaaggaaaaggaatccaaaaccttgttggtatgaagaagactcttgtgttctataaaggaagagctccaaaaggagagaagactaattgggttatgcatgaattcagattggaaggcaaatttgcaactcacaatcttcccaacaaagaaaaggatgaatgggttgtgtcaagggtttttcacaagaacacagatgttaaaaaacctcaaatttcttctggtcttttaaggataactcaattggtcatgatgatcttcttgattattcttcacttccacctctcatggatcctttctacacaaatgatgatttcaaagggattaccacaaatcaacaaatttcatcaactaaat

SEQ ID NO: 7305 - DNA, 846 bp, Medicago truncatula
  Predicted polypeptide sequence is orthologous to G536
gaagaaatggtggagttcatggaaaaagtctccgccaacgccgataacgaagaactcaccgttgaagagaggaaccttctctctgtagcctacaagaatgtcatcggagcaagacgtgcttcgtggcgtatcatttcctcgatcgaacagaaagaggagagccgcggcaacgaggatcatgtctccgtcatccgtgactaccgatctaagatcgaatcagagctttctaacatctgtgacggtattctcaagcttcttgattctcgtctcattccttccgctgcttccggtgattccaaggttttctaccttaagatgaagggagactatcacaggtatcttgctgagttcaagactggtgccgagcgtaaggaggctgctgagagcactctcgccgcttacaaatctgctcaggacattgcaaatgctgaattgccaccaactcatccaattaggctgggtcttgctctgaatttctctgtgttttactacgagattcttaactctcctgatcgtgcctgcaatcttgctaaacaggcttttgatgaagcaattgctgagttggatacccttggcgaggaatcatacaaggatagcactttgatcatgcaacttcttcgtgataacctcaccctatggacatctgacatgcaggacgatggagccgatgaaattaaagaagcagcacctaaacctgatgaacagcagtaaacaaattttactgccaattagaatcaaaacttctcctctatatgttaatgaatgaaggaagaaggttcttgttgctaatctctttgggtgctgagattttaggaattcatgtctgttatgagttctggatgtcct

SEQ ID NO: 7306 - DNA, 700 bp, Medicago truncatula
  Predicted polypeptide sequence is orthologous to G536
tgaacaagctgaacgctatgaagaaatggtggaagcaatgaagaatgtggcgaagctagatgttgagttgacagtggaagagagaaaccttctatcagttggctacaagaacgtagtgggtgctcatagggcttcatggaggattctatcctcaattgagcataaggaagaatctaaagggtatgatgtgaatgtgaagaggataaaggagtatagacacaaggtggaatctgaattatccaatatatgcagcgatatcatgtctattattgatgatcatcttattccgtcgtcctctgctggtgaatctagtgtctttttctataaaatgaaaggggattattatcggtatttggcggaatttaagaacggtgatgaacgaaaagaggctgctgatcattccatggaagcatatcagactgcttccactgcagcagaaggggagttacctcccacgcatcccattcgattgggcttggctttgaacttctctgtcttttattatgaaattttgaactctcctgaaagggcatgtcaccttgctaagcaggcatttgatgaagcaatctctgagttggatactcttaatgaggagtcttacaaagacagcacattgattatgcagcttctaagggacaacctcacattgtggacttctgacatccctggagatggagatgaggaacataaggtggaatct

SEQ ID NO: 7307 - DNA, 676 bp, Medicago truncatula
  misc_feature (20)..(20): n is a, c, g, or t
  misc_feature (192)..(192): n is a, c, g, or t
  misc_feature (247)..(247): n is a, c, g, or t
  misc_feature (263)..(263): n is a, c, g, or t
  misc_feature (392)..(392): n is a, c, g, or t
  misc_feature (452)..(452): n is a, c, g, or t
  misc_feature (567)..(567): n is a, c, g, or t
  misc_feature (573)..(573): n is a, c, g, or t
  misc_feature (623)..(623): n is a, c, g, or t
  misc_feature (663)..(663): n is a, c, g, or t
  misc_feature (676)..(676): n is a, c, g, or t
  Predicted polypeptide sequence is orthologous to G536
ttttttttttttttttttanacagtaaatggattcttgaaggttgaatagtagcctaatagaatgcaaacatagaaatccatgtattacaaaccaatggtgttattgttacacaaacagatataacaacaatagcatacaaatgaagcacatgattcaaatatgttgtaactcaacattaacaataacttanaagttgaaaaaagttcaaagttcaccatccattaaaaggcttcactacattgganaaaatattcttcttanaaaaattaacacatcaatgttatagttatcatgacagagtgacaacttagcgtcccaattcgtcttcatcttgaccgctcttagttgcgctttccattttttgatcctcaccatcttctgggatatcanaagtccataaagtaaggttgtctcgcaacagctgcatgatcaaggtactgtccttgtaanaatcttcatttagggtatccagttctgagacaccatcatcaaaggcttgctttgcaaggtgacaggccctttcaggtgaattcattatctcataataaaacactgagaaatttanagccanacccaatcggataggatgtgttggttgtaattcattctcagcagttgcanaagctgtctgatatgctttaagtgacagatccgccacctntttcttttcatcn

SEQ ID NO: 7308 - DNA, 829 bp, Medicago truncatula
  Predicted polypeptide sequence is orthologous to G536
gggtggtgcgattccagaaaacctaaacagagaacagtatgtgtacctagcaaaactcgcagaacaagctgaacgctacgaggagatggtctccttcatgcagaagcttgtagtggggtccacaccatcatcagagcttagcgtcgaagagaggaacctcatatccgtcgcttacaagaacgtgatcggatcgctacgtgctgcgtggagaatcgtttcttcgattgaacagaaggaagaaggtagaaagaatgaagatcatgttgtgcttgtgaaggattacagatccaaagttgaatcagagttgacgaatgtttgtggtagtattctggagttgttggattcgaatcttataccttcagcttcttcgagtgaaagtaaggttttttattataagatgaaaggtgattatcataggtatttggctgagtttaagattggtgatgagaaaaaatctgctgctgaggatactatgttgtcttacaaagctgcacaggatattgctgctgcggatcttccatcaactcatcctataagattgggtttggctctcaatttctctgttttctattacgaaattctcaatcaatctgacaaagcttgtgacatggccaaacaggcttttgaggaagcaattgctgaactggacacattggggagaagaatcctacaaagacagcacacttataatgcaacttttgagagacaacctcaccctttggacttctgatgtccaggaccagctagatgagccttgattatcccttatagggttgatgggtcgtattcttcctctgaagggagtgggctacgaatgtcatttgtgcgt

SEQ ID NO: 7309 - DNA, 824 bp, Medicago truncatula
  Predicted polypeptide sequence is orthologous to G536
ctgattcgccagctcgaaatttccctcctaaagggaacaaaagctggagctccaccgcggtggcggccgctctagaactagtggatcccccgggctgcaggaattcgggcaccaggtgaaagagagagagatttcgcaattcccaaattcacaaaccctaatttctctgagatcgacgatggcttcttccaaggatcgtgaaaacttcgtctacatcgccaagctcgctgaacaagctgaacgttatgaagagatggtggattcaatgaagaatgttgcgaacctagatgtggaactgactgttgaagaaaggaatttgctatctgttggttataagaatgtgattggtgctcgcagagcctcgtggaggattctttcttccattgagcaaaaggaagagactaaaggaaatgatgtgaatgcgaaacggattaaggagtataggaacaaggttgaaactgagctgacaaacatctgtaatgatgttatgagagtgattgatgaacatcttataccttcggctaacaggctggtgaatcaactgtgttttactataagatgaaaggagattattatcgtataatctttgacggaatgtgaagactggcaatggataaagaaggaggtctgggtgatacaaggtgcgaatgagaagagcctataagaagcgtgactgtacccaagagtaggcaaggcaagaatggctagattgaccaccaccgagctgttgtgttgccatacagatagaggcggctagtgttgtggagagagtgaggacgcgtagtgctgcggatataaggagaagtcgagatgagaagtcagcg

SEQ ID NO: 7310 - DNA, 379 bp, Medicago truncatula
  Predicted polypeptide sequence is orthologous to G536
gctccaactcatcctattcgtcttggacttgcattaaacttttcagttttctactacgagatcctcaattcacctgatcgcgcttgtcatcttgcaaaacaggcatttgatgatgctattgctgaactcgatactttaagtgaagaatcgtataaagatagcacattgattatgcaactacttagagacaatttgaccctttggacttcagacttgcaagatgcagagggtgaaaaaccagaagaagccaaacaagaagttgaagctgaagaatctaagtagcaatagttagttattttattaaaaatatatatatttcatacttcatatatataaaaatcagttttccctcatatttaaaaaaaaaaaaaaaaaaaaa

SEQ ID NO: 7311 - DNA, 702 bp, Medicago truncatula
  Predicted polypeptide sequence is orthologous to G536
aactcaagctgtttgttttttgtttataattgaaataattttgaagttcttgctgtagtagtagtagttgctgtaattaatatttgcataatagtcaaaaggaaacacacacgatgaatttagtttggttagttgtcaccaccctcttgtggttcatcgccatccccttgcgtatccgaagtccagagcgtaaggttatctctcaacaattgcatgatgagcgttgagtctttgtatgagtcctcattgagtgtgtccagctcagctatcgcgtcatcgaacgcctgtttagccagttggcaagctttgtctggagagtttagtatctcataatagaagactgagaaattaagtgccagacccaatctaattggatgtgttggctgcattttgcccttgctaatttcaaatgcatcctggtaagctgtttgggagtcgtctacgacggtgttgcgtgcgtctcctgtggccacctcagctaaatacctgtagtaatcacctttcattttaaggtagaagaccttgctttctggattgctggctttaggaattaggtatttgtcaaggagacccaaacttcataaacaatttcccttaagtctttctcaacacgctctctgtactcgcgggcgagctgttgttttctgggcggagcttcagttttttgttcaatgatgaattacgcgccatgaagatctgcgg

SEQ ID NO: 7312 - DNA, 753 bp, Medicago truncatula
  Predicted polypeptide sequence is orthologous to G545
ttgcaggaagatatagaacctgttggtaatgacaacattgctggtcttaagttgtctcagcaggaagatatggaaccggaaggcaataacaacattgcgagtcttgatttgtctcaaccgcaggttgacatgatttctaatggggaaaatggagtctcaagtgttgctgcagctgaaaatagtcaaaatttgattagtgtatttgaatttgatcctacctatgagcctgatagtcttaggtctccactttacgcaaagaaattggattttgacatattatcaagtgaccgcatggataagaaacgtaccaagaagaagattgtaggggaaactggtaacttgtgtagtagtagggtgctgacaagaagcattgccaagaaaagtcacatgatgcttaaaaaggatgggaaaactgcagtaaaatgtttcacttctcctgttagaagatctaccaggctactaaattatcaaaaatgagctgtttacgattattctgttggattttgatcctaactgaaaaattatttggcttgcttttgaagatatataggtgtagtgttcataggatttggaggcctttgaaatgttcaaattggtgcctgaggaagcatattccataagttttagagtttgcttcttttatttgtacctcttttttttgggttgttgaattaagggtatatatgcacatctgatatatttattgattttgtgatctttaccctgatctttgatgctgttatggtcttggaa

SEQ ID NO: 7313 - DNA, 1193 bp, Medicago truncatula
  Predicted polypeptide sequence is orthologous to G549
attgcttaccatggatcccgacgcattcaccgccagcctattcaagtgggacccacgtaccgtcctaccaacagctccacctctccgtccccaacttctcgactacgcagtcaccccatcaactgctccatcaccttattatccagcgagattaccaagagaacttggaggtttggaggaacttttccaagcttatggaatcagatactacacggcggcgaagatagcagagcttggttttacagtgagcacgctggtggacatgaaggatgatgagcttgatgacatgatgaacagcctttcccagatttttcgttgggatcttcttgttggagagcgttacggcatcaaagctgccattagagctgaacggagacgccttgatgaagaggaaattaaacgccggggtcttctttccggcgataccaccaacgctctcgatgctctctctcaagaaggtttgtcggaggagccggtggtgcagcgagagaaggaggcggtgggaagcggaggagggagtacttgggaggtagctgtggtggaggagaggagaaagaggcagcaaataaggaggagaaggatgaagatgaagggaaatggtgatcatggtgagaatgaagaaggagacgaggaggaagaagataacatcagtggtggcggtgagagacaaagagaacatccattcattgtgacagagcctggggaagttgcacgtggcaaaaagaacggtctagattatctttttcatctctatgaacaatgtcgtgagttcttgattcaggttcaagcaattgctaaggaacgcggtgagaaatgccctaccaaggtgacaaatcaggtatttaggtatgcaaagaaagctggagcaagctacataaacaagccaaaaatgagacactacgtgcactgttatgcattgcattgtttagatgaagaggtatcaaatgagcttagaagagggtttaaggaaagaggagagaatgttggtgcatggagacaagcatgttacaagccacttgtagcaatagctgcacgtcaaggatgggatattgatgcaatattcaacgcacatcctcgtctttcaatatggtatgtgccaacaaaacttcgtcagctttgtcatgctgagaggaacagtgctgctgcttcaagctccgtctctgttggaactgctcaccttcctttttaagtta

SEQ ID NO: 7314 - DNA, 785 bp, Medicago truncatula
  Predicted polypeptide sequence is orthologous to G550
ttccgcttcttccactgatcatccctgccaacgactcttcatttccctcttcttctccgccagaattcacctctgcaatacaacatgaaactgaggaaccatcaaggaaagaactaattacagcacaagatgatgaagcctcgcaaaaaactaccgaggatttaagagctctcacaacatcttcagttgtacatgagaatcctcctaagactccatcagctgaaaccgagaattctttattgaaatcttctacaaatgtagaacaaagcgagactagtgtttctgaagaaaaaactttgaagaaacctgacaaaataattccatgcccgcgatgcaatagcatggacaccaaattttgttacttcaacaattacaatgtcaaccagcctcgtcatttttgtaagaaatgtcaaagatattggactgcaggaggaacaatgagaaatgttcctgttggagctggtcgccgcaagaacaagaacttatctacctcgcattatcgacacttgataattccagagggagctaaacttaattcccctaatggaatacatagtttgggaaatggagcagctgttttgacgtttgattcaaatcctccacttttgcacaccatggcttctgtattgaacatcgctgaaagactcaaaattgtgtgtcaaatggttttcatcatgcaagttcgtatggtggggaaaatgatcactcaattgggagtttcgggtacgggctcaaattcatcagagagaaaaagcacaccagcacaaatggggtagtggataaaa

SEQ ID NO: 7315 - DNA, 701 bp, Medicago truncatula
  Predicted polypeptide sequence is orthologous to G558, G578, G629, G1198, G1806
atgaatcaagggtctgcttttaattttggagagctagaagaggcaattgttcttcaaggaatcaagataagaaatgatgaaggaaaagcatctgctttatttacaagcaaaccagcagctacacttgaaatgtttccttcatggccaattagattccaacaaacaccaagagttgtagcttctctcacttctccatctctgaccattccttatggaggttcaaaatcaggaggagaaagtactgattcaggatcaacagagctacaatttgaaacaaattctccaataagtgtaaaagcatcttcttcagatcatcataatcatgcttttcaacaggagacagcaactgatgatggattaagaacaggcacatcaacacagaatcaatcaaaagccaaatcacctcaacaaaagaaaaaaggagctgtttccacatcagaaaagacacttgatccaaagacactgagacgtttggcacaaaacagagaagctgcaaagaaaagccgtctgaggaaaaaggcttatgtacagcagctggagtcaagtagattaaggctatccagtctcgaacaagaccttcaaagagcacgctcccagggactattcttgggttgtggtggtggcaatataaagccctggagctgcaatgtttgacatggagtatgcaagatggctagaagaagatcaacgacacatggcgg

SEQ ID NO: 7316 - DNA, 611 bp, Medicago truncatula
  Predicted polypeptide sequence is orthologous to G558, G578, G629, G1198, G1806
ggcacgaggatggcttggtggttttcggtcgtctgaacttctcaagcttctggtaaatcaactggaacctctcactgagcagcagttgatgggtattaccaacttgcaacaatcctcccaacaagcagaagatgcattgtctcagggtatggaagcattacaacagtcccttgcagagacgttgtccactggtgcaccttcctcgtctggttcctcagggaatgtggcaaattacatgggtcaaatggctatggccatgggtaaacttggaacactcgagggcttcattcgacaggctgacaatctgcgccagcagacactacaacaaatgcaccggatattgacaacacgacaatcggctcgtgcactccttgccatccatgattacttttcgcggctgcgcgctctcagctctctctggttggctcgtccaagagattaatgattgtagtgaatagtctgtcaaattaattaattatctcatatcaaccaccatcaatactttggtcatgataagttttgctcttagcaagtgttcttggtgttgtacttgtagtctttgtaaggctgatactagtgtttcctagagttcacatagtctaggaatggga

SEQ ID NO: 7317 - DNA, 655 bp, Medicago truncatula
  Predicted polypeptide sequence is orthologous to G558, G578, G629, G1198, G1806
tcagataagccacttgatgcaaagacattgagaacgtttagcacaaaacagggaggctgcaaggaaaagtcgtctaaggaaaaaggcttatgtgcaacaacttgagtcaagtagattaaagcttacacaattggaacaagaccttcaaagagcacgctctcagggtatgttcatggattggagtggtggtgttggaggcaatataagctctggaggtgcaatgtttgacatggaatatggaagatggttagaagaagacaaccgtttattaacggagttaagaaacggattgcaagcggcgttaacagataatgaaatgagagtaatggtggatggatatttgtgtcattatgatcaaatatttagactcaaaggtgtcactgctaaatcagacgtgtttcatcttatcaatggcatgtggacttctcaagctgaacgttgcttcctttggattggtggttttagaccttctgaaattatcatgatgttgatccaacaattggagccactagctgagcagcagataatggggatgtatggactgaggcattcttctcagcaagcagaggaagctctctcacaaggacttgaccagttgcaacagtctcttgttgacaccattgctgggagaccccttgttgatggtgttcaacaa

SEQ ID NO: 7318 - DNA, 660 bp, Medicago truncatula
  Predicted polypeptide sequence is orthologous to G558, G578, G629, G1198, G1806
gacaggacattcaactcatcatgtcccttatggaattcatcataggattaataataataatccttcatcaagcttaatgaatgaagaatctggttttgattttggggagctagaagaagcaattgttttgcaaggagttaagaatggaaatgatgaaacaaaagcatcttttttcacagccagacctgctgctacactggaaatgttcccttcttggccaatgagattccatcaaacctcaacagtaggaggtggtaacaaatcaggaggtgaaagcagtgattcagcactatcaagcaaaaatgagaacccttttgagccagaatcacccttaagtagtaaaaaagcatcttctttttcatcagatcataataataatatggatcagcagaatcttcagctacaacaacagaagatgataatatccaatgatgcttctgctgctataagaacagcctcttcatcacagaatcaaatatcagcagcagccaaagaaaagaaaaaaggagctggttcaacatcagataagccacttgatgcaaagacattgagacgtttagcacaaaacagggaggctgcaaggaaaagtcgtctaaggaaaaaggcttatgtgcaacaacttgagtcaagtagattaaagcttacacaattggaacaaga

SEQ ID NO: 7319 - DNA, 800 bp, Medicago truncatula
  Predicted polypeptide sequence is orthologous to G558, G578, G629, G1198, G1806
tctgttgtttcttctttctgggcctagttgtggatttaaggtttgtggaagaaagataagataagaaaatggttattgatgggcagtagaggtagaactgctgaggacactaataaggttgttaacgggatgccaagctacgcacctccatctaattccatgggcatggagggaactaatattcatccttctcgaatttctgattttggagcccttgaacaatctctaggatttcgtgttgaggatgccatgaatcttagcagaaatccagtgtttaatcaaatgaaagcaaatagccaagctttaggtgctgatattcaatttggtgctttaagtaagtccattgcaaactcggatataaacctctctgctgcaattgctgggtctcagacattgcaattacaaaaagacgcgatgccaaatctggcttcaacatctggtggccatcgtgagaattggggagagtccaacatggctgagggaagcgctgatacttcaacagatgatacagaagacaagaatcaaatgcctgaaaggggggaatccagtgaaagatcaaaagataaatcggatcaaaagacgttaagacggctggctcaaaatcgtgaagctgccaggaaaagccgactgaggaaaaaggcatatgtgcaacaattagagagcagcaggctgaaactgaccccactagagcaagagctacagcgagcacgcccagcagggatatttattttcagtactggagagcagaccatttcatgagtggaatgggtgcatggcatttgatgcaaaatatgcacgat

SEQ ID NO: 7320 - DNA, 702 bp, Medicago truncatula
  Predicted polypeptide sequence is orthologous to G558, G578, G629, G1198, G1806
tagataaattatatacaaatatttgtcaagagacatatcaactgactggtcagtgatgtcttttcaatacagcacaagaaaaaacgaatatatacatacaacagtgtgcaaccacaaaccattaagcaggaaaagaaaccaagagagaggaaaccaccctcaaataagcttgatttctgaaatacaatgaacaactgtaacctaaaatacaaatactatttctacattttcccccttcaactctatctatcatacacctatataatcaaattattgagactatttttcaaagcatataaaagcttaatgaaaaatgttgtaccacaccagcagtatgtggaggagaatagaaaaatcacagtatctaatgtttacaagcaccacaactaggcttcttcttcacaacagaaattcatttcccaaaagataccagcttcatgcagaaagaacatatatatagctttgaaacagtttactcccttggtcgtgcaagccatagagaactcagagctcgcagccgggagaaataatcgcttattgcgagaagagctcgagctgattgtctggttgttaatatacgaagcatttgttgcaacgtttgctgcctcaggttatcagcctggcgaagaatccctcaagagtaccgagctttcccatggccatagccatttgtcccatgtaattcgccacatttccagaagc

SEQ ID NO: 7321 - DNA, 832 bp, Medicago truncatula
  Predicted polypeptide sequence is orthologous to G561, G562
taaccttaattccttctccaaaattcaatcttgtttgctttaaattctgttaggtgtttgcaatgggaaatagcgatgaagagaaatctaccaagactgaaaaaccttcttcacctgtaacagtggatcagaccaaccagacgaatgttcatgtctatcctgattgggcagccatgcaggcatattatggaccaagagttgccatgccaccttactacaactcacctgtggcttctggtcacactcctcacccatatatgtgggggccaccacagcctatgatgccaccttatggacatccttatgcagcaatgtatccacatggaggggtttatactcaccctgcagttcctattggtccacatccacatagtcaaggaatttcatcttcacctgctactggaactcctttaagcatagagacacctcccaaatcatctggaaatactgatcagggtctgatgaagaaattgaaagggtttgatggacttgcaatgtcaataggcaatggccatgctgagagtgctgagcctggagctgaaagcaggcaatcacagaggttcgttgatgttctatttatacatgaagttttccaagagcatacatacatcctatttatctttctctctgttgataagattggtccatttgtttgttattgtggataaccaagtaactttatgatgatatgaacagtgtgaatactgagggttcgagtgatggaagtgacggaaacacttcagggatggagaagggaaaacaaatacacaaggtagtcaaatttccaaagaaattgcagcttctgataagatgatggcagtagcccctgctg

SEQ ID NO: 7322 - DNA, 806 bp, Medicago truncatula
  Predicted polypeptide sequence is orthologous to G561, G562
tatcagataccattataaggtgcacaccaatcattaatacacacaccataatatattatgcgacagtttcaacatccctctctaaactaaaatatctaattttcttgattatacaaactttagtagtcatccatatttgtcaaatctaaatagaatatagttctctttcctaagtaactgatgatgaacaatgaattagttctggttttgatggatttagatactaaaattcagctgatccatcccctcagaaaaactgttagcagtagttttgggtttgtaatatgccaaaactacatgatcatggttttttgtatcaaccagcagccacagcatcagctctaggacttgcatccaatagttggtgcaacttcgcaccagaatttggtttgttgtcacaataaccattctcatcctccacagttctatcattagaacccgaattgttattaactcttgataataagttttctgtacttacaggtgtggtcctctggctgtcaatgttggtcaaaattatctctttcggttgtcccagtttagcaattttaaatttttcctttaatgcagcattttccatcctcagtctttcagaattctcagcaagtcggtttatttctgatctaagtgacgcactctcagcattcaaggattcaacttttcgtgccagttcttcagcctcagcctgcttccttagtctgggacttctagcagattctcgaattgattgtttcctcctctcacgcttcagttcacgctcattctgtatcaagcctcgggaggcatacagcagaagttgtggggta

SEQ ID NO: 7323 - DNA, 553 bp, Medicago truncatula
  Predicted polypeptide sequence is orthologous to G571
gttataattcaattctattatatagttatctgtctatatatttgtacagagcttcttaagattaaaaagggacggaggatggtaacaaattaaagggagagaaaagaacattaaatttataatgttaagaaaaattaaagctacaaattaaggaccatatatatatagctatagttagctttaggtgaatgagccactgaatgctattcttgacgagggcgtgccaaccacagagaactcaatgctcgcatacgatggaagtactcagccatggcaagaaaacaccttgctgcttgacgcgtcgttaggatctgattcagacggtgaatggtttggtgccgtagattatctgcctctctgacgaaactttcaagagtggagagtttgttcatggcccttgccatttggtccatgtagttggtcatattgggaggatagctcaatgaatctgatgttatagtttcagaaagagtttgattgagtgcctcaagtccttgagagagagcatcttctccctgttgtgtagattgttgcaatccatatatgcccatta

SEQ ID NO: 7324 - DNA, 758 bp, Medicago truncatula
  Predicted polypeptide sequence is orthologous to G583
cccttcttctctctctttccccaatccgttatcaccaccacacgagcgtgttctgcgtgaccttcttctctttttcttcttcctaaattacccctccaacaaattttcattttcatttcatgaatctttggagcgacgataactcttcagtaatggaggctttcatgacctcctctgatttatcaaccttatggccaccacaaccaccgtcacaaccaccacaaaccaccaccggattcaaccaagacactctccaacaacgtcttcaggctttaatcgaaggtgcaaaagaaatctggacctacgctattttctggcaaccttcttacgactattcaggttcttcgttactcggttggggtgacggctactataaaggcgaagaagacaaaacaaaagcgaagaaatcaaaagttacttcacctgctgaacaagaacaccggagaaaagttcttagagaacttaattcattaatctccggtaatccggttacagatgaatctcctgttgatgaagaagttactgatacggagtggttctttttagtttctatgacgcagtcttttgttaacggaactggactgcctggacaagcttattataattcagctccggtgtggctaactggagctgaaaatctcgccctctcagcttgtgagagggcgaggcaaggtcaagaacatggtatacagacgcctggcgtgtatacggtcggctgacgggtgttttggagccttggatctacctgagtgatttat

SEQ ID NO: 7325 - DNA, 807 bp, Medicago truncatula
  Predicted polypeptide sequence is orthologous to G584, G1136
gcgtttcggtgaaagtaaaaaaagttcttatatcaccggaaatggaactttcttttctggtcagtcacagttcgtcgctggtgaagaaaacagaaaaagaaagtctcctatatccagaagcagcattgacgatggaatgctttcgtttacttccggtgtagtcttgccgtcttcaaatatgaaatcaagcagcagaggcggaggtggagattctgatcattcagatctagatgtttctgctgtgaaggaaggtgagagcagcagagttgtagagccagggaagcgacctaagaaaagaggtcgaaaaccagctaatggaagagaagaaccattgaatcatgtagaagcagagagacaaagaagagaaaagcttaaccaaaaattctatgctctacgtgctgtggttccaaatgtttctaagatggacaaagcatcgctgctaggcgatgctatatcttatataaacgaattgaaatcgaagctacaagggctggaatcgtcaaaaggtgaattggagaaacaattaggtgcaacaaagaaggaattagaacttgttgcaagcaaaaatcaaagtcaaaatccaattccattagataaagaaaaggagaaaacaacaagctcaacaagctcttctaagttaattgacttggatattgatgtgaagattatgggttgggatgctatgattaggattcaatgcagcaagaagaatcaccctgcggcgaagttgatggcggcgttgaaagaattagaccttgatgtgaatcatgctagtgtgtctgttgtgaatgatttgatgattcaaca

SEQ ID NO: 7326 - DNA, 768 bp, Medicago truncatula
  Predicted polypeptide sequence is orthologous to G584, G1136
cattgcatttctctgaagcaacgacaactcttaagtaatggggaccttatccaccttaaggccaccggtgcggccatcacaaccaccacaatcagccaccggattcaaccaagacactctccaacaacgtcttcaagctttaattgaaggcgtaaaagaaatctggacctacgctatcttctggcaaccttcttatgactattcaggttcttcgttactcggttggggtgacggatactataaaggcgaagaagacaaaacaaaagtgaagaaatcaatagttacttcacctgctgaacaagaacaccgaagaaaagttctcagagaactttattcattaatctccggtaatccagttacggaagaatctcctgttgatgaagaagttactgatatggagtggttctttttagtttccatgactcagtcttttgttaacgacggtggacttcctggacaagcttatttcaactcaactccggtgtggctggttggcggtgagaatcttgtcctctcgcactgcgagagggcgagacaaggtcaagaacacggtttagagacgctggtgtgtgtaccgtcagcgaacggcgttttagagcttggatcgaccgaattgatttatcaaaacaatgatttcatggataaagtgaagatgttattggatttcaataatgattttgattttggatcttcttcgcatagttctttctacatagctcatcaaggtgagaaatgtactgggccataggctatatgttgtatgataac

SEQ ID NO: 7327 - DNA, 794 bp, Medicago truncatula
  Predicted polypeptide sequence is orthologous to G584, G1136
taataatattcagaattttcaccaagttacccatttatgagaatgatacatacacatatatacacacacaggcacgcatgcacaatcttacagataaaaaaatacacttagtttttacttactgcatcaaagctaactctatctatatatgacagtaagaaaactgactctagcaaattctagttctagttcccaataaccatataacttcccaaattaaattacctcaaaactcgtactaagctaccaaaaacaaagaaactaccagtttacagagatagctaccaggaatccataaaatatcccatgccccaaaattttggaggaatgagaaattcacagatataacattcccaattaatgtctcattattacagcaaatttgcagactttattgaacatccccgactttagaggacaatgccgctcgaagctgctcctgagtgtaaaaacgactccccattttcacggttgcttgttgtatcatcaaatcatttaccacagacacactggcatggtgcacttctaggtcaagctccattaacgctgccattaacctcgctgcagggtggtttttcttactgcattggacccttatcattgcatcccaacctataatcttcacgtcgatatctaaatcgattagagcttgattcgaagagggtttattcggtattggctggtgttgttgctgctggtgtggtggctgatgagactggttttcgttgattttctgaattcattcctcatcccatcaagttgctttttctatcccatcttatcagaatcagttt

SEQ ID NO: 7328 - DNA, 765 bp, Medicago truncatula
  Predicted polypeptide sequence is orthologous to G590
ggcttctaggagttcttcaaaaagaagtagagcagctgaagttcataatttgtcagaaaagagaagaaggagtaggatcaatgagaaaatgaaagctttacaaaatctaattccaaattctaacaagactgataaagcttcaatgctagatgaagctattgaataccttaaacagcttcagctccaagtacagatgctgtcattgagaaatggattgagtttgcatcctatgtactttcatgaaggcttgcattctctgcctttgtctcggatgagtacggagttgagtgaaggaaacggttctaatcctttaaatatgacatctactctgcctcatccccaagacaaccccttgctctatccatcaaatctaccaaacaaaaacacattgccgagtcagccatcaatgtcttcctatccttcatatattaacgacacggaaacttctttcggggtggaatctggaatcccagcacagaaagaacgtcttcaacgatcttcagagccaatgcacggcgaagacttgttgcagcaccagcaattgaatgcaataaattcttttaccaatctattaggtggttctcaagttgtcaaagaatttcagtcgggcgcaatggctacatctactactaacaatactttgcaaacttgtgtcgctggaagagatcagtcaggagtggtcatgagaaatagcgagcccaacattatatttacatcgcagttaagtaggtaaatggtatatgatgcacgccaagattagatgac

SEQ ID NO: 7329 - DNA, 677 bp, Medicago truncatula
  misc_feature (570)..(570): n is a, c, g, or t
  misc_feature (639)..(639): n is a, c, g, or t
  Predicted polypeptide sequence is orthologous to G591, G793
aagaacaaaaagctgaaaaagcttacaccaccactctcttctctttctcttctctccttcttctttctcactcacttgttttagtttattgatttcttccataatcaatcttctaattaagctacaaaacaaaacaagacattcttgggaagcatacccttaaattctattccattttcaggtcctagggtttcacacacaccacgtaaggaaaacatctctccttgtttcctgctttttgtgttttccattttcacacttgacaatagaacaaatgctgcagtattgaaaaaggttacactaccactacacaaaactaataacctagctgaaaaaagaaaagaatcttagacatggctggtaattgttcagaaggattaggtgatgatttctttgagcagatcttagcagtgcctgagaacggagttggatatggaggagtgttgcaattagggtccacacctcatggtggttctttgagaggaggaggaggaggaataatgccattagggttgaatttggagcaaaatcatcatgggtttctcaggcagcatcaagatggaacacggnttgttgataacgttgttgatgttgaaggaaatattaccaataacacaacaacaaccatcatcatcttcntctacatgatatcaataatcattaccaccacaacattt

SEQ ID NO: 7330 - DNA, 679 bp, Medicago truncatula
  Predicted polypeptide sequence is orthologous to G591, G793
ggctgaactcaaacaccattttcaactagtcactcagaaactaatgacaacaacaaactgagtagaaaataagcagagagaaaacaacaactacaaattttcttttcttttcagttatggcgaatcatccttccgatacacccgccgacgatttccttgaacaaattctcggtctcccgaatttcacctccgccgacggaaccgacgcttctccgatgatgctgcaacttaactccggcgacgcggcctctcaccttggcgccggaggggggtttcatgcaccggtttatcatttgggtttgagcttggaccagggtaaaggaggagggtttttgaagcctgatgaagcttccgggagtgggaagcgtttccgggaggatcttgttgatacaagacctaagaatacttttcatggacaacccatgcctactacagttcctgctgctccacaaccaccagcaatgcgtcctagagtgcgggcaagaagaggacaggctacagatccccatagcatcgctgaaaggttgcgcagagaaagaatagctgaaagaatcagggctttgcaagaacttgttcctagtgtcaacaagactgatcgagctgccatgctagatgaaattgtggattatgtcaaattcttaaggcttcaagtgaagggtttgagcatgagtagattggg

SEQ ID NO: 7331 - DNA, 745 bp, Medicago truncatula
  Predicted polypeptide sequence is orthologous to G592
tgcttcgttttcgttcaagtttcaaaccaacaaggtgaaggttgtggtggtagtgcaactgctgctacaaattctggtgaaacttcttcatctacctttagagaattcatggaccataacccttctaatcataaagttgacaacaacgagtcttcattatcacaaagacacatgaattctcagcagggttatagaatggatcaacacaaaggtttttataccaatcttttaagacaaagtagttctcatgatggtcatttctccaacaacaacatcatctcctttggaaatgggtatgaacctatgaaaggtgttgaaaactatgatggggtgaaggacagtgatggtgaacttactctatctatgaacatattaaacaatcaaattggcttctcaccaagaactccttcttccttcagaatgttatcacagaaccctaaaactgggagtgatggtattggaacaactagccacgatgatcgaagacaagtaggtagcaatgacgacgctcaatattatggtcataaactcgtttatgattctaatgaccagaatgtaggggtacgaaatcaagttgatacactatcacattcacttgagtttgccaagaaaatcatcagaaatgtgtttgttgtggagaaaattgcttcagtttccagaattctgttcctaagcagtatcagagcaaagagaggctttgcaacacatcctagaagccttgccgaaaggggtaagaagaactcgg

SEQ ID NO: 7332 - DNA, 448 bp, Medicago truncatula
  Predicted polypeptide sequence is orthologous to G592
gttggacttggctgtggattacatcaaagaccttcaaaagcaagctcagaagcttcaagattgtcaagcaaagtgtacggtgcccacacaagcagcagcaacaacaataacggcaaagagtgaattaattaattagtccaatgtacagatttgtaataatttggtatcaccaagtttaaaaaatctagctagattagcttttatttgttaatgcacttaattccaaagataaattcattcagcccttgatgtacataatgaagataaatttgtagggttgcacttgttcaacaattatgagagaactagctggggaagaaaagtgggttattataaattaagttgagtgtaattgagggtgtacaaaaagtccatgtggtaagtagatgcaatttaagcatttattaggacccatatttggtgatgaaaaaaaaaaaaaaaaaaaaaa

SEQ ID NO: 7333 - DNA, 715 bp, Medicago truncatula
  Predicted polypeptide sequence is orthologous to G592
ctaatagtaatactcatcatcaactcaaacaacagaaccaatcatattcttctgggttgcttcgttttcgttctgcacctagttcacttttttcaaatcttacaccttctgctgattctaataaacttactaaacatttttgggatggttctgaatcagagagattcgtgagtaatgataataataatatttctggtttatcttgttctaaggaaatgaattctggttatggtgctggtggttctggtttgccacctcattatcctagacatggttctacttctacttcaagttctgctatggatggttcttttggattggttggttcattgggaatggatcaagaaacattacatgataagagttttggttcaaatcttcttagacagggtagttcccctgctggtcttttctccaacatttcctttcaaaatgggttttctaccatgaaaggcgttggaaactatgccacggtaattggtagtaacggggaacttagtccgtctattaaccgattgaacactcagcttagcttcccttcaagaaatgcttcttccttaggaatattgtcacatatatcagaaatagataacgaggacattgaagcaactagccctgatgacggaggtagcaatgccgattctactcactatggctctggattcccctatagttcttggaacgatactcaatcattcacagaaaatctcagtgg

SEQ ID NO: 7334 - DNA, 607 bp, Medicago truncatula
  Predicted polypeptide sequence is orthologous to G598
accatttccattcactaacaacctcaaaacacacacactatcactataccatgcttgaatgaaatctcttcactttgttgtttcataacaaactttccctccgtactattgagattgtacacatgttgaataataatctaaatacttccaccagccatatatcagaggaaaaccaagaagatgaacaaataacagaaataagagaaatccatgccttaacaccacctcgtcttccacctcctccaccaccaaccaaccgcggcagccatagccaccgttcatcatctctatccatggctagcacagatagtgaaaacttcacaactataagcagagaattcaatgctctagttctagcaggatcaactgttgaccacaacaacataagtcctcatgaacatgaaacagctaacaacaacaataacaataacagcaacaatttgaggaggattagagaagatgatcatatgatggaagaaaccaatcctttggcgattgtggtagataacagcccttttgatcctattccatctcctactagcagaagaaatatggctagtggaagttcacgtgcaagtggtcaaggtggtagtgaagaacatgtgtc

SEQ ID NO: 7335 - DNA, 744 bp, Medicago truncatula
  Predicted polypeptide sequence is orthologous to G600, G2768
gttgcagtaaaccaattccaccgtcttcagcaagcgattatcatcaaaaccgtcaccgttcagaacggccatcgccagattcatcccaccgtgaagttgaaccaccgcgtccaaccaaaagaaaatcagatcactctgaacgcgaacgcgaagacagagatcgagactacgactaccatgaccgtcaccaggatcgcgactacgagcacgaccgtcaccagcaccgccgtcatcaccaccgaacagaagcgtcgtccaagaaatcaacagatccagtcaccaaatccacatctaggaagtcatcggaaccagatatcaaatccaagtccagaaaatcatctgaaccagtgactaaatccttatctttatcaaagacagcacaaactacatcggcggaagcagcggccgccgcagctgcagatcggaagcagaaggcgagtgtcttctcacggataagctttccttctgaggaagaagctgctgctgctgctaaaaagagaaagttgagcgctagttctacaactgaagcatccaccgccgctaccgccagtgtctctgcgaaagctccttccactacgcatctgtctaacggagggaggaagagcaaagctgttatggatgattatgaatctagcgatgacgacgaggatgacgagaggcattttaaacggaggccgtcaaggtatgagccgtctccaccgccgccggtggatgattgggtgggaggaaaggaagacactctag

SEQ ID NO: 7336 - DNA, 695 bp, Medicago truncatula
  misc_feature (454)..(454): n is a, c, g, or t
  misc_feature (590)..(590): n is a, c, g, or t
  Predicted polypeptide sequence is orthologous to G602
ctttctttctctctctgtctcttaaacattttgtgtctgaaccaaactcataacctatggctgaactccaaaccaagcaagaagcagttcctgctccggcaccggcaccggcaccggttccaactccagttcctgctgctgttgagccacctctagctgaggctcctccggttaatgttgttgaaaagaaagcggtggcaccaccacccgtggcagatgacacaaaggcacttgttgttgtggataatgagaagataccagaacctgtaaaaaagaatgcatcccttgatagagatattgctcttgcagaaatagggaaagagaaaaggttatctaatgtgaaggcatgggaagacagtgaaaaaaccaaagcagagaataaggcacaaaagcagctctctacagttgctgcttgggaaaacagcaagaaagcagctcttgaagctcaactcanaaaaattgaggagcaattggagaaaaagaaagcagaatatggtgagaaaatcaagaacaaggtggcaatggttcacaaacaagcagaggagaagagagcaattgttgaagcacaacgtgctgaagcaattctcaanggcagaggaaatagctgcaaaacacaatgcaacaggaactgttccaaagaactccttggatgcttttaatataatgtcataccaattatgaaattttgtctatat

SEQ ID NO: 7337 - DNA, 758 bp, Medicago truncatula
  Predicted polypeptide sequence is orthologous to G616
gctttgtctaaatctggttgtagtagcacttctgagacaagtaaaggttctggtttgtctctttcaagatctgatgttcgtgtgagccgtgtcaaagctagagaaagagcaagagaaagaactgctaaggagaaggacaaagagattaatcatgaatctcacaatactcatcaacagcatcacaacaatgtgacctcttccatttctcaaacagcttcattcactgaactacttacttgtggaatcaacaatactgttactaccacaaatagtccaagagggtcagctgaagaacctagttttttcaacaaagctagacagcaacagcagcagcagcagcaatggaattcttcagcaccaatggatcattactttagtcaagtatttccaggatcttcatcatcaagggcacatcatcatcatcatctattaggacattcacttcatgatcatcaatcaatgacaatgtctaattcagtttcaccattcagtactagtggtgagaatcattctcaagatcagcatcagcatcatttgcagcatccattttcattcataccagatcatatgatgcaaaatgtggttacttcttcttctactcaaccaagcgggaacaacaatgattataatctgaatttcacaatctcttcgggccttgctggttataatagggggacccttcagtccaattcaccgtctcttttgtctcatcttcaaaggtttgcagtttcacctttagatggatccaacaatctacc

SEQ ID NO: 7338 - DNA, 828 bp, Medicago truncatula
  Predicted polypeptide sequence is orthologous to G629
gaaagaggtaatcaaatcaatacataacataacataacataacataacagctttgaactattggaaaacaagttgcttgtgttgtgctctttctatgatcggaccaattagtttgtctatagaacatggatccttcatcatcttctcaatttgtttcctcaagaaatattggtgtatatgatcctatacaccaatttactatatgggaagaacatttcaagagtaatggtgattcaagtgtatatgaacctgaaatgaagttaaataatcagtcagaggatgcttcttttggaatattgggaacatctatcaagtatgaccaccaagaagctaacaaagttactaataaggtaagatttgtattgctacttgcttggtatcatggtgagtttgtcaaaatcacagtgagctatcgtgattttgcaaaagctacactgtgtcgcttcaacataatcaaggtaccatattaattttgttcaacccaccgtcatatcaaacatgtatggactattttctacacggggacccctagatacttactgcatgtgcaatgttaagttcaacttgatacttttgaaagaaaaaaaacttcaatcacattaatccattttggaaaagttgaccaatccaaaaggactaatgcgataaattttttactttcagagaccattttgaatttttgttaatgaaggaaccgaattgctcaatcagtatttcatgaactaaattgacgattcatcccattctttccttatgcctcaaactttgtagagtgacatcgaaaagcattttagaaccacattttggactcactttgcactgcagatt

SEQ ID NO: 7339 - DNA, 457 bp, Medicago truncatula
  Predicted polypeptide sequence is orthologous to G635
gatgaaagactaagaattgcattagacggcatcattgtagttagcatggaagtatgtcgcgctcaaagtttagacagttcggttgaaaaccccttaaaaggaaagataagaattaccacaagatgcctatggcttgacaaagggaagctgttggacgcactccataaagctgctcatgcttctctttcaagctgccctgtaaactgcccactggctcacatggaaaagactgtgtctgagatgttgaggaaaatggtgaggaagtatagtggcaaacgacctgaagttattgccgtcgctatagaaaatcctggagctgttcttgctactgagataaacacgaagttatctggaaaatcctatgtaggtgggatatcaacatttagaaatgtggtgcataaagaaaatcaatccaccaaaatgcaaatgagaggagatcaaaaaaaaaaaaaaaaaa

SEQ ID NO: 7340 - DNA, 803 bp, Medicago truncatula
  Predicted polypeptide sequence is orthologous to G643
ttcttcatacaaacccccctagatgacggaaaacacacgtgacgccgtcggaagccgacgcacacgatcacaagcagcaccagaatggaccctcaccgaatccctcatcctcctcaacgaaatcgccgccgtcgaagccgattgttccgtcaatttctcatcttaccaacaatgggacatcatttcccaaaactgcgccgccttggacgtcgatcggaacttggctcagtgtcgtcggaaatggcgatctctacttgccgaatacgaagaagtgagaaggagaagaagagcgtggaatttggatcgtgaattgtttgatgctgttgagagagttgtgaaagggagagaagaaagaggggaagttgatagagagagtgatggtgaattggggaatgaggaaagggatgttactgttgaaattgatatgattggaactggcttcaaaagaaaaaggcctcgaagtaaagttgagagaaattctgttcagaagcctaagaaatactggccagtggagccttcagaaaatctcaaagaaaaacaggttcctgaggaaattcacgaagaagtgcctgagaataatcatatggaaagagagtttttgaaagacttcctagaaaagaaaccaaagttgaaatctcctgcaaaaaggcgtcaaaagcacatagagacgccactgcagaatctacctgaagtagacaaacacatgacatttgaaagccgagccggcaagtgtaggaacatttacaatacagcagggagaaaacgaggaatgttgactttgaatttgcagagttagcatagag

SEQ ID NO: 7341 - DNA, 817 bp, Medicago truncatula
  Predicted polypeptide sequence is orthologous to G646
gaaaacaatcctcacattactcaaattaataccaaaggcattaattgtatacaaaacaaagtaaaatcatcactactaaagaaaataaattttaggtagaaatattagagacgaaaaaaatatataaactcgtctctagttttaacgtctcaaatatttaagatgaaattagagacgaatttcatatttttctctctttaatttttcgacgcaaatccagttttttcgagtagtgcatgtgcattgatcctattgttagttttgaacaacttaagacaaatgatacctattaaaggagtaaaaaataatagagaaataaagaagataatgcatgatgtttatctcactttccttgtccttcaactcctttctcttaattaattaccatgatccttcacccatcattccattccaatatccagttgaatttccttgttgatctttattgtgttccacttcaacaccacttgtagaaagctgtttattattaacattaacatctccaaatgggaacaaaagtcttccaccaccaccaccaccaccttcttgaacttgaacatgatcatatgatctatttccattaattccatcaattgaaaatccaagactaggtttaacttcttgcatggtgaatccagatggataaatagcatttgagtttggcaaccctaaattattgttattagcataagggttcatgcctctagatgccatgcttgacctaagtaggtcaagagctgaagaagatgattcattattgttatgcatctcaacatatgaagatggcataccatgattatgatgatagttttccata

SEQ ID NO: 7342 - DNA, 369 bp, Medicago truncatula
  Predicted polypeptide sequence is orthologous to G652, G1335
agcgcagctttgaaaagagggttttagggtttgtgaaaaattcaattcaattcatcatgagtgggtcaaaattaacctgggaaggtgaaatggttcaatgatcagaaggggtttggattcatcacccctgatgatggtagtgaggagttgtttgttcaccaatctcagatccagactgatggattccgttctcttgctgaaggtgaatctgttgagtatcagattgagtctgataacgatggaagatccaaggctgttagtgtgactggtcctgatggtgcttctgttcagggatcgagacgcggtggtggcggcggtggtggttatgagcgtggtggaggtggttatggtggaggcggtggtggttat

SEQ ID NO: 7343 - DNA, 683 bp, Medicago truncatula
  Predicted polypeptide sequence is orthologous to G653
agaaaatgcaatgaaaattacatcatgaaattggaaagatacattttgcaagtcaatctctcatgtcagtactgaatgtgcactggataaataaatcacacaagatttgcacaccacacatgtataagtaaacatcagaaaaatgacaagtaatgatggaacaattatgaaggaaaaagaaaaccacacatacaacaaacacttgcttgaaagatcaaaataccctcttctttcaaaacagaacaaaggcaattagaaggcaccaacattcaagattctggaacggaggctgctgcacgtttgattgatgcagacttgataagatgattgtagctccctttctccttaaaaagctgagagaaatggtgcttgcaatacaaaatgccctcaagggctgcataatttgatggagttataggacaaccaccgtgtgaacacttgaaacatgatttgtgataggcctggctttctactgtcaccttctccaatggataagcagttttgccacatgtagcacacttttcttgggtcccagaaaacatgcccgcagctttgctaggggtccttgtcagcacaggggttgtaccgtcagctacctttgcagctgttcaaaataatactatagccggttaaagagggcactgactgaaaaattttacaaaatagctttattatccctgatg

SEQ ID NO: 7344 - DNA, 848 bp, Medicago truncatula
  Predicted polypeptide sequence is orthologous to G670
gtgtgcctatccaggtaaagaagagaagcaatattggaccgtcttttttgaacatgacctatatcctgggaaaaaaaatgagtttgggcattcaaaaacattcagatattcaaccgtcacaatcacatacacaagtatcagtcaaaaaagcaagtcaatcatttggtactcgcaaatggcttcgaaaaacaactgaaaaagtgaatcaaccttttggagttctcacatgggttgacaaagcaaccaaaacacaaactaaaaatagaaatcaaccttttgaaacacgtacattgattgataaatcaaatcaaccttttggatttttttcatggaccgagaaagaaactgaagcagactctaaaaaagcaaatccagcttttgaagcacatacattgattgataaaacaaatcaaccttttgggtttttctcttggaccgagaaagaaattgaagcggaaacgaaaaacacaaatcaacattttgaaacacctacatggaatgataaaacaagtcaaccttttggatttttttcatggaccgagaaagcaaccgaatctgaaggagagattgaaaaagcaaatgaaccttttgaaacacgtacatggaatgataaaacaaatcaaccttttgggttttttctcttggaccgagaaagaaattgaagcggacacgaaaaacacaaaccaacattttgaaacacctgcatggaatgataaaacaagtcaaccttttggatttttttcatggaccgagaaagcaaccgaagctgaaggagagatgaaaaagcaaatgaaccttttgaaacacgtacatggaatgataaaaccagtcaaccacttcctgctcac

SEQ ID NO: 7345 - DNA, 799 bp, Medicago truncatula
  Predicted polypeptide sequence is orthologous to G715, G1646
agcagatgatgatcaaatatgtttcacatattgcatagaaggatcattgttcgattttaaattttgtacatacgtagttaaatcatgttgttgatcatcaagttaaaaggttcttgatggcatcccatacaaatttagttaacaaaatcatttctaaattgcaagcaataaaaaaattccaagaaacattgcagaagtccagcatctttttaagtcttgacagtccatcggcagcagcgcggtcactcagctctggccatcgccattgtgctgaccactgccaacaccgccaccaccagcataagaaccatcatccgcgcccgtctgccaaacagactgccaagcctgagaaggcggctgaacataaacaccggtagcgggatcaacagccggacgaccaatcatcattccagcaggttgtcccataggaggataataataaggaacaccactagcagcagcaccaacaatagcagcagcaccttcatctttaatctcatctctcggaacaatatcaaccaaaaaatcaaaaatatcagtcctagtaatagcagcagcaatatcatttttctgaagagttcgtcgtttattctcttcagcatgaagccaagaacgaatggtgagttcaagaatgaaaagctcacaagctttagcaaagagaattggtgcttctgcagaaatcatgcgaacgtcttcatcagctttcatgattttcttaatgcgtgctaatggaaagtgatggtttttgaagtcattgacgtgttcgatttcttgacgttggtaagacaaaacatttgaa

SEQ ID NO: 7346 - DNA, 722 bp, Medicago truncatula
  Predicted polypeptide sequence is orthologous to G720
ggggccattctggttatcccgtgtggcagcctacagaaagttggcattggaaaccatttccggggatgcatccagatgcatggggctgcccggtgttacctccacctcaacctccttgctattcctactctcaggatatacctgcagtgagtaacgctaatgcaatggactacacatttagcatgatgctacatagttcctttgacgattatccggcagaggaggttattgacaatgttgtgaaggaggcaataagtaagccatggctacctttgccaataggcctcaaacctccttccacggatagtgtgttggctgagctttcaagacaaggcatttccagcatccctccaagctacaatggttctattccctattgacatttacaaccaaaaactggttctgatggtgacaaacttctatacaaaaagggtccactagatcatgaccccattgttatttttttagtttctcaaatttatcaagttccaagtagtaaattgaccgggaataggagaatggggaccattttgttaagtcatattaggttcccccctcccacatcacaccaccaacaaccacttcatacaataccttgatgcaacaaccaagtagaagtcatgcagcactgacacttgacgtgtccggtgtccgacaccaacatatgtgtccaatgtcaacgtgtttgtgtcagcatcgtgtatgatgtttgtggttgtcta

SEQ ID NO: 7347 - DNA, 613 bp, Medicago truncatula
  Predicted polypeptide sequence is orthologous to G720
gaataaacaagccatggctacctttacctataggcctcaaacctccttcaatggatagtgtgttggatgaactttccaaacaaggcattccttttagcaagaagagcaagggctctagaccatgctgacttgtccatgactcaaatgggtcccaccaaacagtgctagttactgttgatggtggtggacagacaaacttgctggcagacatgcatgggccaatgccatatggactgttgtaataatcttgtatctctcaattttaccctcttaggctccaaccaaccagaatggtagattagattaagttgggaccagttatttttcccctgtggtccctaccataacacagacaccttatgtagcttctgggaaatgacatacaatgatgcatgcaacaaatggacatgacatacatggatgatgatggatgatatctattgcaacttgctaaaaccaaaaaaataaataaataattggtagctgaaaaatggccacacatttgttgaattgaatgaagctattgtgcaaaaatgttgcatgtggttgaaaataagttcagatacaaaatattgatggagattgtgaccatcaattgaagtttgtacctatc

SEQ ID NO: 7348 - DNA, 716 bp, Medicago truncatula
  misc_feature (698)..(698): n is a, c, g, or t
  Predicted polypeptide sequence is orthologous to G720
ggaagattacttgatgatggggattgccaagagcagactaattgctccacggaaaaagaaagtggggaacatgatggagaatctaaatctgtcgaaattacatgtgaaaatttgaatgctgaaagtattactcaacaaacgaaatctgaagctactttggttcagaaggaagaggaggaatttgccgacgcttctaagtgtgagagtgttgtttcaccacagttaccaaatgtgaaggttctaaacaacagtgaaagtaatacaacgtctgcaaacaaagtagttgttcgtagtcataaatgtgaaataaaagctaatcggaagaagatgaaagtagactggacgccggagctgcacaaaaaatttgtgaaggcagtggagcaactaggcattgatcacgctattccttctcgaatattggatctaatgaaagtggagggattgacaaggcataatgtggcaagccatcttcagaaatttagaatgcataagagacatatcttgccgaagcaagaagatcggaaatggctaaatccaagggatccaactcaaaggaactattgtcttcaaagaccaattatgcccggtcctccatcatattattctaaccatacccttcctcctctagctcctttatatcccatgtggggacaatctggaactcaaccgctggcatgcaggtttggggccattctggntatcccgggtggcaacct

SEQ ID NO: 7349 - DNA, 772 bp, Medicago truncatula
  Predicted polypeptide sequence is orthologous to G720
agaagattttgccaagggttccaagggtgagggtggtgcttcattgaatccacttaataaaaattttctcggcgacgctggtggcaatacatctctgaataaaacaagggtttttaacgatccgtgtgagaataaagctaatcggaagaagatgaaagtagactggacagctgagctgcacaaaaaatttgtgaaggcagtggaacaactaggtattgatcaagccattccttctcgtatattggagttaatgaaagtcgacggtttgacaaggcataatgtggcaagccatcttcagaaatatagaatgcacaagagacagatcatccacacggacgaagatcgaaaatggccaaatcgaagagatcctgcaaaggaactattgtatgcaaagaccgattatggcttatccaccatatcattctaatcacacctttcctccagctcctgcatatcccatgtggggccaacatggaagtcaaacagctggtgtaccgatttggagtcctccgggttatcctctatggcagcctacagaaagttggcattggaagccatatccgccaggggtgcatgtggatgcatggggtaacccaatgttgcgcccacctcaaactcactgtattccatacactcaaaatatggctgggatgcacaatgctaaagcagtggattatagttatccggcagaagaagtggtggacaaggctgtgaagggaggcataaacagccatggctacctttacctataggccctcaacctcttcaatgg

SEQ ID NO: 7350 - DNA, 664 bp, Medicago truncatula
  misc_feature (643)..(643): n is a, c, g, or t
  misc_feature (650)..(650): n is a, c, g, or t
  misc_feature (655)..(655): n is a, c, g, or t
  Predicted polypeptide sequence is orthologous to G728
tttgactttagcctctgttccaaaaaccgtttctcatttcctcaacaacgttgttcaaaccaaagacatgtctcagaaactttcaatgcttgatgacttagttcatagcttggaagaagaaatgaagaaagttcttgctttcaaacgtgaactccctctttccatactcctccttaatgatgctatagcaagattgaatgatgaaaaagaaaaagttaggttgatgaaaatggatgatttgaaagaaaactgtgataataagaagaattggatgagttcagctcagctatggactaatgaaacaaaatcgaagaatgaaggtgatgatgataggactgtgttacataagggtaatggtgggagaggtatttatgggatttactgaaaatttgttgaaggaggtttcacaagctaagagctttagtttggtctctgaagtgagtcatggaaattccaagagtggtggtggaagttccggatcgtctttgttgcgtgttgagatacagaatcaacctcagccgccgcaacctttgcagcagagttccaggaaacaaaggaggtgctggtcgtcggagcttcatcgccgatttgttgatgcacttcaacagcttggtggagcacatgccactcctaaacaaattanggaaaanatgcnagtggatgg

SEQ ID NO: 7351 - DNA, 841 bp, Medicago truncatula
  Predicted polypeptide sequence is orthologous to G732
aaaacttataatataataataatctaatataaaatgaaagcaattgacaatttgacattacaactaaacaaaaatataaaaatactagagacaagacaagcaggggttgttacatgttacaatcaactagctagcacacagaagcaaccaaaagccgttgatacataatttgtcatcaaaattattcaccaatcaatacattaacatatgatccgaagaagccatgattggttgttgattaacaggaaaagtgttccatgtgtccgagaatccacaatcattgaacaattgatctgtctcctgaaagagtgagttacttgattcaatgtaatgaataatatcattaagtgattgcaacctgtggctaagttcagccatttgaaccctaagaatagcattttcagattccacgttcagatacatctgagtagttactccaacgtttgtgcttatttgaatattctcttttttcagctgttcaatttggttgcttagatcttccatatgttgttgtttcttcatccttgatcttcgtgctgattctctgttggattgcattctcttcctcttcttttgatctgttatgttcacctgcacgtgattatgatctccctctgatccagagttttgaagagagcttgtgccagatgaataagttccaccagaagaagccatatcaattgcagttcccgatgtgtttgttaaaaactaaaaaactttgatgtgatcgtgggtatagtactatttttctaactatgtagtttaaattgatatgttgatagaattaatgaactaatttgtattgaaagaaagatatagattatttataattcctgagaaa

SEQ ID NO: 7352 - DNA, 813 bp, Medicago truncatula
  Predicted polypeptide sequence is orthologous to G735
gatagggtattctcagtggacgaaatccccgaccatctatggtcaccgcagattcatgtctccggcagcgccggcgatgaatcctccaagatgagtcgcagcgcttccgaatgggcgttccaacgctttttgcaagaagctgcctcaccttctccttcttcttcgtctgttgctgataacaccggttttgccgatgctgcagcaaaagacggtgccgttttgcccaatggaccacctccggtggccgtggattccgatgaatatcgggcttttctgaagagtaagctgaatctcgcctgtgctgccgttgccatgaccaggggatctttgactaaatctcaagacctagccacttttcctgagaatggaccacagtcctctaatgctactcaagttggatctcagcccatttctgaaggatctggtccttctggaaacgatccacctatattacaagataaggatgccaaggtaccacctgcggtcccttccataccacatgtgcagaaaaaaaccattgttgcaattaggccatcaacaagtggatcatcaagagaacagtctgatgatgacgaagccgagggagagacatatatgattgacagcacagaccctactgacgtaaaacgagtaaggaggatgctttccaatagagagtcagccagacgctcaagaagaagaaagcaggctcatttaactgagttggaaacacaggtttcacaattaagaggtgaaaattctaccttggtaaagcgtcttactgatgtgaaccaaaagtacactgattctgctgttgacacagagtactgaaag

SEQ ID NO: 7353 - DNA, 841 bp, Medicago truncatula
  Predicted polypeptide sequence is orthologous to G735
ttggttggacctcgaagcgtgcaagggaggagacacaaagatgaatcggagtgattcagaatgggctttccaaaagtttttacgtgaacaagaagctgctgaagaagcagaagctgctactgcaaagccttcttcatcatcaacttcaacttcaacttcttcttccaccgttgatgtcaatctcaaaatcaataatagtattgattcagaggattatcaggctcttctcaagaccaagcttgatcttgcttgcgccgccgtcgctaagtcgaggggatctttggtcaaatctcaggatcctgataatggatcacagccatcttatccttatgaacttggacctctggctacattgaaagaatgtggcccttctggaaatgatccatctaaattacaaaataaagatatcaaagttgctgttggggttccttgcatgccaaagaaaccagctgttacaatcaagtcaacaacaagtggatcatcagacgatgaggaaggtgatggagagattaatatgaatggagacaaccctactgatgcaaaacgagtaagaaggatgctctctaatagggaatcagctagacgctcaagacgaagaaagcaagctcatttaactgagcttgaaacacaggtttctgaattaagaggtgaaaattcttcattgttaaagcgtttaacagatgtgacccaaaaattcaacaattctgctgttgacaacagaatattaaaagctgatgttgaaacattaagagcgaaagtgaagatggctgaagagacagttaaaagatttactggatcgaacccggtgtttaatggcatgtctgaggtatcatcaatggga

SEQ ID NO: 7354 - DNA, 260 bp, Medicago truncatula
  Predicted polypeptide sequence is orthologous to G740
cgtggtgcaatggttcaacaacaccgaaggcttcggattcatcaaacccgatgacgatagggaagatctcttcgttcatcaatctgacatcagatctgaaggatttcgctctctttccgaaggcgatcgcgtcgagttcaccatcgccgatggcgataacggcaaaaccaaagccggtgatgtcaccggtcctaagggtgaacctcttcaggttaggcacgataaccatggtggaggcggcggcggtcgtggatctatag

SEQ ID NO: 7355 - DNA, 854 bp, Medicago truncatula
  Predicted polypeptide sequence is orthologous to G748, G1900
ttaagaagaaaaaaatgattgaaactaaggaccctgaaattaagctctttgggaagaagattctttttcctggggaaggtgaagctcttatgattgatggtgaggaaaatgtttcgcccgcggcggctatggatgtagaagaagaaagagatagtgagtctgagaatgaagatgatgaagaagaaacggagaaggatcctgaagcagataaagatactgaggaaaagaaagaagctgatcctccaccagatgcagcagagatcaagaacaacaacaattcagcagcaacattaccggagggtaacccaaaaacaccttccatagatgaagaaacttcaaaatccgaaaacgaacaaagtgaaacaacagcaaacaacaacgatactcaagagaaaacactaaagaaaccagacaaattactcctgtgtccacgctgcaacagcgcggacacaaagttctgttactacaataattacaacgtcaatcagccgcgctatttctgcaaggcgtgtcaaagatattggactgcaggtggaaccatgagaaatgttccggtgggtgcaggaagaagaaaaaataagaacaactcttcgtcgcattatcgccacatcaccatctctgaggctcttgatgcagcaagaattatttctcctaatggaactcatcatcttcaaaatttgaaaaccaatggtagagttctcaactttgggttggatcatccacatatctatgattcaatgtcaaatgatctcaatcctgcagagaaaaaggttcttaacgacactcgaaataatggtgatcgttttttcagtgcgtcttctgttacagtttcaaaatccatggaggaaagtggt

SEQ ID NO: 7356 - DNA, 760 bp, Medicago truncatula
  Predicted polypeptide sequence is orthologous to G748, G1900
ttttcggtctcatatatatatattttctatatgtacatcaagatatttacccaacatattatcaaatctgcaacagaaacacctgttcagttaggcaggctcaagatagcagctactgaggctaaacagctaaagtacaacactgttgtcctaggactcttgcatggaggttggtcaactatacttccttttgagcataataaagatcaagaacttgtcagcagaataaggttgcattgatatagctacaattctcatagcagtgtaatctgatgtatttcaatgcaattcacaactaggtttcctcatgaaaggtacgagaccgcgataaagccgcagggttggcatacatcagcggtgacgttccaaccgagtgattcatgtcctttcccttggactgaaatccattgaacatgcctcctccattgagagaattggccttgtcattattgatcccaagctttgaccataatgaactctttgcagcttcacttgggtcatcaaatctaagtgtctttgggatcaaaacgctgctttcggtactattgtgttcagtttcaggcttttcttttggtgagttgactgaggtaatgatgtttccatcccttgagtgtttccccaaagtcggtacagaactatgagcagagtcactttcattaacagaagcacttcctggtgagatgcatggtatattccatggaggtggcatacaaccccaatatgcaggtggagttacgggagtatagatgctaatggatag

SEQ ID NO: 7357 - DNA, 703 bp, Medicago truncatula
  Predicted polypeptide sequence is orthologous to G748, G1900
cttaaagagtgccccggagacactcgttaacaagaccccttcctttatcataagaaaataataaagtaaggagctcaagagtgaagagaacaagcttatatttacatgtacatcaactcaaacagaacaagcttagcacataaaataaaaacacctatttatagtgttacacaaaaagagacaaaattagttcccctttcttgtgctgagactaccaaccaaatgcacattggtgagaaagatggtcactgtctcaagagaagaagtgactaacctcaattctcaaacacaatacaaaaaggattatttcttatttaagagttctcatggaaattaagcgatctagctaaagctgcagggttagccatcaacattggagaggtttgaacatggtttttaccatctttctttgattgaaaagccttagtcataccacctctactcaaaccttcattcttaattccaagtgtttcccaaattgaactctttgcagcttcggttggatcatcaattcgcaatgttttaggaaccaaaacacacccatttctttgttttggtgattcttctgtttgcaaactgtcttgtttagcattttcgtcgttggtgttgtcatcgtccctcgagtgtttcccgagcgttggagatttcggactagatcttggagttgtcgcgggagtatgaggcggaaaccaaggaacattcc

SEQ ID NO: 7358 - DNA, 860 bp, Medicago truncatula
  Predicted polypeptide sequence is orthologous to G760
tgtctctctaccaagctcctggattccgattccaccctactgatgaagagatcgtttgtttttatctgaagcggaaactcaccggaaagttaccaccctgttttgatcatcttgctttcatcgatatctacaagtttgaaccatgggatcttcctaatatgtccaagctgaaaactaaggatttggaatggtacttcttcagtgcgctggacaagaagtatggcactggatgcaggacgaatcgtgctactgatcgaggttattggaagactactggaaaggatcgggttatcaaaaacggggaggagacagttggaatgaagaagacccttgtttatcacctgggtcgggccccacatggtaaccgaagcaattgggtcatgcatgagtataggatgattgatgaagaattggccaaaactggagggcaggatgcttatgtgctgtgtaggatcttcgagaagagtggttcagggcctaagaatggggagaagtatggggctccctttgtagaggcagagtggcagaatgttgatgaaccagtcaatcccttgccaccggttgataatcagcttttggaacaagtggctgctcctgctcctgattacgctgaatttttgcaatctttggtggcttttgataacgatcttttgaatgaaagtgtgcctactgctactgatgataattatcttgaaatccttgaccttgaccaggagcttgataccagtgttacagttggaaatgctgatttgccaccaaacttctattatggggagtgtagtagctttcctcagcattcccaatcggaagctgcttttggtatttatgatcatcaggttggtggtctatatggtgtggat

SEQ ID NO: 7359 - DNA, 723 bp, Medicago truncatula
  Predicted polypeptide sequence is orthologous to G760
atccacacaactctttcttcacttgctaagaacttttggtgacaatcatggctgttgatgagaagtatagtgagctagtttcggaagatggtatgaaattacctgttggattcaggtttgatccaactgatcatgagcttgtagattattatctgacgagaaaagtctgtaaccaacctcttccaaatctcttgttagaatttgatgtatttcaaactgagccatggaagctgccaagagataataggacctcttcaaagcatatgaggtactatttctttgatatcaggaaccgtaggttcgagaatatggatgcaagaagagctggaaatggtgaatggagaatatatgagaggaatgaggagtttgctctttcaaacaatcaattgattgggagaaagaacacatttgtttaccggagaatacaaggaaatcaagctctgatgacacaatggaggatgcatgaatttgtcatcggtacaatttttcatcaaactaaggtatactcagctgtaggtgcctatcggatatttaagatgaaggtggcaaaagctgagaagaaggccccaccaactgtgattgatttcacaatggaggatgcaagtgtctctgcccctcctccttctcatgaactcatgtttcattttcttgaatttagaatagttgtaatacatccattattttagtttaaagatttagttgtaacttgtaagtcctatggac

SEQ ID NO: 7360 - DNA, 816 bp, Medicago truncatula
  Predicted polypeptide sequence is orthologous to G760
attctcaaaccctaagtcccaaatttctcatcaatttcaaaaattatctctgttttccatcaaacaatggaagaaaccgctttctaccaaggtcctggattccgattccaccctacggatgaagaaattgttcgttactacctcaagaagaaactcaccggaaatttaccttcttgctttgattatctcgctgtcatcgacatctacaaattcgagccatgggaccttcccaagttgtcgaagctgaagacaagggatttggaatggtacttcttcactgcgctggacaaaaagtatggtaatagtatcaggacgaatcgtgctactgatagaggttactggaagactactggcaaggatcgtgccatcaagaatggagaggagactgttggaatgaagaagacacttgtttatcactcgggtcgggctccgcatggtgatcgaagcaattgggtgatgcatgagtataggatgattgatgagactttagccaaagctggagttcaggatgcttatgtcctgtgtaggatcttcgagaagagtggttcggggcctaagaatggggagaagtacggggctccctttgttgaggaggaatgggagagttttggtgacaagtgctacccttgccgcctgttgataatgaacctttgaaactagaagggtttactcctgatggtgatgaactcgtgaatcccttggcagtttctgtacctgatgatgtactggtggatcccttggatgttttttatgacgagctttggaaatgaaatctgcctgattctacttatgaggacttttttgaaagccatgacc

SEQ ID NO: 7361 - DNA, 810 bp, Medicago truncatula
  Predicted polypeptide sequence is orthologous to G760
tgattcgccagctcgaaattaaccctcctaaagggaacaaaagctggagctccaccgcggtggcggccgctctagaactagtggatcccccgggctgcaggaattcggcacgaggttccttctaaggagtttgctgttgggatgcattccgcagctgagttttccaattcagctcatataactaccggtattattagcattacagacattacttacagtggcaatatgatggattggatggccggcaagaatggaggttttgacaccataatgtctaatgaattttcccaaactgctgctattaactctgctactggcttggtctgtaggaaaactgcatgtatgttatcacatggttgggtttacttgatgggtttctcagttgtgattctttcaatgagtttgaagattggaagcttcatgtatatgggtaaatgagaaatgcaaggttggctatgatacaataatccaggagagagagaactagtctcgagggggggcccggtacccaattcgccctatagtgagtcgtattacaatttacactggccgtacgttttacaacgatacagtgactgggaaaaaccctggcggttacccaacttaatatcgccttgcagcacattcccccttttcagcacaagcctggcgtaattaagcgaaagaggccccgtctaccgtatcgcccttccccaacagtatcgtcacagtccctgtaatgagacaaatggactaaattcagcaagatacagatagaagtatattgagtgtcaaaaatagtcagctttagtaaactcagcttgtgcttaa

SEQ ID NO: 7362 - DNA, 694 bp, Medicago truncatula
  Predicted polypeptide sequence is orthologous to G760
aaaactatcaaggtaaattttgactaatatgtataactaattgttcagtatagctctgtttgcactctgaaaccaaaaaaaataaaaaatatgcaggcgagtaagttacaatgaataatgttaagattggtatgactaaattaccgtaaagaaatctacaaagtcatggaatcctagtcattcaatgaatgccaccaaccgaacgatgcttaactgactggattattctatcgtagccaaacttgcatttgtcatttacccgtatacatgaagcttccgatcttgaaactcagtgaaagaatcacaactgagaaacccatcaagaaaacccaaccatgtgataacataaatgcagttttgctacagaccaagccagaaataggcaccaaagtagcagggttaacatcagtttgggaaaacccagtagacataacggtgttaaaacctccattcttgcccaccatccaatccatcgcattgcctctaaaagtaatgtctgtaatgctgatcatacctgcagttatatgagctgaattggatgactcagctgcagggtgtatctcacaagccaactccttagcaggaaactctgatgcaaatgcaggtggagcaggtatgttggccaacaaatgcttcacaaaagtgtttgcatctcctgagaccaatttgacgctgctagatcctcctttggtaa

SEQ ID NO: 7363 - DNA, 523 bp, Medicago truncatula
  Predicted polypeptide sequence is orthologous to G772, G776
ccaaacctgcaccaaagaaacattttctgtctgcactggtggagttttccctgctagaatcacttgaatcgaagaaggaaaaccacacctcagttcagccggcagattttgacttggcgaatcttgaatcgtgtgtgcctccgagtgttgcaaagtacatcaaatacttgcagagtgagacgcagaagcttggtgttgagaaggagacaatgcggttcgagttgacaagtgctcaaaccatgattaacattctccagtcccgtgttgaaaatctcagcaaagagaacgaggagatgaagatgatgatgagaaatccttaggaattgggagtgatctcattccttgtatgatgatgtaccagttatgtttacagttaattttggatatctatttttttttttcttgagtaagaattctagttcgtttctttgactgaacatgtgaatgacatgcatcattttgaaacatgtttttgtatgttatgtctttcagtttcccattgttaaaaaaaaaaaaaaaaaaa

SEQ ID NO: 7364 - DNA, 650 bp, Medicago truncatula
  misc_feature (555)..(555): n is a, c, g, or t
  misc_feature (583)..(583): n is a, c, g, or t
  misc_feature (595)..(595): n is a, c, g, or t
  misc_feature (612)..(612): n is a, c, g, or t
  misc_feature (617)..(617): n is a, c, g, or t
  misc_feature (643)..(643): n is a, c, g, or t
  Predicted polypeptide sequence is orthologous to G778
gcacgagctaagatcaatattttccactctctctgtctccaaactatgcattctttccttaatatgtgaaaaagagcaaaaacacagttaggaaacacctgttttcatttctttcctaaaatgagtcagtgtgttcctagttgggatgttgatgaaaatccacaaccacctccaagatcagtctctcttcgttccaactctaattcaactaatcctcatgatgttcccatgttagactatgatgttgcagaattgacatgggaaaatggacagatttctatgcatggcttagggttaccgaaagtgccgcataaacatccatcaaccgcaggtacaacaccttccaaggaaacatgggaaaagcctcgtggtagtggtaccttggagtctatagtgaaccaagccacaagctttccgcaccgcggaaaatcaccctttctcgccggtggtggtgtttatggaaacatgttagtcccatggcttgacccacaacgagcggcagccatcgcagccgccacagccgcctccaacggcatggctgtggatgcgtttggntccctgctccaatactactaaggagcanagaacccatgcnatggatccagtccctanatcanggattggatcatgcctggttggcggncatacac

SEQ ID NO: 7365 - DNA, 679 bp, Medicago truncatula
  Predicted polypeptide sequence is orthologous to G782
atggaaattacacctgctagaaagacacagaaggctgatcgagaaaagttaaggagggatagactcaatgaacagtttttagagctgggtaacattttagaccctgataggcctaaaaatgataaagcaactattctaggagatacagttcaattgctgaaggacctttcttctcaagttagtaaactaaaagatgaatatactatgctaaatgaagaatctcgtgagttgtctcaggagaaaaatgatctcagagaagaaaaggcttctcttaaatcagatattgagaatttgaataaccagtatcagctgcaactaaggactatgtatccatggcctgcaatggatcattctgttatgatggctccaccatcatatccgtatccagttccaatgccagtacctgctggttcaattcccatgcagccatacccctactatgctaatcaacatcctgcagtcatccctaacccttgttcaaacatacgttccctttttaagcccccggaatacaattgtttgaacaaaacaatccactcagagtaacgtatccccggcctcttcattccaggtagccgggttcccactgttattgcaagggaaaaaccaagactccaaaaacagaattaatccaagggagaagtaaggctctcaaagaaatgaggattctaatgaattg

SEQ ID NO: 7366 - DNA, 676 bp, Medicago truncatula
  misc_feature (550)..(550): n is a, c, g, or t
  misc_feature (675)..(675): n is a, c, g, or t
  Predicted polypeptide sequence is orthologous to G783
tttctctctcctctgccctaattctaatttcaaattaaattaaaatctctttcattttcatttctcgattccaaatcaaacttcttcatccttcaaccttgattcatacttcaatcaacatattctaattccattccttctgattattcttccacgaaccaggaaaattgttgctgaagaattgaagacagggatagctggttttgttcatatgggatcggagagtgttgctcctatgattgagccatcaaataacaggtctgatcctggtacaatgaagcaagggaaagtccctaagagaattcacaaggccgaaagggagaaaatgaagcgtgaacatttgaacgaactcttccttgatcttgccaatgctcttgatctcagtgagccgaacaatggaaaggcttcaatattgatcgaagcttctagactgctaaaagacttgctctgtcagatccagtccctcaagaaagagaatgtctctttattgtctgaatctcattatgtgaccatggagaaaaatgagctaaaggaggagaatagtagcctnaaaactcaaattgagaagcttcaaggcgagatacaggcaagaatagctcaatctaaacctgacttgaatgcgcctcctcaattagagcttgagtcaccagagcagacaactttttcaggacagant

SEQ ID NO: 7367 - DNA, 696 bp, Medicago truncatula
  Predicted polypeptide sequence is orthologous to G789, G1494
caaggagcttctctgtcaagcttccagctactttctacatcagcaagtcagaaacaaaggagaaaagaaactaaaatctattttgctcagtttaggtactagtttggttcagttcggttcagttagcgatgaacaacaccattcctgattggaattttgggattgatagttttgtcaccaatcaaaagaagcaacctatgggactggaccatgaacttgtggagcttctatggcagaatggtcaagtagtattgaatagccaaacaaataagaaacaacttgtgaataactcaagacaagttcataagaatcttcaatcaacaactttaagcaacttgattcaagatgatgaaactgtttcatggatccaacaataccctattgaggatccacttgaacaagaattatgttcaaatcttttatctgaacttccaccttgtaatgtcgagtctttcaattcgcaaccgacgaatacaaaaccgccttttgttcaggaatttcctatgtcggctccgaggtttcatcaccttgttcccgattcatcgcaaagaaacaatgatttgtgtggatccagcaaggttgtaaacttttctcacttttcaagacatcccaatgttactttagcatctactaacggcgatgcaaatttaagagacaaaattacgggtaatctgtcacaatgtgatgttagagagt

SEQ ID NO: 7368 - DNA, 724 bp, Medicago truncatula
  Predicted polypeptide sequence is orthologous to G789, G1494
tagatcaacttaaaatttaggtcggacctaattgcctctatttataaacatttttttaaatcatatctcatttaatctgagattttcaacagatccaaaaaataagtcacttgtatataaatcaagtgaactatattatctacatacatatatttatagttgagctggcagacatatttttgttgctggttcttctaggaattcctctaaactaattaacccattttgccactcacagcatcattaatgtttgctgttccactcattggtccactgctattgcttggtggaatcattgtttgactattttgtacagcttggggaccatatctgtacatattcattggctgagaagcattttgcataagatgatagcccatgtaacgagcatattgctccgaaagagcaggattttgcatctgattttggtagttgaaggcacctaaaacaggattttggcacgttaatgtctgatttggcgtctgtgacgaagaaacggacagatccagaggcattctcggtaattgcattggattttgaagtggaggaaacgaaggcgtagtcattcccatacccatttgtgacatatagtgctgatatcccggtagcatcattggtgtcatgccagatcccatccacattacctgaaagtgtaactgaagtgatttcaagtattcaattgccctctctaacaatgatggcttgtccgtcttactactgttga

SEQ ID NO: 7369 - DNA, 840 bp, Medicago truncatula
  Predicted polypeptide sequence is orthologous to G791
ataaaacaccggtcagttatccactttgtgccacatgacatcgtctttatccatcttttatataagaaacgaattccctcatactagttagtttactacacttagttataatccgatttgaacctcgagatatgctttagcacacgtagacctcgccacagcgtgcagatcatcgcttggttgattgcacagcagtatgcagagcttttaaaatgctctggagtggatttgggcttgtggcgcagaagtctagttcagagatgggccatgggccctggccaagtcccgaacaagttatttcttaaatttaggtttctatgctttatatttctcaaaataactgataatcatgtgagcaagtatatgactgtatgaaacataattctaaggccgagaagaaagagcttcgtgatgagaaaaataagctgaagctagacaaagaaaagttggaacagcaagtcaaattagcaagtgtacagtccaacttcctctctaatgcaatggctgctaaaggacaaactgctaaccacaagctgatgcctttcattggttatcctggaatttcaatgtggcagtttatgtcacctgctacagttgatacatcacaggatcatctgcttcgacctccagttgcttaaagtggttagcaacagcatccacttccttattgtacaaagttgttagttgaacatcgatttgagacataaaaattcgacaattttttacatggttaacgcagttcgcacatgtggttcatgaagtgttagatttggttaatagatatatcagatgtcagcatgtcgcaatctattaactatctaatggacttcattaatcatg

SEQ ID NO: 7370 - DNA, 730 bp, Medicago truncatula
  Predicted polypeptide sequence is orthologous to G791
ttttccgggaaattcccccactatggtttccccggaaaacaccaattggcttttcgattaccctttgattgatgaaattcctgtttctgttgatggctcctttgccttcacgtggcccccacctcacctctccaatggcggtattgaaatggatgatagctctctagtggattctgatggtatcaaagaacctggttcgaagaagagaggtagatcagattcatgtgctccttccagctctaaggcatgtcgagagaagttgcggagggataggctgaacgacaagtttgttgaattaggctccatcttggagcctggaaggcctcctaaaacagacaaggcggcaattctgattgatgctgtccgaatggtgacacagttgcggggtgaagcccaaaagttgaaagactcaaattcacgtcttcaagagaagattaaagagttaaaggttgagaagaatgaactccgcgatgagaagcagaggcttaaggctgagaaggagaagttggagcagcaggtgaaatcaatgaacacccaacccggtttcttgacacaccctcctgcaatccctgctgcatttgctcatcaaggccaagccccaagcaacaagttaatgcctttcatgagttatccaggagttgccatgtggcaattcatgccaccagccgccgtggatacctcacaggatcatgtactccgtccaccagttgcctaaattggcactgtacaa

SEQ ID NO: 7371 - DNA, 797 bp, Medicago truncatula
  Predicted polypeptide sequence is orthologous to G791
ttaattcataagtattcataagccaaatacaaacggaagccactgggtccagttagaatagatagaaaactaacaaagcaagaaggtattggtgataggatacaatcttgagctaaaatggaagcccggagaattgcacagagccagcttaggcaactggaggacgaagtacatgatcctgtgaggtatccactgcagcaggtggcataaattgccacattgcaactccaggataactaataaagggtaccaatttgttgccatgggcttggccttgtgcagcaaatgccgcagggagtgcagtgggggtaggcaagaaactaggaggtgcattcatagatttcagctgctgctccaacttctctttctctgccttgagcctctgtttctcgtcacggagttcgttcttctcaacctttaactctttaatcttttcttgaagacccgagttggcatctttcaacttttgggcttcaccccttaactgtgtcaccattcggacagcatcaatcaggatggcagccttgtctgttttggcaggccctccaggctccaaaatggagcccaattcaataaacttgtcgttaagcctatctctacgcaacttctcccgacatgctttggagctagtagcagcacatgactcagatctaaccctcttctttgaaccagactctttgagaccgtcagaatcccctaatgagccatcaacttcagcacccattctcatgtcaacagcatcagtccatggaaagttgcactgtttgaagttagacagcgtacccctatctcactaa

SEQ ID NO: 7372 - DNA, 495 bp, Medicago truncatula
  Predicted polypeptide sequence is orthologous to G798
aaaaacgccaaacgctctcgtactaatcatgttgctgtcacttcctcatccgctgtgacttcagcggcgccggagcaccatcattatcagacaatctccgccgtacaaggagggtcttttccattttccggcggtgttgacggtgatggtaaacagaatatgagtgtttgcggaagcttcacttctttgttgaacaacaacaacaacaacaaccaaagctctgggtttcttgcattaggtggatttgggcttgggcttgaagaaatgggatttgggattggaagaacaggttgggcttttccaggaatgatggatggtgttcctgttgtgtcttctggtgttgttggaaacacgtggcagttagaaggtggtgaaggtggttttgttggtgctggtgattgtttctcttggcctggacttgctatttcaacaccagtaaatggtctcaaatgaactcatttttatttcatttttatttattttttttactttttg

SEQ ID NO: 7373 - DNA, 880 bp, Medicago truncatula
  Predicted polypeptide sequence is orthologous to G802
cttcttctgcttctgcttctgcttcttcttctgcacccactcaacacctcattgatgcttctctcgcaattgccaccagatctgaacctcctcttccagatgtatccaacaaccaaattcaaccattttcttcaacttcaaccaccgtcaccgctgttgcaaatcctccaaaacgatccaccaaggacaggcacacaaaagttgatggtcgtggacggagaattcgaatgccggcgacatgtgcagcaagagttttccagttgaccagagaattaggccacaaatcagatggtgaaacaattgagtggcttcttcaacaagctgagccggcgatcattgccgctaccggtaccggaacaatcccagccaatttctcaacgctcaatgtctcactccgtagcagcggctctacactctctgcgccgccttcgaaatcagctcctctcagttttcatagcgcgcttgcactggctcatcttcttcaataggtaattccttttctggacttcttcgaccatcgaatatgttaccggcaacagccatgtgggcaacagcagggagtggaagtacaatttggatggtaccggtgagtggtggtgcagcaacttcaaattcagaaacacagacacaaaacatgtggccttttaatcctcatgtacagtctcaaaatcaaggaaacgctgctgtaactccgtctcagttacatttcatgccaaggttcaatgttccagcttctggtggtgttgaatttcaaggtggacgtggtggtttacaattgggttcagcgtatcaccatcacagcatttgggattggctgtgtctgattccacatgggtatggttgctgctcctaaatgctatatagagctgctcatttcatg

SEQ ID NO: 7374 - DNA, 684 bp, Medicago truncatula
  misc_feature (537)..(537): n is a, c, g, or t
  misc_feature (554)..(554): n is a, c, g, or t
  misc_feature (575)..(575): n is a, c, g, or t
  misc_feature (591)..(591): n is a, c, g, or t
  misc_feature (606)..(606): n is a, c, g, or t
  misc_feature (614)..(614): n is a, c, g, or t
  misc_feature (675)..(675): n is a, c, g, or t
  Predicted polypeptide sequence is orthologous to G805
tttgattacaccaagctcgaaattttccctcactaaagggaacaaaagctggagctccaccgcggtggcggccgctctagaactagtggatcccccgggctgcaggaattcggcacgaggaagtaatggaatccgaagcagacccaatttccctcttcagcttttagagaaaaaagacaacaacatcctagatgtctccgaagaacaaacttgtacaaccaccggaaacgatggctgtactgccataatctcatcagaccagcagaaaaagcctccgccgaagcgagcttcgacgaaagaccggcacacgaaggtagacggacgaggccgccggatccgtatgccggcggcctgtgctgctagagtgttccagctcacgcgtgagctgggacataaatcagacggcgagacgattgagtggctgcttcaacaggcagagccagccgtcatcgccgccaccggaacaggaacaatttccggccaactttacttcacttaatatattctcttaaaagctcaggctcaaccatgtctgcnccgtctcactattttcnaggtaactactttaaccctanctcgttctcctccacngcggcttcagcttanaaaccggnctgaatgggataagaactatgaacatgaacattgaacattgaacatgaacgtttgtagctnatgattcaa

SEQ ID NO: 7375 - DNA, 818 bp, Medicago truncatula
  Predicted polypeptide sequence is orthologous to G831, G1202
gtggggttgcaagttggggagcatatcttttaccacgtgacatattagcagtgtcatttgcaccaagagatacacatgaagctcaagttcaatttgctcttgaacgaggagttccagctttgattggtgttattgcctcaattaggcttccttacccttctagagcctttgacatggctcattgttctcgttgcctaattccttggggccagaatgatggaatttatttaactgaagttgatagagtgctacgtcctggggggtattggattctatcagggccaccaataaattgggagagccattggaaagggtgggagaggactcgtgaggatctcaatgctgaacagacttcaattgagagagtggcaaaaagtctttgttggaaaaaactagttcagaagggtgacattgctatatggcaaaagcctactaatcatattcattgcaaaataacaagaaaggtcttcaagaatagacccttttgtgatgcaaaggatcctgactcagcatggtacaccaaaatggatacatgtttgacaccacttcctgaggtaactgacataaaagaagttagtggtagaggattgtcgaattggcctgagagactaacatcagttccaccaaggattagcagtggaagtttggatggaatcacagctgagatgttcaaagaaaacactgaattatggaagaagagagttgcatactacaagacacttgattatcagctagcagagccggggagataccgtaatttacttgatatgaatgcttacttgggaggatttgcagctgcaatgattgatgatccagtt

SEQ ID NO: 7376 - DNA, 623 bp, Medicago truncatula
  Predicted polypeptide sequence is orthologous to G831, G1202
ctaataaggaaaatatttctcgacctccaacaccagaccagacatacacatccgaaaaaacacaatttttatagtgatctgaaaggatttttccgaacaacttatgtcgttcgaaaaaacactttcaaatatgtaagactttttagaggcaaatggagtaaaaagtagggtcctaaatagtattatcatttgaggcaggagaggtccaatatttcttcacagcaaataaaagtttctccctttcaagaggcccatcttcatggtccacaatttgactctcccattccaagccattgattatgctctttactttgaccaatatatcaacatcatctctaattattacacttccttctggtctaagaatcctatccatctctagcaatatgtcttccaattcacatctgtcattataaaggctaaacacagaatcagcatgaattaggtcataagttctaggataagtagacatagcttcacaccaattatgatacattccaatcaaccctctttcatatattgctccaagtgtatcaactttagcttgaataggaacaacattcataacccaaataggatatttaacaagtgaagctgcaaatccacccaaataagcattcatg

SEQ ID NO: 7377 - DNA, 751 bp, Medicago truncatula
  Predicted polypeptide sequence is orthologous to G831, G1202
ttagaactgctgttgatactggttgtggggttgctagttggggagcctatctactatcacgtgacatattaacagtgtcaattgcaccaagggatactcatgaagcacaagttcaatttgctcttgaaagaggtgttcctgcagttattggtgtttttgcttcaaagagattacctttcccttcaagagcctttgacatggcacattgttctcgttgtcttattccatggcctgaatatgatggactttatctaaatgaagttgatagaattctacgtcctggtgggtattggattctatctggtccaccaattcactggaagagatattggaaaggatgggaaagaacaaaagaagacttgaatgaagagcaaaccaaaattgagaatgtagctaaaagcctttgttggaataaaatagtggagaaaggtgatattgcaatttggcagaaaccaaaaaatcatttagattgcaaattcactcaaaataggcctttttgccaagagcaaaataatcctgacaaagcatggtacacaaacatgcaaacatgtttaaatccactccctaaagtgtccaacaaagaagaaatttcaggtggggaattaaataattggcctcaaagactaaaatcaaccccaccaaggatttcaaaggggaccattaaaagtgtcacacccccaacattctcaaaagacaatcaactatggaacaaaagagtatcatattacaaaaaagttaacaatcaactttg

SEQ ID NO: 7378 - DNA, 768 bp, Medicago truncatula
  Predicted polypeptide sequence is orthologous to G831, G1202
gagggccaaagagactaacttcaattcctccaaggattagtggtgaaagtttgaaaggaataacaccagagatgttcaaagaaaatactgagttatggaaaaagagagaatcatattacaagacccttgattctcagctagcagagactggaagatatagaaatcttcttgatatgaattcttacttgggaggctttgcagctgcactggttgatgatcctgtttgggtcatgaacattgttcctgttgaggctgaaatcaatactcttggtgtcatatatgaacgtggactcattggaacctatcaaaattggtgtgaagccatgtctacttacccacgaacttatgacttcatacatggtgattcagttttcagcctctaccaacacagatgtagtatggagaacattcttctggagatggaccggattttgcgtccgcaaggtagtgtaattttgcgcgacaatgtagatgtgttgacgaaggtgaagagcattgcagatgaaatgcagtgggatgcaaaaattagagaccatgaagaaggaccttatcaaaaagaaaagatacttgtagcagtcaagcaatactggacagctccaccaacagagcaaaactaacacaacaagtattagtttgtttttggtttatgacaaaactttcacaggaattcaattctttcaaacagcaattttttgtttggtgcttataagagaaatttgttcattaagttatggcacctcacatcttgaagcttatcagttatcactc

SEQ ID NO: 7379 - DNA, 731 bp, Medicago truncatula
  Predicted polypeptide sequence is orthologous to G839, G1196
atcattcttggtgccaactatcccctatttctatctttgtataagtcttttataagcttcagggtcaacttgttactgttcctcaagatttgtttctctcacaagcttgctattttgagtggtttcatcttcaatctcaaatcaaagggtgaccatattaagtcaaccaatccattgactcaattgaagcctttgatttacttgaggtcatggataataattcaaatgaagcatcatcatcattgagttttgtatcatctcaattatcaaatgcttcaagtaataatcacaacataacttcctcaaccaacaatgaacatgtggcaatggcaaatactgaaattgtgagtttgaataagctcagtggaagccttgagaagttattgagtgatgttgattatgattattgtgatgctgagattcttgttgaagaaatcccggtcggtattcatcgatgtatactggcttcacgaagtcaattttttcatgaactttttaagaaaggaaaagatggagaagttaaggatggaaagggaaagccaaggtatctcatgaaagaattggtgccttatggtagtgttggatatgaagctttcattgttttcttgcattatttgtatactggaaagttaaaggctccaccaccagaagtgacaacatgtgttgatgaagcgtgtattcatgattcatgtcgtcctgctattaactttgctttggaacttatgtatgct

SEQ ID NO: 7380 - DNA, 676 bp, Medicago truncatula
  Predicted polypeptide sequence is orthologous to G839, G1196
aagtttctatatcccattggaagaaattacaaagcaaattcctaattatatccaattgcaactaaaattgtgtgacatagtttctaggtaataaaattccttaattatattacatgattataagcaagtacattgacttagtaaaaatatctcatgtgcatttgtaaaacaactaaagtaacatagcatcttattagcaaaacatgctactgttggctacttgcaagttacaacattacatcaaaaggccaaaacttatatagcaactactcttgaacaaaatggacttcattttctcctcactttgtggttaagactttccctacgggctgacgatgatgtagacgacaatgcagatgaaaaacctgattggttattttcagccatatccttgtgaaatgccttctgcacctcatctttaagttccatgaaccgcgctttctttgctctctgctcttcttccgttcccttctctaggacaaaaacatccggcatatcatcgtctagatacttatcaagcacttcagaacaatgcggaaaaaaacgcctaccattctcaactatttttaaaagggattgtaatcttaattggagttttcttgttctaacagaaggagtttcatttagatctacttcttttatattgcccttcaaagctgttgaacttgcatagcgt

SEQ ID NO: 7381 - DNA, 658 bp, Medicago truncatula
  Predicted polypeptide sequence is orthologous to G839, G1196
ggagccttcaattatagtatcgcttcttacgaaaggggccttgtgcatcggatttgacttttgatggtcagagtgctgttagtatttgtaggaggttgacgaggccaaaggattatcacacaaaaacagaacaagggaaagaaacaaataaagaccggatatgcattgatgttcttgaaagagaaatgcgaaggaatcctttggctacagatccctctgtgtcttcccacacagtggctgatgatctccacatgaagcttttgtaccttgagaacagagtggcatttgcaagactattcttccctttggaagccaaactagccatggacattgcacgtgcggagacaacatccgagtttgctggtctttcggcatcaaaaggttccaatggaaacttaagggaggttgatctcaatgaaactcccataatgcaaaacaagagacttatttctaggatggaagccctaatgaaaacagtcgagatggggcggcgctactttcctcattgctcggaagtgctcgacaagttcatggaggatgacctacctgacttgttttaccttgagaagggcacccaagaagagcaaagagtcaagaggacgagattcgttgagcttaaagatgatgtcaacaaggctttcagcaaagacaaagctga

SEQ ID NO: 7382 - DNA, 673 bp, Medicago truncatula
  misc_feature (552)..(552): n is a, c, g, or t
  misc_feature (576)..(576): n is a, c, g, or t
  misc_feature (663)..(663): n is a, c, g, or t
  misc_feature (665)..(665): n is a, c, g, or t
  Predicted polypeptide sequence is orthologous to G849
tgtgtcttaaactcttctttcttctatctactattctatctttcttcataatcacaaacacaattatttcatttcattttaaaataataattaaaaatacaaagaaaaatttgcatttttattcaagaacaaaaacagtgacaagaattaaggtttttgtgtttagatctcaatctcaaccattttccgacactttgtacttttgattgggttaggttagctcggaattttcgttacgtgatcagaatttgattcctcggatcgttcttcgaaattcgaatgttgtttttttacaagtgacgaggatctggtgtattgatgcttctgattatttgaagagggatatatatatgttcaaattatggtgtttaagaagagggcaaatcatggattcaatggctttcaagttccggttattcctagagctcctagatctgcaagagggaggagttcattaaacaaaaaggttaaggataatcaagtttgtgcttttgaaatattggcatctatagctggcaagttgctggaggagagtgaaagctctgcttctancaatgcatctgaaggcttcattgngcaagatcgacaaaatgaagttaagccatcaatagccgagggaattcaccatggaagttctggagaaagtatttttacaaccgaggnancctcacaa

SEQ ID NO: 7383 - DNA, 888 bp, Medicago truncatula
  Predicted polypeptide sequence is orthologous to G852, G2633
tttattcaaagtcaaccgtcacatgttaccagcagtagcatgcaatcaaatgaagcagtgcatgtagagaaacgacgtaagttggaagaggattcatctctacaagggtttccatcgggcgatttgaagcaattactgattgcatgtgccaaagccatggctgaaaataacacagaactttttgaccgattgatagaaacggctagaaatgccgtgtctatcaatggggagccaatccagaggctcggtgcttatatggtagaaggtcttgttgcaaggacagaagcgtcagggaatagtatctatcatgcccttaagtgcagagagcctgaaggtgaagaattactcacttacatgcaactgcttttcgaaatctgtccctacttaaaatttggttacatggctgccaatggagccattgtcgaagcttgcaggaatgaggatcacatacacatcatagacttccaaattgctcaaggaactcaatggatgacacttcttcaagctcttgccgcgagacctggtggggcaccccacgtgcggatcacaggaatcgacgatccagtctctaaatatgcccgtggcaagggactcgaagtagttggagagagattgtccttgatgtctaagaaattcggcataccggttgagtttcatgggattcctgttttcggtccagatgtgacaagggacatgcttgatatcagacacggagaagctttggcggtgaattttccactgcagctccatcacacagctgatgagagtgttgatgtgaataatccaagggatggacttttgagattggtgaagtctctctctcctaaagtggtcacccttggtggagcaaagaatcaacacaaacacaacaccctttcttcaaacagg

SEQ ID NO: 7384 - DNA, 539 bp, Medicago truncatula
  misc_feature (453)..(453): n is a, c, g, or t
  Predicted polypeptide sequence is orthologous to G852, G2633
ggcacgagggttttctcgaaactatggactattacacagcaatgttcgagtcaatagatgtgactcttccgagagagcataaagagaggatcaatgttgagcagcattgtttggcaagagatttagttaacatcatagcttgtgaaggggtcgagagagtggaacgacacgagctgctagggaagtggaggtcaagatttgcaatggctggtttcactccttaccctctgagttctttggtgaatggtacaataaagaaattgcttgaaaactacagtgatagatatagacttcaagaaagagatggagctctatatcttggttggatgaatagagatttggttgcttcttgtgcttggaaatgagaactgaaaattatgtaactcctgaatgtttgaggaatttggatttgctgcagttaataattctacgcattcacataatcagctcgtncgtggccggtggatcgagattggatgatccaaatttcaaaattagtatttcgttttttaataaaaatatgccgtgaaatttggacc

SEQ ID NO: 7385 - DNA, 817 bp, Medicago truncatula
  Predicted polypeptide sequence is orthologous to G852, G2633
gtcttattctctaatgtccgcggtggggggcgttgatatagtaggggaaaagttattgacgcttgcgcagtcatgtcatgtaccctttgagttccatgctgttagagtgtatccttctgaagtgcgactcgaagactttgaacttcgacctaatgaagctgtggcggtgaattttgccattatgctacaccatgtaccagatgaaagtgtgaacattcataatcatcgtgataggttgctgcgattggctaaacacatgtctcctaaggtggtgactctagttgagcaagaattcaacaccaataacgctccgttcttgcagcgtttcctcgagacaatgaactactactcagcagtttatgaatcgattgatgttgttcttccaagggatcacaaagagaggattaatgtcgaacaacattgtttggctcgtgaagttgtgaacttagtagcttgcgaaggggaagaaagagtggaacgtcacgagcttctgagtaagtggagaatgcgtttcacgatggctggatttacgccttatccattgagctccttcatcaattcttcaatcaagaatcttctcgagagctaccgtggacattacaccctagaagagagagatggtgcactgtttcttggttggatgaatcaagatcttattgcttcttgtgcttggagatgaaaaattaatgacagttcagttttgttactgcaggtttttatgttaggctatatgtatcatcatcctatttagatttactctttttattatactcaaataactggttttgtaaaagagcatcctaaaactttgtcacaa

SEQ ID NO: 7386 - DNA, 723 bp, Medicago truncatula
  Predicted polypeptide sequence is orthologous to G852, G2633
gaagaggctggatggacaatgtattggtgaagatggtatcggttgctggcgatccaatccagaggttaagtgcttacttgttggaagggcttagagcaagattagaattgtctggaagcttgatctacaagtcgttgaaatgtgaacaaccaacgagcaaagagctaatgacttacatgcacatgctgtatcagatttgtccatattttaagtttgcatacatatctgcaaatgctgttatttctgaagcaatggcaaatgaatccaggattcatataattgatttccaaatcgcacagggaacacaatggcaaatgcttattgaagcgctcgcacgtaggcccggtggaccaccttttattcgaataacaggggtcgatgattcacaatcatttcatgcgcgcggtggaggacttcagattgtaggagaacaactttcaaactttgccaggtctcgtggagttctgtttgagttccacagcgctgcaatgtccggttgcgaagttcaacgtgaaaatcttagagttagtcctggagaagccctcgccgtaaattttccctttagtttgcaccatatgccggatgaaagtgtaagcatagagaatcatagagacagattgttgagattggttaagagtttgtcgccaaaggttgttacccttgttgagcaagaatccaacacaaatacttctcctttctttaaaggtttgtggagacaatgga

SEQ ID NO: 7387 - DNA, 697 bp, Medicago truncatula
  Predicted polypeptide sequence is orthologous to G852, G2633
aggaaagaagttaaggataatacatatatatgagtcttacattacaaaatgaaccagttgtcatttgagtatcacctccaagcactagaggtaataagaggttgattcatccaaccaagataaagagcaccatctttctcttgtagagtataatgtccttggtaattttctagaagattttgtattgaataattaatataagagcttaatggatatggtgtgaatccagccattgtgaaacatgatctccacttcttcagaacctcgtgacgttcaactctttctgcgccttcacacgctactaaattgaccacttcacgagccaagcaatgctgttccacattaatcctttctctgtgctcccgtggcaaagcaacatcaattgattcaaaaactgcgaagtagtagttcattgtctcgacgaaacgtgcaaagaatggaagttcgttggtatttgattcttgctcaacaagagtcactaccttaggagacaaacattttgccaatctcaccaatctatcacgatgattcttaccaccatgtacatcttcatccggtacatgatgcagcatcatggcaaaattcaccgcaatagcttctccacgacgaagttcaaggtcttcaagtctcacctcagaaggactaacccctatagcatgaaactcagatgctacattatatgactctgcaagttttg

SEQ ID NO: 7388 - DNA, 808 bp, Medicago truncatula
  Predicted polypeptide sequence is orthologous to G852, G2633
aataaaaaacacattcaggtatggttttgtaattttcaaacattcacggactatagtgacaatgactcgcattcaagtaccaaaatgactatttactctagcaaaaagggttgtcatattcacttccatgctgaagcaacaatcaagtttttgtcttcccacccaaaatgaagtccccccatttcctctattatcttgtacttgtcacagtactgcctaatgagttctctaattgcttctttcacatttgtgctcattggtgatgaagtgaatccagccattttcatccttgccctccattttccagcgacttcatacctttctattctatcctcgccctcgcaagcaatgacattcacaatgtccctcgccaagcattgcctttcaacattcaccctatcttgactctctctcggaagagtggcgtcaagggactcaaacacagcagagtagtaattgtaagcttcaacaaatcttggaagaaatggggaagtgtttgtgttcacgtcttgttccacaactgttacaagttttggattaaggctcttaaccatgcggagaagctggtctcgttcgtttacagttgatacactttcgtcgggcatgtgatgaagctggaatgcaaagttcaccacaagggcttccccgggacgacagttgagcattgatggagtaacaattgaagaccttgatgctacggctcgaaattcaaatggcaatccgagtacttctgctagcttttcaagtctttgtcctatgatacttaggcctccaacagatcgttgcacggattcaggatcatcaacgc

SEQ ID NO: 7389 - DNA, 653 bp, Medicago truncatula
  misc_feature (464)..(464): n is a, c, g, or t
  misc_feature (550)..(550): n is a, c, g, or t
  misc_feature (620)..(620): n is a, c, g, or t
  misc_feature (623)..(623): n is a, c, g, or t
  misc_feature (633)..(633): n is a, c, g, or t
  misc_feature (642)..(642): n is a, c, g, or t
  misc_feature (646)..(646): n is a, c, g, or t
  misc_feature (648)..(649): n is a, c, g, or t
  Predicted polypeptide sequence is orthologous to G861, G1140
gcacgagctttcctttcttgaaaattcagccacacacaccattcattctattctaatcagagaaagattaatggcgaggcagaagataaagataaagaaaatagacaatgcaacagcaagacaagtaacgttttcgaagagaagaagagggatcttcaagaaagctgaggagctttcgattttgtgtgatgctgaggttggtcttgttattttctcaacaactgggaaactatatgaatatgccagttccaatatgaaggacataattacaaggtatggtcagcagtcccaccacatcaccaaattggataaacctctgcaagtgcaggtagaaaaaaacatgccagctgaattgaataaggaagttgctgatagaacccaacaactaagggggatgaagagtgaggattttgaagggttaaacttagaggggttgcagcaattggagaaaagtcttgaatcangactcaagcgtgtgattgagatgaaggaaaagaagattcttaatgaaatcaaggcacttcgaatgaaggaaatcatgttggaagangagaacaagcatttaaagcaaaagatggctatgttaagtatgggaaaaagtccaatctttggggactcanatnttaccatgcnagaaatgtntcancnnaatc

SEQ ID NO: 7390 - DNA, 350 bp, Medicago truncatula
  Predicted polypeptide sequence is orthologous to G861, G1140
ggtgatgaatctgagaatgagaatgtggttaatgaaggtcaatcctcagaatctgtcaccaacgtttacaattccattggtcctccccaagattatgagagttcggatacatcgctcaagttgggactaccatatgccggctgaaggaatgtttgtgtgcgagggattaaccttagaggcttgagattaacaaggattatatgattggctaaatttcccaaatgattgcgattttaagagtaaatatgtacgtatagtaattgagcaacatgacttcatggggtactctatattatctcatttcgaaattgttaacgtgaaatagattaaaaaaaaaaaaaaaaaaaaaa

SEQ ID NO: 7391 - DNA, 813 bp, Medicago truncatula
  Predicted polypeptide sequence is orthologous to G861, G1140
aacaaacaaaagctccaaaacctaagtttcttttctttatcattccaaataccaacgcctttccctcaaaaggaaagtaaattccacaaagtacaattcacccttccaaaccctcaccacccatcacacaatttcaatattcattttctccaaaaacaaataaatccaccatttgttcactagttgatttcttacagaacctagaaattcctaaacaaaactaaaattagctaaaaatctgcatcatatttcttacagaagcacttttatttgcttttgctttaaacagaaaaaaaaaccataaatagtcaacttacacatctttcatttccttcttgtgcttttgtctcatctttttttagaggataaattaaggtaaagaagggatatggctcgtgagaagattcaaataaagaagattgaaaactcaacggcgagacaagtgactttttcaaagagaagaagaggattaatcaaaaaggctgaagaactttcagttttgtgtgatgctgatgttgctctcatcattttctcttctactgggaaactctttgaatactccaacttaagcatgagggaaatacttgaaagacatcatttgcactcaaagaatctggcaaagcttgaagaaccgtcgctagagttgcagctagttgaaaacagcaactgttctagattgagcaaggaagttgctcagaagagccatcaactaagggcagatgaggggagaggatctccaagggtttgagtctggaagagttacaacaattggagaagtctcttgaaattggattgggccgtgtaattgaaacc

SEQ ID NO: 7392 - DNA, 788 bp, Medicago truncatula
  Predicted polypeptide sequence is orthologous to G866, G883
aaataaaacttgtataatttaatttcatcataattgttttgccggatttacacaaaagtccttatcacaactcgtagacgactcattcattgcgttgcggtccacaaaagtaaaagttgactttcctactctttcttccttggaatctccgttttttctccgtcaccgttacagttagagcataactccgtcatcaaatacaaacggccggttctcacttttcaccacaatagattccgtatattttccgatcaccacggtcgctcaaagaggctgagatatgaatccggcgccagttacgacggtttgtgcgtgacggtgctctccctcgtaagtaacaacaagcatattgggatcgtcttgtgctctttctacatgcttcctcgccggacatcctttgaagctactgcacttgtagtaaccacgtgggtaaggtgaacctttaataggtttttgaccgtatttcctccacgaaaattcgtctgatggtatatcagcgacctttgaacttatcgccggaacacgaattgttctcttcacacgagatttccttctcttggagcaatggcagtgaccggaggatgagactttgccagagattgtggcttcgtgacaccttttccggtgagatgaagctagaggaggcttgccagaggaaatgataggacctattttaccgtcggaaacgcttccatctccggtgatggtggacatgaaagaagaagtagtggtagagatgctataagcttccttttgattggagtattgagaaacagataaatcagtag

SEQ ID NO: 7393 - DNA, 831 bp, Medicago truncatula
  Predicted polypeptide sequence is orthologous to G866, G883
taaataaacaacttaagattccaattttccatctctatattaaaatattttaatataataataaaacaaatttacaacgcagccccaccttaacttccactcatatttttctaacaaaaataaattcatttttaatttttaaatgaaaagtcctccattctcccactttcctccaagttttttaattccccttgttacgttgactcaaataccaaacccacaatcccggctgcgttctcctgcatcgcagcttgaatagtgtgtctgtgctctccttcatacgttacaatcagcatcgttggatcgtcggttgcacgctccacgtgtttccttgctgggcaccctctcactgtgctacacttgtaatagcctcgtggatatggcgaacccttgatcggtttctgaccgtatttccgccatgagtactcgtccggtggtatatcggcggtctttgaacttatcgccggtactctcacagtccttttcaccctattttttcttctcttaacacagtggcacttattcgaccctgaaacgtcatcggagtgttccccatgatcatgacaccttttcttagacggcaccgccgaaagaggcggctttccaccggagatagctggtgtcgccgcaggattgagaaaaatcgaagatccttgtttcccgttaacgcttccatcaccggtaatagcagatgacataaacgatgaagctgaagaaacgctaaacgttgctgtatccttcgagattcaagctcaaccatgggagtttttcgtgtttgactcaaaacaacgtcgtttggcttcctgaatcagtgtcatgctgtgtgattgt

SEQ ID NO: 7394 - DNA, 774 bp, Medicago truncatula
  Predicted polypeptide sequence is orthologous to G872
cggaagaggaagtgggggaaatatgtgtcggagatttgattaccaaacagccgtcagagaatatggttaggttcttatgattctgccgagaaggcggcgcgtgctttcgacgcggcgatgttttgcttacgtggcagtggtgctaagtttaacttccctaatgatccaccaaacattgctggaggaagaacaatgactccttctgagattcaagctgctgcagcccgttttgctaattcgggtgtccatattgagaattcgggtcaacccggtaatgttgcggtggagtatgagtcgtcgtcggaggggactgcattgttggctatggaatctgaagcactgtctccggcaatgtcagatgcaacggttcagacagattatgattcaaagcaaaacgggttgttttccgatttgtttgcggttgatgggtcggggagatttgaaccggattactcggtttttcccggttttgatgattttggtggtaatttttatgtgccggacatgccaatttatgattatggagaagagaacttggatgggttggtgattcatgactcctttttgtggaacttctaaagattgaaggatggtatagaaatgggtcgggttatgagtagttttactatatccgagacttatgtcggatcaacattaggttttgggttggtcaatttttttgtaggaccaagccctatgctaatttagtaggggtaataattttttactgagtggttgattaatgtggatatgattcatgaatcacttgtaaag

SEQ ID NO: 7395 - DNA, 822 bp, Medicago truncatula
  Predicted polypeptide sequence is orthologous to G872
taaatccaagaatggccaaattaaaaaacattatattattatcacatcactttacaatgtttcatgaatcatatgaacaaaattggaactttaattactaaggtaattttttttatgatcagtgttaaattgacactggactatctcccataagaattggcactcgtagatccaatgtggacccgggttcttgtcgcggtttcggatatactaaaactatccgcaacccgaccaacttgaatatcatttcttagaaattccacaagaacaggtctggaattaccaacccatccatgttctcttctacataatcaaaatctgacatctccggcacgtagaaatcgccacaaaaatcatcaaaacccggaaacatagagtaacctgacccggtttctgaaaacatgtccgaaaataacccgttttccttggagttacaatctgtctgaaccgtcacatcggatagagcaggagacaacaactccatagacaacaatgttgttgcagtcccctccgatgatgacggtgtttcaaacggagtattttcgggttgacccgaattagcaaaagaagctgcagcggtcttaatctcagcatgtgtcatggatcttcctccggcaatgtacggaggatcattaggaaaattaaacttagcaccactgccacgtaagcaaaacatagccgcatcaaatgcacgcgccgccttgacggctgagtcgtaagaacctaaccatattctttggcggctgtttggtagtctgatttcagacacatacttttcccatttcctcttccttactcctctatacatgaaagatcacttcg

SEQ ID NO: 7396 - DNA, 497 bp, Medicago truncatula
  misc_feature (387)..(388): n is a, c, g, or t
  Predicted polypeptide sequence is orthologous to G878, G884
ggcagagggaaaattgcaggcatagcataggtttagttttatctttttttcatctatctaaagcgtggactttaatactttatgctgaatttgataattcagatcaaaagtgaattatttgtgacacaaaacaaacaacaagtttgaaagagtttcatttgtttagttcattcatttgtttggctttggtttgtgatcaataatcaataaagttgtgaatggttggaggtggaaatggagagtggccttcaggtggagggtttagtcctggtcccatgactttgctttccaacttgtttggtgacaacgatgactgcaagtctttctccgagctcctcgccggtgacacgttggatgttgagcatggaggtggaggaggaggaggannaaagtggtggtggcttgtcaccgttggccatgttcactgctccacctcagcaaacgctagcacaagcctactcaaatgctcaaaaccaatctgaacatcaattttctgt

SEQ ID NO: 7397 - DNA, 788 bp, Medicago truncatula
  Predicted polypeptide sequence is orthologous to G878, G884
actgttcctcctggtttgagtccttctggttttcttaactctcctggctttttttctcctcagagtccctttgggatgtcacaccaacaggctttagctcaggttacagctcaagctgtcctagcacaatctcaaaatatgcacatgcaacctgaataccagctggtctcatacgaagcccccactgaacgattggcagagcagccgtcttatactcgaaatgaagctccggagcagcaagtgacagcacctgtatcagaacctagaaatgctcaaatggaaacgtcagagattacacattctgataagaaatatcaaccatcttccctacctattgacaaacctgcagacgacggctacaactggcgtaagtatggacagaagcaggttaaagggagcgagtatccacggagctactacaaatgcacacacctgaattgtcccgtgaagaaaaaagttgagcgtgcacctgacggccacataactgaaattatctataaaggccagcataaccatgagaagcctcagccgaataggcgggtcaaagaaaacaatagtgacttgaatggaaatgcaaacgttcagcctaagtctgactcaaactcacaaggctggtttggaaattcaaacaaaaattagtgagatcgtgcctgattcttcgccgccagagcctgagagtgacctgacgtccaatcaaggggctatcagaccacgacctggatcaagtgagagcgagggaagtcgggtatgcagagaataggagaagggagttgactgtgagccaaacc

SEQ ID NO: 7398 - DNA, 589 bp, Medicago truncatula
  Predicted polypeptide sequence is orthologous to G878, G884
ctcaatgtctaagatggaacctgaatctagtcaggcaacagttgaacatctatctggaactagtgatagtgaggatgtaggtgatcgtgaaacagaagtgcatgagaaaagaattgagcccgactccaaaaggagaaatacagaagtcacagtctcaaatccaacaacttcttcacataggactgtcacagagcctaaaatcatcgtgcaaactaccagtgaagttgatctcttagatgatggttatagatggcgaaaatatggacagaaagttgtcaaaggaaacccttatcctaggagctattacaaatgtacaacaccaggttgtaacgttcgaaagcatgtagagagggcttccacggatcctaaagcagtcataacaacatatgaaggaaaacataatcatgatgttccagcagctaagactaatagccacactattgccaacaataatgcttcacagttaaaatcgcaaaataccatttctgagaagactagttttggtagcatcggtattggcgagggcaatgagcaacaacctgttgctcgtctaaggctgaaggaagagcagataacttaagctcataaa

SEQ ID NO: 7399 - DNA, 746 bp, Medicago truncatula
  Predicted polypeptide sequence is orthologous to G878, G884
agacaatgtagaactaaccactcacacatatgatctctaatgctgctttttgtataccagaaattggacttataggccttggtcaaaactttggccacacattcaaaaacaaaaaagcatcaaaccttaaagattacttgtgagttgtaacacatgcttccaatcttgtataaaatatgaaaactacattatatttatatatgctcttccttcaatcttagatgtgccactgctgaaggctgatgttgaccccttctgttgaaattctgcatctcaggtatggcattttgtgattttagctgtgatgcactattattgctagcaaggttatgactgttagtcttggctgctggcacatcatgattatgttttccttcatatgttgtcaatacagctttaggatctgttgaaaccctctcaacatgcttccgaacattgcaacccggagttgtgcatttgtaatagctccttggatatgggttgcctttgacaactttctgcccatatttgcgccatctatatccatcctccaagagatccacatcacttgttgtttgcacaatgattttaggctttgagaccgtcctatgggaaagggctggattcaggagtttggcttctgtttttcttctcttgagacaggttcataatctacttcagtttcatgatctccttcttcctcactgtcacttgttcctgataaaacttgtgcacacttgaattgtcatttgtgagcttgctaggac

SEQ ID NO: 7400 - DNA, 800 bp, Medicago truncatula
  Predicted polypeptide sequence is orthologous to G896
ctaaaaattggcatgaaaaacaccatgttgaatatcagttgtcagcacaatagggataatcctattgctaagtacactaagacaaaacaagagctggttagcctggaattgcagtctattacatctgctaatcctggattaaaggatggtgatgatggcgaacacaaggacaaaacattgataaacaacctacctggtaacctttcaggaaatgggaatggatcgattttcattagcatctacaaccacaattacagcatgcaatatcctcctactacgtacgaaatacctgtccattcctattatcctccacttaggcctccttctgcatttggtaacaagagggctgtgttatttggaatcagttatgctaacacagcgacagcgaagaagcttaaaggttctgtgaataatgctcggtgcatgaaacattttctgattgacaagttgggatttcctggaaattccatttgcatgctcacagatgattcagaagagaaaaacacaattccatcaaaaagtaacatgcggatggccatgaggtggttggttgagggctgcaaacctggggattcattggtgttttacttctgtggtcatgcatcaagggttaaagaccgtaacgtggatgaggttgatgggtatgatgaagcaatatgccctgtcgattatgagcaggaggggatgatactcgatgatgaatcaatgctacaattgttaggcctctacctcatggtgcaaactacatgcccttgttgatgcatccttagcgggacaatcttgacatacatttgtatgca

SEQ ID NO: 7401 - DNA, 717 bp, Medicago truncatula
  Predicted polypeptide sequence is orthologous to G896
catcaagccattcctctttgttgttgtctacaactacaatcggtaacaaacgcgcggttctatgtggagttacttacagaagaagacggtacatgctcaagggaaccgttaatgatgttgttaacatgaaaaaactactgactaataattttgcattcccaatagaatccatacgcgtcctcacagaagaacagaaagatctaaatttcctaccaactaagaggaatataatggaatccttaaagtggctggtgaaggactgcaagttcggagactcattagtgttctacttctccggacatggtacgcaacaaccggcaatagacaaagatgatgaacttgacgggtttgatgaaactatttgccctgttgatttcattagagaaggaatgatcactgacgacgaaatcaattctaccattgttcggccactcaaggaaggtgtcaaacttcatgctattattgatgcttgtcatagtggaacaactcttgatctcattgataattggaaatggatgaataacattccccctagcatagaccctgtcactaaacgtacaaatggtggagtggccatttgcttcagtgcttgtgaagattgtcagatggctgccgatactgcagcttttggaggaaaagagatgaacggtgttatgacctatcttttaacaaaaaatatccgagaacatttctgaatacatatgtccggtttgctag

SEQ ID NO: 7402 - DNA, 556 bp, Medicago truncatula
  Predicted polypeptide sequence is orthologous to G896
gcacgagtcgagttttttttttttttttttataaatcaacgaaaaaatagatgataatgttattcattttttgaacacatgacgtaattcatgagatataagagaaaacattcataaattgcagaggtgtatttttaggatgaaattccagagctagctcagttttcaacttttcattagacactctttcaaagttacaaatcaatatttttccctccttttttttggcacaatgaagtagtagtagtattacagaacttccccaatttgaatgcaaatctctcctataaaccttcatttcctttcccaaatagacattatattttattttctacaaacaggaccaacgtcaattattcctcgtattcattttatttttcaacgcgacttccagttatgttcacattgcaataggctttgaataaatatcaaatttctcagaacatgacagttgtggctcatgagcatactgctgccgattgtccatgacatactgttgattattcgggccatattcttctctagccccacgaatcgtagaacgcatggcattaaa

SEQ ID NO: 7403 - DNA, 523 bp, Medicago truncatula
  Predicted polypeptide sequence is orthologous to G896
cagatacatctgcactatcaaaaattacatcaactggagccatgacgttttgcttcatccaagctgtagagcgctctggtccaggggccacatatggcaccattcttacttcaatgcgaagtgccataaaaaatgctggtagcggtggtagtgggggcggcgatgtggtaacatctcttgtttccatgcttttgaccggaggtagtcttaccactggtgggctaagacaggaaccgcagttaacagcttgcgaagcattcgacgtgtatagaaaacctttctcattatgatagtattctttatacttcaatttgttttccttggtgctgcccttgtacatgaatttatttggttatcgtgtattgattactatgataggttaaaattataagtaggtgaggttctaatttattcggttatcgccaaggacgtctgggtgacttcatgtctggattttagaatgcatttgctcgtaataatgagtagttgtcggtatgatccttctaaaaaaaaaaaaaaaaaa

SEQ ID NO: 7404 - DNA, 668 bp, Medicago truncatula
  misc_feature (533)..(533): n is a, c, g, or t
  Predicted polypeptide sequence is orthologous to G896
attatggccggggacccaacaactcaatcccttctcctcaattcatcattcactccgtcaacaaaattccaattctacccttcaacgatgtacagcaacatcctcgttaactgctccaactgccacacccctctccaactccctcccggcgccgcatcaatccgctgcgcactttgtcaagccatcactctcgtcgccgacccacgcgctctccctcctcaacccgcatcctcccctcacgcgcctccgcctccttccccttacaatcatgccccgcctggtcctttacctaacgttcacggccgtaaaaaggccgtgatcgtcggaatctcgtataaattctctcgtcatgaacttaagggttgcatcaatgacgctaaatgcatgcgttatcttcttatcaataaatacaattttcctgattcttccattattatgctcactgaagaagaagaccctcatggccccaaatttccaaataagcacaacatcaggatggcaatgttttggcttgcacaaggatgtcaacctgnagactcccttgtttttcattattctggtcatggatcccagcaaaggaactataatggtgaagaagctgatggttttgatgaaactatatgtcctctggattttgaaacacagggtatgatagttgatgatgagat

SEQ ID NO: 7405 - DNA, 787 bp, Medicago truncatula
  Predicted polypeptide sequence is orthologous to G898
ctactggcaaaatgttgcattaacggggaatcaaaggaattctaccaataaactcaaggatttaatatacatacataaatccctggaatcgatattagatcacaactggcttttctagcagtgtatcatccaccaaaaaaaagatagacgaaaggttcagatttcagaacatgaaagctcaaaaaaaaaaaactgagcaaggaattgtatccaccaaagatcttcatatatgtgaatgataaatgataaattaaacaaagataaatagctacttaaaacaacaaaaccacccagtaatctctgaaactacaactttcttccaatccccataaccagctcagcttgcattgaaaccctcaagcagttgttggcagaaacacccttataagctctttcacagtaatcttttttctacaggtgggacattttgcctgagcacttatagcagccttgatacacgacttgcaaaaaatatgaccacaccttgttgacatttcttcaaccatagggcccatgcatataggacaggtgaagacaggttcctttggaggctcaggtggctttttgacactttccatcgtattgctgctgctggcgtccaaatttatataaagatcacagttgaaaattgatcgttttggagattctcgtctgcgtttgttgcgattattgttgcttaacctaatctgctcttctgcaaaaaacatgactaaatcgacatcaactacagtccttccacgatttcttcgagaattgtttttggcctcagcaaaagccctcggggaag

SEQ ID NO: 7406 - DNA, 603 bp, Medicago truncatula
  Predicted polypeptide sequence is orthologous to G903
ttttcatcaaacacacactactaaactctttgtaagtttcttattctatgttcgagtcaaacgaatttaagatgctaaaaaatatggatgaagtagaaatcacaaatgctaatttccctcaaaatccaacaatgagtgcttctaataatcctcctgctttgaagagaaaaagaaaccttccaggaaatccagatcctgaagcagaagttgtagctttatcaccaaagacactcatggctacaaacagattcttgtgtgaaacatgtgggaaaggttttcaaagagatcaaaatcttcaactgcatagacgtggacataatcttccatggaagcttaagcagagaacaaacagagaaattaagaagagagtttatgtgtgtccagagaaaacttgtgtccaccatgatccttcaagggcacttggtgactcaactgggataaaaaagcacttttgtagaaagcatggtgaaaagaagtggaagtgtgagaagtgctcaaaacgttatgctgttcagtcagattggaaagctcactcaaaaacatgtggttctagagaatacaaatgtgactgtggaactatcttttcaaggagagacagcttca

SEQ ID NO: 7407 - DNA, 796 bp, Medicago truncatula
  Predicted polypeptide sequence is orthologous to G903
gtcttcctctggttccacaaatcccatcttttctgtttcaattgagtaacctttgtctttccatagtttctcaagagtagtgaaacaaacactcactagtttgtaataaactaaatagaaaaaaaagggaacatttttctacttcctttttcttaatttggctatgtcaaacatcacaagttgtgatagtgggagcttctctacagagaatacaagagaagatgcagttaaacagcaacaaactgatcaaatacttggtcaatttcatagtccacattctcatacttcaactacaacaaataataataataatagcaatggttctaacacagatttacaaccacctcttaagaagaaaaggaacctaccaggaaatccagatccaagtgctgaagtgatagcactatcaccaacaacactaatggctacaaacagattcgtatgtgaaatatgtaacaagggttttcaaagagaccaaaatcttcaactgcaccgaagaggacacaacttgccttggaagctaaaacaaagaactagtgcagaaattagaaagagggtttatgtttgtcctgaaccttcatgtgtacaccataaccctgcaagagcacttggtgatcttactggaattaaaaagcacttttgtagaaagcatggtgagaaaaagtggaaatgtgataagtgttctaagaaatatgctgttcaatctgattggaaagctcattccaaaatatgtggtacaagggaatacaaatgtgactgtgggaccatcttttccagaagagacagcttcattacc

SEQ ID NO: 7408 - DNA, 784 bp, Medicago truncatula
  Predicted polypeptide sequence is orthologous to G912, G2107, G2513
catcatcaccggattctgaggtgcggttagcatcaagcaacccgaagaagagagcggggaggaagatatttaaggaaactcgtcaccctgtctatagaggtgtgaggaagaggaacttaaataaatgggtttgtgaaatgagggagccgaacacaaagaataggatttggctaggaacttttccaacagccgagatggcagcccgagcccacgatgttgccgcgatagcattgaggggccgctatgcctgtctcaattttgcagactcggtgtggcgccttcctattccagcaacttccgcgataaaagatattcaaaaggcagctacaaaagccgccgaagcttttagaccagacaatactttaatgaccagtgacattgacaccgttgtagctgttgtcgcaacacaggagctgaatatgtttcgtgttgaagtcgaagaagaggaagtgttgaatatgccagagttgtggaggaatatggcactaatgtcccctacacatagctttgggtatcatgatcagtatgaagatattcatatacaagactttcaagatgatgaggactttaaaaaaaggtctgttacgacgatctgggctgtgacttcaattggggtgcattcgctgcatttcaccgtcatatcaaggattgtgatgcgaaccttgcttttatgtgtctgaattctgtgttttcatcctggcaagggaagctacaagagaagaatgaaatgaattttagcagatgccagtaattaatatcctctgcaatttcctcatgtatttgg

SEQ ID NO: 7409 - DNA, 798 bp, Medicago truncatula
  Predicted polypeptide sequence is orthologous to G912, G2107, G2513
tacttcataataacaaacacttatcttcagttccaactttcactatcaaattcttttcccactctcaccaacacaatcatatgtatccaactacaaactctgtctcttcctcttcctccgacatgtcgctgccgaattcagagggctctcattggatgtcaatttgcaacgaggagatgcgattagcggcaactaccccgaagaagcgtgcagggaggaagaagttcaaggaaactcgccacccagtctatagaggagtgaggaagaggaacttagataaatgggtttgtgaaatgagggagcctaacaagaagactaagatttggctagggacttttccaactgccgagatggcagcccgtgcccacgatgttgctgcaatggcattgaggggccgctacgcttgtctcaactttgcagactcagcgtggcggctccccaaacctgcaactactcaagcaaaggatatacaaaaggctgctacagaggccgccgaggctttcagaccagacaagactttattgactaatcacaatgacaatgacaatgacaatgacaaagagaatgacatggctgtagttgccactgccactgaggagcagagtatgatttgtatggaagagaaagaagaaggagtgatgaacatgcaagagatgtggagtaatatggcgctaatgtctcctacacatagcttgggggtattatgagtatcaatatattaatgaagactttcaagatgaggaagtatcactatggagtttttaaattttttgtaggaaaatggaattttttagtttg

SEQ ID NO: 7410 - DNA, 774 bp, Medicago truncatula
  Predicted polypeptide sequence is orthologous to G912, G2107, G2513
cttatcttcagttccaactttcactatcaaattcttttcccactctcaccaacacaatcatatgtatccaactacaaactctgtctcttcctcttcctccgacatgtcgctgccgaattcagagggctctcattggatgtcaatttgcaacgaggagatgcgattagcggcaactaccccgaagaagcgtgcagggaggaagaagttcaaggaaactcgccacccagtctatagaggagtgaggaagaggaacttagataaatgggtttgtgaaatgagggagcctaacaagaagactaagatttggctagggacttttccaactgccgagatggcagcccgtgcccacgatgttgctgcaatggcattgaggggccgctacgcttgtctcaactttgcagactcagcgtggcggctccccaaacctgcaactactcaagcaaaggatatacaaaaggctgctacagaggccgccgaggctttcagaccagacaagactttattgactaatcacaatgacaatgacaatgacaatgacaaagagaatgacatggctgtagttgccactgccactgaggagcagagtatgatttgtatggaagagaaagaagaaggagtgatgaacatgcaagagatgtggagtaatatggcgctaatgtctcctacacatagcttggggtattatgagtatcaatatattaatgaagactttcaagatgaggaagtatcactatggagtttttaaattttttgtaggaaaatggaattttttag

SEQ ID NO: 7411 - DNA, 740 bp, Medicago truncatula
  Predicted polypeptide sequence is orthologous to G912, G2107, G2513
gaaacctaagctactttactactagtactactacatacaccccacaaatgaaatcatcacttgatgagtctagttacgtagagaacaactcttcttcatcagaaatcttgttagcatcagaacaaccaaagaaacgtgcgggtcgacgaaaattcaaggagacaagacatccagtatacagaggagtacgaagaaggaacaacaacaacaacaagtgggtttgtgaagtgcgtgttcctaacgacaagtccacgaggatttggcttggaacatatccaacacctgagatggcagcacgtgcacacgacgttgccgcactggcacttcgcggtaaatcagcttgtcttaattttgctgactctgcgtggcggttagcgttgccggcgacgaacaatgcgaaggagattaggaaaatggcggcggaggctgctttggcatttgccgtagttgcggacagtaaggaacaaactatgattagtaattgtgatgttaataagtgttggtgttatgggaagttgataataaacctttgcagggactgtgtggtggaagttccagaggaggaaatgttgcatgattggtttaggagtatggctgatgagccattacgatctcctattactccatttataagacatgggcagggatcagtggaataatgttgatattgatcaggttgatgctgaggtctccttgtggaactttaccatctaatctatgagatgcattttgctttttgt

SEQ ID NO: 7412 - DNA, 783 bp, Medicago truncatula
  Predicted polypeptide sequence is orthologous to G912, G2107, G2513
catcatcaccgggttctgaggtgcggttagcatcaagtaacccgaagaagcgagcagggaggaagatatttaaggaaactcgccacccggtctatagaggtgtgaggaagaggaacttaaataaatgggtttgtgaaatgagggagccgaacacaaagaataggatttggctgggaacttttccaacaccggagatggctgcccgagcccacgatgttgctgcaatggcattgaggggccgctatgcctgtctcaatttctcagactcggtgtggcgccttcctattccagcaacttccgcaataaaagatattcaaaaggcagctacaaaagcggccgaagcttttagaccagacaatactttaatgactaacaatattgacactatcgtagatgtcgtcgccacaaaggagctgaatatgttttgtgtggaagttgatgaacaggaggaaatgttgaatatgccagagttgtggaggaatatggcgttgatgtcacctacacatagctttgagtatcatgagtatgacgatattcatgtacaagattttcaagatgatgaggacttaaaaaaaaaaagtttgttaccactacctggactgtgactgcaactggggtgcattcgccgcatttcaccataatgtacaggatcgtgattgttgccgtgactgcgaaccccgcttttatattttctttgttttcttcctggcaaagaaagtttgaaaagaagaaagaaataaacttggatggtcatattctgaatttactacctaagcagaagcc

SEQ ID NO: 7413 - DNA, 655 bp, Medicago truncatula
  Predicted polypeptide sequence is orthologous to G912, G2107, G2513
gacagtcaacattaaaaaaaaatatatatatgtcttctcttttgtgacatcttttctccacctacacaatagtatccgtactagtataaaaaaatcataagtacgaacactatcctattttttttttgttaagacactatcctagtacgaacttcctgcacaaacaatttattcctcaatttggtactagtaatgtactaatgtttagatatttatcttaaattaaattaaaatgagtaactccacaatgaaacttcagtttcatcaaattccacgtcagcaacaccacaatcacttccccagtaatgtgccggtgacattagcaccatgtttctcaaatactccggcaccgtatcctcttcctcctcccgttgctccatcaccgtctccgacaccgccactgtcgacgaaggctcactatccttcctctcttcactattctcaaacacactctccggcctgaaagcctccgctgcctcagccgccgccttttgaatatcccttgcttccgacgtagccggaaccggcaacttccaagcagaatcagcaaagttaagacaagcagaccttcctctcagtgcaatcgcagcgacatcatgcgcacgcgccgccatctccggtgtaggggatgtttcaagccaaattctggttttct

SEQ ID NO: 7414 - DNA, 814 bp, Medicago truncatula
  Predicted polypeptide sequence is orthologous to G912, G2107, G2513
attgattagtgatttaaaaattcacataaaagctatgaaaagaaattccaatttatgctaccaattaaaaaggttgtagtatagacatttcctattctacaatccaaaaataaagttaaaccaaacaaagaaaatttagaagttccatagtgatacctcatcatcttgaaagtcttgaaaatgaaaatcttcatattgatcatgatactcaaagctatgtgtaggggacattagtgccatattcctccaaaactccggcatattcaacatttcctcttcttcttccacacaaaacatattcaactcctttgtggcgacaacagctacaacagtctcaatgttggtaatcattatagtattgtctggtctaaaagcttcggcggcttttgtagctgccttttgaatatcttttattgaggaagttgctggaataggaagccgccacaccgaatctgcaaaattgagacaggcgtagcgacccctcaatgccatcgcagcaacatcgtgggctcgggctgccatctcggctgttggaaaagttcctagccaaattctagtcttcgtgttgggttccctcatttcacaaacccatttatctaagttcctcttccttacacctctatacaccgggtggcgagtttccttgaatatcttcctccctgctctcttcttcgggttactagctgctaatcgtatctccgattccggtaatgagttatagtaggaagaagatgcttctgaagaaatggagtgtgaataggaagaagtttgtagtagtaaacatatgtatgtgttggcctcgtgccgaattctg

SEQ ID NO: 7415 - DNA, 802 bp, Medicago truncatula
  Predicted polypeptide sequence is orthologous to G913, G976, G1753, G2514
attcattctatcgtgtatgcttagttcctacctacaacaacaacataaacatttcacttctttcgtcatggatggcaccaacaacaacacttcatcggtgccaccaccaatacaacctcctgatgcatcatcagcaccaacaactccttcatcttctccggcgactaccggagtcgcaggaagataccgtggaacccgttgtaggagtggtaaatgggtatcagagatacgtgagccacgtaaaacaaaacgcatttggttaggaacataccctactgctgaaatggcagctgctgcttatgatgttgcagctcttgctttaaaaggacctgatactactcttaactttcccaattcaatactatcttaccctattcctgcttcattgtcttcaactgatattcgtgctgctgctgaagctgctgcacaaaccagaatcatgagaccagcacaacaagatcaacaacaacaaaacccttcagcttttagttttgaggggtcttcttcaagtagtggaatattgcaacaacaacaaggtcatcatcatgaatatattgatgaagatgagttgttgaatatgccaagtttgttagatgatatggctagaggaatgcaggttagtccaccaaggatgagttcattctctaattgttcttcagatgattcacctcgcaattctgatggacgagataatctttggagttacaatttttgaagacagaatcattcattttctctctttgaatttgtttgattttggttatttacaagtgtttgtacgggtagatcttgattcaccctc

SEQ ID NO: 7416 - DNA, 778 bp, Medicago truncatula
  Predicted polypeptide sequence is orthologous to G921
actgaaccacatgtgcaacaattatattgctttgcaaaagcatttgagtcaattcagtcaaacaaattttgaaaatgaattagtatcaccaatatcgcggaagagaaaggccgagagcgttgaaaattgtttcaatcggtttggctatgccattgctgagagcagcaccattactactgaggaggagacattcaaacacaacaacataatctcgccaaaagtttccaaggttcttgtgcaaacagatgcatccaataccggcttatatgtgaaggatggatatcagtggagaaaatatggtcagaaagtcactagagataacccctctcctagggcttacttcaagtgttcctttgctcctggctgccctgtgaagaagaaggtgcaaagaagtgtagaagaccaaaatgtattagtgaccacatacgaaggagagcacaaccatgcacatcaccaacctgaaatgtcactcactagttcaaaccaaagtgaaacaacccctacatataatttagttccagcatcctcgtcctcaccaattaattggcgtacagctcaagcttcaaagcttgacttggtccagccaagacaattggtagttgatgattcccataagtcatctatccagcagttattagttcagcaaatggctacttctttgacaagagatcctaatttcgcagcagcacttgccactgccatttctggaagaataataattctggatgtggaaaacccgaagtaaattcacacttgcatgattttgttatctgtatgg

SEQ ID NO: 7417 - DNA, 786 bp, Medicago truncatula
  Predicted polypeptide sequence is orthologous to G921
gcttcatcttcatcttcaacaagaaagtcatacttatttactttcaatttgaatttatttgacatatggatttttcatcatcatggattaacacttccttggatctcaacattaatccacgcactagggttcatcaacaagctgctcctgtaagtttcaagaaatatgaggtggaaaacaattttttctcattagggatgatgagtatatcttctgcaaaagaagaggtaagttagtttggttactttattaatcagttcattatgaatactagatatatgaagtttttgttttttactaattaaagttgcatgaatattgagaaacaatttgatggaatatatgagaaagaatcctgatcataaggagaaaagaaaatctgatgaaataagcagcagtaacaatctaatgggaggaggagttactggaaacaactctgagagcagttcaagtgatgaagatcaatcatgcaagaaaccaaggcaaatagtagaaacttgcattaaggctaaagtttcaagagtttatttcaagacagaatcatctgattcaagccttgtaagaatattcattcctcttcattaatttgcaaagccaacaatataagtgatttttgtttgacattttttgtgttaattaattttcagattgtgaaagatggatatcagtggagaaaatatggacaaaaggtgacaagggataatccatctccaagagcatacttcaaatgctcatttgctccaagctgcacagtgaagaagaaagtgcaaagaagtgttgatgatc

SEQ ID NO: 7418 - DNA, 773 bp, Medicago truncatula
  Predicted polypeptide sequence is orthologous to G921
gattgagttttgcttctacaactcttttgtctttgagcttgaacaatatttttggatttatttggttaacatggattgttcatcatatatcaacacttctttggatctcaacattattccctatagagctcatgaagaagttccaaagaaggaggtggaaagcaactttttctccttggggatgaccaacttttctgtgaaaaatgagtctattgatgaattggaggaggaactaaaaagggtaaccttagaaaacaagaaattggtggaaatgctctcagtggtttgtgagaattacaacactttgagaagtcatttgatggaatatatgaagagaaatcctgagaaagaagttagcacatcatcaaagaaaaggaaatctgaaagcagcaataataacaatagtaatttgattggaattaacaatggaaattccgagagtagctctaccgatgaagaatcgtgcaagaaaccaagggaagaagaaaatattaaagccaaaatttcaagagcttatgttaggactgaagtttctgatacaggccttattgtgaaggatggataccattggaggaaatatggacaaaaagtgaccagagataacccttgtgcaagagcttatttcaaatgctcttttgctccaagctgccctgtcaaaaagaaggtgcaaagaagtgtggatgatcaatctatgcttgttgctacttatgaaggggagcacaatcatcctcaacctcctcaaattgagtcaacatcacgttctggtcggtagc

SEQ ID NO: 7419 - DNA, 335 bp, Medicago truncatula
  Predicted polypeptide sequence is orthologous to G922
aacacatgcttggtttaattgtaggcaccccatttggatatgagttcactgctgaggcttgatgcgtttgtaattctttttaatataattcactatataatcccatcttcgttattcttgtgactgtttcccataaaatccaagttccctgcttcagcactaatgaaggctcatctggtccagtacctctttcttttaatgaatttctgtaattttcatttggccgagaataatgtagatcaattatgtgaaccaccttttcacattccgtatattcaacaaaatttgtcaaggttacactgtaaaaaaaaaaaaaaaaatataactgaggggcc

SEQ ID NO: 7420 - DNA, 842 bp, Medicago truncatula
  Predicted polypeptide sequence is orthologous to G922
agatcccggcgttctcagaagaatatgttctcgaccaggtagctcatagactgattgcagaagctgaaaaattagatacaccattccaattcaatcctgttgtcagcaaattggaaaaccttgattttgagaaacttcgtgttaaaaccggggaggcactagcaattagttcgattctccaattacatacccttttagccttggatgatgaaaccatgaagagaaaatctcctcttttgttaaaaacctcaaatggaattcacttacaaagattccatccaataaaccgaagcacattcgacaatttgcttgagaaagatttgattagcagctataccagaagtcctgactcaagttcatcatcaccggcttcattgaagacttcaaattcaatgaacacggagatgtttctcaatgcattgtggagtttatcaccaaaggtgatggttgtaacagaacaagactctaatcataatggctcacattttacggacaggctactggaagctctacactcttatgcagcactatttgattgtttggaatcaacgatcccaagaacctcattggagagatttagggtggagaaactgctttttggtgaggaaatcaagaacattattgcatgtgagggattagaaagaaaggaaaggcatgaaaagctggataagtggtttatgagatttgatttagctggatttggtaatgagcctctaagttattttggtagttgcaagcaaggaggttcatgcagagttatggttgtgaggcatatagaatgaagggaggaaatggttgtgtgctaatatgctggcaagatagatccttgttttcatatcagc

SEQ ID NO: 7421 - DNA, 659 bp, Medicago truncatula
  Predicted polypeptide sequence is orthologous to G926, G2632
gtttttttttttccttcttgataggaaattacggacaagaacaaggaatgcagaatactgcatcatctgcagttattcgcgaagaatgcctcacacagactcctcagctggaacttgttggtcattcaattgtaagtctttgcctaagctttattgtttttttttcccccaattgctttcaagttgttaaaataaacatttttttgcaaacatcaaatcagtaattttattctggaacacaaatctttgctgattcgtgcatataatttcaatggaaaatatgttattatagagcttgtagttgcatgcatttggactggatgggactcctagtattcttccaattcttttgatgcaggcatgtgctacaaatccttatcaggatccatattatggtggcatgatggcagcttatcctcaccagccgttggtatgtgacattaatctgttaccttacctgcttaaagggatatcctccttttataggagtgcctcatgccagaatgcctttgccccttgagatggctcaagaacctgtttatgtgaatgccaaacaataccaaggaattctgaggcgaagacaagctcgtgctaaagcagagcttgaaaggaagctcataaaatctagaaagccatatcttcatgaatctagaacatca

SEQ ID NO: 7422 - DNA, 799 bp, Medicago truncatula
  Predicted polypeptide sequence is orthologous to G926, G2632
tcataaaatctagaaagccatatcttcatgaatctagacatcagcatgctttgagaagggcaagaggcaccggaggacgatttgcaaagaaaactgatggtgaggcctcgggaaaggataatggctctggtccagtcttgtcgtcgcaatcaattagttcatctggttcagaacttttgccttcagactctgcggaaacctggaattctcccaacatgcgacaagatgcaagaggatcaaatgaaaatggtggtagctcctaccataataacaacaatggtatgcaatcttcaaggtatcagggtgaaagagtggaagaaggggactgttcagggcagctacgtgtaagcatctcctcgaacgaggcatcgcagaggcgtcttgctattcagtagaccccccttcctgcatgggagggatagatgctgaggttggttttgtatatcctagtgatatatttggtgaatgagtaccttaccttggttatcttcttggcaatatatatgccggcaaatcattcttggcttttgttcttgtgtttatggtgtgaatgatataatatgggggggagaagaatggtgattggggtatatgatttctgttgaagtctcaagcaatcaatcaatccttcaatcttatctcatttttgcattttgtacagagttttagtggtagtcaacttcagctgatatggatggtcaggtcaaaagactgaagaaaacaaactcttttatgtagtaccaaaactctcttgtttcatggggtttggtctgtaaacttacctgggtgggttgttaat

SEQ ID NO: 7423 - DNA, 781 bp, Medicago truncatula
  Predicted polypeptide sequence is orthologous to G927, G1334
tatgatctgtgcaaaatatccgtatatggatcaattttacgggctcttctcgacttatggacctcaaatctcggggcgaattatgcttccgcttagcatgacatctgacgacggaccaacatacgtgaatgctaagcaataccatggaatcatcagacgcaggcattctcgtgccaaagctgtgcttcagaataaattgataaagcgtaacaagccatatatgcacgaatcgcgtcatctacatgcaatgcgtagaccaagaggatgcggtggtcgtttcttgaacacaaaagtttctgctaatggaaacggtaaaagcgggagtgaagagaacggaaacattggtggcctacagctgcagtccagtggttctcagagttccgaagtcttacaatctgaggttggaactttaaattcgtcgaaggagacaaacggaggcagtccaaatgtctcggggtcagaggtgactagcatgtatacacagggagttcttgatagctttactgtcaatcatatcggatctactgtccactctttgggagacatgatcgatactggacacggtatcgtcatgccaacaaaatggtttgcagcagctggcagacagctgctggaaccataagtttcgattcagaaaggaaacaagtgggtttggtacaatgtgaaatattttgcaccaaactcatcctttccgagaccagatgaagaagctatgtttcagtttgttgtgtttactacgacaaatttagtttcggaagactacttttccatctggtgctca

SEQ ID NO: 7424 - DNA, 613 bp, Medicago truncatula
  misc_feature (555)..(555): n is a, c, g, or t
  misc_feature (567)..(567): n is a, c, g, or t
  Predicted polypeptide sequence is orthologous to G928, G931
gcaccagtttcaacccaacaagtacaacacttctaactagtttacttgtctttcttcttcatacatatccttcttgccagatcccaaaggtcaagatctaaattttaagtaatggctgtgttgttgaaggttacatgaagccttttctctctttgaatcatcctgataccgagttcaattgctcacaagttgatcataatcagtcaatggctcagactcatgctcattatccttatagtgatccaattttcgctggttcgttagttgcttacgcaccgcatgctgttaatcaaccccaaatgttgcctcaaatgatgggattagcatccaccagagttgcattaccacttgatcttgcacaagatgggcccatttatgtcaatgcaaaacaataccatggtatactgagaaggcgacagtcacgagctaaacttgaggcacagaacaaactcatcaaaaatcgtaaaccatatcttcacgaatctcgccacaaacatgctttgaatagagttagaggatctggtggccgatttctaagcaccaagcagctttcanagtctaatgcanaatttgtcactggttcacattctggccctggcaacaattatcaaaa

SEQ ID NO: 7425 - DNA, 669 bp, Medicago truncatula
  Predicted polypeptide sequence is orthologous to G929, G2344
attatggccggggggattggtggcagcagctccaactacaacacaaaacacaaacacaaacacacagacagaacacaacacagtaacacttctcttctcttctccactgccccaacacacaacaacacttcaaccttcttctatcattttcaattcacaacactaagatttggacagagtgcatgtgaatcaggaaaccatgacttcttccacacatgatcccacagataatgaggctgatggacagcagcagtcagaatcacagatgcagccaatatctgcaaacggaatttctcacgccagtattgataatgctcagattgttcagtatgcagcacctccacagcttggtacggggcatgccatggcaccaccacctgcttatccatatccggatccctactacagaagcatctttgctccctatgatgcacaaccttatccgccgcaaccctacggtggacatccaatggttcgttctaatatcttggtgttgattctttgtaatacggtggtttcttgtcaaagttattttcttatctctatatggttgaaccatattctgtgccaggccaatcttcagttaatgggaattcagcatgcaggagttcctttgccaactgatgcagttgaggagcctgtgtttgtcaatgcaaaacagtatcatgg

SEQ ID NO: 7426 - DNA, 851 bp, Medicago truncatula
  Predicted polypeptide sequence is orthologous to G938
gaaaaagatgtctagagctcaagatggaatattgaattacatgctgaaaatgatggaggtttgtaaggcacaaggctttgtttatgggataattcccgagaagggaaaaccggtgaccggagcatctgacaatcttcgtgaatggtggaaggataaggttcggtttgataggaatggtccagctgccatatccaagtatcaagcagataacgcaatcccaggaaagaatgatggatgcaattccattggtccaactccacacaccttgcaagaattacaggacacaaccttgggttctctcttatcagcacttatgcagcactgcgatcctcctcagaggcgtttcccattggagaagggcaatcctccaccatggtggccagccgggactgaagactggtggccccagatcggtttgcctaaagatcaaggccctccaccatacaagaaaccccatgacttgaaaaaagcatggaaagtcggtgttctaactgctgttatcaagcatatgtctcctgatatagccaagattcgcaagctcgtgaggcagtccaaatgccttcaagataaagtgacagccaaggaaagcgcaacctggcttgccatcatcaatcaagaggaatccttggctcgagaactttttccagattattgccccccgttatcctctggtggaggtactggttctatggtcatcaacgattgcagtgagtatgatgttgatggggctgacggcgagtcaaactttgatgtggaggaccgaaaacccgagaatcttcatccatccaatcttgggatggatagaatgaggggaagctttccagttcagcaaccttctcatcaaatcaagg

SEQ ID NO: 7427 - DNA, 710 bp, Medicago truncatula
  Predicted polypeptide sequence is orthologous to G938
atctgaagacggcctggaaggttggagttctgactgctgtcatcaagcacatgtcacccgacattgccaaaattcgcaagcttgtaaggcaatccaaatgccttcaagacaaaatgacggctaaggaaagtgcaacctggcttgcaatcgtcaatcaagaggaggccttagcgcgggagctttatcctgattatatccccccatttgtcccagctggacctttcggcatcaatgaaggcaatgagtatgatgtcgatgggggagaagaggagccgaattttgatgtggaggaacggaaacctgagaatcttctccatcaatccaacatcgggttgatggagaggatgagaggtgtaagactgccatttcagcagactttcgcaatgaaggaagaggctgtgaccaacttggatttcgtgaggaagcggaagatctctggcgagtttaacatgatggatccgaaaattttcacttgccaacactctacatgtccttatagccaagctcacatcggttttccagacagggcttctagggacactcatcaattgagttgtccatatagaggctcttcttcatcagattttggtggtccaagttttcatgctaatgaggtaaaaccagtcatatatcctcctcaatcattcgttcaaccgaaacctatgatggctcagtctgttaatatggttccaccttccattgacataact

SEQ ID NO: 7428 - DNA, 654 bp, Medicago truncatula
  Predicted polypeptide sequence is orthologous to G938
cctcgtgccgcctttttgggttcctttcatttttttctttcaattcttattcttcaccaataacaaaaaaaaaaacgcaggttacccttatcgaatcgaatcccaaagttcgtttttttcgtaccaattttcattcatgggtgaactcgttgaaattggagctgaaattggctcagatttagatgtcgacgatattagatatcacaatattccagagaaagatgtcagtgatgaagagattgaggcagaagatttggagaggcggatgtggaaggatcgtatcaaactcaaaaggctcaaggaaaaacaaaagcttgaagcgcagaaagccctagagaagcaaaagccgaggcagtcatctgatcaagctcgcaggaagaaaatgtcgagggcacaagatgggattcttaagtacatgctgaagctcatggaagtctgcaaagctcgtggatttgtgtatggaatcattcctgagaagggaaaaccagttagtggttcatctgataacattagagcttggtggaaagaaaaggtgaagtttgataggaatggtcctgcagccatagcaaagtatgaagcagagtgtcttgctatgagcgaggctgaaaataaccgaaatgggaactccccagagcacgctccaagacctgcaga

SEQ ID NO: 7429 - DNA, 801 bp, Medicago truncatula
  Predicted polypeptide sequence is orthologous to G958
ataattggaaggaagaaggaggtccaaagtatatattcacatatatatggcacctgtttcattgcctccaggtttcaggttccaccctacagatgaagaacttgttgcttattatctaaataggaagattaatggccataagattgaattggagatcatagctgaagttgatctctataagtgtgaaccgtgggacttgccagggaaatcattgctaccagggaatgatatggagtggtatttctttagccctcgtgataggaagtacccgaatggatctagaacgaatcgtgcaaccaaatctggatattggaaggcaactgggaaggatcgaaaggtgaattctcaagctcgagcagtaggggtgaagaaaaccctagtttactatcgaggaagagcaccccatggctctcgtacaaattgggttatgcatgaatatcgacttgatgagagggaatgtgaaaccactcctagtttgcaggatgcatatgctctttgccgtgtgatcaagaagagtacagtgattgtgccaaaagttggaggacaatatggtaatattacaagcgaccaatcaccaagagttgagctatactctgaaagaaggggtgaagatttagatagttcaaattatttgatgcaaatgaaggattgttcaccacacaatatggtaaatgagacttctctcaatatcaatggtacatcaagggatcatggaaattggttgcaattctcatctcaagacccattatttagtcttccaacttcttcttcatttcctaattatggagccataacataccc

SEQ ID NO: 7430 - DNA, 657 bp, Medicago truncatula
  misc_feature (528)..(528): n is a, c, g, or t
  misc_feature (570)..(570): n is a, c, g, or t
  misc_feature (631)..(631): n is a, c, g, or t
  Predicted polypeptide sequence is orthologous to G962
aaataaataaataaataaatagattttgaaagtataaaagaggagagagcaaaggggtgtgttgttgttgttgttagttagttagagagagtggatggcaatagcagcagcaacatcatcacctaacatgagcagcatgagcttgagtcacgaagatggaacttctaacgataatattaacaaaggagctacagctacagttacagtagtagatgatgatgatgatgctgatgatgatcacgagcatgacgtggttatgccagggtttcgtttccatccaactgaagaagaacttgtagagttctaccttcgccgtaaggtcgagggaaaacgtttcaacgttgagcttattacttttctcgatctttatcgctatgacccttgggaacttcctgctttggcagcaatcggagagaaggagtggtacttttatgtgcctcgagataggaagtatcgaaacggtgatcgtccaaatcgtgtaacaacttctggttattggaaggcaacaggagcggataggatgattcnaactgaaaacttccgttcaatttggactcaagaaacccctanttttctattctggaaaagctcctaaaggcatccgaaccagttggattatgaatgagtatanattaccccaacatgaacccgaacgat

SEQ ID NO: 7431 - DNA, 596 bp, Medicago truncatula
  Predicted polypeptide sequence is orthologous to G977
aagcacgtaccaatttcccatacaacccaaatggaccacaatcttcttcatctaagcttctttcagcaactttaactgcaaagttaagtaagtgtcacatggcttctctttctcttcaaatgaccaaacaacaacaaccaccacaaaaagagccacaacaagtttcatcacaaagtttcaattcttccattaatagtaacacttttgtctatgggaatgacattggtggaacaagtggtgaaactagtttaattagatggcttgatgaaggtaataattgtgttgggtttgaaggtcaagttgaagtttctcatcaacaatttcaacctgttcttgaagatgatcacattgaacaaatgattcaagagttgcttgattatggttcaattgagctttgttctgttggttcatcttagactacctctaatataatataatatagcatttaagcctttcttggcacgaagagtcactgagacccaactcgcctaaaacaaagttcatatcaaaagaaaatgtatcatttatccatgacacctttttgagagagagtggtagtaaggggtactaattcacctgtaataaatgtataagat

SEQ ID NO: 7432 - DNA, 756 bp, Medicago truncatula
  Predicted polypeptide sequence is orthologous to G987
tgagattcctaatagcacttgttgtgttactactgattctggtaatagttctagttctaatgagttaaagcctctttcacctgatacaccagtttctggtggtgattctggttttaattcagtgaagtctcaatttattgttccaaatcatggtttgaatttgagtaatagtaatattagtgatggtgtttttgatttggattcttctgagactagggttatggctcaaaatatttttagtgatgctgattctattttgcagtttagaaaagggttagaggaagctagcaagtttcttccacaaaaagctcagctttttactggttttcagaatgctagtgatagtttagtgtctcatgagcctaagggtagggttggagtgatcaagatggagggtggtgttagggagaactcgaattcgagttattcgagttcaaatttgaattcgggttattcgagttcaaattcgaattcacatggtttgttgaagagtagaaagaatcacgagcgtcaagaaagtgacgatgaagaaggaagaattaacaagcagtctgcggtttccgttgaggagagtgaaatatctgatatgtttgatagagttttacttagtgttgaaaatgtgccgttgtgtgctgaacaaaaggatggatccatggtggagagtagaacacaggttggtgaacttgatggagggaagatgcgttcgaagaaacaagggaggaagagggatgctgtggatttgaggacccttttggt

SEQ ID NO: 7433 - DNA, 593 bp, Medicago truncatula
  Predicted polypeptide sequence is orthologous to G987
gcctcgtgccgaattcggcacgagggtttgtcggcttaaaaatttacttgatgagacagttgtgttgaatagtcccagggatgctgttttgaaattaattagggacacaaatcccaatatctttatacatactactgtcaatgggagctacaatgccccattctttgcgacacggttcaaggaggctcttttcaattactctacaatgtttgatgtgcttgacatcaatgttgctcgtgaagatcaaacgaggttgatgtttgagaaagagttctgggggagggaagtaatgaatattatagcctgtgaaggttctcagagggttgagaggccagagacatacaggaaatggcaggttcggaatacaagggctggatttaggcatctgcccttggataaacatctcattaacaagttaagatgcaagttgaaagacgtgtatcatagtgatttcatgcttgttgaagatggaaactgcatgctgcaaggatggaagggccgtataatttacgcttcctcctgctgggtacctgcataggacttggcaatgatctgctcaaggaatctgcatagggctatgggtgacatattct

SEQ ID NO: 7434 - DNA, 669 bp, Medicago truncatula
  misc_feature (71)..(71): n is a, c, g, or t
  Predicted polypeptide sequence is orthologous to G987
actggccggcgtttagctaactattgtgaacgtttcaatgtttccttcgaatacaaggccataccatcacngaaattgggaaaccattcaaattgaagaccttaatattaagagcaatgaggtagtggctgtgaactgtttggtaaggtttaagaatttacatgatgagacaatcgacgtgaacagtcctaaagatgcagttctgaagttaatcaggaagataaatccgcacatatttgttcaatccatagtaaatgggtcttataatgcccctttcttttccacacgcttcaaggagtcacttttccattattctgcaatgtttgatatgtatgatactctcatatcccgtgaaaatgaatggaggtcgatgattgagagagagtttttgggccgggagattatgaatgttgtagcatgtgaaggttttgagagggttgagaggcccgagacatacaaacagtggcaggttaggaatctaagggctggctttaggcaactcccactggataaggaggtaatggtcagatttagagataagctaagagaatggtaccataaagattttgtctttgatgaagataacaactggatgcttcaaggttggaaaggccgaattatgtatgcttcggctggttgggtgccagcataatgatatgttactgaatt

SEQ ID NO: 7435 - DNA, 838 bp, Medicago truncatula
  Predicted polypeptide sequence is orthologous to G1017, G2567
cctaggttggattattcagcagaaccacctgttcagacaattattgctaaggatatgcatggacagtgttggaagtttagacatatatatagaggaacaccaaggagacatcttttgacaactggttggagtaattttgtgaatcataagaagcttgttgctggtgattcaattgtgtttttgagagcagaaaatggagatctttgtgttggtataaggagagcaaagaaaggtggaattggtggtggaactgatcagttttctaattcttctagtacttggaaccgtgtatcacctttgtttggtggtgttggttctggtttcttgtgtggaaatgataacagaaaaaatggttgtgatgatttgatgggaaaagtaggagctgaatctgttgttgaagctgtaaattgtgctgttaatggaagatcttttgaggttgtgtattatccaagagctagtactcctgaattttgtgttaaggtttcttcagttaaatctgcaatgcaaattcaatggtgttctggtatgagattcaaaatgccttttgaaactgaggattcttctaggattagttggtttatgggaactatttcttctgttcatgttcaagatccaattcgttggcctgattctccttggcgccttcttcaggtagtgtgggatgaaccagatttacttcaaaatgtgaaatgtgtaaacccttggttagttgaattagtctcaaacatgccaaatttcaatctctcaccattcacacctccaagaaagaaaccaaggtttatccaagatccatattttcacctcatgaatcaatcatcatcaccatcaatctcccaca

SEQ ID NO: 7436 - DNA, 752 bp, Medicago truncatula
  Predicted polypeptide sequence is orthologous to G1020
cttctcactttcattttcattttctcacaatggctccaagagataacagaatcaccaacaccaccaccgggcctgggccaaacccatcagcccaggctcaagcccagaaagagattcgttacagaggtgtaagaaaacgtccatggggtcgttacgccgctgagatccgtgacccaggtaaaaaaacacgtgtctggcttggaacattcgacaccgctgaagaagcagcgcgtgcttacgacaaagcggcacgtgagtttcgcggctcaaaagcgaagacaaattttccaacgccgttggagattatcaacaacggtagccctagtcaaagcagcactcttgaatcaccgtcgccacctccgcttgatttaactctcacaccattctcctcctcccacggtggtgttaccttggcctatccggtggcgcgtcctgttttgttttttgacgcattcgcacgtgctgaaacagccctaaccgttggccgtcgtgagatgtgtggatttgaacgtcccatggctgattttcgacgcgccgccgtgcagagtgactctggttcttcttcctccgttgttgattatgaaggtgtgccacgtcagagactcttggatcttgatcttaatgttcctccaccacctgaagttgcttgatctggatctattttgaagacccataagcaaaaaaaaattaatttttttttttctttttcgttttttgaagtacccattttgatgaacggaatcactctcgtg

SEQ ID NO: 7437 - DNA, 801 bp, Medicago truncatula
  Predicted polypeptide sequence is orthologous to G1020
acttcaagttacgctattctctcatcctcaccaacatcatcatcaatggttaccaaaacaaagaacgccgcgaatctcaaaatcaagaaaccttccaacaacaacaacaatgcaaccgagattcactttcgcggcgtaagaaagcgaccatgggggccgttacgccgccgagattcgcgatcccggtaagaaaagccgcgtctggctaggtacctttgacaccgccgaagaagctgccagagcttacgacaacgccgctcgtcagttccgtggcccaaaagccaaaaccaacttccctcctcctccttccgatgtcaaagaagatagccctagccaaagcagcaccgttgaatcatctgtccctgctcctgaccgtgaggtcacgcgccgagaagttcccaccggcggtagcgtcatggatcggttcccttttctctcgattcagcaacagatcatgccgtttgctggtgctggtgccggtgctgttgatggaatggtgccagttttcttttacgatccagcgggtcgagctgagtttttgaaccagcggtttactaacaggtttgaaccggaaccggttcagtttaacatcgggtttggaggtggggtccagagtgattcggattcgtcctctgttgttgattgtcagccgaagagagctctcaatcttgatcttaacttagctccaccaatggaatattaatttatttgattaacaccttttaattttgtttaaaaaaatattatctcaccttatttagatgaaaattagaaaaacagagaaaggacaaagtttactgg

SEQ ID NO: 7438 - DNA, 815 bp, Medicago truncatula
  Predicted polypeptide sequence is orthologous to G1020
ttctatgttaatttcaattatactttggctaaacaatacaattaagctaaaaaaacaaaaaactggagaacagtttcatagtagtaataatttgggaacaacagattgaaacctcttagtttctctgtcgcaaaaaatagacacagtcgcctatgtagtattcacatatctttcattcatcttcttcttcttcttcttcatcagaaactgttctttttctttctccactcataaaaactaaagagaaattcataatccgcaaaaataaaaacaaaaattaaaatccaagtttaagattctaattcatcgttcatagcatatcttccaaaggagggtagttaagatcaaaatcgaagcttctaccatggtggttcagatcaatcaccgaggaagaatctgaatcactctgtgcaccaaccgtcgcgtggaatccactcgcctccatagaaggattatattcaaatccataaccgtaacaagaacgtgaattcaccatgccggcacgtaacacaggatcaaaacaaaacgtctggttaaccgccggcatcggagtgaaccggtgctggaaagcaggagctaagttgagatcaagcggtgaagaatcagcggcggcgtcacggtcacggcttgaggattcaacggtgctgctttggctagggctatggatcttaatattttctatagggaaagggaagtttgttttcgcctttggacctcggaattgacgtgcggcggagtcgtaagctcttgctgcttcctccgccgtgtcgaaagttcgagccaacgcggctcttctttcctggatctcttatctc

SEQ ID NO: 7439 - DNA, 759 bp, Medicago truncatula
  Predicted polypeptide sequence is orthologous to G1033
tatatctctctccccccccccccccaaaccctagtttccaaccccattccacctttcgttttcatcatgaaaggagccaagtccaagggtgaatcgaagaaagccgatgctaagcttgccgttaataagaagggcgccgccgctactaagggcggaaggaaaccagccaagggaaaggaaccaaaggaccctaacaagcctaagagacctccaagtgctttcttcgttttcatggaggattttaggaagcagttcaagaaggataaccctgacaacaaagctgtgtccgctgtgggcaaagctgctggagcaaaatggaagtcattgtctgaagctgagaaagcaccatatgcagcaaaagcagagaaaaggaaggcagaatatgagaaaaccatgaaggcatataacaagaaacaggctgaaggtccagctgctgttgaggaagaagaatctgggaaatcagaatctgaagtgcatgatgagaatgaggatgatgatgaggatggcagtgaagaggaggaggatgacgagtagaaacttggatgatgataacatttatgtaggatgtgctgatgatttgatcatcttgtgtagatgatcttttcgtttcttgataaacatgtcttacttctaggaatattttgctgctcccttggtaaatgttttgtcttttcaaaacgtgaatagctaaaatatgagggagctagcccttatctgtacttttaaatccactattttagttaagaggtgtttatcttt

SEQ ID NO: 7440 - DNA, 684 bp, Medicago truncatula
  misc_feature (608)..(608): n is a, c, g, or t
  misc_feature (623)..(623): n is a, c, g, or t
  misc_feature (674)..(674): n is a, c, g, or t
  Predicted polypeptide sequence is orthologous to G1033
cctttgtctctttgattctctgcttgctgtgtcttcggttcttctgcttcgcttgttgaagatcctctcttcaacctttcatccattttaagatcatcttgatactagaacgaagacgatgacaaagggcaagggaacagcaaagacttcaagggatgctttgaaaccagttgatgatcgaaaagtaggaaagagaaaggctgctgctaaacctgagaaggtgccaaagactaagaaggagaagaaggccaagaaagatcccaacaaaccaaaaagacctcccagcgctttcttcgtcttccttgaggatttcagaaagactttcaaggcagagaaccctaatgtgaaggctgtatcagctgttggaaaggctggaggagagaaatggaaatccttgactaaggcggaaaaagctccatatgaagccaaggctgcaaaaaggaaagttgagtatgaaaagcttatgaatgcttataataacaagccaagttcagcggacgatgacgaggaggaatcagacaaggacaattctgaagttaataatgaagatgaagcaagtggagaggatgaccaccaagatgacgaggaagaggatgacgaggacgaanatgacgatgaagacnacgagtgagatttgtgtgcataacttgaaatatgatgtttcattggtggangggaggtttt

SEQ ID NO: 7441 - DNA, 657 bp, Medicago truncatula
  Predicted polypeptide sequence is orthologous to G1033
aagttcaatcaccgtttcaccatgccgaaagctgtttccgacgccaaacctgctgataaccggttgaagcgcaagggcgcaggtactggaaccaagcagtcgaagaaagctaaggatcctaacaagcctaagaggcctccaagtgctttcttcgttttcatgtctgagttcagagagaggttcaagaaggagaatccaagcaacaagtccgttgctgtggttgggaaagccggtggaaaggaatggaaagctctgtctgatgctgtgagaattttgcttctgtttcaccgaaggaaattaatctaattctcttagttttgattttaaagtcgtttttgtgatttgtgtattttaggataaggctccattcattgctaaggctgataaattgaaggaggagtatgagaaaacaatgcgtgcttacaatatgggaattgtaattacttttatcacttttctgtgactttgatttttccgtgttctgattttacttggatttatatctcgtgtttgctgatttgagctaattttggtgcattagactgagaagaatgcttcggaggaagaaggatctgagaagtccaagtctgaagtgaatgatgatgatgaggatggtgatgatgaggaggatgaagagtaaggttggtggtgctgaag

SEQ ID NO: 7442 - DNA, 707 bp, Medicago truncatula
  Predicted polypeptide sequence is orthologous to G1037
gtcaagcgacgtgccaatatctggaatccaaacaaattctttctcttcaagtgaatgttttagacagacagctgttcctccttcagataacatggcttctttgcccttgcaagcagggtattctggtggttcgttgccagatatgcactcccaaggaatgatttttactaattcacctgagtatataaacggtaatttgccatttcaaggatgggaagaccgtaatcaggatgctacttaccactcaaatgttacttgtgggtcaatgaactctcttgctccagttaacggtgccgttgttccaccaggccagacagcaactgaatccaccttggatactaaattttttaatcccatacaaatgaagcatgctggatttgctgagttaactgaatgcagctcatcaagacaatctccagctaatatcataagccagcagaagttttctaataatcttggttcgctggaatacttggcgagttcaatgatgggacaggagcaagataagatgaaattgttgggtggagacttcatatgcgataattactccgacggggtatctttgtgacaggagttttggaactacattcagcatcatgttgtcctcgttgatgaattctagattgataattcctcctctcatgtacacatgctatttaaccagttttgtcctaggagttttctttgtgggatttagcttctccttt

SEQ ID NO: 7443 - DNA, 559 bp, Medicago truncatula
  Predicted polypeptide sequence is orthologous to G1037
gtttgtgcatagtagagaagagagaataatggatgatttcagtgatcggtttcccatcggaatgcgtgttcttgccgttgacgatgatcctacttctctcttgcttttggaaactctcctccgatcatgtcaataccacgtaaccacaactagtgaagcaataactgcattgactatgttgcaagaaaacatagacatgtttgacctggtaatcgctgaagttcacatgcctgacatggatggactcaagctgctggaacttgtaggacttgaaatggatcttcctgtcataatgttgtctgcacatggtgaaacggagctggtgatgaaggcaatttcccacggtgcccgtgattttctgctgaaacctgtgagattggaggagctaaggaacatttggcagcatgtaattcggaataaggagtcccagtttgtttggtctgtggagctgcaccgcaagtttcttgaaactgttaatcagttaggagttgacaaggctgtacccaaaaagatttttgattttgatgaatgttgaaaatattacaagggaagacgttgg

SEQ ID NO: 7444 - DNA, 661 bp, Medicago truncatula
  misc_feature (85)..(85): n is a, c, g, or t
  Predicted polypeptide sequence is orthologous to G1037
cgacgatccaacttgtctcttggttttggaaactcttctccgaagatgtcaataccacgtaaccacaactagtcaagcaataacnggcgttgaccatgttgagagaaaacaaagacaagtttgacctggtaatcagtgatgtacacatgccggacatggatggatttaagctgcttgaacttgtgggacttgaaatggaccttcccgtcataatgttgtctgcatatggtgatacaaagctggtgatgaaaggaatttcccatggtgcctgtgattatctgctgaaacctgtgagattagaggagctaaagaacatttggcagcatgtaattaggaagaagaagtctgatccaaaggagaaaaacaaaaccagtaaaccagacaaaactacttctgacagtggcagtggactaagatctgcaggagcagaaaattcagatgaaaatggaaagctgactaagaaaagaaaggatcaggatgaagacgaagacgaggataaagagaatggtaatgacaatgaggacccatcagctcagaagaagcctcgggttgtttggtctgtggagctgcaccgcaagtttgttgctgctgttaatcagttaggcattgacaaggctgtacccaaaaaaattcttgatatgatgaatgtcgaaaatattac

SEQ ID NO: 7445 - DNA, 827 bp, Medicago truncatula
  Predicted polypeptide sequence is orthologous to G1043
gctacactaaattatagcaaatgaatgttattttacctgaaactgtctctgccaagaaaaagaagctactcataaaagagcttcttcagggtaaagaatatgctactcagttaaaacttttgcttaagaatcctgtttgttctgatgggtctccttctgttaaggaattggtgactaatgtgttgagatctttctctgagactatttctgtgatgaattctactgaagattgtagtttagatgtgaatgattcaggttcattggtggaagctgatgatttgaagtctgaagatacaagtgagagtaagaagagattgtcgccaactacaaaggatagaagaggttcctacaaaagaaggtactgtttgttttgtacggacacaaggaaaaaacatgttttttttttgcactattctcacacatgataagaagaaattactaatctttattgttaattattatgcaggaagacagatgagacaaggaccatagtctctaaaacaattggtgacactcattcctggagaaagtacggacagaaggaaatcctcaattctaatttcccaaggtaatcaatcattattttcctctgctttttctaatgattttgttaattttttaattgaagacattattagttactcgttctatttatacaatatgagcaagttaaaattcataataaaaaaaaagttcataaaaataattgagctagtcaaaaatatttttttaacggttctaaatcgatgtatgatcagatttagaaaatagaagcattttagaggccaatttagatgtgtataattgattgggtctctggaattaat

SEQ ID NO: 7446 - DNA, 802 bp, Medicago truncatula
  Predicted polypeptide sequence is orthologous to G1048
gattccattcaactcattccattcatcatcttcttcgtaatttttgggtaccatggacactttcgaaccccaaatcgatttcgaatctctcttcgcagaatacgaagtcgccgattttttgcaggaggatgatatcaatccttctgtttccgtcgcagacactccctcgcctctttcagagattgagaatcttctcatgtctgatgccgagggaattgcgtcctcatcatcggattctgactatcataagcttctccaagatattctcgtcgaccctatccctctatcggatgatcaaggtttcgttctttctgatgaagccagggttgatccagtaactcctcaagaggttcctcctgaacccgtttcaaaaaagcaaattaggcagatgaggaacagggacgctgctgtgaaatcaagagagaggaagaaggtgtatgtgaaaaaccttgagacaaagagtaggtattttgaaggggaatgcagaagattggagcatttgcttcagtgctgctatgctgagaaccatgctttgcggctttgtttgcaatcgcgtggtggctttggtgctcccatgaccatgcaggagtctgctgtcctcttgttggaatccctgctgctgggttccctgctatggttcctgggcatcatgtgccaactcagtctaccccttccactgtcgctaacaacagtgttacctccaagagaaaacatggatcacaaaggtctaagaaggggtggctctaaaagggccaaacagtaataatatctctgattattttctgacttcgatcgtttgtaa

SEQ ID NO: 7447 - DNA, 625 bp, Medicago truncatula
  Predicted polypeptide sequence is orthologous to G1049
gcttcaaatcctcacaatcttatattcattattccaccatgcaaaccaaagagattaatacaggactcaattatttactcccatattcagatccatctccctatccaccatgtaactataacatgatccaaaacaccatccaaacacctcaacatccaaaactctccaaccaattctatggtttcaaccaaaaccctattcaaattctccaagacttcagtcctccatcctcatgcataagcagcaactcaacttccgacgaagcggacgaacaaaacctaggtctaatcaacgaaagaaaacatcgaagaatggtatcgaaccgagagtcagcacgccggtcgcgaatgaggaaacaaaaacagcttgatgagctttggtcacaagttgtttggctaaggaatgaaaatcatcaattactagataagctcaacaatttctgtgagactcatgataaagttgtccaagagaatgttcaattgaaagaacaagcttcggaacttcgacaaatggtgtgtgatatgcagttacatagttcttgtcttcctttgagtcctcttgaagatgttcctagcatcacttcaccaaatgttaaatctgattcttcaaactaataaatcacaag

SEQ ID NO: 7448 - DNA, 841 bp, Medicago truncatula
  Predicted polypeptide sequence is orthologous to G1050
ctccttatccccaatttatgcctccacaatctcaaactcattccaggtctttgtcacaacctacttttttatctcttgattccttttctttgccaccattgagtccttccccttccccttccccttatcatttaagttctaaccccttttcggaatcgggttcgaaagatgtttctatggaggatggcttgggttttggtgcccatcatgtaccttcgcctaaccgcggtcatgctgttcaacatggtcattgtcttccgcctcgtaaagggcataggcggtctagcagtgattctcctttagggatatcagaatttgttaactctgagcctcagctggtgacacctcagctggtgagtgtcagtgatcgtcggaatttggtgtctggaggagagaaacctggttatgagaagccgattcagttggtgttgaaggatagggactgtgttgatgggtttagaggagagagtttcgatgggaggaaagagaatgttggagctgaaatggatgatttgtttagtgcttacatgaatttggagaatatgcacaatatgagtttttcgggtatggaagatagcagaaccagtggttcgaagacggttgaaagcagtgataatgaagctgagagtcgtgtaaatgtgaaaggaataggtgctaagggtgcgagttcaagctgttcggatgagagaagggaaggagtcaagaggagttctaatggagatattgctcccagtggtcgacataggagaagttactcattggatagttccattgaaaattttaatattgaagatcataagcttcctcctttacaaggtcgacctggtcaacactcgcctag

SEQ ID NO: 7449 - DNA, 568 bp, Medicago truncatula
  misc_feature (499)..(499): n is a, c, g, or t
  misc_feature (529)..(529): n is a, c, g, or t
  Predicted polypeptide sequence is orthologous to G1050
atttggtttgccctcaaatgcatgttttcccttttgctgaaactaactatagatgagatttcctttatatagctaattatgtttgtaagagttactactgtttttggaaataagcatcatgggaaagcagatgtagagtagttggttttctcttcgcatttggtatatttaatatactttgtgatgcgcacttcttttctattagaagtattaataaaagccataatatcttgtcaacaacgattatatacaatctctagtagttgtcacctgtatcacaaacaattttagacttagtcgtaggacttttcatcgattgctttttactgattacttctgatctgtgtatcctcatctaatagctctgaatgaggcgcttactgccgaggttcaaagactgaagattgttacagctgagctgaatggggagtcacttccttctaactgcatgattccgcaacattctgtcaaccctatgatgttccaacaacagcatcancatcagcagcatcaacaacaacagcagcanaatggtaatgccaactcaaagaaatgagttaaagcaata

SEQ ID NO: 7450 - DNA, 619 bp, Medicago truncatula
  Predicted polypeptide sequence is orthologous to G1050
gtcctacaccttcccacacacgatcactctctcaaccctcttttttctctctcgactctcttccacctctcagcccttgcaccgtttcgcgaatcttcctccacgtcggatcatgctgacgtgtccatggaagatcgtgacgtcacttctcattctccgttacctccgtttgctgctagaaacccttctttaccgccgagaaaatctcaccggcgttctaacagtgatattccgtttggattttctactgttttgcagtcttcgccgccgttgattccgctgagaggaagggaaggtgttaaacctaattcttctgtggtgaaaagggaaacgaattgggaacatggtaatgtagaggagaagaaatcgttgtcgccggaaggtgaagttgtggatgatcttttttctgcttatatgaatttggataacattgatgcaattaacgatgataaaaacgcggctactgatgatagtagagcgagtgggacgaagactaatggtggtgatagtagtgataatgaagctgaaagtagtgttaatgagagtggggatagtatgcagaggagggaagggaataagagaagtgcaggaggtgatattgcaccgactacgagacact

SEQ ID NO: 7451 - DNA, 658 bp, Medicago truncatula
  misc_feature (636)..(636): n is a, c, g, or t
  Predicted polypeptide sequence is orthologous to G1051, G1052
gtcattaagattactactagtggtactacttaataatactaatattatactacatgttacaatgaatattaattaataatgcagctcatcaagaagcattgaagagggagatagagaggctgaggcaagtgtatcaccaacaacaaaacatcaagaacaatgctacagcagcagcagtgtcaccatctccatcacctaaaccacgatgtgataatgatactcacattgaaaatgaacatcttatcaatgtttgagacatggctagttcacatgatcctatgttgtctttcttgatatttttttatttttagaaggtggatatttttatttttgttggaatatccctatttcttactactaaaatttggaaggaagaataattaagtagaaaaagaaaagacaaaaagttgtaatgtaatggtaagaaattttgatgaaggataatgtgatgggagaatataagtggtaagcttttgctatcaaactgtggtagtcacgtgatgtgtttactttatataatgggaccactcaaagttgcatgattggaattcagtgaaacacatgtgcaccactcagtgacatcaatatcaaagagaagaaataaacagtacttggtggtgttggtgtctcctttanctatatgggggttatgtaatgt

SEQ ID NO: 7452 - DNA, 259 bp, Medicago truncatula
  Predicted polypeptide sequence is orthologous to G1063
gcacgagggacatcgattgttataaaatatttttgggccctcctcttatacctatgaaatgcatcgatggtgaatgtaaaaggattacatagttaaggttatcggtcggaaatccaagctttgataggggatattgggtgggatgtgtctattgtactattattattgaaatttgaattgttttgtggtctgtaaattattggctcataagctatattataaaatatgaactttaaataaaaaaaaaaaaaaaaaaaaa

SEQ ID NO: 7453 - DNA, 823 bp, Medicago truncatula
  Predicted polypeptide sequence is orthologous to G1069, G2153
ccttctccttaccttagctaccttctttctatttttattctatctttttcttcttcatttgttccctcactcactcacaccttacaataatcctttacctcatcactcactttctagctcaaaaatccaatctctcatcttcatatctagtaacttgttgcaaagattttattgctagatctagtgatcaagttagttgatccatattttgctaccacgatctacttagattcagcttttgttgcttcgattgtaagttaaaaacaattagctatccacatatagataaattaggtttgaggaaatttgttgtggccggttcaactcaactttgatggcgaacaggtggtggaccggaccggttggtctaggagggatggacaactcagtaacctcctctccactaggaaaaccggatctgggtttctccatgaatcaaagtgctgtaacaggagtgaacaacatgaacaacaacaacaatgaagaagaagaagatgagaaagaaaacagcgacgaacacaaaggaggtgcaatagaaacaaacacctccacgcgccgcccaagaggccgtccatcaggttcaaaaaaacaaaccaaaaccaccaatattcataacaagagatagccctaacgcgctacgaagccatgtcatgggaagtagcaacaggaacagatatatcagatagcatcgttcagtttgcaagaaaagacagagaggtatttgcattctaagcgcaagtggaaccgtcgttaacgttttctctcggcacctacaggtcccggagctgtggtagcgcttcagggagatttgaatactctcttg

SEQ ID NO: 7454 - DNA, 759 bp, Medicago truncatula
  Predicted polypeptide sequence is orthologous to G1075, G1076
attctgaagaacaggaatcaaatcgtgccagtgttggtggtggtgcaccgttctcatcgaacgaagaagatgatcgcagccaaggtttagagcttggttcagcagccggaccaggagatgtggtaggccgccgtccacgcggcagaccgccgggatcgaaaaacaaggccaaaccaccggtgatcatcactcgagagagtgccaacactctcagagctcatattcttgaagttgccggcggttcagatgtttttgaatgcgtatctacctatgctcgccgccgtcaacgtgggatctgtgttctcagcggcagtggcactgtgacaaatgtcagtatccggcaaccagcggcggctggtggtgttgttacgctacatggaagatttgagatattatccttgtctggatcttttctgccaccaccagctcctcccggagcaactagcttaacgatttatcttgctggaggacaaggacaggtggtgggaggtagcgtggttggtgagcttatcgcggccgggccggtgattgtgattgcagcttcttttactaatgttgcttatgagaaattgccgttggaagaggagcagcttcagatgcaggctgaggctggaggaggttctcaaggctccggtggtggcggtgggcggcataatataacaatccattttctgatccatcttctggtttaccggttttcaatttgccattgaatatgcagaatggtcatcagctaccctgtgatggtttgggcgggaa

SEQ ID NO: 7455 - DNA, 796 bp, Medicago truncatula
  Predicted polypeptide sequence is orthologous to G1075, G1076
aatctaattaacaactccaacaacaaaagccaaatgttttacaaattgttcctagaaattaattaacttagtccttacaacataacctaaccatggaaattaaattaagaaaacgagacttgaatagaaaatcagtacttcttcacaaatgatttcaaaggaaaataaaaccatggaattcaactcacctttgtgctccaattaagctcaataagattgtcttccaccagagtttccagcccaaccatccactggtaattgaggcatatttagaggcaaattaaagaacgggagcccggatgatggatcgggaaaagagttattgacaccatcaccgccaccgccaccaccacctgcagatgattgcccttgttgcatctgaagagattcatcttcatccaacggtaacctctcatacgctacattcgtaaaagatgaagcgatgacaataaccggtccagaagcaaccaaaggaccaacaacatttcctcccacaacttgaccttggcctccaccaaggaacacactcaaacttgtagctcctggaggagctggtggtggtagaaacgatccggacaaagaaagtatttcaaaccttccatgtaaagtcactacagatcctgcggcagctggctgtcgcaaggtcacgttagtgactgttccactcccactaaggacacagatccctctttgacgctttcttgcattagtagccacagagtcaaacacatcacaaccactacttactttcaggatgtgagccctaagtgtgtttgcactctctcttgtgatgatc

SEQ ID NO: 7456 - DNA, 652 bp, Medicago truncatula
  misc_feature (480)..(480): n is a, c, g, or t
  misc_feature (632)..(632): n is a, c, g, or t
  Predicted polypeptide sequence is orthologous to G1078
gtagaatgatgtacatgtggagatcaatgcatcagtaccatgaagttcaaagcaacatagtgcagcaagtccgcggtctcgtgaatagatcaggaggtgagtcaacttctgaactgcacaggcaggcaactcgtgaccttgaatcggctgtctcggcttggcactccagtttttgccgcctcataaaatttcaacgggacttcattctctccctacacggctggtttaagcttagccttatgccagtcgataatgataacgtcaacaggatggaacactccgacgcgtacatgttttttgatgattggaagcttgcacttgaccgcgttcccgacacagttgcatcagaagccatcaagagctttatcaacgttgtccatgtcatatcttccaagcaagctgaagagctcaagataaagaagcgaaccgaaaatgcttccaaggaactcgagagaaaggcttcgtccgtacggaatttanaaagaaagttttacagctcgtattctatggtagggattggcattcctgacactggacctgataacggacaagggttggatgcaccccatccacttgctgagaaaaagatggaactagcaacctgccaaagacgtgttgaaaatgaaatgacnaagcattcaaaagctgtaaa

SEQ ID NO: 7457 - DNA, 727 bp, Medicago truncatula
  Predicted polypeptide sequence is orthologous to G1089
ggaaggatgattttgactcagatgagcatgaaactcatgctaccatcttggacaagttgctagcttgggaaaagaaactttatgatgaagttaaggctggtgaactaatgaaatttgattaccaaagaaaagtcgcttcactaaacaggctgaaaaaaagaggtaataactctgaagcattggagaaagccaaagcagctgtcagtcaattgcatacaagatatattgtagatatgcaatcattggattcgacagtctcagagattaaccgattacgtgatgaacaattgtatccaagacttgttaagcttgttgaagagatggccgctatgtggaaaaaaatgttatctgaacacgagaagcaatcggagactgtgacattgctgagatcgttggacccttcccaatctcctaagcagacaagtgaacaccatcatgagcgaacttatcagctattggttgttgttcaacagtggcatttacaatttgagatgctagtcaacaatcaaaagggatacataaagtccctaagtaattggttaaaattaaatcttatccctattgagagcagtttaaaggagaaagtttcttcacctccaagagttagaagtccgcctgtacaaggtcttctccatgcatggcatgaccgtctagagaaaattcccgatgaccttgctaggacagctataggaaactttgctgctgtgatagatactattttcaatca

SEQ ID NO: 7458 - DNA, 703 bp, Medicago truncatula
  misc_feature (484)..(485): n is a, c, g, or t
  Predicted polypeptide sequence is orthologous to G1095
agcatttattgacagtagattccattttgatcaatgcttacacaagggccattttcatctcaagatcaaaatccaactagagaaaatctcattggtggtgatgaagattttgttgtcattgaattgagtaacaataatgctatggagtcaccattaccattaccaagaccatgtcctattagtccttcaccaaggaaaatgttggataagaaaggaaggaaaaagttgcataaagagactagtatgggagatgaatgtattgatattagagcaacaaaagatgaacaattttcagttcaaccaattagaagatcattttcgatggattcctcatgggatagacatttctatttagcagttcaagaagctctgcagcagcaaaagaggcaagtcaatgaagtcaacaacaccattgaagggtctagtggtggaagtggaagagtcaagaaatcattcttttcatttggatatggaagtaattagnnagttcttctgttcaacctgtttatttagattcttgaattttaaatacctagtattctctttttagtttccattatgtttgcaacttgcaagtttcttagtttggttttttaggggtgagaatgtgatgtagagattttagaggtatgaacaggtcataggattaaaggattgtatgacacacaattattcaattggatttaattttaatttgaaaaaa

SEQ ID NO: 7459 - DNA, 775 bp, Medicago truncatula
  Predicted polypeptide sequence is orthologous to G1128, G1399
cagttttttccatcaaaattgaaaaatctgcttctgggttttcatcatttctaaaaaagtttatatttttgaagcttttctgtgttgttacaaatttttgtgtttctgggtatcttagttttgcattcaagttttgatttttgaagttttttagattttgggttgtgttagttttggtttgattctgagaaaaaatggaagaaagagagatttttggttctgggcatgctgttaatgttaaccaggccccacctggcttcaatttagctcaaaatacgttgaattttgctgggtccacgggagagttaccggctccggtgccggttgccggtggcgtggaggtgaagaagaagaggggcaggcctagaaagagtgaatctggaagtaagccggccgttgtcaccgatgccaatttcggcttccattccgttgaccggtgatttttcaggttggaaaagttggttggtggtggaggtgggaaggtgatacttataatacccatagatagatagagtatgagagacgcaaaggtcattgtcgacagacgctacggagatgtattcggtgtaaatatcgagaagagtggtgagagtgtgtagacgtctgccctgaataagagagtaaaggcgagaagactcgatcagacgggctgtagtcatagtgcgtgagtcgtgagataaacaaattgatagcgacgcgttatagaatatagcagagcgcgataggtggaactgatcatgcagtgagtaaagaagcagtaggctgattgatgcat

SEQ ID NO: 7460 - DNA, 607 bp, Medicago truncatula
  Predicted polypeptide sequence is orthologous to G1128, G1399
gtttaagctaaatttagaattttggggtgttttagttttctttgatttgcataaaaatggaagaaagagagaattttggagcctgtgaatgtagtgggtggtaatgaggttcctgtgagttttcaagctgctccaaggattgataacaacttggatttttccatggcaacggtgccggtgtcgttgccggagacagcgttgaagaagaagagggggagaccaaggaagtatggaccagatggtaagcctgctcctggagctgtgactgccctttcgcctatgccgatttcatcgtcgataccgttgactggagagttctctgcttggaaaagaggtagagggaagcctgttgaatctatgaagaaatcatcttttaagtttgattttgaaagtccacctgtgcaagttgtaggtggaggtgtaagtgagggaattgcatactcagtaggtgccaacttcacagcttatgtgcttacagtgaattctggcgaggatgttaccatgaaaattatgtcctcccaacaaggatcacgtgcaatatgcattctctctgccactggcaccatttcaaatgttacacttcgtcaatcgacttcttcagggggta

SEQ ID NO: 7461 - DNA, 643 bp, Medicago truncatula
  misc_feature (556)..(556): n is a, c, g, or t
  Predicted polypeptide sequence is orthologous to G1133, G1137
cagaaacagtttttggtcgttgatcaaacgggtgatcaaacaactgttatttatagttcaagatttgggagccctgttgagtgtcttggttcctgggattcgaaattgaatggttgtagcaatttaaatgggaatgatgaaccctccttaaggagagatgtgaatcatgtgattgaagttggaccaacttttgattataaagttgatgaaaatgataatcaaggaactgagattgaaagtgagatgcacgaagatacagaggaaatcaatgcattgctttactcagacagtgatggttattctactgaggatgatgaagttaccagcacagggcattcacccagtacaatgaccactcatgtcaaccaacaacctttcagaattggaggaaccgcagaagaagttgctagctcctcccctggtaaaacaaagaaacgtaagctattcaatatggcttatagtgatgttgatgtgcagtttatggacactgcaagctctctaaaacgaaacagaccctttgatctcaaccgcggtgttgatgatgatgacgacgcanaatcaaggtgctcgggtagcaattacggcagagggtcacctgaaattggttccttaacaggccataagaagatgagaaaggaaaaga

SEQ ID NO: 7462 - DNA, 551 bp, Medicago truncatula
  Predicted polypeptide sequence is orthologous to G1145
gatacacaaactcaaggtaggaaaagggttgcctctggtgttgtggttgagaaaactgtggagaggaggcagaagaggatgattaaaaatagggaatctgcagctcggtcgcgggctagaaaacaggcttacacgcaagagctggagatcaaagtttcacatttagaagaagagaatgaaaggcttaaaagattacatgagatagagagagtattgccgagtatgccaccaccagaccctaagcatcagcttcggagaactagctcagctcccctttgaagactttattgcaaatgagttcctagcaaaagttccaagcgctccaacagttctttcgcatttgctgcatatatttgaacgctcaagtatccaacaattggaaagctatttttcttctggggctatggttaattatcgctggcataccttcttcgaaagtgttttcctgtatgtacattttataagctagactttcagtttacccagccactatatatatgcattagtgtaattttgaacggaacaaaaaaaaaaaaaaaaaactcgagggg

SEQ ID NO: 7463 - DNA, 892 bp, Medicago truncatula
  Predicted polypeptide sequence is orthologous to G1146
cctaaagacaaagagcttgacctgctcattgttatattgcctgataataatggctctctctatggtgaccttaaaaggatatgtgagactgacttgggggttgtttcccagtgctgtttaactaaacatgtctttaagatgagcaagcagtaccttgcaaatgttgctttgaaaatcaatgtgaaggttgggggtaggaatacagtgcttgttgatgcactttctcgacgcattccacttgttagtgacaggcctacaatcatttttggtgctgatgttactcatccacaccctggagaggattcaagcccatcaatagcagctgttgttgcttctcaagattggcccgaaattaccaagtatgctggtttggtttgtgcccaagcacatcgccaagagctcattcaagatcttttcaaacaatggcaagatccagtcagggggacattgaccggtggaatgatcaaggagcttcttatatctttccgtagagctactggacaaaagccccagcgcatcatcttttacagagatggagtgagcgagggacaattttaccaggtgctgttgtttgagcttgatgcgatccggaaggcttgtgcatcccttgaacccaactatcagcctcctgtgacttttgttgtggttcaaaaacgtcatcatactaggctctttgctagtaaccaccaagacaagagctctgttgatcggagtggcaatatattgcctggtactgttgtggattctaagatctgccatcccacagaatttgacttttatctttgcagccatgctggaattcagggcacaagccgtcccgctcactatcatgtgctgtgggatgagaataattttagtgctgatggtcttcaaagtttaactaataacctgt

SEQ ID NO: 7464 - DNA, 794 bp, Medicago truncatula
  Predicted polypeptide sequence is orthologous to G1146
gactgtgttaactactttcctagctagatataagcataaggttataggcaaaaactaaacgtgaaaaactggttattttctgaaacttcttgtcactatagtcacctttgattggtgaatatatataatctatatatctatctattcctgcaagaactcagaaaaaattcaacatgcctttgaggcaaatgaaagagagttcagaacaacaccttgtgatcaaacctcatcagcaaaactctatgagtcaagctaagaaagttactaaagctgttcagaatggtaaaggtccaccattagtgtcacaagaacaacagaaccaaacttcaccacctcaagtaaagagtggtggaagaagaaggagtagaaatggtagaaaatctgatcaagttgatgttttgatgagaccaagttgtaggccttgtactgttgtgaagagcaatgaaaatggccatgttgttgaaaatggaaacacagtctctagtgatgtagaaatgagttttcctacttcaagtaaatctttgagttttgctcaaagaccaggttatggacaagctggtacaaaatgcattgttaaagccaaccacttctttgcagaattaccagacaaggacttgaaccaatatgatgtaactattacaccggaagtgtcttcgaaagccgtaaacaggtctatcatagcagaacttgtgaggctgtataaagaatctgaccttgggatgaggcttccagcatatgatggcaggaaaagtcttttacacagcaggagttcttcccttttcttggagagagtt

SEQ ID NO: 7465 - DNA, 758 bp, Medicago truncatula
  misc_feature (1)..(1): n is a, c, g, or t
  misc_feature (513)..(513): n is a, c, g, or t
  misc_feature (538)..(538): n is a, c, g, or t
  misc_feature (558)..(559): n is a, c, g, or t
  misc_feature (561)..(561): n is a, c, g, or t
  misc_feature (563)..(563): n is a, c, g, or t
  misc_feature (581)..(581): n is a, c, g, or t
  misc_feature (606)..(607): n is a, c, g, or t
  misc_feature (610)..(610): n is a, c, g, or t
  misc_feature (621)..(621): n is a, c, g, or t
  misc_feature (624)..(624): n is a, c, g, or t
  misc_feature (627)..(627): n is a, c, g, or t
  misc_feature (633)..(633): n is a, c, g, or t
  misc_feature (635)..(635): n is a, c, g, or t
  misc_feature (637)..(637): n is a, c, g, or t
  misc_feature (639)..(639): n is a, c, g, or t
  misc_feature (641)..(641): n is a, c, g, or t
  misc_feature (644)..(644): n is a, c, g, or t
  misc_feature (653)..(653): n is a, c, g, or t
  misc_feature (658)..(658): n is a, c, g, or t
  misc_feature (660)..(660): n is a, c, g, or t
  misc_feature (670)..(670): n is a, c, g, or t
  misc_feature (673)..(673): n is a, c, g, or t
  misc_feature (679)..(679): n is a, c, g, or t
  misc_feature (682)..(682): n is a, c, g, or t
  misc_feature (693)..(693): n is a, c, g, or t
  misc_feature (695)..(695): n is a, c, g, or t
  misc_feature (700)..(702): n is a, c, g, or t
  misc_feature (704)..(705): n is a, c, g, or t
  misc_feature (708)..(709): n is a, c, g, or t
  misc_feature (711)..(711): n is a, c, g, or t
  misc_feature (713)..(713): n is a, c, g, or t
  misc_feature (717)..(717): n is a, c, g, or t
  misc_feature (720)..(722): n is a, c, g, or t
  misc_feature (724)..(724): n is a, c, g, or t
  misc_feature (726)..(726): n is a, c, g, or t
  misc_feature (728)..(729): n is a, c, g, or t
  misc_feature (731)..(731): n is a, c, g, or t
  misc_feature (733)..(733): n is a, c, g, or t
  misc_feature (738)..(738): n is a, c, g, or t
  misc_feature (741)..(743): n is a, c, g, or t
  misc_feature (750)..(750): n is a, c, g, or t
  misc_feature (752)..(753): n is a, c, g, or t
  misc_feature (757)..(758): n is a, c, g, or t
  Predicted polypeptide sequence is orthologous to G1181, G1850
nttgattcaccagctcgaaatttccctcctaaagggaacaaaagctggagctccaccgcggtggcggccgctctagaactagtggatcccccgggctgcaggaattcggcacgaggcctattttcgtatggggaattatgtttattgtgacccaaattaatttcttagatgtggcttaagctaatggattctgatcgtcttagaaagccttcagaaaatttagttcattctcgtttcttcctttctggtttctattgttgggattgggaattcttgactgctcttcttctctttagttgttcttcctagacctagacaaattttttacttttaagttatttttttaacatcagatcatagagaagagattttattttttggtttgagaaaattattattagtagtagtgattagaaaaatatattagttgaaggattgatcggagaaaaatgtcgcagcggtcggcgcctgcgccgtttttgttgaagacgtatcagatggtggatgatttancgacggatgatgtgatatcatggantgagagtggtgaaagtttgnngngnggaaacatgcctgatttntgcagggatttgctcctaaatattnnaancacaacaattnctntanctttgntncntnanctnatacttatngattncnaaagctggtnccnacaatnggnaatttcaaacnanaattnnnannaanncncnaacnccnnntnantnntntnaaacnccnnnaaacctntnnattnn

SEQ ID NO: 7466 - DNA, 715 bp, Medicago truncatula
  Predicted polypeptide sequence is orthologous to G1181, G1850
agacacaccaccttgtggatgaaatcgccaccgacgatgtgatttcgtggaatgatacctggaacttccttcatcgtttggaatccaaccattttcgctagggatttgcttcctaaatattttaagcacaacaatttctctagcttcgttcgccaactcaatacttatggatttaaaaaagttgtacctgatcggtgggaattttcgaatgaatctttccgaagaggtgaggaacggcttctcggtgatattcagcgacggaaaatcgtttcagcatcactggcggcagcttccaatgccggtgtgaccgcgacaaaaacggttccgacagcaaagcctatcgcgtcgccgtcaatttcaggagaggagcaggttatttcttcgaattcctcgccgtcgatttctacggcggcgcttttagacgagaatgagagattgaaaaaggagaacatgcagttagcgaaggaaatggaggacatgaaatcgctctacagcaatatattcaatcttctgtcgaattacgtgaattctcaaacggaaggcggtgcggaaggaaaagagtcttgctcaacggcgtcgccggtgaagacgcttcgtttgttaccggagaagcggtgcaacggcgaaaatgcccagcgtggaagatagaaaccccgaagctgtttggaatagcgattgatgccaagcgagagagagaaggaccgtgtatttgaga

SEQ ID NO: 7467 - DNA, 759 bp, Medicago truncatula
  Predicted polypeptide sequence is orthologous to G1181, G1850
tttcgtcgaattcatctccgattgcagtgaacaatggtgctacggtgcagcgtagcacaagttgcaccactgcaccggagttagttgaagagaatgaaagactgaaaaaagagaatatgcaactgagtaatgagttgagtcagttgaaaggtctttgtaataatatacttgctatgatgagtaattataattctggtttcagtagacagttagaatcttctacaagtgctgcgacggcgcgaggcgtggttgtaacagaagggaaaattttggatcttttgcctttaaggaatgtttctttagctgaggaaaatgtggtggttaatttgggtggtgctgccggtggtttgccgtgtgagacgatgagtttgatggaacctgaggttcaagcatctcaggttcctaagctatttggggtttcaattgggcttaaacgatgtaggaccgagaatgaggttgaaccggagagagaggaacgggaacaacatcaacaaatgcaagtgcagatgcaaacacaatcctcgcaggagactgatcgaggatcagatgtgaaatctgaaccacgcgatggtgactcggatgatcaagagcgtcgttggaaattgatgaaatagtggcaaaggccgtgtttggaatttggattatgtccggactcctaaatttgaaacatgacacacatgtttgaacatggctaacagacactagcagttggtgtcattggacaagggcatggtttgaaattgaaattcatggttggtg

SEQ ID NO: 7468 - DNA, 771 bp, Medicago truncatula
  Predicted polypeptide sequence is orthologous to G1190
ttcttcttcttcttcttcttctactttcaccattcccctgttttttccacattcaaacaccattgatacacacaaacagaacaaaacaaggatagtaagtggaataaaagtctaggatcatgaagcataaggatggaaaactgatccaccagccgaacaagaaccgatctctgactgcggcgatcactatcattgttctgtgtggtttttcattctaccttggtggagtctttaaatctggaaacaatggtgttgatgtcatcaacaccattcagaaatcacttgattcacctaagcaatcctcaggctctttgcaaattaagccctttagtttccctgaatgcagcaatgattatcaagactatactccatgcacagatccaaagagatggagaaagtatggtacatatagacttactttgttggaacgccattgccctccgatttttgagaggaaagaatgcttagttcctcctccaccaggttacaagcctccaattagatggccaaagagtagagatgaatgttggtacaggaatgtgccatatgattggattaacaagcagaagtctaatcagcattggttgataaaggaaggggagaaatttcaatttcctggtggaggtactatgtttcctaatggtgttggtgaatatgttgatttaatgcaagatctgatcccacgaattaaagatgggtcagttagaaactgcattgatactggttgtgggggttgctagctggggtggtgacttgctggatcgaggcggt

SEQ ID NO: 7469 - DNA, 601 bp, Medicago truncatula
  misc_feature (554)..(554): n is a, c, g, or t
  misc_feature (591)..(591): n is a, c, g, or t
  misc_feature (599)..(599): n is a, c, g, or t
  Predicted polypeptide sequence is orthologous to G1190
tgagcttgggactgataagataagaaatgtgatggatatgaataccggaatatggaggttttgctgcggccttgattgatgatcctgtatgggttatgaatgtggtctcatcttatgctgtgaatacactccctttggtttatgatcgaggcctcattggaacgttccacgactggtgtgaagctttttcgacatatcctcggacatatgacctccttcatcttgcaggactcttcactgcggaaagccacagatgtgaattgaagtatgtgttgctggaaatggaccgaattttacgacctggtggctatgctctcatccgcgagtctagttactttttggatgccattacaactattgccaagggtatgcgatgggaatgtcatacagaagataccgagcaaggaggtgacatggagaagatactaatatgcaagaaaaagctatggtattcatcaaataaagattcaagatgacaaactctgggacctaagcagtggtattcatatattatgtaatatacccaataatctgatttattagtttagagtttntacatatatatatagagagagagatggagagttaaanagagattntt

SEQ ID NO: 7470 - DNA, 688 bp, Medicago truncatula
  misc_feature (610)..(610): n is a, c, g, or t
  misc_feature (635)..(635): n is a, c, g, or t
  Predicted polypeptide sequence is orthologous to G1206
gcttgaatcctgtttggattggtgtgaggtggaaataaacattaggcagtattttaccgggtctctcaaatgtcgtcctcagagaaacacttggcatgagatgctgaaactgaatggatggctgtcttcacaagtattcaaagagcagtttccagctcatttttctgaagtaattgacgctctaccagttcaagaatacatgaatcctgtgtctggtcttctgaatttagctgcaaatttgccagacaggagtccgaaacatgacattgggccatatgtctatatttcgtatggatgtgctgacacagaagctgattctgtgacaaaactctgttgtgactcatatgatgtggttaatattatgacacattctgcggatgtccctctctctacagaacaacttacaaaaataaggaaattgttgaagaagcacaaagctctgtgtcaagtggagtctgttgagctgttacctgaacgggaagtgaaagggatggcattatcacatgctgaagaaacggtacaaaaaggtttgccgagtatggggaaagaaggaatcgagtttttcaggagagtcgatagaacatcctgcatctcctcaactggagctaanatagcttctactcagagcatatacnacaacatttcccaggacggagaacacaatatcgtttctgattctgaaccctct

SEQ ID NO: 7471 - DNA, 448 bp, Medicago truncatula
  Predicted polypeptide sequence is orthologous to G1206
aaagggaaaatgtttaactgaagaattccgtcagcttcccaagaaacacaaagctagagaagataaacttgagatacagaagatgatagtttacgccattgatcaagctgtcaaagacctagaagctttactgaattgttcctgactggctgaatgttgcatgaagaaagctacttcatttttccttagtcggtgatcctccaggttgctgagagtgtaaactgcgttcgggatagaaatctttaaagtttgaatgcttcattgagaggttttaatggcattcacaatagagtttttccttttgtcaatgttaaattttagataaatttacaatgtctgtgtttattactatttttgcaataaaaaatgtaattaactcagaaattttcaagaaagtattaataattatggtattcataccaaaaggaaaaaaaaaaaaaaaaaaaac

SEQ ID NO: 7472 - DNA, 334 bp, Medicago truncatula
  Predicted polypeptide sequence is orthologous to G1225
gcacgaggcttaagtggtgttttactgagtctcggttgattggagtttgaccgtagcctgatttcagtgcatgatgtgggaattcccttcagtatattgtgattttgttatggggtgttatgttctctcttatgttggtgtttggggttttaaggatgtgtcaacttgtgctgcaagctctcttctagtttcgtcaatataaagaatatattaattctttgactttcctttacttgtaaatgcaacaccgaaattcgcagtgctgactcctcagcaagacattgatttatgataatctgttttcttttgtaaaaaaaaaaaaaaaaaaactcga

SEQ ID NO: 7473 - DNA, 780 bp, Medicago truncatula
  Predicted polypeptide sequence is orthologous to G1242
taaaccaaaggagccccgcattcctagaatgccacagttgcatgatttccagtttttcaacacaccgagattgagtgagttgtatgaaaaggaagtacgctatctcatgcaaacccatcagaagaatcaggtgaaggactcgatagatgttgatgaaccagaagaggtaggagatcaattgaccgctgaagagatggaagaaaaggagcgcctgctagaagagggattttcatcatggagccgaaaagattttaacaccttcctcagggcctgtgagaaatatggtcgaaatgatatacaaagtattgcctctgagatggaaggaaaaactgaggaggaagttgaaagatatgcaaaggtcttcaaagaaagatacaaggaattaaatgattatgatagaattatcaaaaacatcgagaggggggaggctagaatttctcggaaggatgagatcatgaaagctatcggaaagaaattggaccgctacaagaatccttggctagagttgaaggtacagtatgggcaaaacaaagggaagctatacaatgaagaatgtgaccgattcatgatatgcatggttcacaaacttggctatgggaactgggatgagttgaaggcagcgtttcgaacatcacccttgtttagatttgattggtttgttaagtctcgcacaacacaggaacttgcaaggaggtgcgacaccctcattcggttggtagaaaaggaaaaccaagaatacgatgagagggagagacaagctcgcaaagaaaagaaacttgc

SEQ ID NO: 7474 - DNA, 719 bp, Medicago truncatula
  Predicted polypeptide sequence is orthologous to G1242
aaaaaaagcatgaccaatgtttaattgatttgatcttcttaataaggtccataaagagttaacaatactaccatagtacataataaacttgctgcagttaataaaccagtaatttaagagcccctagactgaacttgggaagcaacaatcaatagacatgtttacaaggccataccaaaatcaccaagctttaaaatcagaagttagcctacaaacaaccctcctttaccagatgtagggcttacatccatttacttttttctcttccccgagctaacatagtaatccatagttaactgcttccgcttcttcagagatggactctctgcctgtcttggtaagacgcgctttgatggagttgtactcttggaggcaagtttcttctctttacgagcttgtctctctctttcatcatattcttgattttccttctctaccaaacgaatgagggtgtcacatctccttgttaattcctgagttgtgcgtgactttacaaaccaatcaaaacgaaacaagggtgacattcgaaatgcagctttcaattcatcccaattaccatagccaagcttgtgagtcatgcatatcatgaatcgatcacattcttcattgtataatttccctttgttttgtccatatagtatcttcaactctagccaaggattcttgtagcggtctaacttcttcccatagctttcatgatctcatctttccgagctatt

SEQ ID NO: 7475 - DNA, 642 bp, Medicago truncatula
  Predicted polypeptide sequence is orthologous to G1249
gcacgaggaagaagagaaaacgctgtcgtttgaaccagagtttccgaagagtagagtgaagaagataatcactctggacaaagacgtgaagagggtgagttcagaagctttgttcttggtgtcacggtctacggagcttttttttacagttacttgctgaaaagtctgcggaagttgctattgagaagaagcgcaagacggtgaagcttgaacatatgagaatcgcggtgaagagaaaccgtccaataagtgattttctactcgattcgcttccggtgccgtctgaaactgtgaaatctgataaaccagcggcggttgtggatcggcctaaatccgtttcggttggtactcgccgcatcgatcagatcttccgaaagtctggaggcgacgttgaagctcaagcgcaagcgcaagcaccagcgccggaacctgaacctgaaccagaaccagaacccatggaggaggcataggttgttttcatttgttctctctgtaaatgagatttgctgattacgttaatgacgtattggcgtaactatgcgattctaatttgtaagcaactcgttaatcatatgttatctttggttttacatagaaattgaggtattcaattatgatctaaaaaaaaaaaaaaaaactcga

SEQ ID NO: 7476 - DNA, 637 bp, Medicago truncatula
  Predicted polypeptide sequence is orthologous to G1255
ggcacgaggaaaaaaaaaaaagtacctactgacactagtgtgtctccttcatcacattgtctagtttcaacaaacacaaaccattaattgaatcatttttttgacataaaacaatatagtttagttatattctatgattatagacatgaaaggtgatgcagatgcaggtgccttgggagccaagacagcaagagcatgtgatagctgtttaagaagaagagcacgttggttttgtgctgcagatgatgctttcctttgtcatggttgtgacaatttggttcactctgcaaatctattagcaagtagacacgaaagggttcgccttcaaaccgcgtctgctaaggtaacaacaacagcacaagcatggcacagtggattcacaaggaaagcaagaactccccgccacaacaaaaattcgtcgattcaacaacaacagcaacgtctcaaggaaaaagttctcttcaatactagttttcttccacttgttcctgaactcggaggtgaagaagaacaaggacaagaactacttgttgatattgatgaggctgatgaggagcagttgctgtgtcgtgtgccagttttcgatgccaacccttttgatttagagacttgtactgtgaaaaatgatgctgttgat

SEQ ID NO: 7477 - DNA, 406 bp, Medicago truncatula
  Predicted polypeptide sequence is orthologous to G1255
gcaagagtatcaaggtacagagagaaaagaagaacacgtttgtttgcaaagaagataagatatgaagtaaggaaattgaatgcagaaaagagaccaagaatgaaaggtcgttttgttaagaggacagcatgttttgctggaggagcaacttcttttccaactaattaccactgacatgaatatcatcaactggttattaattaacttccatgtttgcttttctgcaaatttggattgattaatatttggtgcatgtggctgtgtatagtatgtattataataataataatgtttattaattactttactagagttaatgttgcttgggatgtttcaatctatctctagcttcaggtttaattagtaatactaatggtaacccttcaattaaaaaaaaaaaaaaaaa

SEQ ID NO: 7478 - DNA, 659 bp, Medicago truncatula
  misc_feature (83)..(83): n is a, c, g, or t
  Predicted polypeptide sequence is orthologous to G1255
ctccttttcccttttcctctccctaaaataattgtattcccttcactttttttgtcaggtgttaacaaaataatataagaacnttaattcatatttcaaagttcaaagttcaaaccaaaaaacacgtataaacctttttctagcttcaaagttttgtgtgtgtgtgtgtgggtgagagagttattgtgatgacttgttcaagtaaaaacgtagcaaacgcagttggaggcaaaactgctagggcttgtgacagttgcataacaaagagagcacgttggtattgtgctgctgatgatgcttttctctgtcaagcttgtgactcttctgttcattcagctaattctttagctcgaagacatgaaagagttcgtttgaaaacagcttcgtacaagtccattaatggtgatgaattcttcaattgtggtcctttctctggcttcaccaagaaggcaagaacaccgagacaggggaaacacaaatcaaaatcatcctcgagcagcgaaccagcaaggaataataataatattccgtttcatcttgtgccggaattaggtttcgatgaagttaattcaaattccattgaggaaaatgaggcgcaacttctttacagggtaccaattttcgatccttctattgctgatttatgtactagtcctcct

SEQ ID NO: 7479 - DNA, 679 bp, Medicago truncatula
  misc_feature (625)..(625): n is a, c, g, or t
  misc_feature (634)..(634): n is a, c, g, or t
  misc_feature (644)..(644): n is a, c, g, or t
  misc_feature (651)..(651): n is a, c, g, or t
  misc_feature (657)..(657): n is a, c, g, or t
  misc_feature (667)..(667): n is a, c, g, or t
  Predicted polypeptide sequence is orthologous to G1267
ttataaatatcatatcaccgacaccttttaagagtgattaagggtcaagattaactatagctagaaattgacagtggatttacaagcttatgtgactgtgagagtgaataaaacattgttgattcaattccctctaacatggaaagatcatcactctcttcttctgctaaaaggcgaggtataaagaaaagagtagtagagattccaatgaagaatgttgaagggactaatactccaccgtctgattcatgggcttggagaaagtatggtcagaaacccatcaaaggttccccttatccaagaggatactatagatgtagcagttcaaagaattgtccagcaagaaaacaagttgaaagaaaccacatggaccccaccgtactccttgtaacatacacctccgatcacaaccacgccgtgccaccaccgagaaactaccgcaacacaagcaacaacaccgcatcaaacaaagactccgaatcagaacaagaaccagatgaaacgttcacgaatattgaagaaaattcaatgattgccaccggtgatgagttaggaggatggtttggagatgtggaggcgatcggatcacccggcagtgttggagtgtccgatattctcggagaangaagtgtcnatgttggganaaaaaanatgtcnttgtttgcanatcttggtgagt

SEQ ID NO: 7480 - DNA, 771 bp, Medicago truncatula
  Predicted polypeptide sequence is orthologous to G1267
gcaatctcaatcctctcttaatctctctcaatctcactctcctctcctcaattttccggccacccctctcttctttttccggcgagcccaattttcttatcaccatttcctacactaattaagaacttcaaaaaggagaatcaaatttttttttttcttctataagcaatcatgtacaaacgtagattcaacacaaaaccattgtatgttgctgaccgagaagagcctgagcctgagctcaagctcgagcccatcttggaagatggtcctgcttctccctcttcttgtgaagacacaaaaattgaagaatcatcgcccaagaaaaggagggagatgaagaagagggtggtgactataccaattgctgacgtggaaggatctaagagtagaggagagacatatccaccgtcggattcatgggcttggagaaagtacggtcaaaagcccatcaaaggctccccttatccaaggggatactaccgatgtagtagttcaaaaggttgtccagcaagaaaacaagtcgaaagaagccgtgtggaccccacaaacctcctcgtaacctacgcccatgaacacaaccactccctccctctcccaaaatctcatcattcttccaccaacgccgtcaccgccaccgtcacggctgccgtcgacactccttctcccgtcgagtctccggccgccactccccagccggaagatcggcccatttttcgtcactcatccagactttgacctcaccggcgaccaccacagccgtgttttggatgg

SEQ ID NO: 7481 - DNA, 791 bp, Medicago truncatula
  Predicted polypeptide sequence is orthologous to G1272
taaaaaatctgagggtgaagactcatccatcccttcaagagtggaaaatatgcggactcagcgaagtcccatgcaaagagcttacttttactttgaagaaaagggatggtgatggtactgatgagatgactgttctggattattttactaatgtccggaagatagatctgcgctactctgctgatcttccatgtattaatgttggcaggcccaaacggccaacatatttccccattgagctgtgtgaattggtatcactccaacgatatacaaaagctctttccacacttcaaagggcttcactggtggagaagtccagacagaagccacaagagagaatgagaattttgtcggatgcacttaaaactagcaactacggggctgaacctctgcttcaaagttgtggaatttctataagcacaggcttcactcaagtggagggacgtgttttgcctgctccaaagttgaagttcggcaatggtgaagatttcactccgagaaatggaagatggaatttcaacaacaagaaatttgtgcagccaacaaagaagatagaaaaatgggctgtggcaaacttttctgcacgatgtgatgtacgaggacttgtgagggatataattagaattggaaatatgaaaggaattatgattgaccaaccattcgatgtgtttgaagaaaatcctcagtttagacgtgctccaccaatggtgagggtagagaaaatgtttgaggacattcagtccaaacttccaggggctcctcaattccttctttgtttgcttcctgatcgg

SEQ ID NO: 7482 - DNA, 830 bp, Medicago truncatula
  Predicted polypeptide sequence is orthologous to G1272
ttcacctgggcaaactgaaattccctcaattgctgcggtcgtaagctcaaggcaatggcccttgatatctaaatatagggcatgcgtccgtactcagggtgctaaggttgaaatgattgacaatctgttcaagccagtgtcagatacggaggatgaaggaataataagggagcttttgattgatttttataatagttctgggaacagaaaaccagacaatatcataattttcagggatggtgtcagcgagtctcagttcaaccaagttttgaacattgaactgagccaaatcattgaggcctgcaaatttcttgatgaaaagtggaaccccaaatttctggttattgttgcccagaagaatcatcacacaaagttcttccagcctggatctccggataatgtgcctcctggtactgttgtggacaacaaaatctgtcatccccggaattatgatttctacatgtgtgctcatgctggaatgattggtaccagtaggccaactcattatcatgtccttttggatgagattggcttttctccagatgatcttcaagagcttgtgcactctctctcctatgtttatcagcggagcactactgccatctctgttgttgctccaatctgctatgcccatttggctgcttctcaagtgggacagttcatgaagtttgaagacaagtctgaaacttcatctagccatgggtggtagccggtcgtgatatcaatgccttctccatcccacagttgcccaaattgatggatagtgtctgcaaactctatgtcctttgtttgagtatgggagtaatgattcaaaacttgtatttactttg

SEQ ID NO: 7483 - DNA, 696 bp, Medicago truncatula
  Predicted polypeptide sequence is orthologous to G1272
accgatcaaagacctacaaagttgaaatcagctttgcctcaaagatccctctgcaggccattcgccaatgccttaaaagggcatgaaactgagaattatcaagaaagcgattagggttcttgacattatcttgaggcaacatgctgccaaacagggctgtctgcttgtccgccaaaactttttccacaatgatccgaaaaatttcacagatgtaggaggtggtgttcttggatgcagagggctgcattctagcttcaggaccacacaaagtgggctgtctttgaatatagacgtgtcaacaaccatgattgtccatcctgggcctgtggttgatttcttgattgcaaaccagaatgtgagagatcctttcagtcttgactggaataaggctaaaaggactctaaagaatttgaggatcactactagcccaaccaaccaagagtacaaaattactggtttaagtgaaatgccatgcaaggaccagctgtttactctgaaaaagaggggtgctgttcctggagaagatgataccgaggagatcactgtttatgattattttgtcaaccgcagaaaaatttctctacagtactcagctgatctgccatgtattaatgtgggaaagccaaagcgacctacatttgtcccagttgagctttgctcattggtatcccttcaacgatataccaaagccctgtc

SEQ ID NO: 7484 - DNA, 435 bp, Medicago truncatula
  Predicted polypeptide sequence is orthologous to G1273
ggggggaaatccatatcccagaagttactatagatgtactagtatcaactgtaacgttcgcaagcatgtggagagatcaatagatgatccaaaatcatttgtgactacatatgaaggaaagcacaaccatgagatgccactcaagaacacaacaaatatgacatctgaaaaagattcaacgacttctcttaagtaaagataaaccatattgacactacattttcatttattagttaacaataacagtatagttattatgactaaatgctttggatcctcttatagatggtgacaatttggaatgtagtaactacagagactgggttatttactttctgttgcaacatttgatgacagcagtctgtctgtcttggaatttggtgttggtttgtaacttcgtatactattctgataacactgccactattgtccttc

SEQ ID NO: 7485 - DNA, 381 bp, Medicago truncatula
  Predicted polypeptide sequence is orthologous to G1289
gcatattgagaccagatggatatcttgtgattcatgattccatggaaatgcttaacaaactcagtccaaccttgcgttcactacacttggtctgtaaagttgcatcaaaatcagtttcttgtcggaaggaaaagtttttggcgtcccacaagcttaggaaactaaatgcactcaggtcgatgaacatgatggtgcattctttcaatttcccatatttcagtgtattataaatcaaaattacaagcaaaatattggattttaagaaaggaatgttaagttattgataggtaatcttgtatgagtgtgaaatctgttggttaaatatatattatagtaaagtatagagaaacttgttcctttttcaaaaaaaaaaaaaaaaaa

SEQ ID NO: 7486 - DNA, 781 bp, Medicago truncatula
  Predicted polypeptide sequence is orthologous to G1317
agtatgacaattttgttacaagttatatggcgacacaggtagggtgttgtatacattttttcggtagaaaggaaattgtttagggtgttgcatattaatttgtatattagattttaacatgatgtttcaaaagtatgcataaattgttattggcaccaatgatactgttagtcacctgtggtatccaattccaaactaaaatggaagtataaagttgaaggatttggggtggccgggtggcagtttacttcggagtatatcactttatgttgaagctttagtgcttccttgaatgaaattgatacacacactcatggcggaaactggtcattttaatagatttcaaatgtctaggtggtgttgggggaaggggatagtatattcttaagtgcaaactctggataatgttttggtcacgtctcctgaaacattgatatgctcaaattagatgtattaaacatgtacataactctaaatccttttttgaaacaggaaaaaattgtctttggttcttcaatgatttcattgtttcagaaacttctgaaaaaacctccatcctctagattcgtcgctgcctttcaccctttacaaacaccaaaccccattattcctcttaatcaaggacacgacttacccactgaaactctcccgacaagcccaatattaacacatcaatttgttgggtcctcaagttcaaccttgatcttccctagtttcccttttgggtttgcttaaaacccgttttgaaaatgggattctttccatgtggcaaagatgctga

SEQ ID NO: 7487 - DNA, 664 bp, Medicago truncatula
  Predicted polypeptide sequence is orthologous to G1330, G2423
cacttcaagaacagatattgattcttgacctccactctcgctggggcaataggtggtcgaaaattgcacaacatctaccaggtagaacggacaatgaaataaaaaactattggagaacaagagtgatcaaacaagcaaagcaactcaaatgtgatgtaaacagcaaacagttcagagatgtattgcgtcacgtttggatgccccgattactcgaacaaattcaacccgcaccacaattccccgacacgaataatccaaacggatcacatatccttcttcaccaaaacacattgcaaagttcagtttcaggaatcagtggtatttcctcggactcttcatcagtagaattccaagttgcttcaaattcggaccaaaatgattcttcggagcttttgggccatgaaggttcaaaactatggtcaagtttcaataaccagcaggtttcagaacaggagaagagcggtgcttgtgatggtgactcgttgtggaacgatgagaacatgtggtttttgcaacaactttatgaagatgttgaaataaaatacaatttacttgcgtgacgctttgtgggaataatttaattcacagtagtgtgaaatattgaaaaaaaatggtatacggcactaagtagatcaataggtatatttgtcgcataggggatgag

SEQ ID NO: 7488 - DNA, 674 bp, Medicago truncatula
  Predicted polypeptide sequence is orthologous to G1330, G2423
ctacttctattattttatcatctgtaatatatatttcattataactccttttccttactttcacatgttgtcattgggatgttgaaagagcaacatgttttcaacattccagaaattgtcagatgtgtccccttgaatccaaggagtgtttggttccatggaattgaaatccatttgagggaacaatccagatgggctagttatgcaatcaaaaaacccaaattgttgagcttgttggtaataatcagaattagggttattattgttgttactaccaactgggacattgtagtaatcttgagtcaattccgagataggcgaaacttgtgtcccaaatgaatccgatgatgctgctgcggcgccattgctactattttccggggtataactttgtgcaacatgtgaaccacataaactgttggtgttcataattgttggagttaacatgttcgcgtcactatggacatcaaaattgttgtttatgttgtatggtgtattgttggtggtgaccgtcgttgtaccacttggtaaacattattagtggcggtggctaaggtggcggaagtggatgccgcaccttggatgcgctccactagccttggccatcaaagtatcgcatagcatctttaaatgcttgctgtttacgtcacatttgagttgtttggcatgttttt

SEQ ID NO: 7489 - DNA, 679 bp, Medicago truncatula
  Predicted polypeptide sequence is orthologous to G1341
tctattagaagtcatgtaactttatttgccctcatttttttgaagtctccaaactaagaatgctaaaacaataaagatggagcatgagaagaaggtggaattggtaaggaagttagagatgagaagggctgattatgtgaagacagaaaaggcaaagaaagaagtggagaaattagaatcacaaatgatggttgcttctcaaaccattgatagtacatcggctgaaatcgttaaattaagggagatagagctctaccctcaactcattgagcttgttaaagggttgatgtgcatgtggagaagcatgtatgagtgtcatcaagttcagaagcacatagttcagcaactggaatacctcaacaccataccatcaaataaccctacatctgaaattcataggcaatcaacacttcagctggagcttgaagtacagcaatggcaccaatccttctgcaacctcttcaaggcccacagggactatattgaatctctcagtggttggctaaggctcagcctttaccaatttagccgaaaccctcttagtagaacaactgaggagtcgaagatattcaccctctgcgaacaatggcaccttgccgttgagcatataccagacaaagtagcgtctgaaggaataaaaagcttgttgacggttattcatgcgattgtagttcaacag

SEQ ID NO: 7490 - DNA, 618 bp, Medicago truncatula
  Predicted polypeptide sequence is orthologous to G1380
ggttaactttgttatgctactttccttcaaccacaatctctctttctctctcccaccacccattcatctttctctctcttcttcctccatcatcctgttcaaaatcttctctttaatccaaacaatcccttagaaactttaaaacccatcattttttctctctctctctctctatatctcatccatcaagtttcatttcaacccttgttgaaaaaaaaaatgacttttttgtaagaacaagagaaaaaggtcaaaggtttttcctttgattcatcaaattcatcaattttgaaacgttttttcaccgatttgattttctgggtcatcttagaattcaaaaaagattgaacctttgaagatgggtcgtggaaacggcgcaaccgcaacaacagcggctgaacccggttcaaacccggtttttttcaaagagccgagatatcgtggtgttagaaaaagaccgtggggacggttcgccgccgagatcagagaccctttgaagaaagcaagagtttggctcggaactttcgacacggcggaacaagcggcgcgtgcatacgacaccgccgctagaaacctccgtggaccaaaagcaaagacgaattttcctcttcaacagcc

SEQ ID NO: 7491 - DNA, 646 bp, Medicago truncatula
  Predicted polypeptide sequence is orthologous to G1382
aaatctaatgagagagagagagagattcatacaatgtttcaagtcaaccaagtcccactctctcaccatctctgacaaacaaaacaacatgaaaaaatgaccattatacccctatctctattctaactttcgataacaccgccgtcacaatggaagtaaccaccactaactccggcgaaggaacacccactgatccgaatcgaaatgggtcggttcaaaattcgatggcaagatacaagttgatgtcgccggcgaagcttccgatctcaaggtcgccgtgcatcacaatacctgccgggtatagtcctacgtcgttgttggagtctccggttcttctttcaaacatgaaggttgagccttcaccgactacagggtcccttcttcaagctttaaactgttctatggcttctgctacatttcctgtaacttctgcatgcttcaataccagcactgttaatggcagaaaatcaagtttctttgagtttaaaccacaagatagaaatatggttcctgcaaacttcaacaaccatgtaagcgaaaaatctactcaaatggaaggttcaggaaacggtcaatcatttccgatcctctccattaaatgaaaatgagatagaagatcaatctaatgaattaagcctatcatcat

SEQ ID NO: 7492 - DNA, 742 bp, Medicago truncatula
  Predicted polypeptide sequence is orthologous to G1389
gttaagtgttggtccctcacttctctctacctcttccttcatcatctcattgttctttcttcttctcccttgtgtaaccaccaccaccggtcaactcctaccaacatctaacctcttccggcaacatttagcaaaaatacttgttcaaaaaaaaaaacatttagcaaaaataactacatattcatcatcctcttgatctcatctatctttctatcaaagccaactattaagaggagttaattttaaaaatgggtcattttcttaaaagcgttttccggctatgaccaccacaaactttccggccaccaccaccaccaaaaaatgtgcagtttcaccactgattctttgtaaggttgttggtgttaaatttatgcctttttgaattcttctcaaatctttttcctactacaaacttgtgaaattcaaaggaattagatagttgtggagttgacagcacacctttgattatttctgttttggaaacaagcttgttgctggtttggaaaatttagaaaattcagattatgcggctgagccgcctgttcagatggtggtggagggtttttgttgattaaaatgaaattttcttaggatcaaacaattgataataataagatgttttcaagatttttttggggaagaacacatgaagatgaagtggtatgtgtcttctttcttttgcagatttggattttgagaaagaacaaatagacatgaatacatgattttccagattttgcac

SEQ ID NO: 7493 - DNA, 711 bp, Medicago truncatula
  Predicted polypeptide sequence is orthologous to G1411, G2509
gagggaaataggagtatgcattcgtaaataatgagtttgatgcttataattattatgcatctaattttaattggtgtccagacactgatttgtctaccatggtttctgctctctctcaagtcattggaacatcatctaccaatcataataacccacaaatggcacaatcaatctcaactactatggtcaatgaagaatctcaaccacctcaacctcttctagatcaagagaccaaaaagaaaccacactatagaggagtgagacagagaccatggggaaaatgggcagctgaaatacgtgacccaaaaaaagcagctagagtttggttaggaacatttgatacagctgaagatgcagctcttgcatatgacaaagctgcactcaaattcaaaggcacaaaagctaagcttaatttccctgaaagagttgttcaatgcaacagttatagttctactgctaataatgcaattcaacaaagtgattatgtttctaattctcatgatcaacaagttttcccaaacttgtttcagtatgctcagattctagaaagtgatgctgaattcccttattatgcttctcatcttttcaatcaacaacaacaaggagatcgtcacccaccgggcgagtagactctagagatttcctgcaatcaggaaatctcacattcacatagttgagatatcggtgtttgtacaatcaagatcgaacggt

SEQ ID NO: 7494 - DNA, 663 bp, Medicago truncatula
  misc_feature (570)..(570): n is a, c, g, or t
  misc_feature (605)..(605): n is a, c, g, or t
  Predicted polypeptide sequence is orthologous to G1411, G2509
caataacaatgaaatgcatgaagcttcatcaatccataatattgaacaatctcagccaccacagcaagatcaagggaatgtaagacgaagacactatagaggtgtgaggcagaggccatggggaaagtgggctgcagagattcgtgatccgaagaaggcggcaagggtatggctaggaacatttgaaacggctgaggctgcagccgttgcatatgatgaagctgcacctcagattcaaaggaagcaaagctaagctcaattttcctgaaagagttcaaagtgcaacagaatttggatataaccaacaatttcatcacctagtgtctactacaagtaacgagcaacaatccaatccagttcctcttcaacacttttctcgagaaacatattcaaatccttatcagtatgctgcacaagcacatcttcaagctagtggaagtagcaacttcaatcaggatatgcttagtttctatgggagagacatgtttgtttctaattctcaacctttatcaactacatctccgtcttcatcctcatcttctggactatctcagcagcaacaagagcttnctgagattgtcaatgcattatggaggttcttcttnctcttctgacccttcaatgaatttggaggggatgacatggatagaagacaatgaagag

SEQ ID NO: 7495 - DNA, 473 bp, Medicago truncatula
  Predicted polypeptide sequence is orthologous to G1425
agagaacaaaatatggtaaaaacactcaagttagttaattatatgattttctttctttctatttttcttgttgtaaagaatgttgatggtgatgatgttgtcttccaatatgtatttgatggatgtagaattgatgctgactgtccaataagcgggttacaattgcttaagtggatgtgcattaacaatgaatgtgaatttaatcatgtgagaccacgctatgtttaagtaggagacccaattgaatacactaagacccaattatgaccctgaagaaagagtgagttcttatgttactgaaaaaactatgcaatatatcttatattttcatttagttattatgtttgcaccaagtagttttattttttgttaatttttcttttgcaatttctttaatcttgaagttatgtcattgtactctaaatgttggtaatgaaatcaagttagataaaaaaaaaaaaaaaactcgaggg

SEQ ID NO: 7496 - DNA, 830 bp, Medicago truncatula
  Predicted polypeptide sequence is orthologous to G1446
gtctctctatttaacttaacttcccaatttccttcttcctataaaccaatgtcttgttcctattcctattcctattcctaaaccctccttatccactcttcaaaaacgaccatgccgtttccttggaagaagaaaaaaaaccgagtcacacgaatttcgcaattcgtcgctgattttcaatccccacaacgcacaagttcccttgtcgttcaaaccgggttccccacttctcttatcgatcttttcgctaaaaaccgtatccggttcaaaaactccacttttaataaaccggttcgctctgaaatcattgatccgtcatcgtcaccttcacctcctccaccgccaccgccttctccggtcacaactccaccgtcagtttcagagtcacctattcatgacgctttttctgaagagattttgaatccgttaatcggagaaaacaccgacgacggcgccggtaatgttgctcaggttaacaaacgccgttcatcgtttcgttcaaagtcgattatcgtgaagattttgacggttattattctagcggcgagtgttaaggagttaacggttgcgatcaccgtgtcggcgtttgcgttactgtttctagaaaacgcattgaaacgtgtcgtttcgtttttaaagccttgttcgaacgtttttcgtttcaattgaatcattgttccagaagattccgttacatcttaaagcaaagccggttcacaagccccgtttgaatgatggtgaaaatgaattgttgaatttgaattcaaatttggatttgaattgttgtgtgaatgatgaaattgaagttgtttgaagaaaagagcgagtta

SEQ ID NO: 7497 - DNA, 812 bp, Medicago truncatula
  Predicted polypeptide sequence is orthologous to G1446
gtgaatcaagtcaaccatgcctcttctatggaccacaaaaacagggtaacccgagttttccaaatcgtcgccgatcttcattcatctaaacgcgcttcttctttcactgttcagaccggtttcccaacgtccctcatcgatcttttaatcaaaaaccgtacccgtttcacaaaacccaactccagtaaaccgtttcaaacccaaacctctgatccactgccaccggagacaccctgttttaacgattgcaaggttgattgcgccgaaccggatcacactgagtctcagaatttaactcagttgatcaccgatgatgaaaaccttcatgtaaacgatgatgggatttgtcggattggaaaaagcaatgatgggtcgggttcaaaattggtacttggtatttttctgatgatgtttgtaattatcgcttcaattgcgagttttgagaaactcactgttggaatcactgtttcagcattcgtgcttttgtttcttgaatacgcaatgaagcataaggttgctgtcaatgattccttgtcatttgaggaaattaaggttgttggtgtttcttctgaagacacttcttcgtatgatggtgttaaattagattgtgtcaaggaagataagaaattggattgttctggaaaagtttctttacatgaaaataaagttaacaatagtgttaagtttaaatctatgttgaagaaacttttgggtcaaaagtttcaacgttcttcaagaaaagaggaaaaagaatgcaaagttgaaaaagattttgaattaaaagaagaggtagtagtggtagatagtggaag

SEQ ID NO: 7498 - DNA, 547 bp, Medicago truncatula
  Predicted polypeptide sequence is orthologous to G1451
acaccttcttaccacaggctggagcgtatttgttagtgcaaaaagactagtagctggagattctgtgcttttcatttggaatgaaaagaatcagcttcttttgggaatacgtcgtgccagtaggccacaaactgttatgccatcatcagttctttcaagtgatagcatgcacattggacttcttgcagctgcagcacatgctgcagcaactaatagctgctttacagtgttctttaatccaagggctagtccatccgagttcgtcataccactctcaaaatatatcaaagctgtgtaccatacacgcgtttctgtcggtatgcgtttcaggatgctttttgagactgaagaatcaagtgtccgcaggtacatgggtactataactagcataagtgacatggatcctgttcggtggccaaattctcattggaggtctgttaaggttggttgggatgaatcaacagctggggaaagacagccacgggtatcgttatgggaaattgagcctttaactacatttccaatgtatccatcactatttcccctt

SEQ ID NO: 7499 - DNA, 680 bp, Medicago truncatula
  misc_feature (541)..(541): n is a, c, g, or t
  Predicted polypeptide sequence is orthologous to G1451
ttcggcacgaggcgacaaactacttttgcaagaccttgactgctagtgacacaagcactcacgggggattctctgttcctcgccgggcggctgaaaaagtgtttcctcctttggatttctcccaacagcctcctgctcaagagttaatagcaagggacttgcatggtaacgaatggaaattcagacatatcttccgaggccagcccaaaagacatctacttacaactggatggagtgtttttgtgagtgctaaaagacttgttgctggtgattctgtgctgtttatctggaatgaaaagaaccaattgcttcttggtattcgccgtgctagccgaccacaaactgtgatgccttcctcagtattgtcaagtgatagtatgcacttgggacttcttgctgcagcagctcatgcggctgcaaccaatagccgtttcactattttctataacccacgtgcgtgtccatccgaatttgtcatacccttggcaaagtatgttaaagctgtgtatcatactcgagtttcagttggtatgcgtttcangatgctctttgaaacagaggagtctagtgtgcgacgatacatgggtacaataactggcatttgtgacctaaattctgtccggtggcctaactcacattggcgctcggtaaaggttggttgggatgaatccactgccgga

SEQ ID NO: 7500 - DNA, 815 bp, Medicago truncatula
  misc_feature (200)..(200): n is a, c, g, or t
  misc_feature (778)..(778): n is a, c, g, or t
  misc_feature (815)..(815): n is a, c, g, or t
  Predicted polypeptide sequence is orthologous to G1451
tgattacgccagctcgaaattaaccctcactaaagggaacaaaagctggagctccaccgcggtggcggccgctctagaactagtggatcccccgggctgcaggaattcggcacgaggctccaggactgccttcattccatgcaggtttgaaggatgatgattttggcatgaattctcccctattgtggcttcgagatgcntgatagagggcttcagactcttaattttcaagggatgggtgttaatccttggatgcaggcaaggcttgatccgtccatgatgaatatgcaaccagatatgtaccaggctatggctgctgctgcacttcaggatatgaggaccttagatccttctaaacagcatcctgcttccttgcttcaatttcagcagccgcagaatttctccaatggtaatgctgctttaatgcagaatcagatgttgcagcaatctcaacctcatcaggcttttccaaagaatcaagaaagtcagcatccatctcaatctcaggcccaaacacaacaattccagcagcttcttcagcatcagcactcattcactaatcaaaattatcatatgcaacagcagcagcagcaacagcagcagcaacagcagcaacaacagcagcaacatcagcagcagcaacaacaacaatcacaacagcaacaacaagttgtagatcatcaacagatgtcaaatgccgtctccacaatgtctcagtttgtttccgcacctccatctcaatcaacccagcccatgcaagccattttcttcaattggncatcaacaaaacttttcggactcaaatgggaacccan

SEQ ID NO: 7501 - DNA, 673 bp, Medicago truncatula
  misc_feature (567)..(567): n is a, c, g, or t
  misc_feature (586)..(586): n is a, c, g, or t
  misc_feature (602)..(602): n is a, c, g, or t
  misc_feature (620)..(620): n is a, c, g, or t
  misc_feature (673)..(673): n is a, c, g, or t
  Predicted polypeptide sequence is orthologous to G1451
gctgaaatgaagctttcttcagctgggtttagtcctccacctcaagaaggagaaaagcgggttctagattcagaactttggcatgcttgtgctggtcctcttgtttgtttgccagctgatggaagccgtgtggtttactttccacaaggtcacagtgaacaggttgctgtatctaccaacagggaagttgatacttatattccaaatccaagcttacctccccaacttatttgtcaacttcataatctgactatgcatgcagatacggagacagatgaagtgtatgcacaaatgaccttgcaacctctaaatcctgaagagcaaaaggaagcatatcttcctgcagagttgggaacggcaaataaacagccaacaaactacttttgcaaaattttgacagccagtgatacaagcactcacggaggtttctctgttcctcgccgggcagctgaaaaagtttttcctccattggactttacacaacaacctcctgctcaagagttgattgcaagggatttgcatggtaatgactggaaattcaaacatatcttccgtggccagccgaanaggcatttgcttacaacangttggagtgtctttgngagtgctaaaagacttgntgctggtgattcagtgctgtttatatggaatgaaaaaatcagttgcttcttgn

SEQ ID NO: 7502 - DNA, 646 bp, Medicago truncatula
  misc_feature (481)..(481): n is a, c, g, or t
  misc_feature (535)..(535): n is a, c, g, or t
  misc_feature (592)..(592): n is a, c, g, or t
  Predicted polypeptide sequence is orthologous to G1451
gtttacaagtcagggtccttcggaagatcgttggatatcaccaaattctccaactaccccgagctacgcagcgagccttgctcgtatgtttgggcttgaaggtgagttggaggaccctgtaagatcaggctggcagcttgtatttgttgatcaagagaatgatgttcttctcctcggtgatggtccatggccggaatttgtaaatagtgtatggtgcatcaagatactttcccctcaggaagtgcagcaaatggggaccaatggtctagagcttctgaactcagctccaacccagaggctctctaatggtatctgtgatgactacactggccgtgaggactcaagaaatttaagcaccgggctaacaactgtggggtctttagactactgaatgttgtgacaacaaatactgtgaatttcttctcttgtattattattactcttctcaaaccctctgtaaagggtgggaagcggttcctanttgtagtttatagcttactcagatataagcctttctttttccagtttttaccgnctaaaacaattattgagctaaacacttagctatatggcatcttctcattgtagtttngtacactatattggtaaccttttggaactctatgtttgaagttacctctatttt

SEQ ID NO: 7503 - DNA, 566 bp, Medicago truncatula
  Predicted polypeptide sequence is orthologous to G1451
cataaatccaatgactttatagtatgctctcaatatatacaacctatctgtttttaatggctcatgactaaagaaatggtacgaccataaattaaatgaccaaaactatcactgtctgagtgtagccataaattatgagccaagtacttgcaattgcatgctagtaacctacaaacataagtttaatgttgaaatgatatgccagaatataaaataaatagaatccccaaaacatgactggtgttgtgtcaatcttggggaagctgtatcagaaaatgagctaactcatgaaattccctccaccaatgtttgtagctccctgtgatgaaacttgtccctgagaaaccatttgtgagcgccccccaggaccttgaacataggtttgacccattccagcaccaaccatttgttgctgctgaggaagctgttgatgttgcagttgctgtaactgcggaagctgttgctgctgttgctgcagctgagaaagctgctgctgttgaagttgagggagttgctgctgctgttgctggagttgtggaatctgctgttgaatctgggaaagctgc

SEQ ID NO: 7504 - DNA, 829 bp, Medicago truncatula
  Predicted polypeptide sequence is orthologous to G1451
attgtatataattgtagctagcacaatgacaagataccatatagttacagtattagtttatgaatagtcctagcatgaaaaacatgtaaataaaaataaaaggctatattatataagataaactacatttagataacactttccataaaaaaatgcagactattagcagtcacatcttttagtagtctagagatcccacggttgttatcccgctgcttagatttcttgaatcttgacggctcacatagtcatcacaaatgctatttgagagcctttgaattggaaccgagttcaaaagcccgaggccagtgttgcccatttgctgcacttcctcaggcgaaagtatcttgatgcaccatacactattcacaaattccggccaagggccatcaccgaggagaagaacatcattctctcggtcaacgaatacaagctgccagcctgatctcacagggtcctccaactcgccttccagtccgaacattcgggcgagctcactacgcagctcattgtagctgctgaatttagtgatatccaacgatcttccgaaggaccctgatttataaaccttcacaaaggtcttgttcagtgggttgtttccttgctccccgttttcctgggtatgcaagaaaccagattcaccaatactaggcgttactccatgattcaacgaagaatcagcgcctgcggtgttcatgtaactagaagattgatggtaggacatggttgaggaaatcatggtgtttgcactgatccccttaaagtcgacatcccattatgcagtagaagagatgagggatctataatgacaccgaaataaagattactt

SEQ ID NO: 7505 - DNA, 684 bp, Medicago truncatula
  Predicted polypeptide sequence is orthologous to G1480
gtcatcttcacttgacgttggagtggtgccagacggaaacacagtgtcagagatatcatacaatttcggatcggaatcgatggtttcagggggtgtgaatagtagtaaccaaggggtgcaaggagcaacacaattatgtggaatggatcgtgaagcgagggttatgaggtacagagagaaaaggaagaaccgaaaattcgagaagactattcgttacgcttcacgaaaagcttatgcagaaacccggcctagaattaaaggccggttcgctaaacgaaccgaaattgactcggatgtggaccgtctctataaccctgctgatcctctctcagttccttcatctatgctaatggactgtccatacggcgtcgttcccacgttttagtaaacaaggataacagaggagtatgattctcctatactatggtttcaatgtgttagaataattagtgatgatgattctgtgggaaccgttgattattttgtttttattgctaattaaaagttcagataagttgagtccctcagatacatcaatgatcagagacaaagatatttacccgtcgcgcactaacgaggtctttatcactggacttcttaccaactggatcaactgttttaataatgttgattattattattaggatgaaaaagtggtgaattggttagatttggcgccggtgt

SEQ ID NO: 7506 - DNA, 784 bp, Medicago truncatula
  misc_feature (5)..(5): n is a, c, g, or t
  misc_feature (214)..(214): n is a, c, g, or t
  misc_feature (226)..(226): n is a, c, g, or t
  misc_feature (510)..(510): n is a, c, g, or t
  misc_feature (538)..(538): n is a, c, g, or t
  misc_feature (540)..(540): n is a, c, g, or t
  misc_feature (555)..(555): n is a, c, g, or t
  misc_feature (614)..(614): n is a, c, g, or t
  misc_feature (622)..(622): n is a, c, g, or t
  misc_feature (668)..(669): n is a, c, g, or t
  misc_feature (671)..(671): n is a, c, g, or t
  misc_feature (692)..(692): n is a, c, g, or t
  misc_feature (715)..(715): n is a, c, g, or t
  misc_feature (727)..(727): n is a, c, g, or t
  misc_feature (731)..(732): n is a, c, g, or t
  misc_feature (757)..(757): n is a, c, g, or t
  misc_feature (770)..(770): n is a, c, g, or t
  misc_feature (782)..(782): n is a, c, g, or t
  Predicted polypeptide sequence is orthologous to G1480
tgatncgccagctcgaaattaaccctcactaaagggaacaaaagctggagctccaccgcggtggcggccgctctagaactagtggatcccccgggctgcaggaattcggcacgaggacagtcgcagattagtcagagtgtttcatcttcctcgatggacgttggagttgttcctgacgcgaacaccgtgccggagatatcaaactgtggttacngggacggtggcnggtggatcgtgaagctagggttatgaggtacagggagaagaggaagaatcgaagattcgagaagacaattcgttatgcttctcgtaaagcttatgcggaaactaggcctaggattaaagggaggtttgcgaaacgcactgatgcagttgattccatttctggatacggcgtcgttcccacttgttgatttattttttgctcttgttgattttgttgcttcctatcttcccgctgcattttctttcatgatgtatataactttttgcttgtttaattatgtaatntaaagttgcaaactgaccttgcttgccnanaaaaaaaaaaaaaanaaaaaaaactcgaggtcgacggtatcgataagcttgatatcgaattcggcacgaggaancctcatanactttctagattgattttgttatcacctgctggctttcatcatganntncaacatggtcttttctgtggnggaacgtgtaatattttttctanctcctgttttgnctcnnattttccccgccttctacataccantccgattttttcntatgcttgatanca

SEQ ID NO: 7507 - DNA, 742 bp, Medicago truncatula
  Predicted polypeptide sequence is orthologous to G1480
agtctcgtaaaactaactaaactgtaaaacgtacatatacataacatcgtattacattacattttaatattaattcataaggttaatgaaaattcaaaatactcgagaaagacttgaaagcattcattcaaacacggaccgacctttctaatcgacgtgtcagatccggtgaacttcaacaggaaggaacgacgccgtattcatcctctgcaattaaattcatatttaaatctgatcgtttcgcaaaccttcctttaattctaggtctagtttctgcataagcttttctcgaagcgtagcgaatagtcttctcgaatcttctattctttctcttctctctgtacctcataaccctagcttctctttccaccgccgtcatcggaaccgccaccgtcatcggcgccgtctccgtcgccgttgtttggtaactgcagtacgatatctccgtcatcacgtttccgtccggcacaactccaacatccatcgacggtgaagatacggtgtgattgaaattgtaagtgaaaggttttgagttggagaaatcgatgttgatatctgagtagtgttcatgttcgtgttcggtggcggttttgctatgagactgcaccggaacgacgccatctgcggtggtgccgggactgttttgctctggcaagtctgttttagtgttgacagtgacgaaatcatcgatttcggggtacgagtagtgagagtaattgagatcagggaatttaggggtttg

SEQ ID NO: 7508 - DNA, 336 bp, Medicago truncatula
  Predicted polypeptide sequence is orthologous to G1488
attccaactcacatcgaaaggtgcaagagctccgacgccagaaggagatgatgagggcccaacaacaccaattgttgcaactacaacatcatcacagcattatgtttgaaggaccatccaacggtgatgattacttgattcatcaacacgtgggacccgatttcacgcacctcatctagtacggtgctttggtagagaattaaacctccaacgcagctttgaatattaattttgtagctacaattaattttacttatatctctcctaccatttttagtttatgacaggttaattaataatgttttttcatttttcaagaaaaaaaaaaaaaaaaaa

SEQ ID NO: 7509 - DNA, 767 bp, Medicago truncatula
  Predicted polypeptide sequence is orthologous to G1493
agtcagaacaaatgtcttgagcaaccaaataaaaatatttacacacgacagtcatttactttgaagaacataaaattaaaagaggaaacggagaaatatttttcattatttgtatttaagttagaaatactcctacgcgagtttgcagatttatcaaaaccttgcttctgcaatactgccctaacccaaacatacctcttcaagaacaccctaaaattagaacattgctagaaatgtggctacaatagcagcagtcaaaaattgcacatgccttgtgcattttatgcggtcaagttctgtagttgattcagcttgatcaactgtgagtgtccagactaaaccattttagtacactactcccagaagtttgaatatttgacatcaatgaaattctgttgtcgaataatttagactcggattgaaaatagctaattgcagaatgatatcgtgcatatgtgacagcaactatttacactggtaactgcaatcagaaagaactggcaagagtctcttctagacaggaatgttgtccagagaatacccgtcaaagtcaaactcattctcgccttgtccaatgccttcctgctgtttcagaagtgcactcatgagatcatcctgcccgaaatgatcagggaagaggtcagtatgggagctcgcgtcaggaactctttcagccttaacccttgttaaattttcaacataaagaggattgaaatgttgaccggcaccattttggagattaccttgttccaagccttctccagaga

SEQ ID NO: 7510 - DNA, 819 bp, Medicago truncatula
  Predicted polypeptide sequence is orthologous to G1504
agatggtctcatcccattcatgttactaggcatggaacatcattgtcattctacagttcaatctttcatgtccttgtactaaaataacaactaacaaatacttgcacagtgtgagtgttgtaagccctcagataccgagttcgaatcctacttataaaaaagattaacaatgaacaaatagaataatgtctagtactaacatttgttctttctcaataatatctaacataatattatcctagagaattcctgaaaggtttgatgataaatacaacatagaagaacctttaacagtctcctgattaacctttttcctgatttccaagaccttcttgtgagaatttgagtgcactgatgcttcaaaggttgggctagctgcaggccgatattcaggaaataggcgaccagacctgtatcgaactccacaagcattgcatagggtcttaggacccttaggcccctctctccattgtggtgtttcagttacctcgcaatgcgtacattttctaggagcaatagattcatgtaacgatgatctcttcgtctcaatgctatcagagagctgggaggtatcgtctttccttggccttttttgggctctgcataatgatttaccagcacgctgtttatccgattgctgcttttgaaaagcaggtatgaatggaattgagaatagcctgtcgaagcttgagaggcgccggcgtttaccacgaggacgctttgccgggatcactggtaattcaaaggtgtaactctccaccgaggaataactgctgctttcaaaactgaaactgggctgtaagttcggcatccgcgtaa

SEQ ID NO: 7511 - DNA, 827 bp, Medicago truncatula
  Predicted polypeptide sequence is orthologous to G1504
gtatttaatataaaatacaaagtacgcattaaaataaaataaaaaataacaggaaatatccttatgaaacaaaaataacggcttaagtaggagctaactcttcaaactaaattatactaaaaaaacaaagtctaatagtctgtctataaagggtaaataacaaaacccattttgaagctgtctgaaaactggaaagtcgtttttccagaccatggaatagtcatgcatgtgctcttccactataattgtgtgccatgttaccatacatgtgatatcattgtccttgcctttaattaatcctttgacttcatgtcctcatagcacatgcagcaagtaatgcaaaggattcttgcctctacttcagccatatatatataacctcactgccaatgccatgtcatccagttaaacacctactttaacataccattctcaagcactaattactgatctgctgcaactaacttattatttcaccaatcaatttacagtaattaaacaaatgatgctaagtaatatatcaagagactaaaattaaaacaataaacaaaggaggatcctgtctggcacaagtacactatctcatcttcaaaaagatccaggataacactgtcctacggaatttccaggaacatttgatggagccaacttagaaaggacctaacgccatctttgatgactacacctcgcatctccagaacctttctgtgactgtttgagtgcacagatgctaccaaagtggggctgtttgccggccggtatcaggatagagcggccggacctgtacgacacacagcatgcaaacgtttgggacgttggtcctctct

SEQ ID NO: 7512 - DNA, 753 bp, Medicago truncatula
  Predicted polypeptide sequence is orthologous to G1512
gcccgggcaggtacgcggggatttgttgttgcttacattcaataaacttcttagaaagaaagccaaaagctgttctcttttgtatttatcttgggccaaagaagcaccaataagtaactgttttcacttgtgagaaccagttccttgattcatggcatttgaggattgtttttcccatgaattgaaaaccattccaaattccatgtcagaagcagaagaatccaatggttttgattgtaacatctgcttagacttcgccaacgaaccggtagtcaccctttgtggccacctttactgctggccttgcatctacaagtggctacatgttcaaagtgatgattctcttggatctgatgaacatccacaatgtcctgtatgtaaagaaaatatatcacataccacaatggtcccattgtatggccgcggtggccacactccaccgagtggaaaatcatcttgttgcgatgataattttttttaccaccaagaccaactgcttcaggtgctcaagctcttttggcaacagcatctcaaagtgatcaacatcagcgacttccgtatcgaaatccttatcagggacaatatttaaactcctcttcacaccaccaacaagagggtgatgctacttcacaaatgcttaatcttggtgcctcaatgacatcaagatctcgccaccatactgtggttagaatgttcgaggagatgattttttccggagtagtcggccacccgccaaattcttatcagatggtg

SEQ ID NO: 7513 - DNA, 660 bp, Medicago truncatula
  Predicted polypeptide sequence is orthologous to G1554
ggcacgaggcaagaatcttcttcttcttcttcttcttcttcttcttcaacgatccaaatctattcatcataataagatccaatgggttgtgttgttcctgcagaacttagtttagatttaagaccaactttcgttcccaaaaccatcgctaatttcctctttcacctttccacaatccaaaccacctccgataaactctctaaactccatgatttcctctccagactcgaagatgaactcaataagatcgatgctttcaaacgtgaactacctctctccatgctcctcttaaacgacgcaattttggttttgaaggaggaattggaaaaatgtacaagtaaaaattctgtgccagttttggaagagtttattcctttgaagaaagagattgatcaaagtgaagagaataaaaataatgatagagacaagaacaacaacaatgaatgcagcaaagataagaagaattggatgagttctgttcagttatggaataacaacacaacaacttctaataataatgtctctgatcatcatcatcatcataaacttaataaattagaaacaaccaagaaaagggaggaaggacaatctgtgactgtagctgaagacctttttcaatcttgtagtagtaatagaaatggaggaagtgcttttatgcct

SEQ ID NO: 7514 - DNA, 676 bp, Medicago truncatula
  Predicted polypeptide sequence is orthologous to G1560
gatcatttgaggcgcgacaaacaagtgttaatgatggaacttgtgaagcttagacaacagcaacataatacaagatccattcttcaagcaatggaggaaaggctacgtggaactgaaattaagcagcaacaaatgatggcttttttggccagagctatgaaaaatccagcttttattcagcaattacttcaacagaaggaaaagagaaaggagattgaagatgctattactaagaagaggagaaggccaattgagtatggagaatcaagtaatggtggcgatggaaggagtagtgttcgatatggatttgaagtgtcagagttggaaatgttggctatggaaatgcagggtcttggaagaggtggtggagaacatgaggaagagattgaggtatttgagactaatgagaaattgaataaagaacttgatgaagggttttgggaagaactttttagtgagaaatttgagagtgaattagatattctaacttctcaagatgatgatgatgatgatgatgaagatatcaatgtgttgtccaatcgctttggttacttaggttctagttcgaaatgaattacgcttaatcgagattaaccttcttcttatggttgactgattgggattcggactcaaaatcgatcggacactagtagtgtgatcttggttggcaacttgg

SEQ ID NO: 7515 - DNA, 583 bp, Medicago truncatula
  misc_feature (530)..(530): n is a, c, g, or t
  misc_feature (556)..(556): n is a, c, g, or t
  misc_feature (579)..(579): n is a, c, g, or t
  Predicted polypeptide sequence is orthologous to G1591
caacttacctctaaccaccatcatcgcgatcggcctcgtttggcaaaaaaaaaaaaaaccttgttttcctcatctcatcaattgtttatacctttctatccaaacaaaaacactaagggaatagaatgaaaaatgggcagtccctttttttgaagtttatcatgaagctttggccttgttgcatcaatcatgaaccctatccttcatactttcattctcatctacaaaatacatttgcaatagtttccctcaactcatttaatgttacttctgatttgtttgatcaaatacttaaatacagaaatgatggaagcggtgactctccaactcaacacattcaatctttttaatttgaagactggatgcttatggtttcctgctaaagttcataaggaataaatatttgaaagatttagtcttggagcaaaagaaaagagatttggagctgattcggaccaaaaatatgaagatttggtataaaaatatgaagccactaccacatcactccttttgctgcttttgcttcttcnacaaggtgcctatttagtttatttgngacctaagtccatagtttcttgnggaa

SEQ ID NO: 7516 - DNA, 682 bp, Medicago truncatula
  Predicted polypeptide sequence is orthologous to G1635
tccctcttctgtttttcttcaaccattgaggaagttgtaaaagtttgttaacttgtctgtgaacaaaattttgttctgtttacagagaagcaaagattttcatcactggattctgattctatggagattttgggtcaaaaagaaggaatgcattctgttatacatgttcaaaaactacttgatcaattttcatgtggaaatgaccatgccttgaaggcaaggaagccatatactatcacaaaacagagagaaaagtggacagatgaagaacataagaagttccttgaagctttaaaattatacggccgagcctggcgaaaaatcgaagatcaatcgagacactgatgggaatgatacaacaatggtggagacaattgaaattccacctccaagaccaaaacggaagccgattcatccttacccacgtaaactagttgaaatcccaaagaatgaaatctccaacttggaacagccactgaggtctaattcgcttgtgtcgttagattttggtcaagaaaacaactctccaaagtcagtattatctgcagttgcttcagaaacccttggtttctctgattcagataccccctgccggaagtttgtccccggtctcatccattagtgctgttcatacccagtagatttcccactttcttgagtccaaatcatcatcatctgagga

SEQ ID NO: 7517 - DNA, 689 bp, Medicago truncatula
  misc_feature (619)..(619): n is a, c, g, or t
  misc_feature (641)..(641): n is a, c, g, or t
  misc_feature (649)..(649): n is a, c, g, or t
  misc_feature (673)..(673): n is a, c, g, or t
  misc_feature (683)..(683): n is a, c, g, or t
  Predicted polypeptide sequence is orthologous to G1635
attttcttctttctctcttattcaccctcttccctcttctgtttttcttcaaccattgaggaagttgtaaaagtttgttaacttgtctgtgaagaaaattttgttctgtttacagagaagcaaagattttcatcactggattctgattctatggagattttgggtcaaaaagaaggaatgcattctgttatacatgttcaaaaactacttgatcaattttcatgtggaaatgaccatgccttgaaggcaaggaagccatatactatcacaaaacagagagaaaagtggacagatgaagaacataagaagttccttgaagctttaaaattatacggccgagcctggcgaaaaatcgaagaacatgttggcacaaagactgctgtgcagattcgaagtcatgctcagaagtttttttctaagatcaatcgagacactgatgggaatgatacaacaatggtggagacaattgaaattccacctccaagaccaaaacggaagccgattcatccttacccacgtaaactagttgaaatcccaaagaatgaaatctccaacttggaacagccactgaggtctaattcgcttgtgtcgttagattttggtcaagaaaacaactctncaaagtcagtattatctgcagntgcttcanaaacccttgggttctctgattcanatacccctgncggaag

SEQ ID NO: 7518 - DNA, 569 bp, Medicago truncatula
  Predicted polypeptide sequence is orthologous to G1638
ggcacgagggggagattggagaaacatctctaggaatttcgtgaccacaaggacaccaactcaagtcgcaagtcatgctcagaagtatttcattaggcagctttcaggagggaaggataagaggagatccagtatccatgatatcacagtggtcaatctccaagaaacgaaatcgccttcatcagaaagtaacaatctttcttcgccggatcatttggtcaaggttccaaatcaaccgcaaaataataatttgtccggcatggtcaagcaggaatttgactggaaattaccagatgaaggcatgtcatttgttttcaattcaactaaaggaaacatgtttgtggcaccgtcgtgcgggatttcttcacatgaatcgaaatcaccggggcgtaatgtactccgaagcactcatcatggataccagttttcaccttttgatactattttgcaaatgcaatccatgcagcatcaatgaactgaggaggacttaagttagtccatagtaattagaatctatgaagagattagttcgtgttgtttctgatattaaaattcgggcaatagtttgt

SEQ ID NO: 7519 - DNA, 646 bp, Medicago truncatula
  misc_feature (586)..(586): n is a, c, g, or t
  misc_feature (623)..(623): n is a, c, g, or t
  Predicted polypeptide sequence is orthologous to G1638
gtctcacttcaaatattcaacctttctttaagagggtggtgtataatattcttggattcatccatcaaaatcaatagtctcaaaattcattattttcacactcacactaaaatttttagcgcataatgattttcataaagattctgtatgatactaaaaggtatgactttgatagattctcaactttatcttaataatcacacaagtaaaagattcttgtttctgttttctatgtgacatgttgatcaaagttgtataatttcctcttttttgtggttttttatgtgtgtttaaaaccaaaccttttgtagtagtatttgtgatttaaggtatggatttggaaaccctttattctccttattttatgttggatacaaattggcttgttgaagagagttaccaaacagaatggagtagagaagataacaagaaatttgaaagtgctcttgctatatatgataaggatacgccagatagatggcttaaggttgctgagatgattcctggtaagactgtgtttgatgtgattaagcagtatagggaattggtagaagatgtgagtgaaattgaggccggaaatgttccnatcctggctatcttgcttcttctttcacctttgaagntgttgaaaaacaaaacttgatgg

SEQ ID NO: 7520 - DNA, 700 bp, Medicago truncatula
  Predicted polypeptide sequence is orthologous to G1638
ttcacttcttctttcacaaccaccacttatgcttattttcatctcaaacttcacaactttttcactttctcaattaccctcttgactctttttgttccattaaaattcttcaactcatttttatataaatttacactttttatgcatttttaaactgacccagttgcttaatttcactcaaaaaccctcatgttctaaaacttgatgtgggttttgtaaaaaaatcacttttttattttttttctttctcttttggtgatttttttcttgtcttttagatctgattagttttgtaaaagttcttattaataaattctggattttttccttggattttggaaaaaagcactttttttagattccttagttatttgggtagctgaaataagcagcagatagattccacccaaatgctgtttgataatatgcttctttggccataagaacttccacttttgtagcttatctctctctctttgaagctcttttttagagagaaagagatcaagagttagtttatatgattatatgattttatctagaacaatgaatagaggagtttgaagttctatcaccagcttcctatatccaaaattccaattgggttgtttcaagaaaacaatggttcaaaatggacttcagaagagaataagctctttgagaatgctctagcttattatgataaggatactcctgatag

SEQ ID NO: 7521 - DNA, 763 bp, Medicago truncatula
  Predicted polypeptide sequence is orthologous to G1652, G2776
atcaaaaaatattttccaattatgataaccaagcgaatcagaccagaaacactgctcaagctcgagaacatgtaatggccgaaagaaaacgaagggaaaagcttacccgaagtttcatcgctctttcagccattgttcctggcctcaagaagatggacaaagcttctgtgttgggagatgctaccaagtacatgaaacaactacaggcacgtttgcagacactggaggaacaagctgaagacaacaaaaaagctggatccacagtccaagtgaagagatctattatcttcactaataataatgatgatgatagcaactccaataaccaaccacttcctgaaatcgaagtaagagtttcaagcaaagatgtactcatcaagattcaatgtgacaaacacagtggacgtgccgctacggtgcttggccaattagaaaaccttaatctcactgtccatagtagtacctttttgccctttggaaacaacattgttgatgtaaccattgttgctcagatgaacaaggaaaactgtgtgacagcaaaggatctcctgggaagcatacgacaggctttaatcatccaaaattaaccatttgaaggaatatttaatctactacatcaataagtttactcaacaacgattttttcacagttatttctatcatttttccttttttgtcctttgataaggattctagggttactatatccatgaaggaaggtcctgtgatgggagaatctatgatcttatttcaatgttcacat

SEQ ID NO: 7522 - DNA, 750 bp, Medicago truncatula
  Predicted polypeptide sequence is orthologous to G1652, G2776
ttgtgcatacaaagaattcaattcggaaagatgattcaaatttcatccaccaactacatgcctgaatttggattaatggaggacactactttgtttagtgatcatgaataccaaatggattcatatgcattccagtttgatgatatggcatacttcaagtctttctcagaatccccacaagagagtacttattcctctcataccaacatcaacaacaagcgaatccattccgaaagcacacagaacagttctttccctactcaaagtccagatcaatctgttgcctcagcaacaccaccaactaaactactcaaggcttctcccaaaatcatttcatttgattactcgaataatgattcaaaggttaagaagcctaaaaccgagatcgggtatggtgaaaacttgaattttggaagtgtgatttctcaaggtgattattataaacgagagaacaaggtttctgctgtaaatagaaaccctatgcaggctcgagatcatgttatcgccgaaagaaaacgaagggaaaagcttagccagagattcattgcactttcctctattcttcctggactcaaaaagatggacaaggcaactattttagaagatgctataaaacatatgaagcaactacaggaaagagtaaagactttagaggaacaagtagccgataaaaaagtcgaatcagcagtttttgtgaagagatcaatcctcttcgacaataatgatagctcctcttgcgacgaaaactcc

SEQ ID NO: 7523 - DNA, 831 bp, Medicago truncatula
  Predicted polypeptide sequence is orthologous to G1652, G2776
tctctctctctctctctctctctctctctctctctctccaaagggtcattggtccatagctgtcttgcaatttaactctagttagaaatttcagctagcaaaatgacatcaaatcatgagtcatggacaagttggttgtgtgatttggaaccagaagattacaatatcatcaatgagattaacatagccactttgccacaagagaataacaacttgcaacaatctttttctggtggtagccattgctctcacacaacctcaaacactatgagcaattcttcaggagatgttaacaagactaacccttcaaacatagggtacccttccttaccaaaaaaggattcttcccattcttacattctttgttttggaaatgagaatccagaatcaatgttgaacattggttcaactttaaaaccaaaaggcaaggtttctaatcatgggaaatctttagcctcaaaagggtccttagaaaaccaaaaaaagggaccaaaacgcaatattcaagagagcaagaagactgattcagctgctagaaatgctcaagatcacataattgctgagaggaagagaagagaaaaaattagtcaaaagtttatagctctttcagcactccttccagacttgaaaaagatggataaggcttctgtattaggggatgctataaaccatgtgaaacagcttcaagaaaaagtgaagctattggaagaaaagaaccaaaagaataacgttgaatctgtgtctatggtatatgttgagaagacaaagtcatattcttcagatgaagatgtttcagaaacctcatcaaattctggctatgggtaatggtgc

SEQ ID NO: 7524 - DNA, 650 bp, Medicago truncatula
  Predicted polypeptide sequence is orthologous to G1652, G2776
gtattttcttaatatcaaatcatatgaccaatttttcatttctttcagcatcattgattcttggcttgctttgcaaataacaagcataagcatatgagttctatggaggaatcgtggactaattggttgtgtgatatggtaatatcatattacacaaaataaaattgtcttcaaattaacatatatagtttttgtgaattagcaaactcctttgttcaactttccttatatttttccaggaaccaaatgattacagtttcatcaaccaatcaagcataaatgcagaaattgttggtagtttagagagtaacttagagaggccttcaaaattactcaaaactactactacttgtagttcaagctatatgaaaacagaacatctctcacaaaaaacagcttcatatgttttttcgtttgaaaacgagaatccaccaccaagaaaagttgaaccagccttgaagccaaaaaccaaagttgtgaactcaaagaatggtccacgacgtgtaaagaataatgagagcaacaagaagaacggttcattttctaaatctacaacaactcatcacacaccagatcatataattgctgagagaataaggagggaaagattagccaactattcatagctctttcagcccttattccaacct

SEQ ID NO: 7525 - DNA, 684 bp, Medicago truncatula
  misc_feature (419)..(419): n is a, c, g, or t
  misc_feature (549)..(549): n is a, c, g, or t
  misc_feature (567)..(567): n is a, c, g, or t
  misc_feature (619)..(619): n is a, c, g, or t
  Predicted polypeptide sequence is orthologous to G1652, G2776
aacttcatctctcttcttcatccactttctcttctaatttattttcttcaatcttcaagtgcataccacatcaaatcgaatcgaatttttaggaaagaaactgaagatgatgcaaattatgtcccctatctatgtgcctgaacttggaatggaggatctcaatttctttaaccaatacacgatggattctcttgcatctccaacattattcgacaactttggctttcactttgatgacaacgaaacgacaccaaattgtttcccagttgaaactcatcctgatgatcaaacaaggccaaccaagaagatcaagacatcgataaccccttcttcccagtcatcacctcaactcatttcttttgagcactccagttcaacaccaattgcttcaaagcaattttataaccttgattattcangatgtaaaacctaaagtcgggaaaaggtgtaatgaaaacaaggattttctaccagctttggtttctcaaggggtcttatgaagatcaaaaaatatttttccaattatgataaccaagcgaatcagaccanaaacactgctcaagctcnagaacatgtaatggcccgaaagaaaacgaaggaaaagccttacccgaaggtncatcgctctttcacccattggacctggcctaaagaagatggacaaaacttctgtgttggggagat

SEQ ID NO: 7526 - DNA, 836 bp, Medicago truncatula
  Predicted polypeptide sequence is orthologous to G1652, G2776
taaattgtgaaacaaaggtggtaacttaatttaatcacatcaatagtcattatggaaaaattaaactcatcttcaaactcatcatcaactagctggttatctgatctgctattggaagaaatggaaatagagggttgtgatttgtttcaacaatgtgaacaaaacttgtttggtgaaaaagagtttctttcaaatgacatagcaagtatttttcaacaagaggaaaatttccaacatcaacctttgttatcttctgaaagctattcttcttcttatcctttagaaaagaatttcgaaagacccaacaaaaaattgaaaaaaaacacttcttccccttcttctaccacttctcagattctgtcttttgactgtaccttaaatacaaaaaagaacaaggttgttccattgtcacaaacagaattacctcaaaatagaaaagggtcattgcaaaaacaaaacattgttgaaactataaagccacaaggacaaggaactaagaggtctgtggctcataatcaggaccatatcatagcagagagaaagagaagagagaaactcagtcagtgcttgattgctctagctgctcttattcctggcttgaagaagatggacaagggcttcagtcctaggagatgcaatcaagtacgtgaaagagctccaagaacgtttgagggtattagaggaacaaaacaaaaatagtcatgttcagtctgtggtgacggttgatgaacaacaactaagttacgactcatcaaacagtgatgactctgaagttgctagtggtaataatgaaactctcccacatgtagaagccaaagttttggaccaggatgtgc

SEQ ID NO: 7527 - DNA, 789 bp, Medicago truncatula
  Predicted polypeptide sequence is orthologous to G1652, G2776
ctctagaacaattatcattacttaatttacatgaattgaggacttcttaactgtagcatttgaataaacaaacatgctcacaaccttttctcttcaatgtgacaaacaagaaaacaaaccaatccaacaaaatagaaacgattctccaaaatatcctcattccattattataattacaaatggagaactcctttattttgatgcactagaacggatcacaagtaactctcatgagtttccaatagatattttctcagattttccacaaggtcatccatggtcatgctgtcttcttcatccatctgagcacaaatgttgattacaagaatagaatcaccaaatggtaacatgctactacttgttatagtgatattgaacttttcaagcaattcatgtattttgagcactatgtctttttgcttctcacaatgaattctgatgagtacttccttttctttgactctagcttcaacctcgagcagtgattctgaggacttctttttatttgatgaaacttgagatttccacttgaatattgctggatttggtttgctatctttgttttgattctccaattctttaatgcgcttttgaagctgttttgtgtaattcacagcttcgctaagtacataacacttgtccatctttttcaagccaggtatcatggctgaaagtgctatgatattctcagttaaattcccttctcccttttcctctcagccatcaaatgatcttgtactgtctcacatgatcctctaaccttccttgttgcttccttcaccccccttt

SEQ ID NO: 7528 - DNA, 726 bp, Medicago truncatula
  Predicted polypeptide sequence is orthologous to G1655
gatcctcttcttcaccaattcttcattcaatctcttcaataaattcattcctctattcaatcttcaaccatttcaaatggattcattcgaaccaaactcagattcaactcattcaaacacatcacaagaatccaatcacaaaaaacgccgcaaaatcgataacctcaccaccgatcaaaactcaatcaatctcatgccatggagatcccaatcagaccaaaacacctactccaaaaaactcatccaagcactcctccgtataaattccccggaaacaaccaaacctgccgccggtcaagtccgccaaaccgccgatcgagtcctcgccgcaaccgccaaaggaagaacacgctggagccgcgcgattctcggaaaatggaagaaactccgaagacatcacaaaaaagtcaagaaagcttccaccaacggattgaagagagagaggattcaacgattaccggctgtgcagaagaaaacacgcgttctcggtcagttagttcccggttgccggaaagttccgttaccgaatcttctagaagaagctactgattatatttctgctttggagatgcaagtgcgtgctatgacagctcttgctgagcttctcgccggtggaacaccagcgggaatcgccggtcaggtgttgagttgacctgtgcgcattgtttactgcctaggctatattgcgccaggtgttacttgatttttttttcttttaatattggg

SEQ ID NO: 7529 - DNA, 692 bp, Medicago truncatula
  misc_feature (74)..(74): n is a, c, g, or t
  Predicted polypeptide sequence is orthologous to G1662
ccaacgttgtaactaaaaaggttcacctcgtactttggttttcatttcttgatcgacaagaacccatacccacnttattcaggattatgtttttcttaatttcacaaccatagtactttgtttttttctttctttctattcattcaaccttatacctgtcctttctttcttttctataatcttcttccaccatattttctgctttgttcttcttaacacgacacttctgtctcctatatctcactctcaactcttaaccttctcttcatcaaaattacaagaatttgtgagtggttagtaaatgatggagcaaagaaatgaaagtgatatgtttcaacattggagaaaaggatcatggcaatggcaagggttagagttagaggatatgaaagaaaatgatgaactaaacaaattaatgttgtctttgccagaaattcctgagccaccaacacctcttgagcctatggagttcttgtctagatcctggagtctttctgcttctgagatttcaaaggcccttactgagaaacataaacaatcttttcttgataagactcatgagacattgccggaagcgattcctgcgcctcaattaacgccaggaaagctcataccatttactaattgtcgaatgggtactattggaaaatgggtacacttacatcagaagcagcatgggaatgcaaacactt

SEQ ID NO: 7530 - DNA, 741 bp, Medicago truncatula
  Predicted polypeptide sequence is orthologous to G1662
ttgtatggtagaggtataatataacgttcttatgagtttcattgtttgacaaaattttatatgtcctactctattgagacatatacaaaatccaaacaaatcaataactgctactaatatttaaaaaattcatagattttcggttgtttcagcagagttgactcgaccaagtagaaattctattccatcaacccatttttgcttgtggagtttgctctcacacttaaattctagaagaccttgtgcagttttgaggccaaaatagagatcttcagaagcttccctttcttttctgtatggccatgcagaatcttcattacacactccataaaccacacatttatgctttttggagaaagctcctccaatgtgcttgcttttgatcttaattttgacctgatatttcatgttgatgtaaacagccacgtgtttccatcgtaatgcccctttttctgtaacctgcaacaaatctccctcacatggagaatggttctcatcaaacatctgacactcagaagcaggagaacaatgtgtttctgctattcctctatcatagggacttattgatgcatttttctttgcttcttttggaaatcttgctctcaaagctgcttctcctctcaaagctgttgcagctgcagcagtaagagtcattagatcacctggcgttttgatatcgaccgcagacttaacagtagaagcgacaccgtcatgatcagcacctgctaactccgccatttc

SEQ ID NO: 7531 - DNA, 426 bp, Medicago truncatula
  Predicted polypeptide sequence is orthologous to G1706
gcacgaggctgcaacagttgctagtgacctgcgaaagagacgcgagtcggagcgcataactttcggcttctattgtcgactcatcttctcatgatgataaagccgataagggaatgaatgagaatgaaataacttaaattagagattgttgatgtaaaacttaggtctactttggcacacttattttttggcgggaaccttaaatttttaacttttttttttctgtgagcaactattactagatgcttctagtgtcatgttgatcatagtttttttaatcacatttgtttttactcattttatcacatttaaacgcaccatcaaatacaagcaaaaattgtaacttagtcattatactctttctttttcttttaatattacacaaattatattatttttatttaaaaaaaaaaaaaaaaaactcga

SEQ ID NO: 7532 - DNA, 596 bp, Medicago truncatula
  Predicted polypeptide sequence is orthologous to G1718
ggcacgaggtttctttgctgttttgaattgatttgatggcttcagaagctgaaatttctgaaatttcttctttatttgaaagaatgatccgaaacagagacatgtctctgtttttaccctttatgctaagcctttcacaaactttaaacaacagcgacccagatcatgaatccgaaaccaatgaagattccactcctcaaagaatcatttttgtgaaccctttgacacagagtatcactgtaatcgatggagcttcaagcattgaagaactctttaacaaccttggaagttctacaaagaatggtcaaccaccggctacgaaggagtctatagaagctatggacaagattgagattgaagaaggtgatggtggtgagtgtgttgtttgtttggaggaatttgaggttggtggggttgtgaaggagatgccttgtaagcataggtttcatggaaagtgtattgagaagtggttagggattcatgggtcttgtcctgtttgtaggtatcagatgcctgttgatcaggaagatgatggtaagaaaagggaggaagaagaaggtggtgagagaagaagggttggtgatggtggtggtggt

SEQ ID NO: 7533 - DNA, 683 bp, Medicago truncatula
  misc_feature (73)..(73): n is a, c, g, or t
  misc_feature (596)..(596): n is a, c, g, or t
  misc_feature (611)..(611): n is a, c, g, or t
  misc_feature (665)..(665): n is a, c, g, or t
  misc_feature (676)..(676): n is a, c, g, or t
  Predicted polypeptide sequence is orthologous to G1743
aacacactctctctgtcttaaatcttaatttctttctattcatcattcaatataatcatcttctgctagcacntgaatcatacatacatacatacatgtagcagaatctcctcctaatttcagattcatagataactaaactaagcatttgtgggaaaatggggttccctacggatattgtgttaccaaaggtgtttgtacagatcctttctatactatctttcatcaaaaaactcattaccatcttcttcttttacatcggtctcgattccggcttcgcctttccggagagtttgcctgaatttcaatcagttaatcccttgctgctcatcagacaaatcctaccggtggtgaagttctcggagctggagctggagctggagctggcggtggagagttgcgccgtctgcctctgtgagttcaaggcggaggatgagatccaacggctcacaaactgccgtcacattttccatagaagctgcctggaccgttggatgggatatgatcacactacatgtcctttgtgtcgcacaacgttcctaccacatcacatgctagatgcatagtttgtaactactcagacttaaggatgaggngttttcttcttctgngtatatatatattacatacgaaacaaagatgtcaaagataactttggttgatgntatgtatcaantttggta

SEQ ID NO: 7534 - DNA, 659 bp, Medicago truncatula
  misc_feature (609)..(609): n is a, c, g, or t
  misc_feature (635)..(635): n is a, c, g, or t
  misc_feature (650)..(650): n is a, c, g, or t
  Predicted polypeptide sequence is orthologous to G1752, G2512
cacaattagttgtttcactataaaaggaaaaaaaccatatatagaattagaaagtgccaagtgataaaaagaatttattgagtattgtgtccaaaaatggattttgattctcttctcttccaaaaccaaaatcaaaaccttatgtacttccctaataatttctcttgggaactagaagaagattttgttaacttctttagtgatgtcaacaactactcaaactcttctggatcattatcatcaacggaatcaaactcttctggatccgtactaagcaatgaaccactagaagtttcatcaaataccacttataaacaagtgatcaaagagacacaaacatcatcaccacctccaccgccgccgattaaggaaagtaagaaaagagcatttagaggagtaagaactaggccatggggaaaatttgccgcggagataagagattcaacaagaaaaggtgttagagtgtggattggaacattcgacacggccgaagcagctgctttagcttatgatcaagcagctttttcaacaagaggttcattggcagtgttgaattttcctgaagaagtagtgagagaatcacttaaagaaatggctagtaattctaancctttggatgaaggcacttcacctgnattggcactcaaaanaaacatagc

SEQ ID NO: 7535 - DNA, 480 bp, Medicago truncatula
  Predicted polypeptide sequence is orthologous to G1756
ctcatttattttctgaacaagatcatgatgagttattatttggaagttttccagaattctcaaaaactactaatgtccttattcatgaatttgaagagctttgtaaacctaatttctatcctctttcatctcaaaccatccttacaagttctctagctacccctaaagagcctgaacaagtcaaagaaattaaagcagcttctcatcaagatctgcaaattccagcagtatctaaatttaaaaaaagcaagaaaaacaagaacaagagtaatattgtgaagaaagtaacagcagtggatggtactctttgtgatgcatgggcatggcgtaaatatggacagaaaccaataaagggttcaccttatccacgaagctactatagatgtagcagttctaaaggatgtttggcgaagaaacaagttgaaaagaatcatttggatccaaaagtttatttggttacatacactgcagaacacaatc

SEQ ID NO: 7536 - DNA, 426 bp, Medicago truncatula
  Predicted polypeptide sequence is orthologous to G1767
tttggtaataatcctatccataataaacatttacatcatccaccatggacatatgtacatcctaccaccttacccaaaccaatttaccctgccagtaccaacattccaaaaaagcatcctcaccaccctccaaaagaagataacactcatttctaaagtatgaaatgagagttttgaactatatatatgtactgaataggtggtcctagttaccaagctgtttgttttctatagtaatatgtactctcctacttggcaaatgtgtgtgtgtgtgtgtttgtgtgtgtatgtgtcatgaataaaaattacttgacaagaaacaatgctatgtacgtactgcaaattttaaatatttttatttgtgacactagattataataaataaatattatgattgtgtgagattgataggtttgattgatttat

SEQ ID NO: 7537 - DNA, 667 bp, Medicago truncatula
  misc_feature (620)..(620): n is a, c, g, or t
  misc_feature (627)..(627): n is a, c, g, or t
  misc_feature (634)..(634): n is a, c, g, or t
  Predicted polypeptide sequence is orthologous to G1794
gtcttcaaagaaaattttacaaaccagcaacttttttttcatgtccttgttaactgtggctcatcaaagaggttcaggtgagttcaccgggtacacggtgaagcgcgaaggcgacgatcacgaaggtggtagcgacgacggtggaagttctaatgcatcacagttggatttcaaccaaatgttttcagggtataatggtgatagagagttatcagaaatggtttcagctctaacacatgttgcatcatcagggtcaaatcaaatgagtagtaatgaatggattcaaaggagtgattttcctttgatatcaagttttggaaatgcttcatcttcttcttcttatgcttcaagttcatggagtggtcaaaaaagagggcgtgatgaagaaagtagtggttctaatcagtatataactcaagctgttgttcctcctagactctttagaactgttatggtaccttctcaagaatcatcctcattatcatcagtgaccgaagaagctcgaacaagtactaccatagccacctcggcagcgtcagccgcgtcattcgaagactccggcgagcaaaggagacgatacagaggagtgagacaaagaccatggggaaaatgggcagcanaaataanagatccncacaaagcacaaagagtatggctaggaacattc

SEQ ID NO: 7538 - DNA, 662 bp, Medicago truncatula
  misc_feature (543)..(543): n is a, c, g, or t
  misc_feature (624)..(624): n is a, c, g, or t
  misc_feature (661)..(661): n is a, c, g, or t
  Predicted polypeptide sequence is orthologous to G1835
actatttctctctctctctctctctctctcactactctttccttaatttcaatttcacctcaaataaacaactaagttttgtttcaggagttgaattgtgaaattatacattctgcgtcatagtttactcaaattcaacaagttcgaagatcttctttcattggaatgggtgtccaatattgtggacgattcattttgtgaggagagtctcacaatgaaggtggagcagcagccatcatcatcagctgtcagcaaggaggactctgggcattaccaatttcagacaccaagtcctatttctgtccttgaaagcagtagttcctgctctggtggaaagaccacagggatttacgtccccatccccgtgccttgcggacgtgcacgcaccaagcgtccacgccccacagccttcaaccctcgttctgccatgcaactcatttcccctacttcctcttctgttgaggagaacatgcagcctaatgttatctccaccaaggcgatgtcttcagattttgaaaattttgctgagtcccgaattattgncaagaaaccaaagctctcttctggagaaccaagaagaaaaagaaaatcaaggcaccacttcctactgctcctgctgacagnggtgaacagattggttcactacctgttaggaaatgcnt

SEQ ID NO: 7539 - DNA, 657 bp, Medicago truncatula
  misc_feature (599)..(599): n is a, c, g, or t
  Predicted polypeptide sequence is orthologous to G1841
ggcacgaggcagtatctgaccatgttgaaggtggaaaatgggacccaccagtatatcctccgccgcgagagttatcttccggtggccggaaaaactccatttgctgaccaggaaacagaggaagtgaaacagaggataattgactggaaggtgaaaatgcagttggagatgaagaagatgacaaagaaagtgacggagaaggcgataacatggaagaagatgaatgtattgccgccatttgtgattcatagaaccattgttcaagtccttgaaaatcaccagaacctttcagaagctgagaatattgataatagtctctcaacatatcagaagaggtttgaaactgaggaaattgttgttgttgtggctgtatttgcggtggtgcaggggaataatgggttgccggagaaacagaagatgttgaagtattcaccggaaaagttggtcttgttgcacttgctggaacattttcagggaagttgagtttcgctctgtttcctctgaatcttaatgcagcttcatcgtaagctcttgctgcagcttctgcagtttcaaatgttccaagccatactcttgctgctttgtgtggatctcgaatntctgctgcccattttccccatggtctctgtcttactcctctgtatcttcttcttctct

SEQ ID NO: 7540 - DNA, 631 bp, Medicago truncatula
  Predicted polypeptide sequence is orthologous to G1852
cttaactccaaaacaaactcttacatttctatttccaccacagaatctcacgaacaacccttttgaatcccttaatcaaaaaccgattttgaaatcaatttcaatgacccaaatagcttattaatcagatccaccttcttcctcaaaatgcgtcactcaaatttcccaccatggaaacgcaccaacacacgtcaatggcgtctcatcgacctcatttccattgcctttttctcattactctttctcttctttgttctcttttacaccacccttggtcgcagccgtgtggtggctccgtccaccgttgatccgcaacagcgcaaccgtctggtggtggcaattgaggaagggatgctgaatgggaagagtattgaggcttgtccggcaagtgaggtggatcatatgccgtgtgaggatccgaggaggaatagtcagttgagtagagaaatgaattactatagggagagacattgtcctttgccggaggagaccgcggtttgtttgattccgccgcctaatgggtatcgggttccggtgaggtggcctgaaagcatgcataagatatggcatagcaacatgccccacaataagattgctgacaggataggtcaccagcgggtggatgaaacga

SEQ ID NO: 7541 - DNA, 247 bp, Medicago truncatula
  Predicted polypeptide sequence is orthologous to G1893
actgtggggtcaaacttaatttgtggttacttgggttctgatcgtgcttgctctgaatcttactattggtattggggttggttgatctatggatatgtgggattttgcatctaatatttctttgttttttatatgcctatttatgatcaaagttgtaatctgaaaaacctacaaaattgttgatcaatttcttattactgcaagatgtttttttattatatgcttaaaaaaaaaaaaaaaaaaaaaa

SEQ ID NO: 7542 - DNA, 211 bp, Medicago truncatula
  Predicted polypeptide sequence is orthologous to G1928
atttcttggggcttaggccattgtcacatagtgatattctaagtattgcagggattggaaactgcatgaatgatcaacaacaacaaaatcaatctcaaaagccatcatggcaaggttaggtccaaatatacaagggaaagatattatggattttttgtttaattctattcatcttctatataaattttattctttttaaaaaaaaaaaaaa

SEQ ID NO: 7543 - DNA, 747 bp, Medicago truncatula
  Predicted polypeptide sequence is orthologous to G1928
actcagaaatcgaactcagtatctcgagatttatagtactcgtgcacatgcgcatcaatcacttgcgctagctagaatccgatatatctagtgtaagtagcctctagctaaccataagatctaaacaattctcacctttttcggtgaaaaaaagaagttgatctatcactaaagtgtttatatatctctctcacatatattggaaagacatcatagtttgctttatcataatctagttattgtagtgatagagatgatgaaaggtttgtcggtagaagaaaatatgtcaaatttgacatctgcttcaagtgaaataagtgcttcttcagcaaccaagaatggaaaagcttcaacaaatctggaaccacaaaccaaaaggaagagaaatcttcctggtcacccagaccctgaggcacaagtgctagccttgagtccccaaactctcttggcaacaaacaggttcatttgtgagatttgtaacaaaggttttcaaagagatcaaaatcttcagcttcataagagaggacataatttgccatggaagctaaagaaaagaaacgtcaatgaaatcataagaaagaaagtatatgtttgtccagagccaacatgtgttcaccatgacccttcaagggcacttggtgacctaactggaatcaagaagcactttttcaggaagcacggtgagaagaagtggaagtgtgagaaatgttctaaacgatatgcagttcagtcggattggaaagctca

SEQ ID NO: 7544 - DNA, 825 bp, Medicago truncatula
  Predicted polypeptide sequence is orthologous to G1932
gggccggccagccgacaattacgggagccatgtgggtcccttcacttttataaactcaaatcacttctcacttcacttcgcaaaccctttcttttctctcttcttgtgttgtttttctttgttttcatggcttcttcttcaacttcttcagcgaatcgtgaaggacactacagaggtgttaggaagcgaccatggggacgctacgccgctgagattcgcgatccgtggaagaaaacgcgtgtttggctgggtacatttgacactcctgaagaagctgctcttgcttacgacggcgccgctcgttctcttcgtggagctaaagcaaaaaccaacttcccaccggcgccggtcgccggaggactttgtttggatctcaacgctccttcttctgatctccgatggccatctgtcccttcacgtggccgtgtgcttactgagtttcttcaaactggtgttctcaaggatttcaaccctcctccacctccacccatcggcggggtggttggacagaggcataatgaagttactcttgctgtcgccggcagaactatggtggctgagaactctccgacggcggcttacttgggacttgttcgacgtgggattccgattgacttgaatgaacctccaccgttgtggctttgaaaaaccctagacaaataagtagcgtaaaatgagatgatttattgtagttttttaacggcgtcgttttaggatcttatctaattaatcttgtctttttctcccttattagcggcatagttatcatgagggagtatctcacctatcttatcttgtaatgtatctatggcaatctaacatttt

SEQ ID NO: 7545 - DNA, 809 bp, Medicago truncatula
  Predicted polypeptide sequence is orthologous to G1938
agagagagagagagagagagagagagagagagagagagagagagagagagagagagagagagagagagactagtctcgagtttttttttttttttttttttataaaacctcaaaccctgcacaaattcatgaaaaattctactgttctgaactgtgagaatcatccttagtagtattattattctgctgattctggtgctgaaccctagtttgattttgaccaatctgctgataaatctgagttaaagcttgttgattcaacacaccaatatgtccatcttgtgacaaccctaattccaaaccaggcatctgctgatttgcaccccccaaaattgaagtaaaactcatccctcccactcccaaatttgttcctgttggcatatcaaatccagaaaacccaattttctgaaaataatttccactattattttcaccaacagtagtagctactaaaccaccagatgatgatgattgatgaaatccaaatccaccaacatgatgatgtggccataaacttgtagaactaacatgatggccctgatgggcctgatgggcttgatgggtctgagcccaagtattcctatcattcaactgtaaaccagaagacaaagatgaaccttgtggtgtcaaagtattaccagaagaagctaaagctgaagctggtattgttcctgttcctgttgcagctatgattgatggttcagattgttgtaaaagccattgaattgtttcaccatctgatttatgacctaactctcttgttagctgaaaattcttgctgcacataagctggcatccttattcttctt

SEQ ID NO: 7546 - DNA, 657 bp, Medicago truncatula
  misc_feature (497)..(497): n is a, c, g, or t
  misc_feature (523)..(523): n is a, c, g, or t
  misc_feature (537)..(537): n is a, c, g, or t
  misc_feature (562)..(562): n is a, c, g, or t
  misc_feature (583)..(583): n is a, c, g, or t
  misc_feature (601)..(601): n is a, c, g, or t
  misc_feature (624)..(624): n is a, c, g, or t
  misc_feature (641)..(642): n is a, c, g, or t
  misc_feature (645)..(645): n is a, c, g, or t
  Predicted polypeptide sequence is orthologous to G1946
caacattcaaaaacaagaattatccgaaatggatggagcaagcggcggcagtggcggcggagagggttcagccacccaaataccggcgccgacaccgatgcaaaacgcgaacgcacctccaccgtttttgagcaaaacgtatgacatggtggatgatccttcaacggatgcgattgtttcatggagcgcaaccaacaacagtttcgttgtttgggacccgccggaattcgctagagaccttctgccgaagtttttcaagcataacaatttctcaagcttcgtgagacagttgaatacttatggtttcaggaaggtcgacccagaccgttgggaatttgcaaatgagggctttttgaggggtcaaaagcaattgcttaagagtattagtcgaagaaaacctgcccatggtcatactcaacaacaggctcagcaaccgcatggacagagttcatcagttggggcatgtgtagaagtcggaaaatttgggcttgaggaanaggttgagaggcttaaaagagataanaatgttctcatgcnagagcttgtgaggttgagacagcancaacaaaccaccgacagccanctgcaaacaatggttcancggcttcaaggaatggagcaacnacaacagcaatgatgtnnttncttgccaaggcc

SEQ ID NO: 7547 - DNA, 369 bp, Medicago truncatula
  Predicted polypeptide sequence is orthologous to G1950
ttataaggcatggagcagatgtggatgtggaggacaaggaagggtacacagtgcttggtcgaattactgatgacgagtttagatcaatattgattgatgctgccaagaccatgcttgaatgatacaaacacaagagaacgagaacaaggttttgcttaggagttaggacctgttttatgtgtatgaccattgagagcattcaatggcttgcattttcgccaaccaaccttgcatttctgtctcttttttttatagcattcttaactagtatttgaggttattttcaccaacatatacaactaacgtttatgatccctttgatttgagaatatcgtaaattttatatatatagaaaaaaaaaaaaaaaaa

SEQ ID NO: 7548 - DNA, 812 bp, Medicago truncatula
  Predicted polypeptide sequence is orthologous to G1958
aactagaattgtacctttttttattttgatacagttaaaacagacagttcatattagaaatctagtacataccacattgaaatttaggtcgtaggatgttgataagatattgtcctaataagataaggtgaagccattatctgcactgtacactagaatctcatcctaaccaggataccaaataagataaggtgttgaagaatgtcatggtcaaaactgacttaaaactaaatgaaaggtaaacatacaagccctcattgaacacaacaggacatgagaaacccgttaagttatagagctctaggcattaatcaatcaagccttccttgctaaaattataactcaaatgaatcagtattgtgttgtcggttcaatgctgattcagaaagatcacaaggttcactcatctgtcctttgacgcttaggggcttgagggctatcttcattttcattttgctcaagatccttagaagcttgttgagatttggaggtatccaacttctcaactgcttccagtgagctttcctcaaccgtggtactaccattagcttgatcaggtcctgacttgcaatggtccattttggatgcttccaattcatttttggtaggagagtctttcatggtatcagaagacactccagatggattctcaatggctgacgatgatgccttaaatggttcaacaccagatttgcattgcttctcaaacatcatctggagataccctgcttgctcttctattcgcaactgtagatttctttgaatctcaagctgtttcatgcaccgtttctggacctccatctgcagtcgta

SEQ ID NO: 7549 - DNA, 796 bp, Medicago truncatula
  Predicted polypeptide sequence is orthologous to G1985
gcctttgtaaaatttatgtcttatagctatttccccattgctttccaaagaaagatggaatacacccaaaaccctaataaatctgaccaaataagatggagctctgacgacccaggtcaagttaggtcttattcttgtactttttgcaagagaggattctctaatgcacaagcattaggaggccacatgaatatccatagaagagatagagccaagctcaaacaacaatcttccgaagaaaatttgctttctttggacatcgcaaacaaaaaccctaatgatcaaggagatttggaagagaatcacgaaactcaaaggggtaagttaattactacaaaagaacttcctcatagttcttcatttgttggaactcaaaggattgaagagaagaaatgtgatttagaccttgagcttaggttaggttatcagccaatggattcatcaacattgagcactcgatcatttttctgaccttgaaaaattggcaaaattataggtcacttttttttttcgtacctagctacctcttcttccacttcccatttgaaagtacaactcgattttttttatataaacataaaggtacatgtatttaatctatacctttatgcttatgtaaaatacatgatggagtaaataaatgtgaaaatttaattttggtgtgttattagtatatcaaaaaatttacattttagttcaatggcatgtttctacattatttaataaattttgatatctacaaattattgtggtagtcaaatttattcaataatgtaattatatattattgaacgaa

SEQ ID NO: 7550 - DNA, 640 bp, Medicago truncatula
  Predicted polypeptide sequence is orthologous to G2011
aatcttccaccgccctttccctccctttttatattcatcaccaccacactccactctattcttcttctcatattctattcacacccccttcacctttctacctttctattcacacccgctcaaaaaaaccgttttttctgttattattcaacttaacatgaatccaaatgatgaaaaaaactctcccaaattttcttcttcatctttgatggaatatgaagcatcagctataggtggtggtggtagtggtagtagtgatgttcctgtgcctatggagtgtttgcagatgagcccagttccaccatttctttcaaaaacatttgatttggttgatgacccttcattgaatccaatcatatcatggagttccaatggtggtagctttgttgtttgggatcctttggagtttgcaagaattatcttgcctagacacttcaaacacaacaatttctccagttttgttcgtcagcttaatacttatgtgggtatttttggtttttgtattcttttgctacttttcacaataatcacaatgcctctaatggcccctatttatctttgtaatgtaactaactatttttctttttttttgttttgtaactaactatttaaattccctcttccccccttgtgtttgtta

SEQ ID NO: 7551 - DNA, 512 bp, Medicago truncatula
  misc_feature (60)..(60): n is a, c, g, or t
  misc_feature (122)..(122): n is a, c, g, or t
  misc_feature (149)..(149): n is a, c, g, or t
  misc_feature (151)..(151): n is a, c, g, or t
  misc_feature (167)..(167): n is a, c, g, or t
  misc_feature (170)..(170): n is a, c, g, or t
  misc_feature (175)..(175): n is a, c, g, or t
  misc_feature (247)..(247): n is a, c, g, or t
  misc_feature (316)..(316): n is a, c, g, or t
  misc_feature (334)..(334): n is a, c, g, or t
  misc_feature (359)..(359): n is a, c, g, or t
  misc_feature (389)..(389): n is a, c, g, or t
  misc_feature (399)..(399): n is a, c, g, or t
  misc_feature (406)..(406): n is a, c, g, or t
  misc_feature (443)..(443): n is a, c, g, or t
  misc_feature (459)..(459): n is a, c, g, or t
  misc_feature (485)..(485): n is a, c, g, or t
  misc_feature (501)..(501): n is a, c, g, or t
  Predicted polypeptide sequence is orthologous to G2035
agagaactagtctcgagttttttttttttttttttttttttttttttttttttttggganggagtcaaagggtctgcgtttcatgacccaccaatcaatattcaccacggttggatctgganaccttgatgggttgaaaaaactgttananaaacttaataaggaanaanatggngatataagtaatgggtcatcatcatcatctatgtcggtttctgatgttatgtctcttcaaaatgatcatggngaaacaccactttacatagctgcacacaataatctgaaggaagttttcacctttttgattaaattatgngactttgaggttctcaanattcgttctaagtctgatatgaacncttttcatgttgcagctaagcgtggccatnttgatattgngaggganattttgagtgcctggcctgcggtctgtaagttgtgcnactcgacaaacaccantcccctatatgctgctgctgttcaanatcacttggatgtggnaaatgctattt

SEQ ID NO: 7552 - DNA, 687 bp, Medicago truncatula
  Predicted polypeptide sequence is orthologous to G2035
gcattttccaagtgattcccagagacgcatcaagagagcaagtggaagcaaatccttctcatggtcttactctgcaaatatatcagatatagacgaatacacttcagacattgagaagatctatgctttgtaagctggtgattgagtgctaccacgcaatataacactgaatatgtatagtataatccaaatcagttttaacaattatcgatactttataaagttataatcattttgatttggtaaaaatgctgatgaggatcaaaatatcaatgattatagttttataatatatcagtggttgttaaaagtcagtccattatcgacaagaactttcctgatagcaccatattgtatagatgtagaggatctaatttcctgtttccagcttttaactgaaacctgaggagttacggatggcacttcagtgcctttgatgtttccttacctggatttatctctctagttatcagcttgaagttttaggttgtgcctggcaaactctttaggtttgcattttctattgtctgtgattatataattaataatcagcacttgtagatgtatgtatatatgtgataaaaggaaaaggcatttatgtaaagtatttcaagcaacacgtacaagagaagtgcttccttcctagcctgctatgatagaaattagaggatgaaaagttgaaaggag

SEQ ID NO: 7553 - DNA, 812 bp, Medicago truncatula
  Predicted polypeptide sequence is orthologous to G2059
gaaatctttacacaaaaggaattaccaacttgttttcaagaaatagcaacaacagaatccaagtatttggaggatacaattataagaagaggctcttactctctcacttcctcatcaacatcatcaccacaaaagcttttctggtgtacttcaaattctacttcaatgaaacaagaggtacctttaaccactttagttaatcaaatacctgcaaagttcaatgatcatcatgatgacatgaagaatatgaaagctataaaccaatccatttctgaattcaattctatttccaatcctaatgtcttagcctcagatataaaacatagttttgttcctctaaatcttttggaaactctcccggctttaaccgtagctccgatgtctgatgagcctgcagtatctttagcttcttctacttgcgctacaccgaaatctccaaacttgactttgtttttgcaggaaccatccatgctatactcatcaacttcaaatatcaaaagtagtgaaatcatgtcaacatcttcaaatcccacatatcctatgtctcaatttggcctaactcagcatcatcaacaaagtgcttatgaattttatgattcaaacaaaatggacaggaatatgataacaaatctacaatccaagtctttcaatgagaattgggttgagtgccacaaagactcaacctatgaagtatggtacaagagggaagctttttaaaggggtgaggcagagacattggggaaaatgggttgctgaaataggctaccaagaaacagactagggtctggttagggacatttgaaacagctgaa

SEQ ID NO: 7554 - DNA, 696 bp, Medicago truncatula
  misc_feature (471)..(471): n is a, c, g, or t
  misc_feature (612)..(612): n is a, c, g, or t
  misc_feature (652)..(652): n is a, c, g, or t
  misc_feature (674)..(674): n is a, c, g, or t
  misc_feature (683)..(683): n is a, c, g, or t
  Predicted polypeptide sequence is orthologous to G2071
gtaaagaccatacttctgctttaagtctttaaaagtggggtcaaaatgaacttcgcttgggatgcaatgagtgtgaagacacctggaagtgttaacctagcaagccagtcttcaatatactccctcacttttgatgagttacaaagcaccattggaggagttggaaaagattttggatcaatgaacatggatgaactcttgaaaaacatatggaatgttgaagagactcaagccttgacatctctaactggtggaggagtaggagaaggacctaacaacccaaatggtggtactttgcaaaaacaaggctcattgacattgccaaggacacttagtcagagaaaagttgatgaagtttggagggatttgatgaaagatagtggttcatctatgcctcaaagacaaccaacattaggtgaagtgactttggaggagtttttggtgagagctggtgttgtgaaagaagatacncctaatcatgctcaacaaatcgaaagaccgaataataatgaatggtttagtgacttttctaggtcaaacaataacaccaatctacttggctttcacaaccaaatggaaataatggggatatgagccacaacaataacttanttccgaaacacgttcctcttcctccttcctaatttaactngaatcactctcaacgggcgcanccacttttnccgaaacctcaac

SEQ ID NO: 7555 - DNA, 784 bp, Medicago truncatula
  Predicted polypeptide sequence is orthologous to G2085
ggtatggatgattccaactccgatgctgtttacggcaacggcagtgaaaatcctgaattcgcacttcaaagttttgatgaatctgatcagctggacgctgtcgtttcgtggtcaagtttatgtctttgattctgttacgcccgctaaggttcaatcggtgttgttactgttgggtggatgtgaacaacctaatgttggtgtgaatgcggtgcctcaacaaagtttgagggtggaatcaatggattttcctacaaaatatagtcaactgcatcgagaagcctcattacttaggttccggcagaagaggaaagaaagatgctttgataagaaagttagatatgaagtacgtcaagaagttgcactcaggatgcagcgaaagaagggtcaatttactacatctaagaaacaagatgggtccaatagttgtggtacagaccaggattctagccaggatgccagtccatcagaaatctcttgcacacattgtggcacaagctcaaaatcgaccccaatgatgcggcgagggccatctggtccaaggtcactttgcaatgcttgtgggcttttctgggcaaacagaggtgttttgagagacctttccaagagacatcaggagttatctactggtaccagttgagcagggttgatcaaagtaacagctcagactgtggaactgcaactatccctgcacacaacatcacccctattgagcaccatctactatttgctagtactatactgggtacttggtctgttgggatgcacagcctgtctattggatgca

SEQ ID NO: 7556 - DNA, 803 bp, Medicago truncatula
  Predicted polypeptide sequence is orthologous to G2110, G2574
tttcaataaaacaagatacagaataatacactaaaattcaattctctaattacatacataaatccaatcaaaaaaagaaagtatagaatttcctaagtaactacattaaaataaataatcaccaattaattggtgttgtcactattatcaccaccaggagatgtagaagcacttttagttgcagaaaatggcaaagaaggagacaacaacatcaaacttccattctgtgtattgttcaccggtgccgttttgttcaagaaacttgaagcacaaccatttactttagaacttgatgaaggcaatgaagtagaagaaacttgaaacatctcagcccatttcattttctgactcaaattttctcctgcactttgattttgattcccttgattggtggtgtttccgataagcgaagaaagtgctgcagctaaagctgattgaaaagttggatctgctgtgatagcttttgttgctgcagatatagtactatcttgtaaacctacatgttgtgaaatgtttgaactattgttgtttttttgcatgtaggtttggtatatactttccattgtgttttgtctaccaaagtttaaagtgcttaggttattattgttcctattattactatatggttgattttgagtagtagcatagttgaggaagctattccaatgcatgggatttgattcaggagaactaaagctaagagtggaagaagggtatcttgggtagttggttattggttgttgtagcttggattgaatctaaccaagggtgatgatgttgaagaatttgatgggtttgaagtg

SEQ ID NO: 7557 - DNA, 726 bp, Medicago truncatula
  Predicted polypeptide sequence is orthologous to G2140, G2765
tatctcattttcatcatggattctagctctgatatttcgaggatactattcaatgcctcttcatatagatttggtgcttcaaatgagacttcaagaggtgggtttgtatcaacaaactcattggttttggatagtgagaaaggagaattagtgaagtcccctccaataattaatggagagaaaaagatttgtgatgctaacaaaactttagtggctttgaagaatcatagggaagcagagaggaagagaagaaacagaattaatggtcatcttgctaaactccgtgcactagtgccctcctctccaaagatggacaaagcaactttactagctgaggttattaggcaagtgaagcatttgaaaaaaaatgcagatgaagcaagcaaaggttattcaattccaacagacgatgatgaagtgaaagttgaaccatatgaaaatggtggatcatttctttacaaagcatctatcagctgcgattatcgaccagaacttctatctgatctaagacaaactcttgataaacttcaactacaattggcactgagttctgtactggaaagggcttctacctcgatggactactcgttaagaacaccacgtccttgcaaacagatgcagcagacatttactatgtcatgcaaccatgaattttgcctcttgttgatgccaaacattttgggttcgttaattgataaccggtttaaatgcctttttagtctccca

SEQ ID NO: 7558 - DNA, 715 bp, Medicago truncatula
  Predicted polypeptide sequence is orthologous to G2141
tccccatgttggagggtactactagtggagagccttctatgaaaggactaaactcgaagaaaaggaaaagaagtggacaggatgctgataatgataaacccaatggaactcaagaacctacaaaatgaaggtgcaaaggacaaccctgagaaccaacagaagtgtgaccaacaaccaacttcgacaattaaggcttctgggaagaatgccaaacagggctctcaaaattctgatccacctaaggaggaatacatacatgttagggctcgccggggtcaagcaacaaacagccatagccttgcagagagggtgaggagggaaaaaataagtgagaggatgaagtttcttcaagaacttgtgcctggatgcagcaaggtcactggtaaggcagtgatgctggatgaaatcatcaactatgtacagtcacttcaacgacaagttgagtttttgtctatgaaacttgcaacagttaatccacggctggatttcaatattgaaagccttcttgctaaagatgttcttcaccaacggcctggtccttcgtcccactaggatttcctctagagatgtcaatgaattttcctccattacatccatctcaaccagggatgattcagtcagtgattccaaacatggcaaacccgtccgatatccttcgaagaactattcatacacagttaacaccccgttgagtggaggattcaaggagccaaat

SEQ ID NO: 7559 - DNA, 527 bp, Medicago truncatula
  Predicted polypeptide sequence is orthologous to G2142
caggattcggcacgagcatctcgagtgtatactcccaagggctgttgaacaatctgactcaagcgctacagagtgctgggttagatctgtcaaaggccaacatttcagttcaaattgatcttgggaagcgtgcaaacaaagatccaagcggcacagcctcatctcccaagaatcatgataaccctctttgttgcaatcaatcatttgcacattttagagatggtggcaatagagaagactcagatcaagctcaaaaaagaatgaaaacatacaagtgaataattcatgtggctcttttatgagcctacattttcatcctcatttcttactttgtttctctcccttgttcctttgtggttactgtaaatccttccccatttgtttgagcttaattcctttcatgaaggttattttaaagctgcaaaatcctttactacataattatttgtggagatgattaggtttctgctctactgcttatgtcatctattttcattgtatccttactaaaaaaaaaaaaaaaaaaa

SEQ ID NO: 7560 - DNA, 650 bp, Medicago truncatula
  misc_feature (538)..(538): n is a, c, g, or t
  misc_feature (558)..(558): n is a, c, g, or t
  misc_feature (612)..(612): n is a, c, g, or t
  misc_feature (631)..(631): n is a, c, g, or t
  Predicted polypeptide sequence is orthologous to G2142
cttttcccgccggagaaactcaacaacggtgtagatcatcatcctttcagaattgttgagtgagtgagtgagtgataccctttgcctacaacaatgaaagcagggaaagttaatcatgaagaagatgagtacgatgatgatgagtttaattctaacaaaaaacaagctacttcctctgtccctaacaccaacaaagatgggaaagctactgataaggctagtgtgataagatcgaaacattctgtaacggagcagcggagaagaagcaagataaatgagagattccaaatattgagggatctcatacctcaatgcgatcaaaagagggacacagcttcgttcttattagaggtgattgagtatgttcagtacttacaggagagggtacaaaaatatgaaggctcatatcaaggttggagtcaagaaccgttcgaagttgatgccatggagaaatagccattggcgtgcccaaaattttgtcggtcaacctccaattgtaaagaatggttcaggtccagtattaccatttcccggaaanttttgatgaaaatagtgttnggtatctctccaacgatgcttagtggctcccataatatgatagatcacgatccntctcgggatattgtcggcnagacggcggagaggcaacc

SEQ ID NO: 7561 - DNA, 843 bp, Medicago truncatula
  Predicted polypeptide sequence is orthologous to G2142
gctcagacgtagattatcatctgatgcagagaacaccaattatcaaccttcagtagaatctcagactatgacttcaaccagtgaaaagctgaaagagaaagagctcaccattgaaggaggtgccattagcatatcaagtgtgtactcacaagggttgttggatacacttacacaagccttgcagagttcgggagtggatttatcacaggctagcatttcggtgcaaattgaacttggtaaacaagcaagcctcagaccaaacataccaatgccaatgtgtgtttccaaggatgatgaagatccttctaagaatcaaaggaaaatgcgctctggctctagagtcgctagctctgagaagtctgatcaagcactaaagaagctgaaaatgtgcagaagttaattcaaccgttacattcattctttccttaataatttttatcaattatttggggtaactttttaaaattaatttttggaaggggtatttatttcctgtgctggattattatccagcatggatgagattgactgtacatgtagtgtcttagtttgttgggatccttaggctctccccaacaaaataatatgcatcattttagtttctaaatatatataattatagaggcctcccatactgatacaagctgtttttgattcatagcttccattgctgtaaattagtaaactcttggtcttttatttgctgcatatttttttaaccattgattttggtggtcttgtgtattatgcttgaatagagaccccttgcgtagctcattatttatagcctcacacctccattgtgatagctaataaaattgtacctatgagatatctttcaaa

SEQ ID NO: 7562 - DNA, 771 bp, Medicago truncatula
  Predicted polypeptide sequence is orthologous to G2142
ttataaattctcttaaatacttacacaagtgatggtgtcataactccaaacaagttataaataagctcttccagacgtttattctaaaatgtccttgtttcaaaaccagaatcatgaaatatacattttaatctagatctactaagcatgaaaaaaataacctgacctacccaatcccactttccctcagctcaacataaaaaaaaagaaatatttaaacagaacaaaatgaatatgaggagaatcactagcttgcttctcttctgaacctctttgaactttgttcagaatcctcactgaagtaatccattcctgaacatgctattgcttgattgctcacaaattgattttcattactctttgagctatattggcagggggtaaatccagtatttgttcgtctaccaacatcaatatctaccgatacattggtctgggacaaatctacacctgaagattgtagcgcttgggtgagagtacccaatattctttgagagtaggcacttgagatactatctgactctgatccgctatcaattttcatctcctcttgttccttcaatgtattatctgaaacaatatgattggtccttgtttggtttgccaagccatacttgaggctggagattggaagccatgtcaggattagatacaggcaactccagcatctgttgagtcaccataccaccgctaacaaccggatcaaacatatccaatcgcatttgcatggtcagggggactactttctggatggtgaggggggaagagcaa

SEQ ID NO: 7563 - DNA, 663 bp, Medicago truncatula
  Predicted polypeptide sequence is orthologous to G2144
atttgagatatccaaaccaaacaaaaccgtagcgtaacaacgttgttttcttacttacttcaaatgccagagaagaaccaacacagaacaaaaataataagcacattataaaacacagacttcactctttttccactctctttctttccctccttcattctcccccaacaacttacacagttaactccggtttttgggttttcggagttttctcaaaccggttcatttcggtttggttcagttaaacgatggaacaaaccacgttcgagtcgattcaattcaatgaagaaattcaaggaatcatggctccggcgacggaaacagcgaactctttcaccgcacttcttgaacttccaccgacgcaggtcgttgagcttcttcactcgtcggagattaccggaaaaccaccgaaaccctatccactgacttgcaacaccggtaatttaactttcccttccaacgccgcgttggttgaacgcgccgctagattctccgttttcgccggagaaaattccacaaactcgccgaacttgccgcaggtgaaggatgagctaccggagactgaagaaggtggatgtgtctctgatccaacagtttgaaaacacgaatttcagagtgcgaagaggaaggaacggagagaagaaggtgaattgtcgtctaaaa

SEQ ID NO: 7564 - DNA, 672 bp, Medicago truncatula
  misc_feature (664)..(664): n is a, c, g, or t
  Predicted polypeptide sequence is orthologous to G2144
cagaacaacaaaaacaaaaacagattgaccgccatcacactcaactacaacattgaacaaaattttcaacactctcacacttcaaattaaacaaaatttcaattggatttttaatttcattttctttgctcaatggaacaagctacagtaggattaagtggatccattcacgacgattctgttcaatttgacgaagaaattcaaggaattatgattccggcgccggcaccggaaaacgcaagctcattcacagcactgttagagcttccacctacgctggcggttgagctacttcatttgcctgagcagaaaccctatcttccgaactcttctaacgggaatttaacttttcctactaacgccgcgttgattgaacgcgccgcgaaattctcagtgttcgccggagagaattcttcaccgggagattcgcggctgtttccggtggaaagtgtgaagaacgagcctcaagagactgattcgaatccttgctcgacgcaagagtgtgtttcggatccagctgagaataagaatcagagaaacgtgaagagaaaagagcgagagaagaagggtaaagcgtcgtcgtcgaagaagagcaaaagcatcgccgatgaaacttccggtgccggtgagaagcttccctatgttcatgttcgcgttcgacganggcaagct

SEQ ID NO: 7565 - DNA, 706 bp, Medicago truncatula
  misc_feature (426)..(426): n is a, c, g, or t
  misc_feature (626)..(626): n is a, c, g, or t
  misc_feature (648)..(648): n is a, c, g, or t
  misc_feature (673)..(673): n is a, c, g, or t
  misc_feature (694)..(694): n is a, c, g, or t
  Predicted polypeptide sequence is orthologous to G2157
gtcaaagaaaacagcacactactaaaaaaaaaacacaaacattatcatctcaaacattcactcaattccaccttcttcttaccctttttcacacaacatccaaaaaacatctcaagtttttcaagaaacatgtcgaatcgatggtggagtggaagacaaacggaggcgaacccggtcgaaggagagaaccgaaacggtccaacccggatcattttacgaagagagtcacgaagggcaagtaacggtagcgttaacggcaacgttaccggcggtaacgttactccaacgaggagtaacaccagcaataccggcaccggcaacagcaacggccatgttaacgacgaacttgagaacagcaatggccgttccggcgaccagaccgccagaagtggacgccggccacgtggacgtccgccggggtcgaanaacaagccaaaaccaccgctgatgatcacaaaagaaactccaaacgctcttagcagcgttatcttggaagtcgccaacggagccgacatcgcccatagcatttcatcctatgctaaccgtcgccaccgtggtggttcagttctcagcggcactgggttatgttaccaacgtgacactccggcaagataatgctccgggangaatgatatctcttcaagggangtgtcacattctgtcactcagcggngcttttttgcctccgccttcnccgcctgatgct

SEQ ID NO: 7566 - DNA, 664 bp, Medicago truncatula
  misc_feature (655)..(655): n is a, c, g, or t
  Predicted polypeptide sequence is orthologous to G2226
ggcacgaggacctcttcacaaattgttcttgttgacccacatcacaaatcctcaaatcctttatctgtaaactattaacaagatcaaaatagtttccattgataaattctgcttcaaaatacacattgcatcataaagtgtatcacaaatttgttcatcaaaatgggcctatcaagtcttccagcacaatctgaaggagtgttatgcatcattctagtaaacactgccatgtcaatatccatattcaaaggcattataaggactatcctgcacattgttggtatcattgcttcaccatcttcctctccttcccaagactacattcctcaaaacatacctgagtcatatgaaatccatctaagtccttcagatgatttcgttgaagagttcagaagcagaacaccaacacttaggtttgatagtgtgtgtaatagctgcaaagaacctgaacatgattgctcagtgtgtctcactcaatttgaacctgaatcagagataaactattgcatatcatgtggccatgtttttcataaagtgtgtttggagaagtggttggattattggaacattacatgtccactttgtaggagtcctttaattcctgaagatgatgcatcttgcttatggtaagagcaatgattgaagcatgcacaanatatctaat

SEQ ID NO: 7567 - DNA, 832 bp, Medicago truncatula
  Predicted polypeptide sequence is orthologous to G2227
tcaatctatccgatcacaccctcatcgtttgtcctcactgcgataacggtttcgtcgaagagatcgccgccggcgaatccccgcatcaccgtctaagtccttttcctgcggataccgtttcttctcgccgacaaggcttccgccgtcgccgtcgtgacgctggtagtcgttcacctttcaatcctgtcatcgttcttcgtggagccggtgatgatggagtcggagaagacggcgctggtgctggtggtagcgcttttgaacttttctacgatgacggtgatggttcggggttacgtcctctaccaccgacggtttcggagtttttgcttggatctggatttgatcggttgttggagcagttttctcagatcgagatgaatggttttggacggccggagaatccaccggcgtcaaaagcggcgattgaatcgatgccgactgttgagatctgtgaagaacacgttagttgtgaattacactgcgccgtttgcaaagaagagtttgagctacacgcggaggcgcgtgagttgccttgcaaacatttataccattccgattgcattcttccatggctgacagtgagaaactcgtgcccggtgtgccgccatgagcttccttctgatctcaacaatcctcttgaaactagggtttctggtcaaattgatgaagaagctatcgggttaacgatatggaggttacccggtggtggattcgctgttgggagattctccggtggaagaagtgccggggagagtcattttccggttgtgtatactgagatggatggtgggctcaatgctgcacaaggatcggctccgaggagaatatctag

SEQ ID NO: 7568 - DNA, 807 bp, Medicago truncatula
  Predicted polypeptide sequence is orthologous to G2227
ctaaatgaactcggaactgaaacaccatcctcaacgacgtcgttttggtgctacagctgcacacgtttcattcacatcttgaaccaaaacaacgttgtttgtcctcactgccaaaacggcttcgttgaagagattcacgccggtcaatcaccggcggtttctcttttcgccgacggaattcagtcctccagaagacaaacctcccgccgcagacgtcgtaacgccggcggcagccgttcgccttttaatccggtgatcgttctccgtggacctagagaagacaccaccgccggtgtcggtgcagacgccggcgggggtgatagcgaggggaatacaagtagttttgaattatactatgaagacagtaatggcaccgatctacgtccacttccaccaagcatgtcggagctattactcggttccggcttcgatcggttgttagagcaattctctcaaattgaaatcaacggtttcggaaggtcggagaatccaccggcgtcaaaggcggcgatagagtcaataccaacagttgaaatcaccgattcagaaatggaatccgaaattcactgtgcagtttgcaaagaacaattcgagctaggttctgaagcgcgtaagatgccgtgtaatcatctttaccattccgattgcattctcccatggctttcaatgcgaaattcgtgcccgggtgtgtcggcacgagttaccgtccgatcaaaacgcgtcggagagtagaatttccggtcagattgatgaagaagcggttggattgacatatggaggttccgggaggtggatttgctggtggaa

SEQ ID NO: 7569 - DNA, 820 bp, Medicago truncatula
  Predicted polypeptide sequence is orthologous to G2239
ctccggcgtccccttcgccggattacaaaccaacgacaacacaaatgataactcatattacaaccgtgtaagcccttccatggctataataatcgtaatcctcgtagctgctctttttctcatgggtttcttctcaatctacatccgtcgatgcggcgactcaccttccaacagcatccgaaacatggcaggaggtttagccggacgttcaagacgggcggcgcgtggtctcgacgcttcggtgattgcgactttcccgatctttgaatactcgactgtgaagattcataaaatcggaaaaggcgcgttggaatgtgctgtttgtttgaacgagtttgaagagagtgaaacgctgcgtttgattccaaagtgtgatcatgtttttcatcctgagtgtattgatgaatggcttggttcacataccacttgtccggtttgcagagctaatttggttcctcaaccgggtgaatcggttcacggtatcccatcgattaataccgaaccacaagatattgaagctcaaaacgacgctgttgaatcggttcatgaacatcaaaacgcagacggttctgtaaaagtcgacccaaccgaaccagaagtgctgactgtaagccagacgctgaaccggaaccgtacgagaggttcacagtctggtcggccacgttggtttcaacggtctcattcaaccggtcattcattggttcaaccgggtgagaatactgaacggttcactttgaggctaccagttgaagtgaggaaacaaatactacagaacccggaattgcatagggctagaagcttagttgtgttgccaagagaa

SEQ ID NO: 7570 - DNA, 855 bp, Medicago truncatula
  Predicted polypeptide sequence is orthologous to G2239
tattcatcctctttggaatccttcttctctcaatcacaaaaacccaatcccaagctactaacgataaccccacaaatccaaatttcaaccaagaatttaacccttccttcgctataatcatagtcattttagtagctgctctttttctcatgggctttttctccatctacatccgtcgctgctccgattcaccttcctccaacaacctccttctccccatcaccaacggccgtagagcggtggcgcgtggactcgatccatcagtaatcgaaactttcccgattcttgaatactccgaagtcaagatccataagatcggaaaagatgttcttgagtgtgccgtttgtttaatggaattcgaagatactgaaacgctgcgtttgattccaaagtgtgatcatgtttttcaccctgagtgtattgacgagtggttatcttctcacacaacgtgtcccgtttgtcgcgcgaatctcgttccacaacctggtgactcagttcacggcgttcctgagtcacagcaacaagacgttgaagctcaaaacgacgcggttcaattaccgacggaatctgactcagtattacttgctccagaagtgatttcgttgaataaaacactgaaccggaaccgtacgcgtggatctcaatcaaaccggccgcgtcgttttccacggtctcactcgaccggacattctttaatccaaccgggtgaaaacacggaccggttcactttgaaactgcctaataaggttaggaaacagataatgagccggcaattgcaacgagcgagaagtttgattacgttaccaagagaaagtagctcaagacatggctaccgaaccggaggtgaaggaagta

SEQ ID NO: 7571 - DNA, 675 bp, Medicago truncatula
  Predicted polypeptide sequence is orthologous to G2311
gcacgagagacaagacagtaagcgaaaaagaagcgcttattgttttattgaataataatgggaaatcaaaagctgaaatggacgaatgaagaagaagacgctcttatcgctggaatcgaaacacatggccctggtaaatggaaggccattctccttgatcctcagtttggtcctttactcacttctcgttccaacatcgacctcaaggataaatggaggaatatgaatgtgaataatattagtcaagttcctaagtttcccaagtgcaaacctgattctcctgctcctgtttcttcttctggtgctgctgttgatcaaactgttgctcttccttcttctgatgttgttaacaatgttcctcctcctcctcctcctcctcttcaaattgaacaagatgttgttaaaaacaacacacctaggtatgatgtcatgatttacgaagctctgtctacattaaaggatactaatggatccgacgtaattgccattgctagtttcattgagcaaaaacatcaggttcctcaaaatttcaaaaagtcactgaaggcaaggttgaggatgcttgtgggtcatgggaagcttgaaaaggaacaaaactgtttcaagataaaagaagctttgtcagtgaataaatcaccttcaccaaaacaaaaggaggccaagccatcaccttca

SEQ ID NO: 7572 - DNA, 694 bp, Medicago truncatula
  Predicted polypeptide sequence is orthologous to G2311
acgcattcgttgttgttcgtgctcagaaagagaagagagatgggaaatcagaagcagaagtggacagctgaagaagaagaagccttgcatcaaggtgttcagaaatatggtgctggaaaatggaagcacattctcaaagaccctcaattcagtcaaaaactcgctagccgctccaatatcgatctaaaggataaatggcggaatttgaatgtttttcctggtcaaaaccctaaaactcctaagggtaaaccatctgggtcctctcctgctccaagcaatgctactccttctccgtctcctgctcctggtactcctgctgcttctgctggtactcctgctgctgctgctgctgctgctgctccggtcaatgttgctgctacacctcaagctcagactacgattcggactcctactagtcagccttctcagaatgatgacaatgctgccaagatttatcctcagtacaattcattgatttttgaagctctatcaacaatcaaggatcccaatggttctgacttaaatgctattattagcttcattgagcaaaagcacagcttgcctcaaagtcaaaatttcagaaggacactaggtgcaaagttaagaaggcttgtcggtcaagggaaacttgaaaaggtacaaaatggttaccaagataaggacacctcagtggggggtgaagtcagctgatgac

SEQ ID NO: 7573 - DNA, 821 bp, Medicago truncatula
  Predicted polypeptide sequence is orthologous to G2317
ctcagctgaaatttcaaggatcaagttcaaggcacaaagtcaactggaacagctagtaagtgccattccaaaggtggatcgcagtctgaaaatgatgcgaagtcgcaggatataccttctgtcggaaacaaccttgctcccaaggttaggaaaccgtataccatcactaaacaaagggagaaatggaccgacgaagagcatcaaaagttccttgaggctttgaaactatatggccgtggctggcgtcaaattgaaggttgtgcgggaacctgatggcagtgctgaaagtcctattcagccaattgacatacctcctcctcggccgaagaggaaaccccttcatccataccctcgcaaatcagttgactctttcaaaggacagttggtcccaaatgaatcagaaacatctccatccattaacctgtcagttgcagaaaacgacacccaatcgccaacctctgtacttggttcggaagcatttgggtcggcagcattttctgagcagactaatagatgtctttctccaaattcttgcaccaccgagattcacccggtcagcttgtcacctgttgagaaagaaaacgattgccagacatccaaaccatctgaggaggaagagaaaggatctctagcttcaattccatccaccgactcaaaaccacttatgtgcatgaagtctgagaatatttcttccgaggaaactcaatcttccaaagaagacgctgcaaatatgccacaaatcactagtattaagctgtttggtcgaacactctctatgggttctcagaagtcaatgaaggatgatgacgaaaatactaagt

SEQ ID NO: 7574 - DNA, 683 bp, Medicago truncatula
  misc_feature (624)..(624): n is a, c, g, or t
  misc_feature (643)..(643): n is a, c, g, or t
  Predicted polypeptide sequence is orthologous to G2319
gtattattcgcacaacacaatttggtgattctgatgaatgatgggaccgtgcaaaagcatagtatgaaatgaatgaatgaatctaattgaattatatgaaatgttcggatcagtgtaaaaagttgacaacttgtgttgtgtttgggacagttggaacctccatcactagttatctatcactgcacatgtgccatacccaattaactatttccctttcttgtaagtttctattatgttctctgtggcagaagaaaaccaaaccatgaactctaattctaactcaatggcagcaccaacaacaactacaacaactagtggtggagatgcttctggtaagaaggttagaaaaccatacacaattactaagtcaagagaaagctggtctgatgaagaacatgacaagtttcttgaagctcttcaattgtttgatagagattggaagaagattgaagattttgtaggctctaaaacagttattcagattcgaagtcatgcccaaaaatacttcttaaaggttcaaaagaatggaacactagctcatgtccctcctcctcgtccaaagcgcaaagctattcatccttatccacaaaaaagcaacaaaaaatgttttggtgccactaccancatccattgcttttggctnttccgtaatacccttctacctgcagggtatgtcacgtggg

SEQ ID NO: 7575 - DNA, 536 bp, Medicago truncatula
  Predicted polypeptide sequence is orthologous to G2348
caatttcttctgtttgttcattctttgattatctttctttctttattttttggtgaagcggcgcttgagaggactgaaactagaatgcttaccattccttgcacttctgacgctaactgtccgaaggtgattagtccttgccatacaaagtgttttgatggtttttgtgggtggtatattgaaggttcatatgaagggccataattgcacaatcgaaaccaggggatatcacattatttctactttttttctttacttaaaaatataaattatgtttatctagcttttaaatttaattttatgtgtatgctgcactcttttttccttcatcaagttttatctcaatagattttcttgttaaggtttttaatgaggcagttgtttgtttccttgggttttggcatagtctacccaattttttatttttttaataatatgtttctttgaggtcttacttagctgagatttcctcatgtattatgcatgatgcctatgtacgtcgttgatatctgaaaaaattaaatgcatttttccat

SEQ ID NO: 7576 - DNA, 682 bp, Medicago truncatula
  misc_feature (612)..(612): n is a, c, g, or t
  misc_feature (645)..(645): n is a, c, g, or t
  misc_feature (659)..(659): n is a, c, g, or t
  misc_feature (668)..(668): n is a, c, g, or t
  Predicted polypeptide sequence is orthologous to G2348
gaaaaaacaaagctcaacaacccatccaccaccgtatcgtaccttctccgccaaacatccaacaactttctaaccaccaccaaaaagcgcttattccaaccgcgcttttttcataatctcaatggaatccaaatctcaaccaattctccctccaatggatcctcccgaagatctctcctccgtttgggacctctcttacctcctcgacttcgatgacgatattccacaactcccgcctcttcctaaccctaatcctactccagaagaaaacgagaggatccgaaagcgtgacccgaggttaacttgctccaactttctcgcgggtcaagtaccatgtgcatgccctgaactcgatgctttgttagaggataacggtttaccaggaaagaaacgagctcgaactgcacgcgcggctgcatcggcgcgttgtcaagttcctggttgtgaagttgatatctctgagcttaaaggctatcatcgacggcatagggtttgtttgcggtgtgctaatgctgctactgttgttcttgatggtgatgtgaagagatactgccaacagtgtgggaagtttcatgttttatcggatttcgatgaagggaaacggagttgtanaaggaaattggagcggcataatactcggaggangagaaaggccgtanattctgcantaggagttgatatg

SEQ ID NO: 7577 - DNA, 653 bp, Medicago truncatula
  misc_feature (602)..(602): n is a, c, g, or t
  Predicted polypeptide sequence is orthologous to G2455
gagaaaaagaaaaatgtcaatggacatgattgcaacagaacgtgtttgttatgttcactgcaacttctgcaacaccattctagcggttaatgttccatacagcagtttgttaaccatagtaacagttagatgtggacattgtgctaatttgctatcagttaacatggtagcaccattacttcagccatttcctcctcctcaactccctcagccacagaaacagcacataattgatgaagaagcaagcagcaaggaaattggatcatcatcttcaaaatgcaacaaaatagcatcatttgaggcagtagaacatcctaggattcctcccattcgtcctatagagaaaagacatcgtgttccttcagcttacaaccggttcattaaggaggaaattcaaaggattaaggccagtaatccagatatcagccacagggaggctttcagctcagcagccaaaaattgggcacatttccctcatattcactttgggaagcagcaagcaaagttggatcatggtgaagggactcgtgaaaagactaatggattctactgatataaatatcgtagcctttgtttgacctaaatctgtgaaaattaatgangttttcctgatcctacaacaaagattggagactggtctgcaaattaatctc

SEQ ID NO: 7578 - DNA, 623 bp, Medicago truncatula
  misc_feature (607)..(607): n is a, c, g, or t
  Predicted polypeptide sequence is orthologous to G2457, G2459
cttttttatatcacattgccttaccctatttattttctccttctctctttctaatataactcatcctttgggttccaaacaaaccccttcatcaagctctttctaccgtaattctctatatatattactatccacccttccctcagcttttatttactgttctcatatccaacctagcttataaatatacacaaaccaagtagaggtttggaaataaagagagagagagagacctttctcttcaactttggtatcccttgcaagatatttaattatcttatctatctatcttcatctccttcttcttcgtctctcttacatctttgtttttgtaaaagaatcttccttgtagagacatgtctagctgcagcatcgatgttgcacctgcagctgcagagcaactttgctacatcccttgcaacttttgcaatattgttcttgcggtgagtgttccatgcagtagcttgtttgacatagtgaccgttcgatgtggtcactgcacaaatctatggtcagtaaacatggccgccgcgtttcagtcactgtcatggcaagatgttcaggcacctagccactgcatgaatccagagtataggattcgaactanctccactcccaaatgc

SEQ ID NO: 7579 - DNA, 801 bp, Medicago truncatula
  Predicted polypeptide sequence is orthologous to G2465
gattctttcttcatcgatatccccactctctctcttgcttcccaaaacgccattctcttcttcacaatcgattattcctcttcttacataaaccatttttgccttcacaatgcagcgttttaaaatgggtttctctgattacatccaagcattagaacaagaacgtcgtaagattcaagtctttcctaaagaacttcctctttctttagaactcgttacacaagctattgaagcttgtagacaacaattgtctggaacaacaactgagtataatttgaatggacaatctgagtgttctgaacagacaacatcaacagatggacctgttttggaagagtttattccaattaagaaaagggcttcttcttattctcaagaagtgtttgatgatgtggaagattatgatcaacattttcatcataagcaacaaaaactttctttggataataagaaaaaatccgattggcttagatctgttcagttatggaattcagatccttcatctgaagaggatgttactaagaaagcagtgcctgtgttggaattgaagagaaatggatgtggggggtggtgcttttcatccattccataaagaagatagagttaacaacacgacaagtgaattgttgagtaaaggacaaccttcttcgaccggtgtagctgccgtgagttctatgcggctactgtcaccagtaacaatggtgaaaacaggaaaagagatgagaaagaggaaaagagaaaacagcgacggtgctggtcgcaggagttgcacaagcgattcctgaaggcgcttcacagctt

SEQ ID NO: 7580 - DNA, 644 bp, Medicago truncatula
  misc_feature (605)..(605): n is a, c, g, or t
  misc_feature (642)..(642): n is a, c, g, or t
  Predicted polypeptide sequence is orthologous to G2510
cataaacccccacacacaacctcaatattcaacaccattaaaccacaacactcacaaaaatctcatcactcaattttcctttttctcatttctcatgtccatcacaaaggaatctgaatctcaatctcaagcagaagctcgacccggctcgataacaaaacgaagctcgagaaaaggtgactccgtatttcacggagtcaggaaacgtagctggggacgctacgtttctgagataaggctgccaggtcagaagactcgaatatggcttggatcattcgagtcagctgaaatggcagcccgtgcttatgactcagcagcttttttcttgaaaggaaattcagctagccttaattttcctgaagaagttgagtttctaccacgtcctctttcttcttctaggagagatattcaatctgctgcttctaaagcagctcatcaacgaagccaccaccatcaacaacaagaagaacaattacgtggagttacaccttcttcttcttcttcaacaagaatgaatgaaaataatattatcaataatagtgatgataatattattagtggaaataataatgttaatgatttttccattgagatgatggaatggnggaaagaaaaaaagtgtgtttcgaccacctcgttttngg

SEQ ID NO: 7581 - DNA, 664 bp, Medicago truncatula
  misc_feature (2)..(2): n is a, c, g, or t
  misc_feature (600)..(600): n is a, c, g, or t
  misc_feature (612)..(615): n is a, c, g, or t
  misc_feature (628)..(629): n is a, c, g, or t
  misc_feature (631)..(631): n is a, c, g, or t
  misc_feature (635)..(641): n is a, c, g, or t
  misc_feature (651)..(653): n is a, c, g, or t
  misc_feature (662)..(662): n is a, c, g, or t
  Predicted polypeptide sequence is orthologous to G2510
gncccattcattgaagatgatgtaaccgctgctgacagacagagaggtggaacacgccaccctgtctaccgcggtgtccgtaaacggcggtggggaaaatgggtatcacaaattcgtgaacccaagaagaaatctcgcatatggctaggatcattcccggtgccggagatggctgctaaagcatatgacgttgcagtgtattgcctgaaaggccaaaaagcgcaactcaactttcccgacgaggtggagaatctaccacttccggctacatgtacggccagagacattcatgctgcggcagctaaggcggcggcgagtatgatgaaggcttcgttggatgagaaaggttgcattgtgtctgatgaagatgatttttggggtgagattgaattgccggagctgatggagagtgattcgtcatggagttgctccggtgatatcatgacgtggccagaagttgaggttttggcgcagcaacatttcatgtcgtcgtgtctataaataaacgttggtctgtttcttgcatatctatcaatgtagtattatcttttatattgctatatatcatgatcatcaatgagttatatttatcatttgaanattaaaaactcnnnntctttctcccccnngnaagnnnnnnnaaaaaaaagnnnggggggggngg

SEQ ID NO: 7582 - DNA, 643 bp, Medicago truncatula
  Predicted polypeptide sequence is orthologous to G2520
aggactaagaaggccgcagtttgggaacggtttaggacagtatggtgagtttggacccggtttgaaccgggatggtaatggtttgaaccatgcttggtggtggtggtaagaagaggcgtgactctgaagatgattctgctaagtgtgtttccaccagtaatggcggtgccaatgccgtgaatgatagtgatggaaaacggactaaagcatcggggaacaagaatgagggtggtgatggtaaagttgaaggagaagccagttcaggaaagcatgcggagcaaagcagtaagccacctccttctgaccctcctaagcaagattacatccatgttcgagctagaaggggtcaagctactgatagccacagtcttgcagaacgtgccagaagggaaaagattagtgaaaggatgaaaattctacaggatttagttcctggttgtaataaggttattgggaaagcattggtgcttgatgagataattaattatattcaatcacttcagcgccaagtggagtttttatcgatgaaacttgaagcagttaattcaagactcaataccggcattgaagcctttcctccaaagattatggtcaacaaacgtttgatcttgccggcatgccatttgtttcacaagctacaaga

SEQ ID NO: 7583 - DNA, 667 bp, Medicago truncatula
  Predicted polypeptide sequence is orthologous to G2522
ccggttctgcatcatactttatgcagagaggattacctggttctggaaaccaacatgagttgcataattcgcctggtattcgtccactgaataccaattcatcgtttcaatcaagcattggtggtggtggtactattggatccacgttgccgatggattcttctggaattggatctcaatgtatcaatgtaggtgcttcttctgggggtgctgcttcaaccggtgaacctgccaaaaggaagcgtggaaggcctagaaaatacggggctgatggaagtgtgtccttagcattgactccaacaacaccagcaagccatcctggaaccgtaccgcaagtccagaaacgcggtcgagggcgccctccagggtccgggaaaaaacaacagttggcttctttcggtggtttgatctccagttcagctggaaatggtttcactcctcatgtcatctcaattgcaattggagaagacattgcaacaaaaattctggcattttctcagcagggacctagaactatatttgttatgtcggccaatggtgctgtctctactgtgacactttgtcaggcttcgacatcctgggggttctgtcacatatgaggggcgttttgagatactaagcctgacaggctcttacttggttgctgataatgatggctcgcgtaatc

SEQ ID NO: 7584 - DNA, 701 bp, Medicago truncatula
  Predicted polypeptide sequence is orthologous to G2531
ccctaaacttcaatgagagtcaatattatggacataaataaatccaccatataatacataaatgtaaatggttatctgattagtaaaattagtaaaagaatcactgttggtctaccaagaagctcttccaatgttactttctctccagcactcttactttgtttgcatgatccattgataagggaataatagttccattactttgaacagccatgtttggtataatcagttgtggagtgctttccctactatgaccaacatgcatattgtcataatttgtataacaagcattgtagcattccacatgagctacattgttgggggctgcactgttattaccatggtcacttcctttgttgattattttttcatatgaatctcttacattattaatggaattactaccatgttgtctaggctgtgtctggtagaagatctttgaagcaacgaattctccatctctttcttcttcattcataccaagatggtattgatgcatcacccaattagtcttctctggttttccatctttgcaatagttggtgtagagtaccaatatcttcttaaatcccttcacaacaccattggaaaaaattgctctagttttccctgttttgtgccatcttgtttcaattccttcttcatcagtgtgaacctttcttcttttcctgttcctgttgtgtatgcttttgagggctatg

SEQ ID NO: 7585 - DNA, 803 bp, Medicago truncatula
  misc_feature (764)..(767): n is a, c, g, or t
  misc_feature (769)..(773): n is a, c, g, or t
  misc_feature (788)..(790): n is a, c, g, or t
  Predicted polypeptide sequence is orthologous to G2550
ccgggcctgcaggattcggcacgagccgaaagcacgtggaatggaaaagcaagaaacaatccgcaacattggattggataatcccaaagatagtgatggaaaatctattagtcagtctatgcaaataacttcagggggacctaatgatcctaattccaatccttcttgtgaaatatcctcagccgaaagacagaatttgttggataagaagacaaagcttttgtccatgttggatgaggtagacaagagatacagacagtactgccatcggatgcaaattgtggtgtcatctttggacatggttgctgggggtggagcagcagagccatatactacacttgcattgcgaacaatttcgcgtcagtttcgctgcttgcgcgatgctatcagcaaccaagttcaagtgattcaaaggaaccttggggaacaagaaggaatacctcgtctccggtacgtggaccaacagcttaggcaacaaaaggcacttcagcatcttggtgttatgcgacaagcttggagacctcagagaggacttcccgaaaactctgtttcaatacttcgtgcttggctctttgaacattttcttaatccgtaagtgttactttataataccccctagaccttcactcagttttgtattttcaattagttgcaatggcttcatatgtatgctactttcataatattttctatttatgtgtattttaataaaattcattttgaactttgatttcataaattggttgataccagttaccccaagnnnncnnnnnaaataatgctagctnnncaaactggtttga

SEQ ID NO: 7586 - DNA, 715 bp, Medicago truncatula
  Predicted polypeptide sequence is orthologous to G2559
ctacctcaatctgaatctgaacctcgagagttttcctacttccttgaagaaaaggaaccggggaacgaaggaacttcaagcagtgttgttaaacaagagcgtgtcgtgagtgatcatgctacttcttcagttgatcaaactactgctgctggaacagatacaaaggactcagttgaccgagttcctttagatgctgtactagcaagggttgaatcgcagaaaagattggctttaattaaagcatgggaagaaaatgagaagacaaaagtagagaatagggcatataagatgcaatctgctgttgatttgtgggaggatgataagaaagcatcaattgaagcaaaattcaaaggaattgaggtaaaattggacagaaagaagagtgaatatgttgaagtaatgcaaaacaaaataggtgaaattcataaatcagcagaagagaaaaaggcaatgatagaagctcaaaaaggggaagaaatcctcaaggtagaggagacagctgcaaagtttcgtactcgtggctatcagccaagaagacttcttgggatgtttcagcggtttaagggtttttcagttagaaatatgcaagagaaaaactttccattagcttgcttgttttggttatacatttaatttaaattttgctttctggaatcggtttttttctaaatagtgggtgggtaataaaagatggacaatgaaatttgcatttgaa

SEQ ID NO: 7587 - DNA, 805 bp, Medicago truncatula
  Predicted polypeptide sequence is orthologous to G2559
gagagttaaattgtttttattcccaaagtaatggatatatacaacaagcaaatatacatcactatgcacacagaataaattaacataaactaaaaagacaccaaatcacacatgaagaaaacacatagtaataataacacatcatattttgttgaccacaagcttgaacattgtagcattagaaaagaccaaagagtttctttggagctgttccagttgccctgtattttgcagctatctcctctgctttgagtaaatcttcacctttctttgcctcaatcatagccttcttttcttcagctgccttgtgaagtgctgctattttgtttttcaatttctctgcatattctccctttttcttctctagttgttcctcaagttttctcaattcagcttctttagcagctttcttactgttctcccatgctgttatggttgaaagtcttctctgagctttgttctctgcttttgacttttcactttcttcccatgctttgattagtgacagcctcttttctgttgcaactcttgtaagcacagcatcgcggtcgatagagccgccctcttttggtttctcttcagcagcttcatcagtcttctgaactatgacaagagctttggagtcatcaacaactggaggaggaggaggaggattgttatcttgtggaattacagatttctcctcagctacatctttctttggagcctcagggagaggagtagtagtagtctcagttgaaagcaggtggtggtggaagattcgatgttgattcagattctatcttttttgggtgctcttgatctg

SEQ ID NO: 7588 - DNA, 609 bp, Medicago truncatula
  Predicted polypeptide sequence is orthologous to G2565
ggcacgaggtgcagattcaaattgaaaaccaagggaaacatcttgagatgatgtttgagaaacagaaacagattggtgacaacaagggcccttccccttcaaatgcaccttctgctgcagtgttggacacgacgctgccttcttctccggtggacaatttaaaaacttcaaaagatgaatgcgataaatcaggatgtaacgctgatattcctaaagacatacccggagaaagttcccatgatgtaagcagaaagcaaatggcagatgaagctgaagttaccaatgaacatgagagggtagatgatcagttttctgacgtacctccaacaaaacgagcgaagattcaatgatggcatctagagacaacatgctcgaatatctccttctgcttatcataatgatataatcaactttaacagtagccagcaatgacttaaacttcattttttgggatgaaataaatttcactccctagatttgttttatattcttggacatgttttagaccccatggaacttgtagatatagtattggatccatgaatgtttcaactaatgtggtatttacgttttataaggttatttttctgacaagcatgcttgagggtt

SEQ ID NO: 7589 - DNA, 663 bp, Medicago truncatula
  Predicted polypeptide sequence is orthologous to G2565
ctcattcggctcatgagacaaacttaacaaacaatccccaattcattcttcattatgcattaatttaacgctgctgcttcttcttccttcataaggtcatacaaagttgattgattcatctggaaaccttccgccagagctatgtcttcgtctattccatcttcctcgatgcaggctgcatcaatcaattccaatatcagaagtgttggacacatgttttcaaccccttctgaacagcctgataacgtccatttttcctctgcttcagaaatacattctatgacattccctcaagaaagtgatgttatgtcctggggaactgatccatttgaagatattcttcaatttcatgataatgttcccacccagaatgaccatgtggaatacaatggttctgaagtcttgggtggaaatgccaaaacaacggatttcaaggagtgggttgatcagttgatgtcagtcgatgatgattctattcagcctaattggaatgaacttctcggcgacaataatatggcagaaccaaaatcacagggatgcacaaatgtccccttctctcttgatgcaagagactcaggtttcacagcagcagtatataccatcactaccatctaaagaagttaatgatcttcccaattcttctgtgtcgactacatcgcaatc

SEQ ID NO: 7590 - DNA, 683 bp, Medicago truncatula
  misc_feature (501)..(501): n is a, c, g, or t
  misc_feature (506)..(506): n is a, c, g, or t
  misc_feature (516)..(516): n is a, c, g, or t
  misc_feature (599)..(599): n is a, c, g, or t
  misc_feature (601)..(601): n is a, c, g, or t
  misc_feature (610)..(610): n is a, c, g, or t
  misc_feature (612)..(612): n is a, c, g, or t
  misc_feature (661)..(661): n is a, c, g, or t
  misc_feature (671)..(671): n is a, c, g, or t
  Predicted polypeptide sequence is orthologous to G2571
gcacgagtttctctttctctctcaacttcttcttcttcttctaaccttcactaactcataaagaaggcaccactttttttcagtaaccttcttcctaataccatagtcatggatggaattcaaaacagagatattggatcatgtttatcaaatctcatattatcaagttcaacaaacacacttgactctattttctcagatattccttcaacaaacaccaccacagacagcacaaccttcttgggctgttcaaattttgaacctttaggttcctctgtttaccttcgccagagagatattttacaaaaattctacgaagaaagccgattaaacggctcattcgttccttcttcattttcaaatcaatctctactaaccccttcattatacacaacaaattcaacttcaatttcaagttcgttcacttctttggtgaacccttgtaagaagaagctatacagaggagtgagacagagacactggggaaaatgggtggctganattanacttcctcanaatagaatgagagtttggcttggaacttatgaaactgctgaagctgcagcttatgcttatgatcgtgcagcttataagcttcnangcgaatacncncgtttaaattttccaaatttgaaagatccaactaagttgggttttgganattctactanattgaatgcttt

SEQ ID NO: 7591 - DNA, 771 bp, Medicago truncatula
  Predicted polypeptide sequence is orthologous to G2592, G2713
tcgaaaaaagtttcaccaaaggtccctagtggcagttacaatatcgcccaggtcacctatgagttgaatgtcctcggtactagaggtccacgaaggatgaattgcactatgcattcaatccccgcatcatccctcgaacctggtggtcttgtcccaggccagccagagctcgttccccgcaatcttgaggattctttccgtagtctatcctttgcacgatcaatcgataactcaactgagtttagcagctgtaggttctcagacataatgggagctggcaatgaagacgaggaggaggggaaggagagacctctagttcttaagaacaagtctcctagatggcatgaacagctgcaatgttggtgccttaactttaggggacgcgtgactgttgcgtctgttaagaactttcagctgatcgctgcagcacagcctgcacctgtcgctcctcatgccgcaacaggacctgcaccatcacagccagcacagtcagaccatgacaagattattcttcagttcggtaaagtcggcaaggatatgtttacaatggactatcgataccctctttcggcatttcaggcttttgcgatatgtttgactagctttgacacaaaacttgcatgtgaatagtaacaagagatacatgtggcaagacaattagaatgtaatctccattttaggaattcataggatggtgaagctgaactaagtcattgtatgcctcatagttaaactgtaaagttcaaaaccaaaacaatctcttcccatgtc

SEQ ID NO: 7592 - DNA, 810 bp, Medicago truncatula
  Predicted polypeptide sequence is orthologous to G2592, G2713
agttttctctaaacaacatagaaatgtttcccttctttccttttttccgatcaaaatcaaatcgtgtggtagagaactctctatccggacctcttgttggtgataaaaaagatggtatgcttgtgttgaaaaacaaggctccaaggtggcatgagcagctgcagtgttggtgcttaaactttcatggacgggtgacaattgcctcggttaaaaactttcagctggtggcttccgcagaaaatggaacagctggaccggaacacgataagattattctgcaatttgggaaagttgggaaggatttgtttacaatggatttccgataccctatttcggcgtttcaggcatttgcaatctgcctcagcagctttgataccaagattgcttgtgaataagagcatgtttaaacaggttcaatccagattagatcacaatctgagaaatatgtttgaatgtcacttcgtgggaagaaatctaatgagaagtatttatgaagatgattggatggtgttctactgaatcaataaaaaggtgctgcacatgagttttcagttagtttccggaatcagcattcatagcatgaaattgtaatgttacttgtcttcattcgtgtaaattattccccttgtgctgtacataaattctttctccctcagtttttcttctcttttaacaatttgattttcatttggttgtttatattattatgcaatatagtgtcatgtacttgcaataacataataccggtgttacaacgttgtctttcaaaatcagtaacaaattggttccattttgtgtagagtatgtcac

SEQ ID NO: 7593 - DNA, 809 bp, Medicago truncatula
  Predicted polypeptide sequence is orthologous to G2592, G2713
tcttttgtgacaaattaagttctgaagctgtcagtgtattggaaaaaaaatgtcattccgtagtattgttcgtgatgtgagggatggatttggaagcttatcgaggcggagttttgaggtaaggcttcctggacatcaaaggggaaagtcgcgtagttcggtccatgagttgcatgatcaacctccagttatacagaacagcccatgggctagccttccaccggagcttcttcgtgatgttattaagagattggaagcaactgagagtacttggcctggtcgtaagcatgtggttgcttgtgctgcggtatgcaaatcgtggagagaaatgtgcaaagaaattgtcaacagtcttgaatactgtgggaagattacttttcctgtttctctgaagcagccagggtatagagatggacccatccagtgtttcatcaaaagagataaatctaagctgacataccacctcttcctttgcctcagtcctgccttgcttgttgaaaatggaaagtttcttctctctgcaaaacgtaccagaagaacgacttgcacagagtatgttatatcaatggatgcagataacatatcaagatctagtaacacttacatcggaaagcttaggtctaattttcttggaaccaagttcataatttatgatacacagcctccctataacaatgctcagctggctcctcctggacgcagccgtagattcaactcgaaaaaagtttcaccaaaggtccctagtggcagttacaatatcgcccaggtcacctatgagttgaatgtcctcggtactagaggtccacgaa

SEQ ID NO: 7594 - DNA, 789 bp, Medicago truncatula
  Predicted polypeptide sequence is orthologous to G2592, G2713
gatgagggaggtgtaagaaactgagtatgttagcattttctgacctaaagcttttatctttctgctttgtttcaagtttgtatctttcatctcagcttcatacaatacaatacaaggtttctttagatctatttattctggataaagggtgctttgtgatctagcttaggagttttggtcaacttacattaactagcaagttttaggagcatatgcttgtactggttggttatagtccatcagaagttcacaaaagagatacttattcttggggtcctactacggaatgtctttccgtagcatagttcgtgacgttcgtgatagttttgggagcttatctaggcgtagctttgatgtcaaacttactggccatcatcatagaggaaagtctcatggttctgtacaggatttgcatgatcagcctcttgtaattcaaaatagctgctgggcgaacttacccccggaattactatttgatgttattcggcgactagaggagagtgagaatacatggccttcaagaaagcatgtagttgcatgtgcttctgtttgccagtcttggaggaatatgtgcaaggacatcgttaggagcccagagttctgcggcaaactaacgttccccgtgtccctgaagcagccagggccacgagatggaatcattcaatgctttatcaaaagagataaatctaacttaacataccacctattcctttgtctgagccctgctttgttagttgaaaatggaaaattcctcctctctgctaagaggaccagaagaacacctacact

SEQ ID NO: 7595 - DNA, 757 bp, Medicago truncatula
  Predicted polypeptide sequence is orthologous to G2592, G2713
ggtgtggccccgacacagactcaatttcttcatagcagagctgatacttctccatctatcccgttcttcagatcaaaatcaacccgctcagagaatctccaatcagcagcacctttgataagtcaaaatgatggggagctggtgttaaaaaacaaggctcctaggtggcatgaacaactccaatgctggtgtttgaacttcaatggacgtgtgacagtcgcttcagttaaaaatttccagctggttgcttctcctaaaaatggagtttctgaggaggcccaggaaaatgtcattctgcagtttggaaaagtcggaaaggatgtgttcaccatggattaccagtatccaatctctgcctttgaagcatttgcaatatgccttagcagctttgacaccaagattgcttgcgagtgattgctggaacaggttttagccgattggaatcggccctcacagtattgcaggtctgatataggcaacatgtctgctttctgtttagtccaacccggcttcatagtctctcccccttcccccttctcccttttattttgtatataagtgacttgtgtgcattatatttaacaaacatggaacatatgttgtattttgtgttttagtttgcgaaccaacttatgtttttttggccatgagattgtagacaacgaccttagatgcaattggtctgtgaacttgccagttgtgtctgtttgatggcttttgggtttcagaatgtatgtacttgcctggcttttgtgct

SEQ ID NO: 7596 - DNA, 672 bp, Medicago truncatula
  Predicted polypeptide sequence is orthologous to G2604
atttcaaggaggaagcttttcctttgactctcactttatctggtttttgatttgatattctaccaatcttttgcttcaaaggagttgaaaaaatggatggaagtgctttgttctgtttgtagaatttggcacagaaaaataatacttttgacttagttcttttataatgccagttccacttgctccttatccaactccacctccagctcctgctccagctccagctccatatacaacacctccaacaaatggtgcacagagtcaacttgtgtgttctggctgtagaaaccttcttatgtatccagttggagcaacttctgtatgctgtgctgtttgcaatgctgtcacagcagtgccacctcctggcacagaaatggctcagttagtttgtggaggatgccatactttactcatgtacatccgcggagcaacaagtgttcaatgctcttgttgtcacacagtcaatctagctctggaagcaaatcaggtggcacatgtaaactgtggtaactgcaggatgctacttatgtatcaatatggagcaagatccgtgaaatgtgcagtttgcaattttgttacctcagttggggcctcagcaagcacgacagagccgcagaagttcagcacctaataaatcatatactattatagcaaggtcattacagactctac

SEQ ID NO: 7597 - DNA, 396 bp, Medicago truncatula
  Predicted polypeptide sequence is orthologous to G2604
taactgcaggatgctacttatgtatcaatatggagcaagatccgtgaaatgtgcagtttgcaattttgttacctcagttggggcctcagcaagcacgacagagccgcagaagttcagcacctaataaatcatatactattatagcaaggtcattacagactctacaaccttggtttttgctatttacatatcaatcttaaggaataataaagagtgcaaatcagattgaaaactttcttcacatgtatagagttatttttcccttgcgtgacggtgattgtattaagcgtttttgtttgaattggtgtatgaataagtcgataactatttgttataagattcttgattctgagtgctatgcaaaaaccacatcttttgataaaaaaaaaaaaaaaa

SEQ ID NO: 7598 - DNA, 664 bp, Medicago truncatula
  misc_feature (585)..(585): n is a, c, g, or t
  misc_feature (638)..(638): n is a, c, g, or t
  Predicted polypeptide sequence is orthologous to G2633
ggttgttgtgtagtttctataacaatataagggctatttctcattcattattctatatgctactgtcagattttttttctcatcataatagctttctcttcctatactatgctctcttagattctactccactattctttccttcctcaaaaacataatacagataatgtgagacgcggtacgacgcttcattattgattctacaatgcaggcatcagagcagcatagaagttcaagtatgtactatcaaccattgcagcaaatcgaagcctattgcttgccacaatatcgaaatctaaatcatcagctatacaacaatgatggaggccaagcaactcaattctcggctccaacttcttctgacctttattactgcactttggagtcgtcctctgcagctggaagtttcgccgtttacaactctccttcaactgttagtttctcgcctaacgatagtccaatgtcgcagcaagaatctcagtcttatccatctgataagtatcattcccctgacaatacctatggctcgccaatgagtggatcatgcataaccgaagatttaagtagcttcaaacacaagcttanagagttggaaagtgtaatgcttggtcctgactctgataatcttgatagttacnacagtgctatcagcaacggaaccaat

SEQ ID NO: 7599 - DNA, 604 bp, Medicago truncatula
  Predicted polypeptide sequence is orthologous to G2649
accgattaagaccataaaatgtccctctttagttaaaaacttaagttaaacattcgatataaaatctttgcaacattaatgtccctaatctagtgcaagaaatttaacaaagggaccattaaactttaggtctgcatgtaagcaatttggaactaggaggattaatttacagaattaaagtggaatatggttagttttctcaacaaaacggcatcataaaacgtccattctttgctggttcatgaaattggatccatcacctgataatcaatcttcatggctagctagcagaagcagggtaagcattattgttgggaacaccaattgcagaagaacattcaccattttttccactacaattatttcccaattgaagttctgaaacacaaggcattggatttttcccatcaacaccatgatcatagagaaaccctttgaaaacatggccactaatatgaactgtggccaagtaagcaaattcatcttcaccattgccaatagcagttactctatggcacctgaatacagctggtgcattaacatgacctggtaaaccctctttgaaacctgcatcttggtgacaggagctagtagcaaaactctt

SEQ ID NO: 7600 - DNA, 718 bp, Medicago truncatula
  Predicted polypeptide sequence is orthologous to G2655
tgattcgccagctcgaaattaaccctcctaaagggaacaaaagctggagctccaccgcggtggcggccgctctagaactagtggatcccccgggctgcaggaattcggcacgaggaacaacaacaacaacaacgtcacaatggaacaacacaattaccaagaacagaaacaatgggctgttgcagacattgaagttacaatggtagatagtcatgccaacatgaaaattctatccaagaaaaaaccaggacaacttatgaagattgttgttgggttacaaaatcttaggcttaccattcttcatcttaatgttaccacggtcgatgatatggttctttactcagttagtatcaaggtagaggaggggagtcagctgaatagtgtggatgaaattgcggctgctgtgaatcgactattaaggacggtccaacaagaactggcttatcaactaaattgaatgaatttaatttccttgcttaatttattttaaaatttgtctatcaaaccttctccatcgtttggatatataaatgtgactgtgtttattgggaatattagagggggtaaggtagcatgtgtagcactttaattatttgtcataattttttcttctgatagcagcagcatttgtggcaaacaacttcaatgcctagttgaaatgtgttaattaggctgttatgtacaaccaacagttatcttacaagtctatgtgaattac

SEQ ID NO: 7601 - DNA, 687 bp, Medicago truncatula
  Predicted polypeptide sequence is orthologous to G2655
gttaaaaagggtcacctttgttttctctttcgggtatctaatacttttgtttgggacttttatgttcataatttctttctaaaagtttttctccttcaactttttaccctctcttcaataattttagattagtcacaaattaataataataatggctcttgaaactgtggttttcccacaacaagatccattcacatatagttacaaagacaattacttcaactctttgaataatgactatgatcatcttcatgcggaagaacaagagaatgttctcctaggaatcatcaacaatgaacaacaaaatctccatgcaaactgggatcatcaatgggaatattcacactcttcctctcctgaaatctgcaccgttgatcaaactatcacagcacctccttcttccaccatggaggaagctacagtaacagcatcgtgtaggagaaagcgtccgtcgtatcaagagtgcaaagaacaaagaggagattgaaaatcaaaggatgactcatattactgttgaacgcaatcgaagaaaacaaatgaatgagtacttgaatgtgcttcgatctttgatgccttcttcttatgttcaaaggggtgaccaagcttctattattggaggagcaataaactttgtgaaggagttagagcaacatttacagtctatggggggccaaaagaaaacgaaag

SEQ ID NO: 7602 - DNA, 742 bp, Medicago truncatula
  Predicted polypeptide sequence is orthologous to G2655
aaaccaaaaaattccttcaatgagcccataatttatagagtaatagaagataaataaacattacaatagctaggcacatatcttgagagagagagagatagatttaatttataaggttaaaaaactaatgaatcttaattcaacattgcctcttgttgaatcctagtgaccgtctggtatacagctgaagctatatcatccaccgatcccaacttgcaatcatcttcaaccttaacactgagagagtaaagaacaatttcaccaatagtagtaacatttaaatgcaagattgtgagacgcatgttttgcaaaccagatacaattttcaagagctgctttggcctctttcttgatcttattttaagatttgcatggttttccaccattgtcacttctatgtcagcaatgcaagattgaatctcaccaactttttcaccaatagtagctacagaattagaattatcacacacactaccacttgttgaatactgtggaaatgtaaagaactcagaaaatggcatgttgtttgatccaccagcttcatcagatttcaccactctttctttcttagcaccaagaaaatgaaacttgtgctcaagctctttaacaaagttaatagctcctccaattatagaagcttgatcacccctttggatgtgagaatctggcattagagagcgaagaatagaaagatactcattcatctgctttcttctattacgctcaacagccatgtgagtca

SEQ ID NO: 7603 - DNA, 842 bp, Medicago truncatula
  Predicted polypeptide sequence is orthologous to G2717
tccctttccacgaaaaaacaaaagacgaaacaagacatactcatcatctctttctcgtgtatctctttattcgcagaatttctcgtattaattcaatttacccgcacgtaaattctcccaattcgcacctataccctttcattctccgatccattcaatttcttctttaattttcccagacaaataatctgagctgtggttgctggagattcctgaattgatctcttttcaaacattggatgcataaaaatgtgcaattgaagttaatttggctattgaggtcaatgtttggtcaataaagtcagacattttgtggatagacatgcacaagaagactgcattccgaggttttctctagtactagaataaaagcaaaaacaatactgtcataagaaggccgtggacttcttccaatgggtgctcctaagcagaaatggactgcagaagaagaggcagctctgaaagctggagtagtcaaatacggggctggaaaatggcgtacaattcttacagacccagatttcagcaccattttgcgcatgcgttcaaatgtagatctcaaggacaaatggaggaacataaatgtgactgcaatatggggatccaggcagaaggcaaaacttgcacttaaaaagagcctaccacccccgaaaaatgaaaataaccaccacccgacctcgaccgccatagttcaatataatccagaagttgcagctcctaagcctctttcagtttctggtggaatgtctacttcaaaagaacaatatcaaggttatagcacttcatgcgaaatattttttacactttatagaactaaatggggtctgtgattctggggttgg

SEQ ID NO: 7604 - DNA, 775 bp, Medicago truncatula
  Predicted polypeptide sequence is orthologous to G2717
cacacagtagtattgttacaatacccttatcgtatgtctttcaataaaaataatgttacaaaaataatgaataaaaactattcctgactcatgacaaaaatgcttcatggatcaatccggcacgttcaaaatttacaagcctaaattatgcacagtaattaaatacatgcaggcagccaacatcagcattatgatcgaaagccaacataatgctttgatcatgtcaaccatgaagaagcaaacaccgtcaaaacctttgattatcgaaaatgtggtattttcacaagagaccacgtttcggctggcagataatgtagcaacggaggatgtggtctcttgtaaataaatgccgcacgttattcaagacatgttggcaggtcaaatattaagtcttctgcattttagtgccttcgttgctgcttttgcaaacacacgtgcagcctctgcttcagcttcagctgtctcggcctcccttgccgctgtctcagcctcagcaatggcagcttctgcctccgcaactgcttttgcagctgctgctgctacctcttgagctgtcacacccctcatttttaaaagctcaacatcaatttgagattttgaaaggacgttggcatcagttttctctgcttttggagatcttttggcctcccttttcagagtaacaaggaagagcatcttcttttctcggatgtttttgttgatttggttgcatcctgtacttatgatttacctcactaatttggcgcttgcaccatatgcttcagttttgtgacag

SEQ ID NO: 7605 - DNA, 829 bp, Medicago truncatula
  Predicted polypeptide sequence is orthologous to G2743
aactaatttatcatttcataaatttaagtatcaaattattcaaccagtacaatttcaatgttaaaatggtaatttaatcgattagaaaccgaacaatttatccctatagctcaattgacattgacatgcattattatatacaagaacaggggttcgaaccccggacaccccacttattcatcttgaaaagggtgaattctagcactaggctacttgataaaaaaaaaaccgaacaatttttttaaccaaagaaaatagaaaccgcacaaattgaccaccaatgtgataaagttgaacatgttgcctaggaagggcgatttatttacttaacatacaaaaatgtcactttcctttcactgtattttcacttgtataatttaagtcccaaacaaaacaactctactaaaacatagctacaaaaatgaattatttttcagcatcttgaagttgtaggtgtatgagtggaacatgatgaggcaggggagttagaatgagcaacaactctttctacagaatgtgaattctcactcaactcaaatttcttagactttggttttataactgtggttgtagatgaaggatgtgtagccacaggtgcataaattcctgttggagtagtaactgtggttaattctcctgacactgttgttttggtggctactgcagcatattcttgtggttggacataaatgttccctaccaagaacataggagctgtatgtgaattagaattgttgtgaattattgggcttcttcttgtgtgcagacgaaatttcctgtaatgacttttgacttcatcgttggtgaggccatcgactttcattagttc

SEQ ID NO: 7606 - DNA, 895 bp, Medicago truncatula
  Predicted polypeptide sequence is orthologous to G2783
cacggcatggctcctcccaccatgggccaacagccaccgcaacaataccaacagccaccaccacagcagccgtacgtcatgatgcaaccacaacaaccgccggctatgtgggcggcccaatccgctcagccacctcagcagcccgccagcgctgatgaggtccgtactctctggatcggtgatttgcagtactggatggatgagaattatctctatacctgctttggtaacacaggcgagttgacatctgtgaaagtgattaggaataagcaaactagtcaatcagaaggttatggttttattgagtttaatactcgtgccactgctgagagagtgcttcagacatacaacggaactattatgccgaatggtggtcagaactacagattgaactgggcaactttcagtgctggggaaaggtcgtcgagacaggacgatggtcctgaccataccatttttgttggtgatttggctgcggatgttactgattaccttcttcaggagacttttagggctcgttataactctgtgaagggggcaaaagttgtgattgataggcttaccggtaggtctaagggttatggttttgtgagatttgctgatgagggtgaacagatgagggctatgactgagatgcaaggggttctttgttcaacaagacccatgaggattggtccagccactaataaaaaccctgctgccaccactcagccgaaagcttcgtataaccctagtggcggacaaagcgagaatggtcccaataacacaactatttttgttggcaacttggatccaaatgtcaccgacgatcatctgaggcaagttttcacccaatatggtgaactagtacatgtgaagattccatcaggcaagcgatgtgggtttgtccaatttt

SEQ ID NO: 7607 - DNA, 819 bp, Medicago truncatula
  Predicted polypeptide sequence is orthologous to G2789
caatttcacaccaaccaccaaaccaatgaagaggaacaacaaagtggcaatgggagcttaagccgaggccaaaaaagagaacgaaacaacgaagacggcaacaacactcccaccggaggagaaggaaaagacgacggtggtagcggaagtgctggtggaggaagtggtggtgagatgggaagaagaccaagaggaagaccagcaggttcgaaaaacaaaccaaaaccacctatcatcatcacgagggacagcgcgaacgcactccgatcccacgtgatggaagttgcaaatggatgtgacatcatggaaagtgtgacggtctttgcgcgaaggaggcagcgtggtgtctgcatccttagcggaagtgggaccgtcacaaacgtgactctccgtcaaccagcatcgcctggtgcggtagtcacacttcatggaagatttgagatattatcattatctggctctttcctgccgccgcctgctccaccagcggcgtcaggattagccatatatctagctggtggacaaggacaggtcgtcggtggtagcgtggtgggaccgttgttagcttccggtccggttgttatcatggcagcttcctttggaaatgctgcttatgaaaggctacctttagaagatgaagaaacaccagtgaatgtgccaggaaatggagggttagggtcaccgggaaccatgggaagtcaacaacaacagcagcagaaccagcaacagcaacaacttgtagcagatcctaatgcttcatcactttttcatggagttccctcaaatcttctcaattcatgccaattaccagctgaaggt

SEQ ID NO: 7608 - DNA, 600 bp, Medicago truncatula
  Predicted polypeptide sequence is orthologous to G2791
gaggtagctcctcttgtggctgatatgtcctccgagggtgtcagtgactgcgtccaaacaaacggcaacggaggggtccacccacgaaaccctaaaacggcgtcgtcctccaacgaaagcctcaccatgacggagcatcaagtggccaagctaatggaagaagacatgggatctgccatgcaatacttacaaggcaaaggtctttgcctcatgcctatttctcttgctactgcaatctctactgccacgtgtcacaccaggaaccctttgatcaatgctgctaataataacatcaacggtagttccaaccctatcaccgcatctaacggtgatgggccatcttctcccggaatgtccgttaacagcatcgtcaaagatgctaactccgcttctaagtcgtagacgccgtctgtttcgttgactttttcactcaacagagacataaacaaaagagtagcatctaagatgaaaacacaaaatgaggtggagtttctcaagtctaggaaaataatgcgtgggacttttacgacgtcgtatttacctagactttggcagatgctaactttcgtattaatttcagccttaccatctttctattat

SEQ ID NO: 7609 - DNA, 727 bp, Medicago truncatula
  Predicted polypeptide sequence is orthologous to G2802
gtgaaaatggattgattcggtgtccgaattgttgtatttcttgaggatttgtttcgatgtatgtgtgtattagtatagtagttggtgttttgtgcaattgcagcttgtttattgatgcgtgcttgcaaggttttaggtgttgtcgataaataatttgatcaagattgatgaatttgtgtcgttgttgttgttggcagtggcggtgttgatgatgataagtctttggttaaggttatcaagggttttaaataaaggtctgcgatctagacagccgacatgaccgagactgcaattgagaccatgtcagctgtcacatgtcacagtttgttgtaatatcgagcaaggattgcaatgcagctgcaatgtgaccatgactgcaattgagaccacatcagctgccatgattatttgtaatatcaagcaaggatcgtgatgtgactgcagttcaaaaccttggttatatcaagattcaaagctctctttgaattttatatggttggtgtttacttatttatttgatatataggatttgtgtgatgagctgaagctgacggtgttttcagctccttgaacatgatttttgttgttcaagagtgtgcttataggaataaatgggtttgagtgtgtatgtctgttgtagttcattcctgatgaaggctgaggactgtttctcatcaagggaatgtaaatatttagtggtattatgatatgatcccttgtagggatt

SEQ ID NO: 7610 - DNA, 797 bp, Medicago truncatula
  misc_feature (732)..(732): n is a, c, g, or t
  misc_feature (743)..(743): n is a, c, g, or t
  misc_feature (797)..(797): n is a, c, g, or t
  Predicted polypeptide sequence is orthologous to G2834
tgattacgccagctcgaaattaaccctcactaaagggaacaaaagctggagctccaccgcggtggcggccgctctagaactagtggatcccccgggctgcaggaattcggcacgaggccctccccttctcctcctatgttttctttctcatctcataattttttattttcatttttttattttcctttctttttctcttagtatgattgattattcagattgttagaccttcctttcagctttcaactttgtcactgtacctttgattgataggatattgattccttggatacaagtttcaaatgaatccaactggaagcttgtgtgctaacaactgggcaaggtcctcttcttccttggcccctactcggaatggattacaaacgaatttgtcctcagatccttcccctttttatagggtgggaattgaaacacctttcaaagaaatcaaccaaccatctcgaactccgtctgtgattccgggtgaatctaacattgatattaagatcactgatcaggaaacaagtaaacttcaagattgggattctagtgttatgttgaataagctttcgtttttggaagaaaaggttcatcagctccaggatctagtgcatttgattgatactaagaagtgtcaaccttttgaacaaccttgtgaacttgtgactcaagaacaacaactcatcacagctgatttaacatcaattattgttcagttgatctctactgcanggagtcttctnccttctgctaggaacaccgttacaaacacaagtccattggcttggacagcttan

SEQ ID NO: 7611 - DNA, 514 bp, Medicago truncatula
  Predicted polypeptide sequence is orthologous to G2834
gtattcgtgtaatctttgtcgtaagaagaattattcaatgctttcggatttgaagagtcatatgaggcaatgtggtgagtctaagtggaagtgttcttgtgggagtactttttctaggaaggataagttgtttggacatgttgctttgtttgagggtcatatgcctgctgttgtgttggaagatgaggtgaaagggaagcaagttgtggctgaggagaatgaagatcctatggaaatggcattgagtaaagatgatgaaattggtatggatgaagagttctttcatgattttgggtctattgataactattgtttggatgaagttttgggatttcgtcgtagctagcctgcctagtttcatgtttaatgatttcttgttggttttattagcattttaacattagattcagacattgaacatgcatatttattctgtgtttttgtatagtttactgtataatgttacaaatatgctattgctttttaattaattcttaaaaaaaaaaaaaaaaaa

SEQ ID NO: 7612 - DNA, 653 bp, Medicago truncatula
  misc_feature (643)..(643): n is a, c, g, or t
  Predicted polypeptide sequence is orthologous to G2834
gttgaatgtcttaccctaacccaactataaacatgtctaatccgaacctagattcccatcacactacccagatacttcaaccacaacaaaatccaagtaacacccccgaccctcaggttccgcttcggaatctatccttggttcagacgagcatcgattctctccgaaccctcctgtcccaatccatcaccaccaacgctcctgtcaccaacgatcaattaaccgccgtctccaaccaaatcttcaccgtcctccaccataccatagtcaacgccgccgccctcgttcctggcgtctccgtcttcccctccgccaccttcgattctttcaacaacaaccccctcgccgccgtggaagattccgattgcgaaattgtggagctcgacgccatggaattgctagctgaacatctccacttttgcgagatatgcggcaaaggcttcaagcgcgacgcgaatctccggatgcacatgagagctcacgggaatcaattcaagacgccggaagctttagcgaagcctttaaacatggtccgtcgtccaacgcaattctcgtgtccgtttgaaggatgtaacagaaacaaaaagcataagaaattcaaagcattgaaatcggtgatttgtgtgaagacccatttcaagangagtcattgt

SEQ ID NO: 7613 - DNA, 823 bp, Medicago truncatula
  Predicted polypeptide sequence is orthologous to G2834
cctccaatctgcattcaatggtatgtgggtgcacataaccatcgtttgtataaataataatgaaagcttcaatagagaattaacattaatatttttctatgttaagaaatggcgaatacacaaaatacttggtttggctttacaaaactaacagaaacaaaaagtttattcattaacaatgtactaaagaaaacatagatagtttgtagattaaccccaacataaactgttacagattgtcagaacatgattcaccaccagctttaggagcatagttaaacgaacccgacatgagaaaagagaaagagccttctgaatcttcaaatggaggttggggaaattcattaaacccaccaaagttacagccttcaaagttcaaagatgagaaataattgataggatcatcaatattacctttcacatccataatgccatcaactccattttcacttgaaggatttgatccaaaacagaagttcgtgcttcctaccatagcactgttttctctggtatcacatcgatcaggtggctcggcagatactttgttgtcttccaaaggaatagccggtgtatggccttggaaaagagcaatgtgtccgaaaagcttgtctttccttgaaaatgttgtgccacatgaacagagccatttatccttgccacaatgtttctcatgagttttcagatctgccatgactggaaacttcttcgtgtggcatctgctgcaagtgtaactcttatcacagtgtgttcttttgtagtggtttttgacacataaaatagtcttcagaagctgaaatttcttgtgatccttgttacgcttgca

SEQ ID NO: 7614 - DNA, 315 bp, Medicago truncatula
  Predicted polypeptide sequence is orthologous to G2847
gcacaatcacacattggtggtggattcattggagggaataatatgatgaacaattttaataatgtgaattataattctggtttgatgatgaagggttgtcaaccttttcaaatggtgggttccacttccaaacaattgcttagctagttaaggaaattaatctatgtaagacatggaattaagttgcttaattaattgtttcttatgtagtgttaattggtgcatggttttgtggatcatgttattgtaaacacaattaatgtttcttcatgtgtttgtcaatgtaatttctgatattgaatgatcacttctttt

SEQ ID NO: 7615 - DNA, 654 bp, Medicago truncatula
  Predicted polypeptide sequence is orthologous to G2851
ctaatttcttctcaactactactcctaattctaattttcaaactccatatcctcatgcatcttctcttcctcttccttcttggcatgaaaatcaagatcaacttcctgagtcatggagtcacctcctcatgaatggtgtggtgtatgaagaagagaaggctagtatgctaagtcagcctccttcaaatgcttctcttgttgatcatgttaaacaagaaagttcagtgaacaactatgtctatggaaatgaagaatttcatggaacaccaaattctacttggtctcaaatagtgtcggtgccttcttcttcctcctccaaatcctgtgcaacaagtttcaccagtactagcatgttggatttctctaacactaaaacggatataagatctccaccatcagatctatcttctgatcagtgtaatagctcttcagctggtggggcattgaagaaagctagggttcaatcatctacattcaaggttaggaaggagaagttaggtgacagaattactgcccttcatcagctcgtttccccatttggaaagactgacacagcctctgtcttattagaatctattggttatatcagattccttcagagtcaaattgaggcacttagcttaccatacttgggaaatggatcaggaaacatga

SEQ ID NO: 7616 - DNA, 695 bp, Medicago truncatula
  misc_feature (679)..(679): n is a, c, g, or t
  Predicted polypeptide sequence is orthologous to G2851
gcaccagcctaactggtggagcatgcatccatcatctttgaatatccctcctcaatatatgcttggatcttcttcaatccctttcaattccttgacagaaaataatgctgaagtacctcctcaatcatggagtcaactactttttactggactacctggagaagaagagagacttggttttaatcattttcaacctaaaaactcagaaaactgggatgtgcaaattatgaatccatcttcaagagttccttttatggatataataaagcatgaagtttctcaaggtgagaatttttatggccaacaagggcatcatcatgaggagtttcatgctaactctggatcacttggttcatcttggtcacatatggtgccagtttcttctccaagctctcatatcactagcttaagtagtgataatatattggatttcacttacaacaaggtagatcatagcaagaatcaactaccagatcaaatatctgagtgtaatagctcaaccactggagttaataagaaggctagggttcagccatcttcaagccaaccacctttaaaggtgaggaaggagaagctaggtgatagaataacagcacttcaccagctagtttctccatttggaaagactgacacagcttctgtattattagaagccattggatacatcagggttctacanagtcaaattgaggcac

SEQ ID NO: 7617 - DNA, 743 bp, Medicago truncatula
  Predicted polypeptide sequence is orthologous to G2854
tggaccagcctctaacaaaaaccttggcacacagacttcaaaagcttcttatcagaatccacaaggaggggcacagaacgagaatgatccaaataatacaaccatttttgttggcaatttggatcctaatgtcacagatgaacatttgaaacaagtttttacccagtatggtgaactggttcatgttaagattccatcaggcaagagatgtgggtttgtccaatttgcagacaggagttctgctgaggaggcactacgggttttaaatggtacacttctaggtggtcaaaatgtccggctttcatggggccgaagcccggcaaacaagcagactcaacaagatccaaaccagtggaatggtagtagcagttacttcggcggttatgcccaaggttatgaaaattatgcttatgcccctcctgctggacaagacccaaatatgtatggcagttatccggcggggtatgcaagttaccaacctcctcagcagcaacagcaattaggatatagttaaaaagttcagccccacattttctattctgtacttctgagacttaattttggttgcctttctttttgtgtcttgtgaaactttattttgaggggaacttgaaacccattttgctccgttgtttatttaacttgtctcctgtgttcgctaaaaacatttatattctatgcggaccttatgtatccttaaaatatttgcttgctatctatattttatgaattgccgcattttc

SEQ ID NO: 7618 - DNA, 693 bp, Medicago truncatula
  Predicted polypeptide sequence is orthologous to G2907
gagaaaacaacaaaaggaatacgatggtgacaaatttggaatatctgatgaacgtgcctctttcactaataacagtgaatgcaaagtcacacaagtctggactacgcattgagcctgttcatgttgctgcaacacgtattcagaacaagtttcgcagttggaagggcagaaaagattttttgattattcgacagcgaattgtaaaaattcaggctcacgtgagaggtcaccaggttaggaaaaactataggaagataatttggtcagttgggattgtggaaaagattatattacgttggcgtcgaaaaggtagtggtttgcgtggattcaaatcagaggccatttctgagggaactatggtacaaggtgtatcatctgccactgaggatgactatgattttctgaaagaaggcaggaagcaaactgagaaaaggttggagaaagcccttgctagagtgaagtcaatggctcaatatccagatgcaagagaccaataccacaggctgttgaatgttgtaactgagatacaagaaaatcaggtaaagcaagatcgaaattttatcaattcagaagaatcaagacaattcaatagccctcggttgatcttgaagcattgttggatgaagatacctttcatgcctacagccacttaaaaaaatccgcatccatccataatatgtccggttattcatg

SEQ ID NO: 7619 - DNA, 718 bp, Medicago truncatula
  Predicted polypeptide sequence is orthologous to G2969
ggtccaatatcgtgcaaatcatcttcaaatcgggttggccagaaacaaacaccttcccaaacatacaccgaatcatgaagatccataacagccagaaaatcctctcgaaattcgaagaatatcgcgaaacggtgaagattaaagcagcgcgtggtgtcacgcgccgccgtgacgaacgctgtattgctgacgggaatgaactcatgcgttttcattgctcaacttttttatgtgagttgggacataacggggattcttcgatttgttctcagcaattttgtaatatctgtggaattattaaatcagggttttccccaaaattagatggaatttccacgctgtcgactagctggagggcacacgtgtcaattcctgatgacatcgagcgggagtttaagttcatgaacgtcaaacgggcaatgctcgtttgtcgtgttattgcgggtcgggttgggtcagatttggacgatgaggtggataaaaccgatggaggttttgattcggtgatggcgcggggcgagagtggtgtttacacaagacttgatgaggaggagttggttgtttttaatcctagggctgttcttccttgctttgtgattgtgtatagtgtgtaatttgtgatgaacaatgattatgagcttgatctaatggtcatgtgatgatgagttgtaatcttaatttagtcaagtattttgtagttaaggaatccctttttgac

SEQ ID NO: 7620 - DNA, 821 bp, Medicago truncatula
  Predicted polypeptide sequence is orthologous to G2983
aaacataaacattatgaaggtgcatcaattacacgtggattttgggagcatgaaccttccctcacacttggttgcaagcgtttacgtcctcttgcacctaaaatttcttctaataacaccgataattctactactaacaccccttctctttcttttgatctcaagagtttcattagacccgaaactgctcccagaattagtctttcttcctctgatgataacaagaaagatccaccttcaccacaaagccaggttgaaacgcatattccaggagggacaagatggaatccaacacaagaacaaataggaatattggagatgttatacagaggtggaatgagaactccaaatgcacaacaaatagaacagattacagttcaacttagcaagtacggtaaaattgaagggaaaaatgtgttctattggttccaaaaccacaaagcacgcgagagacaaaagcagaaacgtaacagtcttggccttcctcatagtcctcgaactcccaccaccacacttgtgtctatgtcccccacctttagtactattacaactttggacaccccaaaaagggtgcaagtaatggaaagagatcaagaagatagcccattgaagaagagtaggagttggccatttgagtatttggaagagaaaaattggtcaatgtgcaaagtagaggaacataaaactctagagcttttcccattacacccagaaggcagatgaagggagtttgatctataacaatttttagctttttctttcccaaatgtgctttaatttgctttagtaatttcttctttcatttacattgggaaagaaga

SEQ ID NO: 7621 - DNA, 904 bp, Medicago truncatula
  Predicted polypeptide sequence is orthologous to G2989, G2990
ctgattcgccagctcgaaattaaccctcactaaagggaacaaaagctggagctccaccgcggtggcggccgctctataactagtggatcccccgggctgcaggaattcggcacgaggggaggtggaggtggtgaccgtggttatggtggtggaggtggcaggtgatcgctactctcgtggtggtggtgctgatagcgagtggaaactggagggattagaaaattaggtcttcagtttggtggtttatgattatgaatgttgtcatgttgaattagtttgatttagttggttgaatttagtgttttggctatgatatttgttctgttatggtttagttttgctttgtcgtgtttttggtgctgaatctggttttgtataaacgattgattgaaaaggataatgaaaaattggattcaacaaaataaaaaataaagatggaaaagagtacaaggggaggaaatctggagggggggcccggtacccatttgtccctatagggagtgtcgggttgtacaatgagcactgagcccgtggtgtgttgtacaatcgttggtgaactgtggaaaacccttgagtcgcgttgacccagaatttgagtactggggccttgtgtcatcaccctttaccccatttttatccagttataagacgatcgaatatgcgcgaaaaagctcccaaacccaagatgcacagcctctcctcatatagtagtgttgcaatcatctgccctctttagtgatatatactattattatatatgatactgttattatttgtccatatatacacatatcgtatactaacagtttttattgtatgctgtagatattacttttattttttcggttcgtcattgctttagtgcgtcatattgcgattgattatatcagttattatatattaa

SEQ ID NO: 7622 - DNA, 594 bp, Medicago truncatula
  Predicted polypeptide sequence is orthologous to G2996
cctttgaacaaaaaaaaagcacatagagaaaaagagtgaaagtgagagtgaatgttcctttgttttctttcttctttcagctcaaattattattcactacatcaaagcaaccattgataacctaacttcaaattttgctacaaaaatggattttgatgaagatcaagaagaggaacaagatgaagagttatgtatgggtggaggaaattacgactctttacctaactcatcaagagttgttaagatgcctggtggaactgaacctatcatggtgactcatccactcagaaacatcctcaacaacaacaacaacaacaacaacaacaacaatggaaacagcaacatagggtggtgttgttggaaatggtaaagcaaggtatagagagtgtctgaagaatcatgctgtaggtattgggggtcatgctcttgatggttgcggtgagtttatgccggcaggaagtgaaggaactttggagtcactaaaatgtgctgcttgtaactgccaccgtaacttccaccgaaaagagtcatcggcagatgttactgccggtgacccttttctgttgacacaccatcatcaccatccaccacctc

SEQ ID NO: 7623 - DNA, 718 bp, Medicago truncatula
  Predicted polypeptide sequence is orthologous to G2996
gataatgttatgtttgataattgttcttattgagattcaccttttttttcataaaattccatgttgatatggttggagcaattcccttgtcttcattgtattctccgactttatcattgtgaatcccttcaataaactcttcccactttcttaggccttcctttctaatcacttgatgggttactactattgtaaacccagggctaatgatactcatacttccaatgttgttctgttcttggctgtggcattgattcttctggttataccaaagctcttctcaagtgaaccagaggaagaagttgaagtagagagtggttcctcaccttttgtactaccaatactcgtattattgatggtgcttttggtatcatggttgggaagctcaagtaaaagggtttgtgccaagccacgatactgttactgcacgcatgcctgctactgttatcggtaggtagtgtgtccaagagcttggtggtggtggttggggtgtttgatgatgaacggtattgtgtttgtttgtcacccatcatcatctcaggctagtaaataagatattgcataggaatattggatgagcttcttgcattgcttcatatgataattaaaaagaatgttcaatgtttgtaatgaatcaacaaatagcatttgtaagtctgtaatgaacatgggatgagctttttggatttcacataaaaagtttcttatttatcagtgt

SEQ ID NO: 7624 - DNA, 671 bp, Medicago truncatula
  Predicted polypeptide sequence is orthologous to G3060
ccgccttcaaaacccctcttttcttttcttttcttttcttcctccgctagggttagggttttactcaatttcaagattcgatctcgatccatggatatgcgcaagagaggaagacccgaacatggattcaacaacaatgggggattcaagaaatccagacatgaaatggagtccttatcaactggtgtaggaagcaaatcgaagccatgtaccaagtttttcagcacttctggctgcccatttggtgagagctgccacttcttgcaccatgttcctggcggttataatgctgtttcccagatgatgaatctaacacctgcagcacctcctgcacccagaaatgttccagccccacgaaatgcacatgcacccaatgggtctgcaccatctgctgttaaaagccgcatatgcagcaagtttaatactgctgaaggctgcaaatttggtgacaaatgccatttcgcacacggagaatgggaacttggtaagcctgttgctccatcatttgatgatcaccgtcacaatgaccaccgtcacatgggaccccccaatgctggccgttttggcggtcatcggatggagcctcctcctgttccagctagctttggtgccaatgccactgccaagatcagtgttgaagcctccctggctggagctatcattggtaaggg

SEQ ID NO: 7625 - DNA, 528 bp, Medicago truncatula
  Predicted polypeptide sequence is orthologous to G3067
tgcatgctctcttggcataaatggttcttatagtttatgcactttagactattgtggtgtatgtcaaattttgaggcatggtttttctactaacaaggaatttcaaggtgcattaggagtttacacaagttccacaagtggaaaagcctttgattcaattatgctatctgatgagagagcatttacaagaaaggcagttataatgtgtagagtaatagctgggagagttcattgtccttttgaagaaattcaagaaaaaattgattcaggatttgattcatttgctgaaaagataagtgatcattcaaatattgaggaactatgtttgttgaatcctaaagctctgctcccttgctttgtggtaatctacaaacaaaaatagatggaaattaaaaggttcaactcaagctcaaggataagtagataaagtatgtaggataagctatgctccctctctttttagatttttcagtcttttcatatatttatataaaatatgtattcaaagtaaaaaaaaaaaaaaaaaaa

SEQ ID NO: 7626 - DNA, 702 bp, Medicago truncatula
  misc_feature (26)..(26): n is a, c, g, or t
  misc_feature (395)..(395): n is a, c, g, or t
  misc_feature (526)..(526): n is a, c, g, or t
  misc_feature (530)..(530): n is a, c, g, or t
  misc_feature (565)..(565): n is a, c, g, or t
  misc_feature (585)..(585): n is a, c, g, or t
  misc_feature (598)..(598): n is a, c, g, or t
  misc_feature (665)..(665): n is a, c, g, or t
  misc_feature (702)..(702): n is a, c, g, or t
  Predicted polypeptide sequence is orthologous to G3067
ggaaatctagtttgatgtataagganaaaaccaaaaagggtaatatgccaacagtgtggttttctttgaagaagtcacatacattgcaaatcagaaccatcagatgtacatgatccaaaaacaagaaagcatttaagcacaatcttaacaaaaaaaggaggaggaggaagatcaggttgttcaaggtcaatagcaaatctaaaagatgttatccatggaagcaaaagacatatacaaaagccaccaagttgcagtccaagatctataggaagcagtgagtttcttaatccaataactcatgaagttattttgagtaactcaaggtgtgagttaaaaatcactggttttcaagaagggattaacggtggtggtaataatgctagtggtggtagtantagtggtggttcttcaacttatgttggtactttaagacctggtacacctggtcctggaggacaccctacaatgcattactttaacccttcttttagaacttcttcaactcctacaaggaaatctccttttntttngtcagaagggtctaatggttttcatggtggtgggnggtgttcattcaagtaatangatgtcttttganacagattctaatggttcttcaactgttacttgtcacaaatgtggtgaacagtttaacaaatgggaanctgctgaagctcaccatctctccagcatgctggtaan

SEQ ID NO: 7627 - DNA, 731 bp, Medicago truncatula
  Predicted polypeptide sequence is orthologous to G3067
aaaattacaaatgtatgaatagggggttcatacaaattacaattaccatggacaagcacaagtgacttgacaaaaaagaatcaaaatccttcaaaagatgtaggccaaagaacctccatataaaagccaaaagtatagagcatgttctgaatcatggtaagttcgacgaaattacagggctaccgtgattttgttgaaactctaaagttctgccaaattcactgtgaatccaaacagcgtcaacactttgatcctgtttttgggctcatgatttgcaaattaccacaaaacaaggaagaagagctctaggattgagcaaataaagctcctcaatgtttgaataaagacctactttaccagccaatgaatcaaatccagtttgagatgccatttcttgaatgttttcaagtggcctatgaaccctaccagcaattaccctgcatactatcaatgcctttctaagtgaaggttcattatcaaaaatctctatagattcaaaagctcttccacttgtagatgttgtgaaaacacctatgccacctttcaattccttcttagcagaaaacccactcctaatgattctacaaacacaacattttttctgataaacaaagacttgaagagccattgagaccaagagaacagcaactgtggttccatagaactttaaaagtcattttcatcagctagacacctagggatgttcttctggagtttgcttgctttaattt

SEQ ID NO: 7628 - DNA, 578 bp, Medicago truncatula
  Predicted polypeptide sequence is orthologous to G3074
ctgtaaccaacgtgttactctttcaaacctttctcacacattgcgttgaacgaatctcagaaacgatgaagtgtgttttgcacctttggatctgaaaaatgggttcctttgatctcatcgcgttgaccttgggagcaattcttctcttcaaaacttgcgatttcaccttcttactctctttcttctacttcttctgatctctctcaactttttcgttaccatgaagaagaagctcgatacccgtttccctgctgctcggataaagaaaataatgcaagctgatgaagatgttggaaagatagcattggctgtgcctgttttagtttctaaagctctggagctatttctgcaagacctttgtgaccgcacttatgaaataactcttcaaagaggggcgaaaaccatgaattcattgcatttaaaacattgtgtacaaagctataatgtatttgactttctgaaggatgtagtcagcaaggttcctgactacggccatggtcatggccatactgatgctggtggtgctgatgatcagaccattcctaaaagaaggaaagctgcaggtgatgatggtaatg

SEQ ID NO: 7629 - DNA, 829 bp, Medicago truncatula
  Predicted polypeptide sequence is orthologous to G3074
cttacatcacaccattcaccccttcctttgctttcaaatttcccttcaaaattgttaccttcttcctgttcaatttcccaatttgatgccatgaagaagaagcttgatactcgtttccctgctgctcggataaagaagataatgcaagcagatgaggatgttggaaagatagcactggcagttcctgttttagtttcaaaagctctggaattatttttgcaagatctttgtgaccgaacttatgaaataactctacagagaggagcaaagaccatgaatgcattgcatttgaaacattgtgtacaaagctacaacgtctttgactttttgagagacattgtcagcagggttcctgactatagccatggacatggccattctgaggctggggctgatgatcgcgccgttccaaagagaaggaaagctgctggtgatgattgtaatgacagcgatgaagaggctaagcggagtaaaatgcttgagttgggccacactggcagtactggtaggggaagaggaaggggtagaggaagaggccgcggtcgaggggctcgaactgcagaaagagaaaccttacatcagcaggttgaatctgaaccttgcacttctattcagcaaactagcaaagacgtccccaatacaagtatggcaatagataatggttcagaaccaaaggagttatcgaaggaaaatattgcagctcatgaagaaagtacccaatctctccgaaacattgatctgaatgccaacttacatgaaaacgaggaaaaaaataatacaagcacggatatacctactcaggccccattgcctgaacctgctgcacaac

SEQ ID NO: 7630 - DNA, 768 bp, Medicago truncatula
  Predicted polypeptide sequence is orthologous to G3074
caagatgcttgagttgggcacactagccctactggcaggggaagaggccgaggtagaggaagaggacgaggtcgaggtcgaggacgagctattcaaagagagggacatcatcaggagactgagtctgagccttgtccttctgttcagcaagttagccaaaatactacagatacaaatgtggctatacttgatggcacagagtcaaacgagttaccaaagaataatgttgttgttcttcctgctgataactctgactcactccttaatattgatctgaatgccaatatgaacgaaaatgatgacaaaaaggctagcacagttgctaatctcacagtcactattcccgaagccgctaatcctgaagctgccaatccccctgtgtctgaacctcctccaccagacagcagtcatcatgaagaaattccgggctggtccctttctgaggtggacaagatggccattgattcgatgcagcttgcccagcttggtacacgaatggatgaagatgatgaagattatgacgaggaagggtaaattgtagtcttcaggagagggagattagattagctaaaagctcattataagtgtagaagaagtatatactagtgttatgattataagtattcactagccgtcataacatgtcttatgttgactgggaaaaaaagggttctgaatgtcccatttgtttaatatggtttatctatgttagcacatgttcgctgttgtatctgtcagttatgttagctttggtgactcttagggctg

SEQ ID NO: 7631 - DNA, 624 bp, Medicago truncatula
  Predicted polypeptide sequence is orthologous to G3075
gtaaatacactatggagatgtaaaacagtgcattactaagtactaaccatcatacatgtttccatttcagaatgtgtttaacaaaagaattgacttaggttcaccactttctgtgttttacatttcctaacctcctttattccctcttgagtttgtctctcttaatgcatcctcagctttcactttctcaggaacaaagtcggacagaaagtcatatcttttttgcttactaacaacacgtgatagatgattgtagctcaaagatttcttccgatcctgagcacaacaaccataagcatcttccgctaattgttcaagaaacttctccgcagcattgttaatagccaatatagcttcctgagaaacacgcaaatcgctaatttcaccctttaacatcgtcctaattcgattcataggaaacacatgcgttttcgcatcttcttcttcgtcatcatcctttgaatgtttcttttttcttccactttcttcctgttctttggaatttccatttgtgaaattgagcttcttcttattcttgttgttgttttctttggatttttcaatgtttttgttgtctttcctgattttgcttgtaggagttgagggttgtggttttttggtttt

SEQ ID NO: 7632 - DNA, 816 bp, Medicago truncatula
  Predicted polypeptide sequence is orthologous to G3086
ctctcttgtctcttacctgtttgtgtgtttattaaagagttcttagtttgactcaagaagctgaaggacttgaagttttgatttcaattcaccaaaatttttgagttgcatatatatcctttattggctttttcttagttttcttgtcacaaaaactaaccttgattacaaaaggcacataaatcaagaaagaatctctaagataattgtataagcaagatgggtgctatgtatgaagagctaagaagaaaccaagaaatggattcttcaagtattattcattcaaaacaacattatcaacaacaaaattctggactactaatgaggtataactcggctccaacctcgttgtttacaaacctaatcgacaacaacgctcaaaactttatcaacaatgaagaatcgtttacaaatgagagttatcttccatccacaagttcagaaatggataccatgttatccaagttgatatcatccaacaatggatggaacaattctgaagaaaatttgcaagagtttgatgtgaaacctgtgaaacaagaaataggtgaatctgttgcacaacagaatggtaattactcttatggtggatctgagttgatttaccaaggcttttcaaatggttctggtaatggtttttatggctcttttggtggagttaacactatggaatcagatgattctaatcaatctaaaattggtgttaggaattgctccaatcttattaggcaaaagagttcacctgctgaaattttctctaatgaaaatggttttgcaacattgacattgagagaagtagaaagctttaaagccaat

SEQ ID NO: 7633 - DNA, 677 bp, Medicago truncatula
  misc_feature (637)..(637): n is a, c, g, or t
  misc_feature (666)..(666): n is a, c, g, or t
  misc_feature (669)..(669): n is a, c, g, or t
  misc_feature (677)..(677): n is a, c, g, or t
  Predicted polypeptide sequence is orthologous to G3086
cacatagagaggaacacataaacaggagaataaaaagtgttctgtttttgcacagaggtttgtgttctgttcttgttgttctgttcttacaaaaaatttcaaccaaaataattattcagctgttatttttgctacaactactcttccattgaccttctcaatatcattttttgttgataagttagaaaaattaataaatattcataaccctatttttatatatatttttcattttccattcctctgttttgtcctgtttcctatgcactctaccttcaccatacttcactgttcaaacaccaacaataaatgaatttcatctacatatagatctgcaaaaagggtcaataattgcttagttttgaaggttttgtgaaagaaaaaatatattttttttaaagaagaaaaattctctgtttgaaaaaaaaaaagctttggtagaaaattatggagtcagatcttcatcaacaacaacaaccacaagtaaattcttcaggtttaacacggtttaaatcagcaccaagttcatatttcaacaacatcattgacagagaattctacgagcatgttttcaataaaccatcaagtccagaaacagagcgagttttttcaaggtttattaacagttttggttcanatgatgattactagctcaaaaaatctcantanattcaacn

SEQ ID NO: 7634 - DNA, 808 bp, Medicago truncatula
  Predicted polypeptide sequence is orthologous to G3086
ggcctatagaggtttcttcactttcatttctacacctccactctcttcactacacgctacattaaatccacaccccccaacacaacaacaaaaaattgttgaagtagaggaattgttgaagaagaagaagaagaaaagaatggaatcagatcttcagcagcatccaactatgtttctagatcatcaaaatcatcatcatcaacaacaaatgaattcagggttaacacggtttaaatcagctccaagttcatatttttcgaatatcattgataaagagttttatgagcatcttttcaatagaccttcaagtcctgaaacagaaagagtttttgcaaggtttatgaatagtcttagtggaagtggtggtagtggtggtggtggtgggtggtgatgctgaaagtgtttctgttacagcttctatagctcctataactgattcagtagttgattcattgactcagcagcttcctatagtgaaggaagagattgatcaacaatctcaaactatgcaaacaatgaataataataataataataataataatgaagctgtggatcttccacagcttcaaagacaacaaagtaataatatgagtaattatggttcttctgctgctcctcagagtttttaccataattcaggaagaccacctttgccgaatcaaatgaagaccggtcggtctaatcttattagacatggtagttcacctgctggattgttttcaaacattaacattgatactggttttgctgctatgagaggaataggaactatgggagctgctaatagcactagcaaagaagcaaa

SEQ ID NO: 7635 - DNA, 669 bp, Medicago truncatula
  misc_feature (581)..(581): n is a, c, g, or t
  misc_feature (597)..(597): n is a, c, g, or t
  Predicted polypeptide sequence is orthologous to G3091
gtttttgaatgaaaggcctcaacctaggcctggaaaaggggtcaccaacacctgccaagtctgtgaccgcagccttcttgattccttcagcttctgctctcttggttgtaagattgttggaacctccaagaagttgaggaagaataaaatgttgagtcagaaagatgggtctgatggtgaagagtcaatgaatggcattagcaatggaagtggcagaaacagaagtcatagttttacaccttcaacaccacctccaacagcagtgagttacagaacagttaagaggaggaaaggaattccacatagagctccaatggggggaggaatcattatagaattctaaaattaataataatgttatatagtggttttaatgtcacttagcaatcaatgtttatacctaaaaaatatacaacagttgttatcactttctcaaagtggtatcctcagccattaaagtcatatttggtttgaggatcagtctctttacgggttcgcacagaggacacccgatttacaccaaaaaagtagtgtcctcagaaaatatgattttatgtttttggcaatagttgtaacaccanagccttgttccctgangccggtgtagggatttactgctctacattgtataggaaaaaaaagggagaagaatttaaaaaaaatgttgga

SEQ ID NO: 7636 - DNA, 876 bp, Medicago truncatula
  Predicted polypeptide sequence is orthologous to G3091
tgatgatgaggaaaacaggtggcctccatggttgaaacctctgctgaaagagcgtttctttgttcaatgcaagttgcatgctgattcacacaagagtgtgtgcaatatgtattgtttggattgtatgaatggtgctctttgctcactctgtctcaattaccacaaagatcatcgtgctattcagataaggaggtcttcataccatgatgtgattagggtgaatgagattcagaaagtgttggacataacaggtgttcaaacctatattatcaacagtgcaagggttgtgttcttgaatgagaggcctcagccaaggcccggaaaaggtgtcaccaacacttgtgaagtctgcgagcgtagccttctcgattcctttcgattctgttctcttggctgcaagattgttggaacttcaatgaatttccagaagaagaacaagtcagctcgtgcttcaatgatatcagactcagaggattcacacagcagcagttgcagccatggaagactgaagaacattaaggtgcaaagcttcactccttcaacaccaccaccaacagtcaattacagatcagccaaaagaagaaagggaattccgcatcgtgccccaatgggaggactagtgctgcaatactaaaaaacagatcataggttattgctataatgcccttaatgagtcgagctcccctatagttagagattcattgcattcacgcagttggaacatcaatgatcgtccaaattgaacagccactaatgtcctgactacgtgaatgtgggatcccttgacttaagggaatcaagttcgcctttatatagatacgaaaaaaaatctaggtatctgtctctatgctgcttcatcagttccactgctaaagc

SEQ ID NO: 7637 - DNA, 692 bp, Medicago truncatula
  Predicted polypeptide sequence is orthologous to G3111
ctttcactcaaacatttcatcaaacactttccctcgctcgctaacatgactcgaccgctaagaattctcctttcaatggaaaccacacccaccaccgtagtggtggcaccgccaccggaagccgtagctatagaatcagatttcgttgtaattctcgcagctttactctgtgctttaatatgtgttgttggactcatcgccgtcgctcgttgtgcttggctccgacgagactccggcgccggaaactcacctcaacaagctttagccaacaaaggactcaagaaaaaagttctacaatcacttcccaaattctcttacgtcgatagcaaccctggaaaatggttagcaacaacagaatgcgcgatttgtctctcggatttcgccgccggcgatgagatccgtgttcttccacagtgtggacatggttttcacgtggcttgtattgatacatggcttgggtcacactcatcttgtccttcttgtaggcagattctggcggtgacgaggtgtcagaagtgtggtaggtttccggcgaacggaggtgaagctaccggagttacggttagtgaaccggagatgaaaagtagagaagatagcaatgtcggtgcaaatagtaatagtgggggtgttagtagttgtagtataactctgcactcacatcatagtggaacagtggttcttgccttaagaga

SEQ ID NO: 7638 - DNA, 705 bp, Medicago truncatula
  Predicted polypeptide sequence is orthologous to G3111
cattatggccgggaagcacaaagcacatcaaataacaataacaatacactaacttttcatttcattcacttcacatgactcgtcctttcagatttctcggcgagctcaactcgtcttcctccgattcacctgagtcatccaccgtcgttgattccgatttcgtcgtcatcctcgctgctcttctctgtgctctcatctgcgttctaggtcttgttgccgtcacccgctgcggttgtctccgccgcctacgtctctcctcaaccacaaacaacacttctccagctgcacctccagctgccgccaacaaaggcgtcaagaagaaggttctccgttctcttccaaagctcacagcaacagaggaatccgccgtgaaattctctgattgtgctatctgtttaagcgaattcaccgcaggagatgaaatccgagtgttgcctcagtgcggccatggctttcatgtgtcttgtattgatttatggctcagatctcattcatcatgtccttcctgccgtcagattctggtagtttctagatgcgataagtgcggcgggattcctcctcccgccacaactacgacggccggctccagctctacggcggcaccggcgccagattgtgaaggtagattaaagcaagcactgcagggtcgtcgttgagaaaagggaaatttaattatattgttattatataaagtttgtaaactgt

SEQ ID NO: 7639 - DNA, 642 bp, Medicago truncatula
  Predicted polypeptide sequence is orthologous to G3967
cttcttctattctatctatctatctaacatcttcatttccaaactataaacttaccacaaccctctttctatcatttctttcctccttttgatcattacacaatactctccattctcacacttacatcttctcatcctatcaaagtcagaaaatttccaattagctctacacacagctcagctaagctaacccaggatttaatacttgattggtatcatgttttggatggatttgggataaaattgcttttcatatataatcagaagctaaaggattcaagagttgaaagtttttgatgacttcttcttctatggctgctacaagtgaaaggtggattgaccgtcttcaattttcttcattattctggcctcccccacaagatgttcagcaaaaaaaggatcaaattgctgcatatgttgagtacttgattcagtttacatcagaacagtttgctgacgatattgctgagttgatccgcaaccgttacccgtcgaaggaaattattctctttgatgacgttttgggtatttatgcttaatcccatcaacatttgtccttcatcatccagagcatgggcatgcagttgtacttcctattatttcgtgtattatcgatggtacactagtctatgataagactag

SEQ ID NO: 7640 - DNA, 826 bp, Medicago truncatula
  Predicted polypeptide sequence is orthologous to G3967
agtacaacaattagaatttaatttcacgacacactatcaacatatatgtattacacaaaatgggacaaggataataaaaaagacccggttacatcttgtctttacaactgtacatgtctgttatattaaaagcacagtcattagcaagttcgtggtgaacatttgctcagtgtctacgtagagcacatacataatacaaaatgagctttctataaacaaactgcaatcatgactgcggctttttatgacgaccaacagaatgatgtttgcatatatgcaaacctgttagttccaaaatcataaatagtttctctgtaagtctagtgaaaaatggtcacagactaagatggtttcatttccatttcatacggaaatagcgcagcctagttctttggcagcagtgtcaagaaacttaataggcaatccagcagaaattctgctgtgagcttcccatgccatgcatttttctatgtcagcttgccaatcaacgacgtccaacttgaagtattgataagagggattgtggctgccgtttatccgcagtggtttaggactacaccttattgaaccagtatgcaaaatgtcacggagaactgagacgctcagagcacggacatgtgcacttggatgacaaaggcacctaatggtagctgctagacgacacttcaaaaggtttgaaaggccgtctgctacagccaatcctggttctccaaactcaagcactggttgaattgctctagctgttgcttccatagctccagctgtggtaaagacagcttctcatcacagcatccatctgtggctcgtagagtaatctgatgcactt

SEQ ID NO: 7641 - DNA, 641 bp, Hordeum vulgare
  misc_feature (1)..(1): n is a, c, g, or t
  Predicted polypeptide sequence is orthologous to G28
ntgggcctaaatttgtttgctgccatctataaaaatatcatgtcaccggtgtactccaaaaacaaatattacatggaactacatgcataatgagtggatggacatcaattaataacctttttgcgtacactttctcttggacaccaacaagtccagtacaacaaaataaggtaataataattggagtattttgccaacaattatggtttatgctgagcacgaattgaagcccgggcaacatgatgagcagctggagctttctcgttgataataatttgttctgggaagtccacacgaattgacttgaacttatagtgctgttctttccaagatatatctagaattttgtagtatggttccagcagttccacttgatcgccttctttaattgcttcattttgtagcccataaactgatagtatgaaataagactgatccaagtcacatgttaaataatacagtggagcatcttcgtcatgtcttatccaaagaaccactttacacacaacagcaactgtcttgttcaaacctcctgataagatgcttatggttgctttcttgtgggatgacttgaaattgacttcattcatagatgacaccaatgatgctgatctcttgggttgtagttgtcccttcgttgc

SEQ ID NO: 7642 - DNA, 1048 bp, Hordeum vulgare
  misc_feature (981)..(981): n is a, c, g, or t
  misc_feature (983)..(983): n is a, c, g, or t
  misc_feature (985)..(986): n is a, c, g, or t
  misc_feature (995)..(995): n is a, c, g, or t
  misc_feature (998)..(998): n is a, c, g, or t
  misc_feature (1000)..(1001): n is a, c, g, or t
  Predicted polypeptide sequence is orthologous to G481, G482, G485, G1364, G2345
cctctcccacgcgctcctcgatctccttgctgcactgcacctgcagtcctgcacgtacataatagtgccccaaagattgattctcagtttctcgtacaagtgtccttccagttaagttcatgcctccgccgcgtcgatgcttgatcggagtggtttgacgtcaccacttgcttcttgatttgagctgagacagatcatatatatcgaggcgccagcgccatgccggactcggacaacgactccagtgggccgagcaacgcgggcggggagctgtcgtcgccgcgggagcaggaccgcttcctgcccatcgccaacgtcagccggatcatgaagaaggcgctcccggccaacgccaagatcagcaaggacgccaaggagacggtgcaggagtgcgtctccgagttcatctccttcatcaccggcgaggcctccgacaagtgccagcgcgagaagcgcaagaccatcaacggcgacgacctgctttggcaataacccccctcggtttgagaacttctcacccgttaatactacttccccaattccccaaatcaaggcaaaggcggttcttcacaacaccacaccgataacaagccgcgaccttcccaaatccaggacacattcccggggtccccgatcggagggagcccctccccccgcggaggttaataataggcttcccaggcaccccagtgggaagaaaaaagtttaaattgacaagcggtcccgaccctaggtacgtgggctaaatataaggggggggacctcctgttgttccaaaaaaaaatttgttcaggggagacacacccccggcggcgaaaataatccctgagtattgtggtgttcaaaaaaaagaaaaaagagggcggcggcgccggcctacggaatagatgtaccggcggatacggcacggcggcgaggacccgcgttttcggccggttgggtattcgaacagcggagtacaggtgcgttgcgcgcgcatgngnanngcggggggnggntnntcatactatagttcgggggcacccgggagtgtgcggctcagggcgac

SEQ ID NO: 7643 - DNA, 674 bp, Hordeum vulgare
  misc_feature (206)..(206): n is a, c, g, or t
  Predicted polypeptide sequence is orthologous to G481, G482, G485, G1364, G2345
aaacgaatcgcacccgcctgcgccgccttctcttctccagcgtcggatctccccccactcgccgccctcaccgcacctccattccccgcctccaccaccttccctccacgcgcacgcgctcgtctatataaggaggagggccggatgtcggacgcgccggcgagccccccgggcggcgggaacgggggaggagggggaggggtggncagcgacgacggcggcggcggcggatacggcggcgtcagggagcaggacaggttcctgcccatcgccaacatcagccgcatcatgaagaaggccatcccggccaacggcaagatcgccaaggacgccaaggagaccgtgcaggagtgcgtctccgagttcatctccttcatcaccagcgaggccagcgacaagtgccagagggagaagcgcaagaccatcaacggcgacgacctgctctgggcgatggccacgctcgggtttgaggagtacatcgagcccctcaggtttatctgcagaagtacagagagacggagggtgatagtaagctagctgggaagtctggcgacgtctctggtaaaaaggatgccactggtcctcatggaggagcaagtgcgccagggatgggccaacaagtagcatacaatccaggaatggtttatatgcaacctcaataccataatggggcg

SEQ ID NO: 7644 - DNA, 693 bp, Hordeum vulgare
  misc_feature (650)..(650): n is a, c, g, or t
  Predicted polypeptide sequence is orthologous to G481, G482, G485, G1364, G2345
gtgccacatggagcaccgcaagaccgtcaacgcggaagacatcgtgtgggccctgaaccgcctcggcttcgacgactacgtcctgcccctcagcgtcttcctgcaccgcatgcgcgagggcgaggcggggacaggtggtgccggtgcaggcgacaaccgcgccgccacgagggcgcctccccgcgcgccgccgcccgctctccacgccgtgccgttgcaggtactgcagcgtcccatgtacgcgcccccgtctccggtgcaggttcagaatcacatgcagaggccagtgtacgcgcccccggctccagtgcaggttcagaatctggtgcagcggccagtgtacgcgcccccggctccggtgcaggttcagaatctggtgcagcgccccatgtccatgtacgcttccccggctcctgttcaggttcagatgcagctgggcatctacgggccccgggctccggtgcgcgggtaccccgtcacgatgtcccccgtgcggtccgtcgtcgcgccgcacgtcggcgagcagtgccatgcgttcggcggagaacccgtcgtggcccagcaatactacgggtacgggtacggggaaggagcgtacgggcgctgtactagcaacaacggaggaacctgtgccgacgaggaaagtcgtncaaacgcgttcccgtgccccgggttgccaacgatgagccggaa

SEQ ID NO: 7645 - DNA, 519 bp, Hordeum vulgare
  Predicted polypeptide sequence is orthologous to G867, G9, G1930
gtcctggaattttttaatgaatcatacatttcagcacaggcaggaggtagcatcctagaatcttgagagttggcacgctagctactgcgaccgcacgatcttaggatagatcctttcgcggcttctggttcccaaggctactttgtcatctttacgcccggagtcgacgaacaaccgcgtgccggcgcggtagaaggagacggtatagccagccgcaaggtcgcggtcgttaacaaagtagttcaagcccttcatgagatagtattggccggaggcctcaaactgaaatggccacaccttcccgttgccgctgccgtcctcaaactgcagcacggcgtgcctccccttgatcgtcttgcggaggccggggtgcggccacaccaagttcactgggaccatcagcgagcagccatccgactccatatcactcgccgtcagcactcgctcgaacatgtacctctgctcattttgacagtcgatgaagagcctccccctcgtggcctccccgacgccgcggct

SEQ ID NO: 7646 - DNA, 849 bp, Hordeum vulgare
  misc_feature (675)..(675): n is a, c, g, or t
  misc_feature (765)..(765): n is a, c, g, or t
  misc_feature (831)..(831): n is a, c, g, or t
  Predicted polypeptide sequence is orthologous to G1274, G1275
ggcggcaccagtgctctaccaacagcaggcgcaggcggtgggcgacgcctgcttcttctcctccatgtcctcctacttctccaacgaggcaatcagctcctcctgctccagcccagcctccagcttctccgccgcgctgggcgccacgccgcccgctgcgccggcgatcagccccgaccccgcgtcgcagttcgacatctccgagtacctctacggcgacggcccgttagccgcgccgctggcgcccgttggcgctgctgttgcaagctcggcgactgcggtgcctgcgaggagcgcggccgagtcggcggcggcggtggagaggccgcggacggagcgcatcgcgttccgcacgaggacggagatcgagatcctcgacgacggctacaagtggcgcaagtacggcaagaagtccgtcaagaacagcccaaacccaaggaactactaccggtgctcgacggaagggtgcagcgtgaagaagcgggtggagcgggaccgggacgacccggcgtacgtggtgaccacgtacgagggcacgcacagccacgccagccccagcaccgtctactacgccagccaggacgccgcctccggcccgcttcttcgtcgccggcacgcacccgccgccaggctccctcaactgagtagactagccaccaacgacggagccacgtngagatcaagcacgtacggggccttccatttttgggcaaagctaagccaagcttcgggccttcggtgcccgtaaccaacccaacaaagttngtaagttaaacttaagtggccactaactgggtttcaagggttccgggttttcccgaacttgtaagnggtttggggtaacttggc

SEQ ID NO: 7647 - DNA, 760 bp, Hordeum vulgare
  Predicted polypeptide sequence is orthologous to G1274, G1275
cggcacgaggtgtggacttgccgcaatgtcctcgtactcgtccctcatctctgtgagccccggcgagcagatcggtgggtatgcggaccaaggtgacgacgacgacatggcggccgccgctaactacctatcatcattctgctttgattttggcgacgagtattccgtagggaaggcagcaacagcctcctaccccttgcacggacagcagcagcaggcgccgaccaaagccgacagccaccacagcggccaagcagcaagtattaccagttcacagagattcgacaatatcaacacgagcttgacgagcagcgacgcgaggagcaaaggcagtaagatcgcgttcaagacgaggtcggaggtggaggtgctggatgacgggtaccgctggaggaagtacggcaagaaaatggtcaagaacagcccaaacccaaggaactactaccgttgctcaagcgagggatgccgcgttaagaagcgagtggagcgggatcgcgacgacgagcgcttcgtcatcaccacctacgacggcgtccacaaccaccttgcgccactgccgccgcagggatgcgccggatactcgctatcgctagcgcagacgcgcgtggacgaggggtcatcaccgctacccatggaagggcgccgttgctttcttgacgccatgaagatgcacgctgccgggagcctcgctggctcctcacccgtgcccgcaccgcgcacactagagcgtcataactgataattgataatatgtccagga

SEQ ID NO: 7648 - DNA, 677 bp, Hordeum vulgare
  Predicted polypeptide sequence is orthologous to G1760, G152, G153, G860
gatcaaagactgacacagcgtgtcatccatactcaaaagtcaaaagaatagcatcattaagcaagtacagacctattcaacctatcctcgaccaaaaatctatcttattgacttgttcactgaatcaaatcgagagttgtgcaaatttgagactctgaatattcaggatgcagatggagtgcagagttgaaatcctagaatagaactacaagtgtacatgaggagggacgtgaacaagagttaatctgtttgttcttcgtccacatacaacatacaaagatctgtggcttcatctcagttgagaatgtctgtgaatgtaagtttcagggaggctggactagccttcaaatgagttctttttaaggtgtggaggggtgacgcggtgaagaaatgctccatgggtccatgtttccagtatttacctgactaaatttcctatttcacattgcggtctggcagacggagtcagcaagcttgagacagcaactgcacaacttgcaagaaagtcacgattatgaagacccatagattttgtaacttccttgaaagtaatgcagttgttgcctcatgcttggtgccaccacatgcaataactcaaaccctcggcgcatgcaggcggccaggcgcgcccaagaacaagcactcccggctgcgggaggagaggcggacctaaaact

SEQ ID NO: 7649 - DNA, 707 bp, Hordeum vulgare
  misc_feature (250)..(250): n is a, c, g, or t
  misc_feature (280)..(280): n is a, c, g, or t
  misc_feature (340)..(340): n is a, c, g, or t
  misc_feature (356)..(356): n is a, c, g, or t
  Predicted polypeptide sequence is orthologous to G1792, G1795, G30, G1791
gccaccaccgcaccgcaccgcaccgcaacaacaaccgccgcgcccgcgcagagcaccgtcgaacactcggcgccacccatggctcccaagaacgcggcccccgtcgccgtcgcagccgcagccgcagcgggcggcggcatggagcccaggttccgcggcgtgcggaaacggccgtggggcaggtacgcggcggagatccgcgacccggcaagggaaggcgcgcgtctggctcgggaaccttcgacaccgncgaggcccgcgcgcgcgcctacaacgccgncgcgcttcactaccgggggccccaagccaaagaccaacttttcccgtcggcacccgtcgnccgctacgcgcacgtnccgctcccgctcccgctttccgccgccaagaagctggccgtcagccccagcagcagcaccgtcgagtcctcgtcccgggacactccggctgcttcccccgcggccccgccggcgctcgacctgagcctggcgatgccggccatggtggcggcgcagccgttcctgttcctggaccccagggtcgcggtgaccgtggccgtggcagcgccggcgccggcgccctgccgatcagcggcgatcagcggcatgaagaacaaggtggcgtcccgcgaggaagagcagagcgacaccgggtcgtcgtcatccgtggtggacacctcgccggccgtgggcgtggggttggacctgaac

SEQ ID NO: 7650 - DNA, 1815 bp, Hordeum vulgare
  Predicted polypeptide sequence is orthologous to G2
ggcgcagggccctctcctcgtcctcctccagtcctcatccccatggccaccaccaccgcctccaccccccaccactacttctactcctcccgcctcgccctcgcagcccgcggccaccgcgctcccatgccatagacgccacccagctgatcggtcgacctcgctcggacgcggcacggcgagcgaggcgggcatacctgcgtttcatttgcgagttcccggcgcgcgggcctcggatcggaggacggagatggtgctggatctcaatgtcgagtctccggccgactccggcacgtccagctcgtccgtgctcaactccgcggacgccgccggcgccttccggttcggcctgctcgggagccccgatgacgacgactgctccggcgagctggcgccggccgccgcgtccgggttcgtgacgaggcagctgttccccgcgccgccgcccgcgcccggggtcatgatggggcaggcgccggcgcctccgcccacggcgccggtgtggcaacctcggcgcgccgaggagctggtcgtggcgcagcgggtggcccccaagaagaagacgcggcgggggccgaggtcgcgcagctcgcagtaccggggcgtcaccttctaccgcaggaccggccgctgggagtcgcacatctgggattgcgggaagcaggtctacttgggtggtttcgacaccgcgcacgcggccgcaagggcctacgatcgcgcggcgatcaagttccgggggctggaggccgacatcaacttcaatctgagcgactacgaggaggatttgaagcagatgaggaactggaccaaggaggagttcgtgcatatcctccgccgccagagcaccgggttcgccagggggagctcgaagtaccgcggcgtcacgctccacaagtgcggccgctgggaggcaaggatgggccaactgctcggcaagaagtacatatatcttgggctgttcgacagcgaagttgaagctgcaagagcgtacgacagggcggcgattcgcttcaatgggagagatgctgtgactaactttgatagtagctcctacaatggagatgctacacctgacgtcgaaaatgaggcaattgttgatgctgatgctcttgacttggatctaaggatgtcgcaacctaccgcgcacgatcccaagagggacaacatcatcgccggccttcagttaacttttgattcccctgagtcgtcaaccacaatggtctcctctcagccaatgagctcatcgtcccagtggcctgtgcatcaacatggcacagcagtaccacctcagcagcaccagcgtttgtacccatctgcttgtcatggcttctaccccaacgtacaggtgcaggtgcaggagaggcccttggagccaaggccccctgagccgtcctccttccccggctgggggtggcacgcgcaggccgtgccgccgggctcctcccactcgccgttgctttatgctgcagcatcatcaggattctctaccgccgccggcgcgaaccccgccccgcccgccgtcgtaccccgaccatcaccaccgcttctactcccccgcccgccggacaactagctctctgcttactcccatggacggtggtcgacgggtgtgggcgtgtgcgcgggcgcgatcgacgtgttcgcgccttgtcggtaacagttgttgtgaattaatcggagagagataacattgccgagccatgtgtcactggctggttcctctccctcgccatgatcagaatcacaggcatcatggtttcccgttcagactacgtatccatgctttcaatcatgatcatgatcatgcggttgtcc

SEQ ID NO: 7651 - DNA, 896 bp, Hordeum vulgare
  misc_feature (471)..(474): n is a, c, g, or t
  misc_feature (520)..(520): n is a, c, g, or t
  misc_feature (522)..(522): n is a, c, g, or t
  misc_feature (526)..(526): n is a, c, g, or t
  misc_feature (532)..(534): n is a, c, g, or t
  Predicted polypeptide sequence is orthologous to G4
gccaaggttaactttccagaggaaccagcaactcctcaaaagcgtcgagcgcgccctgctcctactaaagcacccaagccaagcgcaacacaggaacctgcagtcaacaaccttgccagcccaagtgctttcgtctacccatatgctgactttgcatcaaaccagccacttgctctgccttacaacatgtaattagatcctgcaatgaactctgctgcccctgttgaagcctctgttatgaatctgtactctgaccagggaagcaactccgttggcttctatgacctggtctgggattttgacaccgagactccagatatatcacccattgctcccatttataccactgctgaaggagcggaatctgcacttgttcagagtgacgcatacaacccagtggtgattgctgaagtacctgaatctgtacttgtccagagtaacacctacaactcagtggtgcctggggggggnnnnaaacaatgatggccgattcccgagccctggggggaggggggggggncntttnatggcnnnttggacgagtcgattgacagccttgtgaactttggggtgcctaggaatgtattggggacatggacctttggagcttcaatgacatgcccatttggggagaattttgctgattgttccaaatcctttattttaaaaataaggggaataagaggttgggaagattgggaaaccacccttgttgaacctttgggtgggcaacgaatttggttcgaccttaaaatgcaaaaaaatacggtttgaaaaattcctcttgtaatgagacccgtttcctaaatgaacggttctttggggccacccgattttggataaaccggagcatcagtgatttcgacaccttttgtgaaagccttccagttcctaag

SEQ ID NO: 7652 - DNA, 700 bp, Hordeum vulgare
  misc_feature (6)..(6): n is a, c, g, or t
  misc_feature (162)..(162): n is a, c, g, or t
  misc_feature (696)..(696): n is a, c, g, or t
  Predicted polypeptide sequence is orthologous to G4
caccgnggggtgcgcctccgcaagtggggcaaatgggcgggcgagatccgcaaccccttctccggcaagagggagtggcttggcaccttcgacactgccgacctggcctctgctgcctaccaggccgcctcccggagctttatcgaggagaagcgtcgccgncgtggccagtccggtgccgcggcctcacctgctcagtcggccacgtcctcaccggcgtcgtcttccacaccgacggcatcttcgtcgtcctccacctcggctgctccatttgcgcacccgtcaccgtcttctgttctggaagccaccaagctggcagctgagtccatttcgcctgagccgacaccagttcccgtcatggtgtccaccacacccgagacagcgcagcttcccgacgacccagagttctaccaggacctcctgcgtgggcttcagctgccggacattgacccgatggacttccgcgcggggcttgatgccttggacgtctcggaggcgtcggcttacttggacggcgaacaggacctgctgctcggcgacttggccgacgaggagctggagctggacatggacctcgacatcggtgacgacttcctggagatgcccggctgcgactttggccgaggcatggatgatttcctgcaaaaccgtcgattttctgcgtcttgaattgggggagaaggtttaaagggtttnacta

SEQ ID NO: 7653 - DNA, 928 bp, Hordeum vulgare
  misc_feature (2)..(2): n is a, c, g, or t
  misc_feature (9)..(9): n is a, c, g, or t
  misc_feature (573)..(573): n is a, c, g, or t
  misc_feature (770)..(770): n is a, c, g, or t
  misc_feature (798)..(798): n is a, c, g, or t
  misc_feature (814)..(814): n is a, c, g, or t
  misc_feature (837)..(837): n is a, c, g, or t
  misc_feature (856)..(856): n is a, c, g, or t
  misc_feature (865)..(865): n is a, c, g, or t
  misc_feature (876)..(876): n is a, c, g, or t
  misc_feature (914)..(914): n is a, c, g, or t
  misc_feature (916)..(916): n is a, c, g, or t
  Predicted polypeptide sequence is orthologous to G4
antaagccnccctccccggcgacgactagcgtcgagtcaccgccggcaacaaccatgtgcggcggcgcgatcctcaaggacctcaaggtccccgcggtgacgcggaaggtgacggaggcggcgctgtggcccgagaagaagaagcccaggcaggccgacggcggggcccggcgcctcgggctggtcgacggcgaggaggacttcgaggccgacttcgaggagttcgaggccgactccggggactccgacctggagctcgggcgcggccgggcggctgagaaggacgacgacgaggtcgtctagatcaagccctacgccgccgtcaagaggcccctctcccaagatgacttcagcatcattactactgctggttgtgatggtcctgcacaaaggtcagcaaaaaggaagagaaagaaccaattcaggggtatccgtcagcgcccctggggtaagtgggctgctgaaatcagagatcctagcaaaggtgtccgtgtttggcttggtactttcaacagtgctgaagaagctgcaagagcctacgatgttgaagcacgcaggatccgtggcaagaangccaaggtaaactttccagaggaaccaacagttcctcagaagcgccgtgttcgccctgctcctcttaaagcacccaagctaaccgcatcacaggaacctaccgtcataccagcagtcaacaaccttgcccaacccaaatgcttttcgtctacccatctgctgactttgcattaaaccagccactgtttcagccctgntaaccgtggccattttgtttccttgcanatggaagttttggctngccccctttttgaaagcctcccntggtttatgaaaatattgntaactcttngacccaagggnaagcccactttcttttttggggcttgtttctttgaacntngggccttgggga

SEQ ID NO: 7654 - DNA, 1140 bp, Hordeum vulgare
  misc_feature (236)..(236): n is a, c, g, or t
  misc_feature (783)..(783): n is a, c, g, or t
  misc_feature (1090)..(1090): n is a, c, g, or t
  Predicted polypeptide sequence is orthologous to G4
cccgtctcgtctcgtctcgcagcgtttcactcttcccctttcctttcgcttagctctccacccgcggccgcacgtgctcccagccatgtgcggcggcgccatcctctccgacatcatcccgccgccgcgccggcccgccggcggccgcctctggcaggcggacaggaagaagaggagggccgggccccgccgcgtgcccgaggaggagcccgaggaggaggcggaggagggcgacnaggacttcgaggccgacttcgaggggttcgtggacgaagagtccgacggcgaggtcaagcccttccccgcccgcaggagcggcttctccggagatggattgaaggcaactgctgctggtgaatatgactgtgcctcagggtctgctaaaaggaagaaaaagaaccagttcaggggcatccgacgccgcccttggggtaaatgggctgctgaaataacggatcctcgcaagggtgtccgtgtctggcttgcgacttacaactctgccgaggaagctgccagagcctatgactttgacacccgcacaatctctgggaagaagggcaagggtaattttcccacacgaaagctctatggcttctcagcaacgctgccctgagcctaccggctgggaagggcctgaattcaacaccgaacaaaaccgggacctcaataacagggcaaggcgaatgttattctgcgctgctgggacgcccctgaaaaacgatgcggcaacccagacatgaccgtcgcctccagaatgcagttaggctcttcatgaattttccngatcggggagcatacctctatggccaactttaggggacatgagtcagaaccttcctacatttggcgggtcactgccccctccaaggataaaactcgttttcgcaaaaggcaatgtcaaggcctccttgagggaggcgacagaacttccctgcggccatcaatgcgctcgcgcggtcggtagaaagcgaactaccgctagtcggcagcggcaccatacccgggccctatcgcccatatcggtcttcgcgcgggggggcccgcgtttgcaggcggagtgcaaacacggttattggcttgcctccaaccntcttctccgggtaccgcgacggtcacatgtcggccgctcggaaccccccg

SEQ ID NO: 7655 - DNA, 857 bp, Hordeum vulgare
  misc_feature (515)..(515): n is a, c, g, or t
  Predicted polypeptide sequence is orthologous to G4
cgcccgcaaagctcgcctcctcctcactgtgccgcccgtgctcgcctctcccggcaggcaccgatctagccctccctcccttgatccacagctcgccatgtgcggcggagccatcctcgcgggattcatcccgccgtcggcggccgcggcggcggccaaggcagcggcgacggcggaggaagaagcagcagcagcgcagcgtgacggcagactcgctctggacgggcctgcggaaaaaggcggacgaggaggacttcgaggccgacttccgcgacttcgagcgggactccagcgaggaggaggacgacgaggtcgaggaggtcccccctccgccggcgccggcgacgggcgggttctccttcgccgccgcggccgaggtcgcgctcatggcccctgcccgccgagatgctgctggtcaacatgatggacctgctgccaaacacgtaaagcgcgttcggaagaatcagtacagagggatccgccagcgtccctgagggaaatgggcagctgaaatnccggaccctaacaagggtgtcccggtatggctcgcgacatacaaccctgctgaagaagcagccggggcatatgaagctgaggcccgcaggatccaaggaagaacacccagtcccgctccccacgatgccccgattggtcacagggcaccctggagccgctgttggtaaatccacaaagttgcctccacctccacaggcctggcaagaataccctctaatatcgctggcccaagagcaacagctatcgtccgcattgttcgccttcacagacacaaggtccgcgcaaatcagctgacccgtcgagttccatcgggcactggccgagctaccggcagcaaagag

SEQ ID NO: 7656 - DNA, 692 bp, Hordeum vulgare
  misc_feature (478)..(478): n is a, c, g, or t
  Predicted polypeptide sequence is orthologous to G4
ctcgccacctttcttcacaggttccttagttcctactgcccagctccacatcagcgcactcctctatctacttacttacagcatgtgtggcggcgcgatcatctccgacttcatcccggagcgagaccaccgcggcggcggcaagcggggcccctccaccgccgacttctggacgcacgccgccgccaccgagttcgacgaccctaccgaccaccactacttctaccccgacgacctgaccggcgccggcgcctgcacgttcccacccgagcaccaaggtacgtgccgcgtacgcgcagcagaggagccgagcaggaagcgggagcgcaagacgatgtaccgcggcatccggcggcggccgtggggcaagtgggcggcggagatccgcgacccggccaaaggcgcgcgcgtctggctcggcaccttcgccaccgccgagggcgccgcgcgcgcctacgaccgcgccgcacgccgcgtncgcgggaccaaggccaaggtcaacttccccaacgaggacccgccgctcgacctggacgactacgaccttctcaacggcggctacaacgtggccgccttcttccaccagccgttcatggccgacggcgccgcgccggcgacctcggcgccggaggtggcgtacgtgccgcagctctggagctttgacagcatcaacactcaagtgcctatgtgat

SEQ ID NO: 7657 - DNA, 987 bp, Hordeum vulgare
  Predicted polypeptide sequence is orthologous to G4
atgtgtggcggcgccatcctagcgcagctgatcccgccgtcggcgggccgtccgtcgaagcaggcggcagcgggcggccgggccccgcccacgagctccaagaagggcggcgtgagcaagagccgccacagcagcaccccagatgccgacgacgacgtcttcgaggccgccttcgaggacttcgatgaccacttcgacctgcgggcggaggaggacggcggcgacgaccatgtcgtctttgcatccaagcctgccttctctccacgtccggcctacgacggtggccgcgcggcgcatgcggcgagcaggaagaagcgcaccggccacctccatggcatccggcagcggccgtggggcaagtgggcggcggagatccgcgacccgcacaagggcacccgcgtctggctcggcacgttcgacacggccgatgatgccgcccgggcctacgacgtcgccgcccgtcgcctccgtggcagcaaggccaaggtcaacttccccgacgcggccaggaccggggctcgcccgcgccgcgccagccgtagaaccgcgcagaaaccgcaatgcccccctgcgcggacgacggcgtactctgccaccgcagcagcacgcgcacagccggagcaggacgctatgatggtcaaacccgagctgatggagtttttcaacgtggacgccatcgtccacctgaccactgccgtcgccgcgctaccgcctgtcacggcgagcaccttcgccgacacgatgccgagggtcgacgaggactcttctgtggggagcggcggcggcgccatgctggggttcgccgacgagcttgggttcgatccgttcatgatgttcctgctaccctgctcggacatgtacgaatccgccgacagcatcttcgccggagacgctgtcatcccggatgccctcagcgtggacagtggcatggacgccgtcagcctctggagcttcgacgagttccccatggacagcgccattttctga

SEQ ID NO: 7658 - DNA, 850 bp, Hordeum vulgare
  misc_feature (553)..(554): n is a, c, g, or t
  Predicted polypeptide sequence is orthologous to G5, G974
gccagtcgctcgccgcgccctcgtccaagaactccgccgaggcggagccggagccggagtcccccaagtgctccgcgtccacggagggagaggactcggtgtccgccgggtccccgccgccggtcccggagatggagaagctggacttcacggaggcgccgtgggacgagtcggagaccttccacctgcgcaagtacccgtccgtggagatcgactgggactccatcctgtcgtgaacagcaagcagctactaccactaccagtacagtcttcgttaagctccgtagctatgatgtaatttctccttggatcgaatcggcggctgctctggcccgacggcattttagacgtcggccatggctgctgcgagtagctagcagtagcagtagcagtaagaagccagtggtgtttagtgctgtagtaaggtcgtcgctactacgtggtgtaactgatctcctggttgacccgccggcagttttttcacggcaaaggcggccagtcgagaggtgtaatcgtgtttacccgttggaaattgcactagcttaattatgtnnaagaagaaaaagaagtgcggacgttctggtgtttctgtgagaagtagttgtggggggtcgaggagcaattgttccttagtttgtaggtggtagagattctaacaccttcgggggggggccgggaccccaatttggccctataagggaggtggtttaaaattactggggcgggggtgttcaacacgccttaggtggggaaaaccccggtcgttccccaaatataatcgcctggggaacattccccttttcgccaggtggagtatgaacagaaggagctcctccgttttccttttcct

SEQ ID NO: 7659 - DNA, 1080 bp, Hordeum vulgare
  misc_feature (5)..(6): n is a, c, g, or t
  misc_feature (817)..(817): n is a, c, g, or t
  misc_feature (1048)..(1054): n is a, c, g, or t
  misc_feature (1057)..(1057): n is a, c, g, or t
  misc_feature (1059)..(1060): n is a, c, g, or t
  Predicted polypeptide sequence is orthologous to G5, G974
tgggnngcggggacttgaggccgtcgtagcttactcgggggactgggatgaagctggcgccgcccagcttaacggtctagaactagtggatcccccgggctgcaggaatttggcacgaggcgacgcagcgcgcctcaacttccccgacaacgccgcctcccgcggcccgctccatgcctctgttgacgccaagctccagaccctctgccagaacatcaccgcttccaagaacgccaagaagtccgcctccgtctccgcgtccaccgccgcagccacgtcgtccacccccaccagcaactgctcctcgccgtcctccgacgaggcgtcgtcctcgctcgagtccgccgagtcgtcaccatcacccaccaccaccgcagcagaggttcctgagatgcagcagctcgacttcagcgaggcaccatgggacgaggcagccggcttcgccctcaccaagtacccgtcctatgagatcgactgggactcgctcctcgccaccaattagcacccagttcatcttcgtcagctactactaccagtaccgtcttttagcgtgtcatgatgctaggttaatgggtcgccgcgatgcaaatggcattttagacattctgcgccggcctttagcggattagctctaagtctctaatccttgttcattgtgtagacctatgattcgttctctttgtggtagggtttggttagtccctcccggatgactataagccggcgtttttgtgcccggcgtctccggtgggtcgtcactgggcagtgactccggccggtgaagtctgtccattgttctagctaagtgctgttcttnccgctgctctgcagattgtaacagtgggagacttgtcatgtaaaatcagctcatcaaaaaatcgggtaatgtggaatattattttgttgtaaaaaaaaaaaaaaaaaattcgggggggggcccgggacccaattcccctaatgagagatttataacccccctcactggcccggttttaaaacttctgactgggaaaaccctggggtacccaaattaatgcctcttaagggnnnnnnnttntnngggggcgggggggcgccccg

SEQ ID NO: 7660 - DNA, 561 bp, Hordeum vulgare
  Predicted polypeptide sequence is orthologous to G5
aaacgtctcccgacaagtcgaacataaactgtatctcatttcagtgatgtcgtcttgttcacgcgcgcgcacacacacgtaagctattttttacacatgggcgcgtacaaaatttacagtgtaaagagaatcagcaatgaaatccaaattgtacaccttgaccaaagaggaggctatctgaatttcgccagtcctcgaggtccctatattcccccaaaaaaatgcccctcaactgaatattttgtaaaatttcctagagctgagcttgtgggatcttttcttggccgatctagctttattcttccggggaatggcatgcagaccactacagatgtgatctaaccctgcatccacaggcttgtcggcggccatttgcccacctgtgctgtttacagcgtgatcaatgtccgaacagtcgtcactctcttcatcagaatcggaatcaacggggaccagcgtactgtgtttcggcgttgtgaaggacagcctcaagcggtcgacctcgatgttcttgactttgttaagggaaagagaatggaaggggagctgatacgtgaaggt

SEQ ID NO: 7661 - DNA, 675 bp, Hordeum vulgare
  Predicted polypeptide sequence is orthologous to G15
cggcacgaggtatgaagctatttgtgggacagtacttgtagagtagatgggggagaaggaaagggaagcaagtttatttaggaagttatgatactgagcaaaaagctgccagggcatatgatgttgcagctcttaaatactggggactaaatacaaagctgaacttttcgatttcagaatatgaaaaggaactggcggacatacaagacatgtctccagaggaatgtgtgacatacttgcgaaggaggagcagctgcttctcaagaggggcttctatttacagaggagttacaaggaggcagaaagatggtcgatggcaggcccgcataggactgattgctggaactagagacatttaccttggaactttcaaaaccgaggaagaagctgcagaagcatatgatattgctgccattgagatacgtgggaaaaacgcggtgaccaactttgaccgaagcaactacatggacaggggcatgcattgtatagaaggggcagggttgaagctgcttgcaacgaagccagaatgatttgatatcgtatattgaacagatttggtaagccatattttggggcttagtggtacatacaagatagaagaactggtcgcagcctgtcagtatttgctgctgtatgattcttcagattatatatagttcttccagagagaatttc

SEQ ID NO: 7662 - DNA, 669 bp, Hordeum vulgare
  Predicted polypeptide sequence is orthologous to G19
aaggtgaggaggtgacggagaaagcgccggcgccagcgcggaagacggcgtaccgtgggatcaggcgccggccatggggccgctgggctgcggagatccgggaccctaggaagggtgcgcgcgtgtggctgggcacctacgctaccgcggaggaggccgcgcgcgcctacgacgtcgcggcgcgcgatatccgcggggtgaaggccaagctcaacttcccgcccgccgtgggcgcgccgcaggcggcggtggcgggggcgcccaagaagcgtccgagggtcgcggcagaggagagctctgcgtcttggtctccacttccgggcacagctaccggcgtcggcagcacggacagcctgcgggagagcatgtccgggctggaggcgttcctggggctgaaggacgccgccggggacgacgacgtccagcccttggaggccgtcgatatcatcttcgagtagtcgtgtgccgtcgccacataccgaccgctcttgcggggtccataggtacatttgccgataaataagcggtcgttcggctttcctgggcttcgtgaggcatatccaggtcatttgtacctgaatgtatgtaagtcgagcacgactatcacaaatgccgacaaagtttaaaaaagtggtattttcagcaaaaaaaaaaaaaaaaaaacttgaa

SEQ ID NO: 7663 - DNA, 331 bp, Hordeum vulgare
  misc_feature (66)..(66): n is a, c, g, or t
  misc_feature (78)..(78): n is a, c, g, or t
  misc_feature (155)..(155): n is a, c, g, or t
  misc_feature (195)..(195): n is a, c, g, or t
  misc_feature (197)..(198): n is a, c, g, or t
  misc_feature (210)..(210): n is a, c, g, or t
  misc_feature (216)..(216): n is a, c, g, or t
  misc_feature (219)..(219): n is a, c, g, or t
  misc_feature (224)..(224): n is a, c, g, or t
  misc_feature (230)..(231): n is a, c, g, or t
  misc_feature (235)..(235): n is a, c, g, or t
  misc_feature (249)..(249): n is a, c, g, or t
  misc_feature (251)..(251): n is a, c, g, or t
  misc_feature (259)..(259): n is a, c, g, or t
  misc_feature (270)..(270): n is a, c, g, or t
  misc_feature (291)..(292): n is a, c, g, or t
  misc_feature (295)..(295): n is a, c, g, or t
  misc_feature (306)..(306): n is a, c, g, or t
  misc_feature (313)..(313): n is a, c, g, or t
  misc_feature (315)..(316): n is a, c, g, or t
  Predicted polypeptide sequence is orthologous to G21
tttttttttttttttaaaagaaggctaaatataagccatacgattttcagttgcctcaaaaacagntccaacaaaccnaatcacaaccacaaccgggggaaaaaaaaacagatcctatcaggcagtagatgaacacagatcctatcaggcagtanatgaacccagctatggggactgggagcgaaggaagggaancnnacggggcggggntgatcnganggatncagccnntganggccttttaaaacntngttccaangtctttccttncccgaaaatcggccggacgannccntaaacggcccnttgaagnanncggacaacctttcaa

SEQ ID NO: 7664 - DNA, 969 bp, Hordeum vulgare
  Predicted polypeptide sequence is orthologous to G21
ctcacgctctcgctcgctcatcactccccaactactaactccaccaccagcagcaggcagcagctagcgcgcggcagccatgggcgccacggaggattcctcctccggctccgagacgaccacctcgtcctcggtggaggccctggcctcgccgccgtccccgacggccaccaccgcgtcgtccaagaagaagcgggcgcgcaacgacgggcggcacccgacgtaccgcggggtgcgcatgcggagctggggcaagtgggtgtcggagattcgggagccccgcaagaagtcgcgcatctggctcggcaccttcgccaccgcggagatggcggcgcgcgcgcacgacgtggccgctctcgccatcaagggccgtgccgcgcacctcaacttccccgacctcgcccacgagctcccgcgcccggccaccgccgcgcccaaagacgtccaggcggccgccgcgctagccgcctccgctgacttcccggcctctgccactgccactgccaatgccggcgccaagaaccccgacggcccggaacccaacgccgcctctgcgtcgacaccgccggacacagccgaggacgcgctgttcgacctccccgacctcctcttcgacctcagacacggccctccgtcctgccaggtctcgtgcgcttccacgtgggacgacgacgtggccttcgccggccccggcgccggcgtgttccgcctggaggagccgctgcagtgggagtattgaaaacccgcccggtcgccgccgccgccgctgcatgcatgtgtggctcgtagatggtcgttaccacatcggaccagaaatcatgtcgaaacgatcggtgaaccagcgctgcgtttgcctttactaaatttaggagtcgggccatgtacaaattggggttagccctgtgttctttatcgtatttgctttgcgtggattgtggggcaaaaaaaaaaaaaaaaaaaaaaaaaaaa

SEQ ID NO: 7665 - DNA, 565 bp, Hordeum vulgare
  Predicted polypeptide sequence is orthologous to G27
ctaactccaccaccagcagcaggcagcagctagcgcgcggcagccatgggcgccacggaggattcctcctccggctccgagacgaccacctcgtcctcggtggaggccctggcctcgccgccgtccccgacggccaccaccgcgtcgtccaagaagaagcgggcgcgcaacgacgggcggcacccgacgtaccgcggggtgcgcatgcggagctggggcaagtgggtgtcggagattcgggagccccgcaagaagtcgcgcatctggctcggcaccttcgccaccgcggagatggcggcgcgcgcgcacgacgtggccgctctcgccatcaagggccgtgccgcgcacctcaacttccccgacctcgcccacgagctcccgcgcccggccaccgccgcgcccaaagacgtccaggcggccgccgcgctagccgcctccgctgacttcccggcctctgccactgccactgccaatgccggcgccaagaaccccgacggcccggaacccaacgccgcctctgcgtcgacaccgccggacacagccgaggacgcgctgttcgacctcc

SEQ ID NO: 7666 - DNA, 962 bp, Hordeum vulgare
  Predicted polypeptide sequence is orthologous to G38
agctagaggagatctctctctcccttcctccctcctcttccgcctcgatggagaccgggggtagcaagcgggaaggagactgccccgggcaggaaaggacgaagaaagtgcgcaggagaaccactggtccagattcggttgctgaaactatcaagaagtggaaggagcaaaaccagaagctccagcaagagaatggatcccggaaagcgcccgccaagggttccaagaaagggtgcatggcagggaaaggaggtccagagaattcaaactgcgcttaccgcggtgtgaggcagcgcacgtggggcaaatgggtggctgagatccgtgagcccaaccgtggcaaccggctgtggcttggttcattccctaccgcagtcgaagctgcacgtgcatatgatgatgccgcaagggcaatgtatggcgccacagcgcgtgtcaacttcccagagcattccccagatgccaactctggttgcacgatggcaccttcactgctgacgtcttatggggcaaccgctgtgtcacatccgtctgatgggaaggatgaatcaaaatctcctccttctcttggcttcaatgcgccgacagctgcgctgcttcggtctgatgcccaagatgaatttgattctgcagggactgtgggccttaaggtgaaaccgaaatgaaccattgatttggaagtacccatgaggaccacaaggcctggaagttttccaaccaaaagggaaggcttaccttaaaaaagccgaacctaagttttaattctcttaccgttgaagaaattgtcgaccatgaatattggggaattgagggctcagtgtaaaaagggaagccccttgaaagatccccggagaggcgatgaacggtttatatcttttttcatatatggggtgtaactttgagaggtgggttactgcggggaaaatgggagtgcgttatttctgctgcggcgaactcttccg

SEQ ID NO: 7667 - DNA, 1536 bp, Hordeum vulgare
  Predicted polypeptide sequence is orthologous to G38
gggtttccgacttttctttctcccctcccccacgcctctctctctctctctctctctctccccccttaacgaagtcgacacggcgaagaacacgggcggcgcgattgcgagctctagatacctcgacccggtccggatcgggccggccatgacggtagatcggaagggtgcccaggcggcggcggcggcggcggccacttctgcgcccttcgagatcccggcgctccagcctggaaggaaaaagcgacctcggaggtcacgtgatggccctaattccgtctctgagacgatcaagcgatggaaagaagtgaaccaacaacttgagcatgatccacagggtgcaaagcgggccaggaagccacctgcaaagggttcaaagaagggctgcatgcaagggaaaggaggccctgagaatacacaatgtggattccgtggggtaaggcaacgaacttgggggaagtgggttgctgaaattcgggagccaaatcgggtcagcaggctctggttggggacgttccctactgctgaagttgctgctcaagcttatgatgaagcagccagagcaatgtatggcccgctggctcgtaccaacttccctgtgcaggatgcacaagctgctcctgctgtggctgtaccagtggcaaccgaaggtgtagtacgtggttcttcagcatcatgcgagtcgactacaacatccaaccactccgacgttgcttcttcctcgcataataagcaacgacaaattcaagctcctgagatttcctctcggtcagatttgctggagtccacccagtcagttgagtacagccaacaacagtctgttcctgatgctgtctcaagcattgcaatgagcacatctgaagaggatgtttatgagccattggagcctatctccaatttgccggatggggaagcagactgttttgatattgaagaactattgaaactgatggaagccgacccagtggaagttgacccggtgactgtgggctcctggaacgaattccaggatgctggggccaacgctaggggctcttggaacgaattccagtgtgcccgagccaacactggggtctcctggaacgccaacgctggcatggagatgggccaacaggaacctctgtacctggatggcttggaccaaggcatgttggagggcatgctgcattctgattatcctttcccagtgtggatatcagaggatcggccaatgcacaaccctgccttccatgatgctgagatgagcgagttctttgaggggttgtgattcctactggccgccttgctcatggcgtttggtcggcttccccctcggcgtccgctgctgcgtttcaatgaagaagaggtgttccaatgaagaagaggtggaccggattggattcctttgcagaactaataagctcctaagctagttttttgtgcttcgtttgtagttctgttggcatggggacccttctctgtttggtgtttcttttgataagaaaccttattgtgcatcacgatctttggaagtggaataagaaaaatgtgaaatgt

SEQ ID NO: 7668 - DNA, 1377 bp, Hordeum vulgare
  Predicted polypeptide sequence is orthologous to G38
aaagcaccaacccctcaagaggcacatccttgcttgcttgcttgcctctcgtgttctcatctccatagcttgcagataagtaaagcttgtccgttgtgcagagaggggaggtggataggtgcagatggaagggctgcagagatcgtcctccactttcagaaggaaaaagcgacctcgaaggtcacgtgatgggcctaattcagtctctgagacgatcaagcaatggaaagaagtgaaacaacaactcgagcatgatccacagggtgcaaagcgggcgaggaagccaccagcaaagggttcaaagaagggctgcatgcaagggaaaggaggccctgagaatacacaatgtggattccgtggggtaaggcaacgaacttgggggaagtgggttgctgaaattcgggagtcaaatcgggtcagcaggctctggttggggacgttccctactgctgaagttgctgctcaagcttatgatgaagcagccaaagcaatgtatggcccgctggctcgcaccaacttccctgtgcaggatgcacaagctgctcctactgtggttgtacaagtggcaaccgaaggtgttgtacgtggttcttcagcatcatgcgaatcgactacaacatccaaccactccgacgttgcttcttcctcgcataataagcaactacaaattcaagctcctgagatttcctctcagtcagatttgctggagtccacccagtcagttgagtacatccaacaacagtctgttcctgatgctgtctcaagcattgcaatgagcacatctgaagaggatgtctatgagccattggagcctatctccaatttgccagatggggaagcacactgcgcgatcagcaggtgtttcggaccaaggacgtggcctgagacatggacccgccgtcgccgagggtgtccggcggcatcctctacgccatcttcgggggttccggctccggctctggccccgcagcgcgccgaggccgtgccaagcccaagaggaggcaacggtcggcggtgtaggggttctgatcgggcaatggtggatgtcatgcgagctgtgtttatactggagtgatgatcatgatcatatactactgatattggttggtttgtattgtactctgctctgcgttattgcctcttagtctataagtgtcaggttagttcctcttttttgtttagtttcttgattcagatccgtgagcagcagctgttgagatctgtgatgttcttccttgatctggtgcatgatctttttttcctctttctctcaccggagccgctgggtgttagttgcttccatgtgagcgtgaggtgttggcgctgttgatgtgttgcatgtatggagttgcaaccataaacaatcaattggacggc

SEQ ID NO: 7669 - DNA, 1328 bp, Hordeum vulgare
  Predicted polypeptide sequence is orthologous to G38
caaaaccaaggcggcggcagcggggtgggagagccgggagcaccgaccgacaccgggggctgcatgcggagctgaggcgaggcgaggagagatccggcgcgggtgccaccgccgcccgcccgcgggagatctggttggcggcgccgccgcccggacaaggaagcggccgcggaggcggcgtggggcgagctgccggggaggccgacgaagctagaggagatctctctctcccttcctccctcctcttccgcctcgatggagaccgggggtagcaagcgggaaggagactgccccgggcaggaaaggacgaagaaagtgcgcaggagaaccactggtccagattcggttgctgaaactatcaagaagtggaaggagcaaaaccagaagctccagcaagagaatggatcccggaaagcgcccgccaagggttccaagaaagggtgcatggcagggaaaggaggtccagagaattcaaactgcgcttaccgcggtgtgaggcagcgcacgtggggcaaatgggtggctgagatccgtgagcccaaccgtggcaaccggctgtggcttggttcattccctaccgcagtcgaagctgcacgtgcatatgatgatgccgcaagggcaatgtatggcgccacagcgcgtgtcaacttcccagagcattccccagatgccaactctggttgcacgatggcaccttcactgctgacgtctaatggggcaaccgctgtgtcacatccgtctgatgggaaggatgaatcagaatctcctccttctcttgtctcaaatgcgccgacagctgcgctgcatcggtctgatgccaaggatgagtttgagtctgcagggactgtggcgcataaggtgaaaacagaagtgagcaatgatttgggaagtacccatgaggagcacaaggccctggaagtattccaaccaaaagggaaggctttacataaagaagcgaacgtaagttatgattacttcaacgttgaagaagttgtcgacatgataattgtggaattgagtgctgatgtaaaaatggaagcacatgaagagtaccaagagggcgatgacgggtttagtcttttctcatattagggttctagctatgagggttgtagtcatgcggagcaatagggataacttcattctagctgctaggaaatacttcaaattatctgcaacctgaagctttgtagtcacttatggttttaatcttactggagagaatagctttataccataagtcaacgggtacaagaagttgtcctgtgtgtcgagttcatgtactgtggtaaaaattgagtccatatttaatgagcttactctgttga

SEQ ID NO: 7670 - DNA, 1068 bp, Hordeum vulgare
  Predicted polypeptide sequence is orthologous to G129, G136, G140, G146
acgagaagctggctacaccatccacaggcctaatggtgaaggagtccgtgtccccgggcttgggatcggcgggtgctgctgctgagaagatggggagagggaggatcgagatcaagcgcatcgagaacacgacgaaccggcagctcaccttctgcaagcgccgcaacggactcctgaagaaggcgtacgagctctcggtgctctgcgacgctgaggtcgcgctcgtcgtcttttccagccgcgggcgcctctatgagtactccaacaacagcgtcaaggcaaccattgagagatacaagaaggcaactagtgacacctccagcgctggtacagtcgcagagatcaatgcccagcactaccagcaggaatctgcaaagctgaggcaacagataaccaccttgcagaactccaacaggactctaataggcgataccatggctaccatgagccacagagacctaaagcagctggagggaaggctggacaaaggcctaggaaagattagagcaagaaagaatgaattactaagcgctgaaattgagtacatgcagagaagggaaatggagctgcagaataacaacttctacttgagggaaaaagtcgctgagactgagagggggcaacagcagacgttgaacatgatgggggcggcttccacatctaatgagtacgaccaaaatatgatacaatgtgatccgagaaccttcctgcagttcaacatcatgcagcagcctcagtactacacccagcaggaggatagaaaaaccctcaactcagttgagaggtgatggatgcatccatgcatagctgtgtctctcatttacttcaagtgagattgaagctatatccgtgcactataactagaacttccttgaatgcatgtgtgtatttctatacacccccaatcaattttatcccataattaaggcttggccacaccaatgcaatgtatccatatgtattgcgatgaaacgacttaactctttcagtgcaacgcacgtacttcttcgcatatatctatgtaggagtacctttttctaaatgcaatactactggtggcgatttcat

SEQ ID NO: 7671 - DNA, 1163 bp, Hordeum vulgare
  Predicted polypeptide sequence is orthologous to G129, G136, G140, G146
tagagagatcctccttccgtagcatccatgatgagcatgatggccgatttgagctgcggagcttccggtgtgaccgtgaatgatcatcagctgacggctccggctccggaggagtcggcggtggcggggagcgagaagatggggaggggccggatcgagatcaagcgcatcgagaacaccaccaaccggcaggtcaccttctgcaagcgccgcaacggcctcctcaagaaggcgtacgagctctcggtgctctgtgacgccgaggtcgccctcgtcgtcttctccagccgcgggcgcctctacgaatactcaaacaacagtgtgaaagccaccattgagaggtacaaaaaggccaacagtgacacatccaactctggcacggttgcagaagtcaatgcccagtactaccagcaggagtcctccaagctgcgccagcagatcagtagcttgcaaaactcaaacagtaggtcactggtgagagattctgtcagcaccatgaccctgagggatcttaagcagcttgaaggcaggctggagaaaggcatagccaagataagagctagaaagaatgagctgatgtatgctgaagttgagtatatgcagaagagggaaatggagctacataacgataacatttacctgaggagcaaggtgtctgagaatgagaggggtcagcagccgatgaacatgatggcgtcggggtcgacgagcagcgaatacgatcacatggtcgcgccgtatgattccagaaacttcctgcaggttaacatgcagcagcagcagcattactcccaacagctgcagccaactgcccttcagctcggccagcagtacttcaactagttttgctccacaccctgcagtccacgcacgctagataatactgtcgcgtgcatgtgtgcttgcaatgtcgttgctcgttctccggtggtataacagtagtaaccggaatttgtggatcagatgcatgtgggactcgtaatatatatgtatgtatttgctcatgagcaactagctaggtgctgctagtcgatcaccacacaagtggtcgatttcggcgtgcaccatcgcgttgcatatcttccccaatgtattaattaattaccagcatttcgaattgtgtaccgaaaatcaatggaccagggattgacgaagggctaact

SEQ ID NO: 7672 - DNA, 1540 bp, Hordeum vulgare
  Predicted polypeptide sequence is orthologous to G131, G135, G155
agacacaactcagatctcagagataaattatacagcgaatcatgaagttacaggtagagcttcaaagatgatcacgaaacgttcatgttacacaccaaatatgtcataatgcgtaggccataattcacaagcaccataataattcatgtctctcaagcaaatatatacatatacagagcaaaccacaccatcacaccgcatttctcagtcttcctcctcacatcgccgtaccagctagctagttagccgggagagaggggccggcgccgccgagcgagagagccggagggggcggggtggaggcagggcggagatggggcgcgggccggtgcagctgcggcggatcgagaacaagataaaccggcaggtgaccttctccaagcggcgcagcgggctgcttaagaaggcgcacgagatctccgtgctctgcgacgccgaggtcgcgctcatcgtcttctccaccaagggcaagctatacgagtactccagccaggacagtagcatggatgtgattcttgaacgttaccaacgttactcatttgaagaaagagctgtactggatccaagtactggagaccaggcaaattggggagacgaatatggaagtttgaagataaaactcgatgcactccagaagagtcaaaggcaactcttaggtgaacaattggacccactcaccacaaaagaacttcaacagttggaacaacagcttgatagttctttgaagcacataaggtcaagaaagaatcaacttctctttgagtcaatatctgagcttcaaaagaaggagaaatcattaaaagatcagaatggcgtcctgcagaagcacctcgtagagacagaaaaggagaaaaataacgttttgtcaaatattcatcaccgggagcagttgaatgaagcaacaaatattcatcaccaggagcagctgagtggagcaacaacaagctcaccgtcacctacaccaccgacggcccaagattccatggcacctccaaatattgggccatatcaatctagaggaggaggggatccagaacctcagccgtcaccagcacaagcaaacaacagcaatctgccaccgtggatgctccgcaccatcggcaacagatgaaggctggcgacagcctcatacgactccacctgaaggcgacaatggcgcctgacacgcgcccactatggaagctagctgccggtgtgcagtccatctccggcaatggcttccggtgtagccaccaataagaccatgtgtctttgctacagggtgaatggggtcttcctgtcttgagcttttcctgcactatagggagcagtgtcttgtttccacgtttcagttccctttttttcgctgatcgatgagcacgatcttgtggttggactttcgtgtgtaagctttaatggatttgcggtatggttttacacgttgacacggtttttgtattccatccgttgtaaaaatgcaaaagggcgctgccttctctttatattgttattaaaagagtagggcactgtacttcttgcaaaaaaaaaaaaaaaaaaaaaa

SEQ ID NO: 7673 - DNA, 1196 bp, Hordeum vulgare
  Predicted polypeptide sequence is orthologous to G131, G135, G155
ctctcccctcccacttcacccaaccacctgacagccatggctccgccacctcgcctccgcccgcgcctctgagagtagccgtcgcggtcgctcgctcgctcgctcgctgctgccggtgttggcccggtcctcgagcggagatggggcgcaggaaggtgcagctgaagcggatcgagaacaagatcaaccgccaggtcaccttctccaagcgccgctcggggctgctcaagaaggcgcacgagatctccgtgctctacgacgccgaggtcggcctcatcatcttctccaccaagggaaagctctacgagttctccaccgagtcatgtatggacaaaattcttgaacggtatgagcgctactcttatgcagaaaaggttctcgtttcaagtgaatctgaaattcagggaaactggtgtcacgaatataggaaactgaaggcgaaggttgagacaatacagaaatgtcaaaagcatctcatgggagaggatcttgaatctttgaatctcaaggagttgcagcaactggagcagcagctggaaagctcactgaaacatatcagagccaggaagaaccaacttatgcacgaatccatttctgagcttcagaagaaggagaggtcactgcaggaggagaataaagttctccagaaggaacttgtggagaagcagaaggcccaggcggcgcagcaagatcaaactcagcctcaaaccagctcttcttcttcttccttcatgatgagggatgctccccctgtcgcagataccagcaatcacccagcggcggcaggcgagagggcagaggatgtggcagtgcagcctcaggtcccactccggacggcgcttccactgtggatggtgagccacatcaacggctgaagggcttccagcccatgtaagcgtactattcagtacgagtaacaagttgcagcggccagcctggtgtatcatgcggttgcgaacatgctaaccccatggaggggagaggaaaagaaatcagagtaaagcagcaagctgcaggaatgtgtatatttcacttcgtccacctcagtttcctttccacctgggctgagatggctgtacgagtaatctaccatgtaatttatatgtagcatgagtgacgaattttcaactttcgatgatatccgttgctcctgggtgttgtttctgtgaattaacctatcgaatatgagcgttgtg

SEQ ID NO: 7674 - DNA, 1203 bp, Hordeum vulgare
  Predicted polypeptide sequence is orthologous to G131, G135, G155
cgtggcgcgcacagcagccgacacctagatcgtgaaatcgggatgggtcgcggtaaggtgcagctgaagcggatagagaacaagataaatcggcaggtgaccttctccaagcgccgcaacgggctcctgaagaaggcgcacgagatctccgtcctctgtgacgcagaggtcgccgtcatcgtcttctcccccaaaggcaagctctatgagtacgccaccgactccagcatggacaaaattcttgaacgttatgagcgctactcttatgctgaaaaggctcttatttcagctgaatctgaaagtgaggggaattggtgtcatgaatacaggaaacttaaggcgaagattgagaccatacagaagtgtcacaagcacctcatgggagaggatctggattctctgaacctcaaagaactccaacaactggagcagcagctggagagttcattgaagcacatcagatcgagaaagagccatcttatgatggagtccatttctgagctacagaagaaggagaggtcactgcaggaggagaacaaggccctacagaaggaactggtggagaggcagaaggcggccagcaggcagcagcagctgcagcagcagcaacaacaacaacaaatgcaatgggagcaccaagcccagacccaaacccatacccatactcaaaaccagccccaagcccagactagctcatcatcttcctctttcatgatgagggatcagcaggcccatgcccctcaacagaacatttgtagctacccaccggtgacgatgggtggggaggcgacggcggcggcggcggcgccggagcagcaggctcagcttcgcatatgcctaccgccatggatgctgagccacctcaacgcttgaggaaggaagaggtttaattgccaaagcagctgaaacagcattaatcggcacactagcaattaagctgctatggttatgtttgcttgcccctacccttatatatatgatttgcaagaaaaaaaatgagcagagagatcaggaatgctggttcgctgtataattttgttgcatgttcagcaacacgtaccaattgatgcaaacatgcatgcttagcaaccaaccaattaccttagcatggatgacttgcttggcttaattatggaaagctaggttgcatgatgacgtgtgtatatatatgatatatttttatattttatctgaaatctaacg

SEQ ID NO: 7675 - DNA, 1151 bp, Hordeum vulgare
  Predicted polypeptide sequence is orthologous to G131, G135, G155
cctcccacttcacccaaccacctgacagccatggctccgccacctcgcctccgcccgcgcctctgggagtagccgtcgcggtcgctcgctcgctcgctcgctgctgccggtgttggcccggtcctcgagcggagatggggcgcgggaaggtgcagctgaagcggatcgagaacaagatcaaccgccaggtcaccttctccaagcgccgctcggggctgctcaagaaggcgcacgagatctccgtgctctgcgacgccgaggtcggcctcatcatcttctccaccaagggaaagctctacgagttctccaccgagtcatgtatggacaaaattcttgaacggtatgagcgctactcttatgcagaaaaggttctcgtttcaagtgaatctgaaattcagggaaactggtgtcacgaatataggaaactgaaggcgaaggttgagacaatacagaaatgtcaaaagcatctcatgggagaggatcttgaatctttgaatctcaaggagttgcagcaactggagcagcagctggaaagctcactgaaacatatcagagccaggaagaaccaacttatgcacgaatccatttctgagcttcagaagaaggagaggtcactgcaggaggagaataaagttctccagaaggaacttgtggagaagcagaaggcccaggcggcgcagcaagatcaaactcagcctcaaaccagctcttcttcttcttccttcatgatgagggatgctccccctgtcgcagataccagcaatcacccagcggcggcaggcgagagggcagaggatgtggcagtgcagcctcaggtcccactccggacggcgcttccactgtggatggtgagccacatcaacggctgaagggcttccagcccatgtaagcgtactattcagtacgagtaacaagttgcagcggccagcctggtgtatcatgcggttgcgaacatgctaaccccatggaggggagaggaaaagaaatcagagtaaagtagcaagctgcaggaatgtgtatatttcacttcgtccacctcagtttcctttccacctgggctgagatggctgtacgagtaatctaccatgtaatttatatgtagcatgagtgacgaattttcaactttcgaaaaaaaaaaaaaaaaaaaaaaa

SEQ ID NO: 7676 - DNA, 1166 bp, Hordeum vulgare
  Predicted polypeptide sequence is orthologous to G133
attcggcacgagtccatccacccctcctttactaaaccagcagctggagaaggagcagcagcagctagccgatctccttccctcgtccactttcttctccgcgcatcgctgcgccgcgcgcgcgacctagctagcaagctcgctcgctcgcaggcggtggccgcccgtgcgggcgcgcgcgcgattgcggggacggaggaggtggatcggccggcggagatggggcgggggaagatcgagataaagcggatcgagaacgccaccaacaggcaggtgacctactccaagcggcggtccgggatcatgaagaaggcgcgggagctcaccgtgctctgcgacgcccaggtcgccatcatcatgttctcctccaccggcaagtaccacgagttctgcagcaccggcaccgacatcaaggggatctttgaccgctaccagcaggccatcgggaccagcctgtggatcgagcagtatgagaatatgcagcgcacgctgagccatctcaaggacatcaacaggaacctgcgcaccgagatcaggcaaaggatgggtgaagatctggacgcgctcgagttcgaggagctgcggggccttgaacaaaatgtcgatgccgctctcaaggaggttcgccagaggaagtatcatgtgatcaccacacagactgaaacctacaagaagaaggtgaagcactcccaggaggcatacaagaatctgcagcaggagctgggcatgcgcgaggacccggcgtacgggttcgtggacaacccggcggcgggcgggtgggacggtgtggcggcggtggcgatgggcggcggctcggcggctgacatgtacgccttccgcgtggtgcccagccagcccaacctgcacggcatggcctacggcggctcccacgacctgcgccacctgcgcctcggataatcgatcacctcgatcgctcctgctagcttatgtatcaagtgatcgattaagttaccacaataaaaggaaaacattgtgcgtttgtatttgtgatatgttgtggtctcgtgcacacgatttagttcaatgtgtaattaacatcgtagtgctcgactgtgtattgtatgatctgctatgactttggttgtgaactagctacttgctactactatcatatatattttggtaccttgtgatgaccatttcat

SEQ ID NO: 7677 - DNA, 965 bp, Hordeum vulgare
  Predicted polypeptide sequence is orthologous to G134
cggcacgagctccacagagacaagggaggagaggtgtcctctgggtcttttgggtgctccgctcctaggtcttgtgccttcccggcgagtagcttgttgagatggggcgcggcaagatcgagatcaagaggatcgagaactcgtccaaccgccaggtgaccttcgccaagcgccgagccgggctggtgaagaaggcccgcgagatcggcgtgctctgcgacgccgaggtcggcgtcgtcatcttctccagcgccggcaagctctacgacttctggacgcccaagaccacgctgccgaggatcttggagaagtaccagaccaactccggcaagatcctgtgggacgagaagcacaagagcatcagcgcggagatcgacagggtgaaaaaggagaacgacaacatgcagatcgagctcaggcatatgaaaggcgaggatgtgaactccctgcagcccaaggagctgatcgccatcgaggaggcgctcaccaacggccagaccagcctcagggacaagatgatggaccactggaagatgcacaggaggaatgagaagatgctggaggaggagcacaagctgctggctctgaggatgcaccagcaggacgtcgagctgagcagcggcatgagggagatggagctcgggtaccatcagggtagggatttcacttcccagatgccgttcaccttccggctgcagcccagccaccccaacttgcaggaagacaagtaggccgctaaatcatgccatggcctgtctgaactggtgctccatctacctgcaggctgcaactgctagcttcaatttccttgggcaaccttaaatgtatcttccttttcatgtctggcttgatgaacttaccagtgctagttgtttcccaacacataaattttaattaagacagttgatgccaagatgttcctggtcttaggactggaaaacaaggaacttggtatatcatgcttc

SEQ ID NO: 7678 - DNA, 917 bp, Hordeum vulgare
  misc_feature (742)..(742): n is a, c, g, or t
  misc_feature (917)..(917): n is a, c, g, or t
  Predicted polypeptide sequence is orthologous to G137, G145
gagaactagatcaaccgccaggtcaccttcgccaagcgccgcaacggcctgctcaagaaggcctacgagctctccgtgctctgcgatgccgaggtcgccctcatcatcttctccaaccgcggcaagctctacgagttctgcagcggccagagcatgcccaaaacacttgagagataccaaaaatgcagttatggtgggccagatacagcaatacaaaataaggagaatgagttagtgcagagcagtcgaaacgagtacctcaaactgaaagcacgagtggagaatttgcagagaactcaacgaaatttgcttggcgaagatctcgggtcacttggcatcaaagatcttgagcagctcgaaaagcaacttgattcatccttgaggcacataagatccacaaggacacagcatatgcttgaccagctcactgatctccagaggaaggaacaaatgctgtctgaagcaaataagtgccttcgaagaaaactggaggagagcagccagcagatgcagggccaaatgtgggagcagcatgccgccaacttgctcggctacgaccatctgcgacagtccccgcaccagcagcaagcgcaacaccacggcggcaacgggctctttcaccccctggaccctaccactgagcctacacttcagatagggtatactcaagagcagattaacaacgcgggcgtgggggggtccctcatgccgactggctgccctgagatcgatgatcaagcangcaataaagtgcagacgggcttgaccttcggcgttggatctctcctacgtatttccgggcgacgggagcatagacgcgtccgacgctatagtcggtgggggttggccctggtgaaactttggaaccggttgtaatctgctgcaaaggcgccgtctccctccgtatagcgggttgn

SEQ ID NO: 7679 - DNA, 984 bp, Hordeum vulgare
  Predicted polypeptide sequence is orthologous to G137, G145
cgactttacgcagccagcagagagtagagagagagaaagaaagaggggaggaggaggaagaaggaagatgggtcgtgggaaggtggagatgaggcggatcgagaacaagataagccggcaggtgaccttcgccaagcgccggaacgggctgctcaagaaggcctacgagctctcgctgctctgcgacgccgaggtcgccctcatcatcttctccggccgcggccgcctcttcgagttctcaagctcctcatgcatgtacaaaactcttgagaggtaccgcacctgcaactccaactcacaggaagcaacacctcaggtagaaaatgagattaattaccaggaatatttaaagctgaagacaagagttgaatttcttcaaagttcacaaagaaatattctcggtgaggatctgggcccacttagcatgaaggagcttgaccagatagagaaccaaatagatgcatccctccagcatatcaggtcaaaaaagaatcaagtattactcgatcagctatttgaactgaaaagtaaggagcaagaattgcaggatgaaaacaaagacttgaggaagaagctgcaagacaccaccaccaccagctgcggagagaatgcggtccatatgtcctggcaagacggtgggcagagtagctccagaaggcatgccactgagccttacccgggagtactccaacacccggagcatgatacctccatgcaaattgggtatcctcaggcctacatggaccagctgaacaacagagatcacatggcttcacagcgccctggtggacatcctggatcgtctgcaggttggatatgattaactgatgtggagctgcgtcccgtcaccgtgtactgtagctattgtatttggacttgagtgacaattgctatgttcttttgtgtgtgtaccggagttgtggtggtgagcaccacatgtatctactgaaattacgtgtatgctaagctgcgttgtacgctgcg

SEQ ID NO: 7680 - DNA, 1140 bp, Hordeum vulgare
  Predicted polypeptide sequence is orthologous to G137, G145
cgggagggtggagctgcctgctcctcccccacccccttatcttcctctcccttcttgctaggagtagtacgcttggtggtggtggtggtgcatgtgtatggttgctgcagcatagctagggacagggaaggtggaggaagcagcagaggcgtcggccatggggagggggagggtggagctgaagcggatcgagaacaagatcaaccgccaggtcaccttcgccaagcgcaggaacggcctgctcaagaaggcctacgagctctccgtgctatgcgacgctgaggtcgcgctcatcgtcttctccaaccgcggcaagctctacgagttctgcagcacccagagcatgacaaagacactggacaagtatcaaaaatgcagttatgcaggacctgaaactactgtgcaaaacagagaaaatgagcaactgaaaaacagccgcaatgagtacctgaaactaaagacacgggttgataatttacagcgaacacaaaggaatttgcttggtgaagatcttgattcattaggcataaaagagcttgagagccttgagaagcaactcgattcgtccttgaagcacattagaacaacaaggacacaacatatggttgaccaattgacagaactccagagaagggaacaaatgttttcggaggcaaataaatgtcttcgaataaaattggaggagagcaaccaggttcatgggcagcagctctgggagcacaacaacaacgtactgagctatgaacgtcagccggaagtgcagccgcagatgcacggcggcaatggattcttccacccccttgatgctgctggtgaacccactcttcacatagggtaccctcctgagtccctgaatagctcatgcatgactactttcatgcccccgtggttgccttgattgaaaacagctagcgaagaaagtgtgaaaaataagtatatacgtggcacctggccggccgcatatatgcatgtataccacttcgagtgatggactattccagtcaagattctcagttattttgcgtgcaactttcgtgtgatgaaaattccagaaccctgtatttgatgctcaacgttattgtgttattgcgtgtaaaagatcatacattatattactactagagcggctatgtatgcgcg

SEQ ID NO: 7681 - DNA, 1464 bp, Hordeum vulgare
  Predicted polypeptide sequence is orthologous to G142, G148
aggtggcgtgggggacgcagcattggatcgccctcattccgtcccgtgcttccagttagggtaaacccgtggtaactgccccaaagttaccctcctgtaaagttgagagagagggcgcgcgacagggatgtgtcaagcgagatcgacgcaagaaaccagcaccgagctacagtaactgtaccccccctgcctgcttgctcccctttttttcccttgcctccactaatatcccgcgccccattatatgctggggcatcatcgcttcccagcccaagccctatgtgttagtaggtggcaccgccggaggaagagcgcagagctagcttgctgatcggtagagctttgcttccttgcttgcttgggaggaggaggaggaggaggagatcatggggaggggaagggtcgaactgaagcgcatcgagaacaagatcaaccggcaggtcaccttctccaagcgccgcaacggcctcctcaagaaggcctacgagctctccgtgctctgcgacgccgaggtggcgctcatcatcttctccagccgcggcaagctctacgagttcggcagcgccggcacaacaaaaacattggagaggtaccaacactgctgctataatgctcaagattccaatggtgcactatctgaaactcagagctggtaccaggaaatgtcaaagctaaaggcaaaatttgaagctttgcagcgaactcagagacacttgcttggggaggaccttggaccgctaagcgtgaaagaactgcagcagctggagaaacagctagaatgttcactgtcacaggccagacagcgaaagacgcaacttatgatggagcaggtggaggaacttcgcaggaaggagcgtcagctgggagacatcaacaggcaactcaagcacaagctcgacgctgaaggcagcaacagcaacaactacaggaccatgcagcagatcacctgggctgccggcaccgtcgtcgatgaaggcgccgccgcatatcacatgcagcagcagcagcagcagcagcagcagcaccctaatcattccgctgcgatggactgtgaacccactctgcaaattgggtaccctcatcatcagttcgcggctcctgatcaggtagccaataatattccacggagcagcgcccccggaggggagaacaacttcatgctggggtgggttctttgagctatctggctgctctagcagcagctggttagcttgggtgtccaccagccaagaaaccaataaaatgcgcgtgctgctccgatgctctacacgagaagtaccctgcgtggcgcgttcccatttctttatttttactcgttgttcgtgtgtaagaagtaagaaccgatgcaggaactacttctatattttcagtgtttgaactacatggatcttgcaaaagacttgcaagctctaagctgtccattcatgcatgctcagttatctagtacaaccataatttctggac

SEQ ID NO: 7682 - DNA, 571 bp, Hordeum vulgare
  Predicted polypeptide sequence is orthologous to G154, G627, G1011, G1797, G1798
aaagcttggaggtcaaaattgacaaaagcctcctaggcatcagggcaatgaagactcggcggtttgaagagcagctctctgcgttgaggctcaaggagacgaagttgcggcaggacaatgaagatctgtatatccagtgccagaaggagcagcaccttgagttggaggcgccccctgctccggtgaccatggcggagcagggccaggacgacgcggttgaagtggagacggacctatttcttggactgcccggcaccggccgcccctgagatggagtctccaggctttggaggaaaatgcccagaataagctggccatggagttgcaagcagcagcaagcaatcgatgcggacggcgtatatagatataaaccctgtggagccgaaaccttgagagtacatacatgagttagttgatgtcgtcgtttccccgggtccttcctggccgtggtgtgccgatgtcttgatgagatgagaggaacaggacgatcctctggagaagaaagtggcggagaggggcgaaaaggatatttatggtgcccaaaaaaaaaaaaaaaaaaaaaaaaaactcg

SEQ ID NO: 7683 - DNA, 808 bp, Hordeum vulgare
  misc_feature (726)..(726): n is a, c, g, or t
  misc_feature (737)..(737): n is a, c, g, or t
  misc_feature (746)..(746): n is a, c, g, or t
  Predicted polypeptide sequence is orthologous to G156
tcgacccacgcgtccggcgacgcgcgcgtcggcgtcgtcatcttctccagcaccggcaggatgttcgagtactccagccccgcctccagcttgagggatctcattgagcagtaccagaacaccaccaacagtcagttcgaagagattaaccacgatcagcaaatatttgtggagatgacacggatgaggaacgagatggagaagctggaggatggcatacgcaggtacaccggcgacgacctctcctccctctccctcgtcgacgtcaacgacatcgagcagcagctcgagttctccgtcgccaaagtccgtgcaaggaagcatcagctcctgaaccagcagctcgacaatttacgtcgcaaggagcatatcttggaagatcagaacagtttcctgtgccgcatgatcagcgagaaccagcatggcggtgatggaaagatggcggtgatgccgccggtgctgtcgatgctgacgccggccttcccggcgacgccgtactacacgggcgaggagtcgtcgagcaccgcgctgcagctgacgtccccgcagcttcagctccacgccgccgaagccgccgggttccggctgcagccgacgcagcccaacctgcaggacccggcgtgcagcagcctccacgccggccacggcctccacctctgagatttgatcatctgatcatcacgggcgcggtgatggacatgctgattcatggattctaggaagaanaagatcacggncgatggaanattgacccttatgatgcatgcatgaggatgactatttaatttgggagctatatgtatgtatg

SEQ ID NO: 7684 - DNA, 579 bp, Hordeum vulgare
  Predicted polypeptide sequence is orthologous to G184, G186, G916
ggtcctccgactcggtggacgccgggcagttcgcgcagcctaggcagcccatgggcctgccaggccagctgtccgacagcgtcagtgcagcggcggctgcgatcaccgcagacccaaacttcacggtggcgctcgccgcggcaatctcgtccatcatggccggccagcacgccgccggcaacagcaacgcgaacaacaacaacaccactaagaacaacgtgacgacgaccagtaacaacacgacgagcaacaacaccaacagcgagactcaatgaatggctttggtcaagttggaaaagagttgagaaaccagatagctagattgcaagttatacatggatggtgttccattcttctttggtcaggattagcttctcgagaagtttgtttggtcttgataccaagcatgatatacgatcactccttttcttttgtgattttgcggcagcaaaaaaaaaagttgtattagttcattccttccccttagttctttttcatcgcccacagctgttgatatttcactgtaatgaatatagttatagtaataagtaaaataatggtgcctcgggaaaaaaaaaa

SEQ ID NO: 7685 - DNA, 722 bp, Hordeum vulgare
  Predicted polypeptide sequence is orthologous to G185
ctccggtctacacacacacacacactcacgcatccttccgatcttacatttgctctggaaatcagggaggaatccaccttacaccggcgaggaagaagttccgagcaaagagagatggaggcagtggaaggcaatggaggagggagcggcctggtggtgacggagctgagccacatcaaggagctggtgaagcagctggacgtgcacctgggaggctcgccgggcctctgcaagcacctcgcccagcagatcttcgccgtcaccgagaagtccatcggcatcatcaggtccggccacttcaactgccccaagcgctcggccgccggcgccggcctcgactcgccgccgctgtccgcgacgcccagccccgtcagcggcgtctccaacacgccgttcaagcccaacaagaagaggaagacgtcggagaaagggcggcatcagatcagggtgagctcggcgggaggaggagcggacgccccggccgacgacggccacagctggaggaagtacggccagaaggacatccttggagcccatcacccaaaggcgtactaccgttgcacgtaccagaagacccaaggatgcgcggcgacaaaacatgtgcaacgcgccgacgaagacccggcgctcttcgaagggatctacccccggcgagcccacctgccttcacaagagggcggcgggcctggtgcaacccggacgggcataaccaggtacgcccg

SEQ ID NO: 7686 - DNA, 550 bp, Hordeum vulgare
  Predicted polypeptide sequence is orthologous to G188
tcgacccacgcgtccgctctactaccgctgctcgtccagtggcgagggctgtgccgcatctcggcgggtgcagcggtcgcaagaggatcccgcggcgttcattatcgcctactacggcgagcacacctgcggagccggcctcggcgacgcgtgccagcagcaacgggcggcaccagcgcctcctaccgtcgttgacaccggctcaatcgctcgtggaatcgtcggtgccgacaactggaacaggaactctcctctgctgctaccgctctcggccgagcacagcgcccatgcggcgcccggcgacacgtcgcggcgatggttgtcgccgtcgtcctcctcgtcctactcgtcggaggtggaaggggagcttggtgcttctcctgtcgaggagtttctcgatggcaacttcgactgggaatgggagactgtcgtcaactccctccgtttcggtgatctgcttcagtagagcttagtagatgcctgcctcagcgtgcgacacacacaacctctgcactatttggtggacagatcgggagtaaaaaaaaaaaaa

SEQ ID NO: 7687 - DNA, 544 bp, Hordeum vulgare
  misc_feature (431)..(431): n is a, c, g, or t
  Predicted polypeptide sequence is orthologous to G196
gaaaatggatgtcccataaaataaacctggaagagggggaacaactactaactactagccccgcctgtccttaacaaaaaataagggtgctaccatcatggtgctagcgctgatgctggcgcttcaggcacccgtgacgccggcccgcttttttccaactccaggccggacgactgtccgcctggatactcacgggaatgcatatcgttggccggcaatcatttctgcggtgcgcacagatctcagcttgtggcggcgagaccagagaagaatggtcgcatgttgaccagctagattgcccaccaggccaacagtgtggaagtcccatttcggtctgggcccctgcgaatgcatgtagctagccggtacctatatcctagcaataatggccatgcatcaaacatgaattacactgtgtgcatattgcatgntatgctgctcggagtagtactgatgctactcgtgtcgttgtaaaggctaccttcttataccaaccaataaaataagggcaaggctctgaaaaaaaaaaaaaaaaaaaattcct

SEQ ID NO: 7688 - DNA, 700 bp, Hordeum vulgare
  Predicted polypeptide sequence is orthologous to G196
gctcgagcggccgctacctttctcattaatcactcaacagaaagataacagagttttcatccttattacaaccatctccaacactgctaagcaacatactaaagcaagaaagtaggaaagagagagcgagttggggtactactagtaaaccactatagatgctcgacctcgaaacatctatcacaggtcaaaaatctgatagcaccacaatcaccaaataacaccataacaatatcagaacacaatgcgccaaagaacaaagtcaacagaagcacaaaatcacaatcagatagaatcctccgcttcttggggacatcaaagcaacaaagaagcgacttcaaggaatcccccgcgcaccatgatatcttcctttcaacaattgagcaggtccacatgcagcggtgtcaactgatacgccagcgatgtagcttctttcaacacgcccgtactactgtactagccagcggccgctggccacagtagtgttatataacttacgattatcaactctgctgttaagctataacaattaattccaatcacagcgggactcacagttcaaatgctaaaacggtgtgtgagcataacaattatctattttatctctagaaaatggtgcaggtaaagacataggtgcttacatagttgagttcagcttaaagcctctttcgataaagaagagggggggacagttaaaacc

SEQ ID NO: 7689 - DNA, 1284 bp, Hordeum vulgare
  Predicted polypeptide sequence is orthologous to G197, G255, G664
ccgcaaacaaaatggagcagcaagagagcatcggaagaagaagaagatcttgccgaaacagggcaccgccggcaagatcatcattctttctccttcctgcatctctctctcttccactcctgcaaaccccaacccaacccaacccaacccaccaccgagaagcacgaggaagaaagaggacggtgtcatcggcggcggaccatctaaagcgatggggaggtcgccgtgctgcgagaaggcgcacaccaacaagggcgcctggaccaaggaggaggacgaccgactcaccgcctacatcaaggcgcacggcgagggctgctggcgctccctgcccaaggccgccggcctgctccgctgcggcaagagctgccgcctccgctggatcaactacctccgccccgacctcaagcgcggcaacttcagccacgaggaggacgagctcatcatcaagctccacagcctcctgggaaacaaatggtccctgatagccgggagactgccggggaggacggacaacgagatcaagaactactggaacacgcacatccggaggaagctgacgagccgggggatcgacccggtgacccaccgcgcgatcaacagcgaccacgccgcgtccaacatcaccatatcctttgagtcggcgcagagggacgacaagggcgccgtgttccggcgagacgccgagcccgccaaggcagcggcagcggcagcggcgatctcacaccacgtggaccaccatcaccgtagtaacccccagcttgactggggccaggggaagccgctcaagtgcccggacctgaaccttgacctgtgcatcagccccccgatccacgaggaccccatggtggacaccaagcccgtggtgaagagggaggccggcgtcggcgtcggcgtggtgggcctctgcttcagctgcagcatggggctccccaggagctcggactgcaagtgcagcagcttcatggggctccggaccgccatgctcgacttcagaagcatcgagatgaaatgagcatagcagagcaccccctctctgctctgctcttctctcccctgtctgtgacgtggagatattggtttagcctgtaggtgaaaatacagcgagcgaaagagagagagatgcaggaaggagaaagaatgatgatcttgccggcggtgccctgtttcggcaagatcttcttcttcttccgatgctctcttgctgctccattttgtttgccccgttgtaaaaaaagaaaaattaccgtttgactaatcatgagcaaaaaaaaaaaaaaaaaa

SEQ ID NO: 7690 - DNA, 1102 bp, Hordeum vulgare
  Predicted polypeptide sequence is orthologous to G197, G255, G664
gctagctggtaggaggagctaggatcgaatcggatcgaccggcatggggaggtcgccgtgctgcgagaaggagcacaccaacaagggggcgtggaccaaggaggaggaccagcggctgatcgcctacatcagggccaacggcgagggctgctggcgctcgctgcccaaggcggcgggcctgctgcgctgcggcaagagctgccgcctccgctggatgaactacctccgccccgacctcaagcgcggcaacttcaccgacgacgaggacgagctcatcatccgcctccacagcctgctcggcaacaagtggtctctcatcgccggccagctgccgggcaggacggacaacgagatcaagaactactggaacacgcacatcaagcgcaagctcctctcccgcggcatggacccgcacacgcaccgcccgctcacggccgtcatcgacgccgccgcgccgacccgcccggcacagatagccgtgccggcgagggcggcgcccaccacgatgttcgccctgccaaccaaacagcagcagccgccggtgccggtcgagtcgtcggacgacgacggcagcagcggcgcgacgagcaccggggagccacggtgccccgacctcaacctcgacctgtccgtgggcccgccggcggccgacacgccgacgtcgcacccggtctgcctctgccgccacctcggcttccgcggcggggaggcgtgcagctgccggcaggccgacagcgcgggctcccagggcggcggctttagatatttcaggccgttggaggagggccagtacatatgagagacgacgggacggctaggccctagaactccacagcaatttgtaagacagggaaatttttctacttactcctcctccagtccacagcacctagcgctgctggctggctcacaaaacggtgaaaacaaaatctaatctgttcatatccttccttgtacgccaaaaccgcgaatttgtccgctctcttttgttgttggttggtgctgttgcgttgggtgggaaaaaccaggggataatgtgacaaaggttggtgtgtattttgtggaaaaagggagggcctgatgtgaggcagcgaccacggtc

SEQ ID NO: 7691 - DNA, 969 bp, Hordeum vulgare
  Predicted polypeptide sequence is orthologous to G197
ttcgacactcttacttatcgaaaggactaagattgatcccctatacttgtgggtcatcaagactcttttctggcgctgttgccggggagtgaagcgcctttggtaagtggaacttggtaaggaaacattcatatagtgtgctgaaatttgttctcacttgtcactatggatactaatcctttgaggggcttgttcggggtatcttcacctcgaacagaagcacaaagagttgctcctcaacctgctgcacctagtgaaaatatttgctttgaatttccttcgggtatgcttgagaaactgttggctcatccttttataaaagatggaacatcacatccagacttgcatctgatctatgtggacgaagtttgtggtttatttaagcttgcaggtgtgcccgaggatgaggtcaagaagaaggtctttcctttatctttgaaggataaggcattgacatggtataggctatgtgatgatactggatcataggactacaatcggttgaaattggaattccatcaaaagttttatcctatgcatttagtacatcgtgatcggaattatatttataacttttggcctcgtgacagagaaagcatcgctcaagctccgggggaggcttaaatcaatgctatattcaagccccaatcatgagctctcgagagaaattatcattcagaacttctatgctcgactttctcatgatgatcgcaccatgcttgacacttcttgtaccgattctttagtgaagagagatattgacttcaaatggaatttattggagagaattaaacgcaactctgaagattgggagcttgaagaagatctaggtcaagatgtcttctcgggattcagagggggagagctatgtggctgattaccttgctaaccccaaggtctatggggacttggatccttatggctggaccactgatgaggaagaagactatgatcccaaggggaaggaac

SEQ ID NO: 7692 - DNA, 863 bp, Hordeum vulgare
  Predicted polypeptide sequence is orthologous to G200
tgccggccatggaccgttgagatatattaggctaggctaggtgtgttgtgataaatagagatattgtactgttgaactagctatcatatagttgcctagctatattatctttcggcaccgacgacatggggaggccgccatgctgcgacaatggcggcgccagcgtgaagaaggggccatggacgccggaggaggacatcatccttgtctcctacatccagcagcatgggccggggaactggcggtccgtgccggagaacacagggttgatgaggtgcagcaagagctgtaggctgcgggggaccaactacctcagacccggggtcaagagagggaacttggcccagcacgaggaagggatgatgatacgcctgcaggcattgctgggcaacaggggggcgagagtgagcctggctgctgccacggagaacaggtggcggcatgaaggacctctggggaccgccattgggggaggaaggggggggggctgggtgcggcggacacgtggtacataggagtggggggggagcgcggggagagggcacggggagggagacgaagcacgggaggggggagggagggagcagaggagaaaagcgtaagcagaggcggagcgagaaaggaggaggagggagaaacaggacagagacaagagagaaagaagaggaaaggggagaggggggaagggggggaggggagaagggcgagggagcggggaggggggggttgggggtgaggggggtggggggagggtatgaaagagatggaggaaggatgggggtgggtgttgggggggggcggggcgagggaaacgtgaggagaaatcagggaagaggtggtgaggagaaggaggagaggaggag

SEQ ID NO: 7693 - DNA, 949 bp, Hordeum vulgare
  misc_feature (605)..(605): n is a, c, g, or t
  Predicted polypeptide sequence is orthologous to G214, G680
cagattgaaccgactaaaacagaaatcaaagatatggcagccatggaaaggaggtctacttccgttgatgtggcgaaggatgtaaaagatattaatgaccaggaaatggaaaggaacaacagagtccacatcagttctaaatatgaccgttctcatgaagattgtttggatagctcaatgaaacacatgcagttgaagccaaatactgtggagacaacatacacgggtcaacatgttgcaagtgctccactctaccaaatgaataagactggggcaactggcactccagaccctgaaactgaaggaagtcatcctgatcaaacgaatgatcaagtgggaggagctaatggaagtatggactgcgtccatccaacacttcccgtggatctaaaatttggcagcagctccacagcgcagccctttccccacaactatgcatgctttgcaccaacgatgcaatgccagtgcaaccaagatgcctacaggtcatgtgaagatatgtcagccaccttctgcaacatgcgtcggtccacattgttgtaaaaccccacagtacatgcaactgcagggctggcaggatcatactggccagccgcagacgggancaccgctgtcgatccaaattaaggagttgtggctcaaaatgctcgaggggaacattttgttactcctccaagcgtgggttatgggggtagcagctactgttgctgggggcttcgcacctggtggggcaacaacaagggctttctgccttcgtgttggcttgcgcacgttggctttatgcactttgggcctaggttataacacggtggctgtttcgccaactagaatgtcccagggaagcgtggatagaatcttggccaagaggtgagaggcgcgcagaggagatcccatgatatattgggcggtcgggtggagatgtaaagacttatagtaggggagagggccg

SEQ ID NO: 7694 - DNA, 383 bp, Hordeum vulgare
  Predicted polypeptide sequence is orthologous to G214
atcatatcaacaataccgacgaaatatgttgcaaccctcagataacatacgctacagaacctatcacctttggaacaagatcgtggctcaagcaactacatacaatgtgcattcaagtgtagttctgcccatttgcatattgcattaaggcgtaggactgccctaacctagacacgagtagtacaactatacaaataacacgcacactcagaaatcatgagtaatttcagatcagaaatggtactgcatgtgatgtgagttctagtctcgactactcggcgagttgaaatatgtttgactacttttgaccattcggaccctttactgaagcaagcacatgacgagctagtggaaggaccaaacacagccgccagcggccgcca

SEQ ID NO: 7695 - DNA, 1270 bp, Hordeum vulgare
  Predicted polypeptide sequence is orthologous to G222
ctccgtccatccacgctgcttgcccagcccagctcatcatcccggagcggaatcaactgatcgaatgggacgcccgtcgtccggcgccgtggggcagcccaaggtccgcaaggggctgtggtcgcccgaggaggacgagaagctctacaaccacatcatccgtcacggcgtcggctgctggagctccgtccccaggctcgccgcgctgaaccgctgcggcaagagctgccgcctccggtggatcaactacctccgccccgacctcaagcgcggctgcttctcccagcaggaggaggaccacatcgtcgcgctccaccagatcctcggcaacaggtggtctcagatcgcgtcgcacctgccgggccggacggacaacgagatcaagaacttctggaacagctgcatcaagaagaagctccggcagcagggcatcgaccccgccacgcacaagcccatggcctccgcggacacggcaacggcagcggccgcattgccggacgcagaagaggaagaccgtaagcccctttgcccggcggtcgacggcagcctcgttccgaagcagccggcggtgttcgacccgttcccgctgtgcgtcgactacggcgccgggttcgccgaggaactcggcgcggcgaacgctgcggcattgtatggccagctctgcggcgggaaggaggtcgcggacgacgacgccgggttcggcgccgcggactacagctgcgtgctggacgtgtcggagaacctgggctacggggagagctcgagcaacagcagcaactggaactacggcggcgaggtgggcagcgtgctggacggcgaggtgccgcactgggccaagccggagccggccttcgcggagatggagaggcagcagcagcactcaccggcggagcagaagctttcgctgccctgccaagaacagagcctcctcgcaagtttcgatttcaacctggaattggaaccatacttctgaaattcccccctcttttttcccttcatttttcaccttcttgaatcatatcacgatttccaaccacgtatattcacacgtcaacaggatggcaaggaaccatccgaaagccaattagggattgtacgtagagtacaaacaaagacacacgcttgtttgatttttcacagagacgacaatacggtaagtatgtcgtggaacattgttgtgtaggcgctgcttagtcacggagacgacatatagcaatcaaacacttgtaaaaaataagcacaaacatttatatacatactggagtattac

SEQ ID NO: 7696 - DNA, 796 bp, Hordeum vulgare
  misc_feature (767)..(767): n is a, c, g, or t
  misc_feature (775)..(775): n is a, c, g, or t
  misc_feature (778)..(778): n is a, c, g, or t
  Predicted polypeptide sequence is orthologous to G229
tatagatcagggccgccaaaggaagatcatcgcccatccccttgatctctcacactaactccttttggacgcgagcgcggatcgactacacgtctacacccaccgcgctcgacctgctatagtatctagctagctagcctcggccggcgacaacgggcggtttgctcgtgtgttgggagatatatagggaggctcgtcgtatacaaggggatggggagggcgccgtgctgcgagaaggtggggctgaagcggggaaggtggacggcggaggaggacgacatactcgcaaactacattgcccagcacggcgagggctcatggaggtctctacccaagaatgcagggctactgaggtgtggcaagagctgcaggctgcggtggatcaactacctgagagacggggtgaggaggggcaacatctccaaggaggaggacgacctcatcgtcaaacttcatgccacccttggcaacaggtggtccctgatcgccagccacctaccaggacgaacggacaacgaaatcaagaactactggaactcccatctcagccggcagatccacaccttccggcggatatacaccaccgtcagggacaccaccataaccgtcgacatccacaagctttccgccgcccgggaagcggcgcggcggccggaccccaggccagtcgccaaagagcagttcaaagaagaagcagcccgtgcctgagcccgtcacaacgcaaaggggcacctcgtaacaagcgtcagccccgcctcatagcgacnaagcttanaancgcggtgtccgacccgga

SEQ ID NO: 7697 - DNA, 1180 bp, Hordeum vulgare
  Predicted polypeptide sequence is orthologous to G233, G241
cagaagaagggagcacgggcacggctagcctggccggggtgcctgtggatgccgcggagtgcaagatcctggtcgcacacatccacagccacggccacggcaactggcgcgcgctgcccaagcaagccgggcttctgcggtgcggcaagagctgccggctccggtggatcaactacctgcggccggacatcaagcgcggcaacttctccgacgaggaggagcagtcaatcatccagctgcaccagctgctcggcaacagatggtccgcgattgccgccaggctgccggggaggacggacaacgagatcaagaacgtgtggcacacccacctcaagaagcggctcgaccccagcgcgcaggagcagcaagaggaggccggcgccgccaagaagcgcaagaagccggcggcggcggcggcggcgccgaggaagcgcgacggcaaggtcaagatgaggaacctcaacgcgctgaccgccagggctgcggcggcggcgcccgtgtcctcgcccgagcgctccgtctcatccacggtcaccgagtcgacgtcgaccgcctcggcggcggcggagcagcacggcaactcggggagcagctccgcgtccgcgtccgcgtccgtcaaggaggagtgcttcacctcgtccgaggagtcggaggagttccagatcgacgagagcttctggtcggagacgctgtccatgccgctggacgacctcaacgacgtctgcatggagccccacgacgcgttcggcaagcccgacggcgacatggactactggctcagactgttcatggagggcggcggcggcagcggcagcggcagcgacgacaacaacaaccatgacggcgcgctagacttgccacagatttaggctcctgatgagatgatttgatcgttctttttctctctctctctctacatctgcgtgcgccatcttcgctgcatcggagggattgctaacaggggaagagtttccggcccgccccgtggaggaaaccagtatccagccagcaagaacgctgatcatgcgccgggtagctttcttcgatccattttggttagtcatttaccttgttgtatagaaggagatgatgagagatcagtgttcagtgatcggaaccgatgcattctctgtactatcatggagtttatctgaaatggagtctgtctgtccgcttttcg

SEQ ID NO: 7698 - DNA, 879 bp, Hordeum vulgare
  misc_feature (724)..(724): n is a, c, g, or t
  misc_feature (850)..(850): n is a, c, g, or t
  misc_feature (856)..(856): n is a, c, g, or t
  Predicted polypeptide sequence is orthologous to G233, G241
cccgggctgcaggaattcggcacgaggattcttccttgcagctcagacagcagccatttccttcggactagcgtcaacacactgagcaatccatccatcacacgcacagcgcaagaggtttaattaatcgtccgagaagagcagaggagtgagcaaggtagccatggggaggtctccttgctgcgagaagatggggctcaagagggggccgtggacagcggaggaggacatgaccctggtggctcacatcgagcagcacggccacagcaactggcgggcgctgccgaatcaggccggcctgctgcgctgcggcaagagctgtcgcctccggtggatcaactacctgcgccccgacatcaagcgcggcaacttcaccagcgaggaggaggacgccatcatccagctccacgccatgctcggcaacagatggtccaccattgccgccaggcttcctgggaggacggacaacgagatcaagaacgtctggcacacacacctcaagaagcgactccagtcctcgtccaagccgtcaggccaggcagcgcctaagcgcaaagccaagaagcctgctatggctgcagcgagcacagccgatggctcggcctccgtgccagtgtcgccggagcaacccatctcgtcgtccgccaccgattactcgatggcatcgtcgttggagaacacagacagctttacatcggaggagtttcagatcgaggacagcttnttggtcggagacacttgcaatgacggtggacaactccggttccccgatggacgccggcgtcaccttgggcgcccaagacagtgcatcgccctcgtccacacggaccgaggtgactttctgggtcanactgtncatgcagctgggcgagggcccaa

SEQ ID NO: 7699 - DNA, 717 bp, Hordeum vulgare
  misc_feature (593)..(593): n is a, c, g, or t
  Predicted polypeptide sequence is orthologous to G237, G1309
agccgaagccgaagcctaagccaccggtgctgcgtcccgtaaacctccctgaggtttcgtgcggcgtccgtcgttcgcctgcaagcaagcaagcaagcaatggggtgtaaggcgtgcgagaagcccaggccgagctaccggaaggggctgtggtcgccggaggaggaccagaagctccgcgattacattctccggcacggccacggctgctggagcgcgcttcccgctaaagccgggctccagcggaacggcaagagctgcaagctgcggtggatcaactacctgcggccggggctgaagcacggcatgttctctccggaggaggaggagacggtgatgagcctccacgccgtcctcggcaacaagtggtcgaggatcgcacggcatttgccggggaggaccgacaacgaggtcaagaactactggaactcctacctcaagaagagggtcgagggcggcaagggagcgcccaactcgcccacgccggcggcggcgagctccgccgcggactcagacgggtctctagagccccgagccccagggggagggttatttagttacgggtggcatggaaacggggcccaagcgcgggnccattggaaacctgcccgcccaggtgttcaattcggggagcccggcccggcaccggaagtcccgtccgttccgggcccggaactttcggagagcttgccccttggaccccgtgggaacccggat

SEQ ID NO: 7700 - DNA, 558 bp, Hordeum vulgare
  Predicted polypeptide sequence is orthologous to G255, G664
tcaaggcggagccggtgacggaggagagcaagccgcccaggtgcccggacctcaacctggacctctgcatcagcctgccgttccaagaggttgaggaacggccgccggcgagagcatgcgcgaagccggtcaagatggagctatctgcagggcggcggcggcggcctctgcttccgctgcagcatcctacgagtgagaggagcggcgacggagtgcagctgcagcagcaacttcctgggcctaagggccggcatgctcgacttcagaagcctcgagatgaaatagaaatttgggaataattattccatcaaactttctgctgtaaattgttgctccctccctcctaccaagtttttatttagcttttaggaaaagatatactactcctactcctattagaaggtgaggaggagactggtattattaggtgatagaggatttgtagcgagatcctctctgccctcctcgctctgctcagtttcatgtaaattattactgctccactgatgaaatggaatggaatgaaataatacagtactgtctaacaaaaaaaaaaaa

SEQ ID NO: 7701 - DNA, 698 bp, Hordeum vulgare
  Predicted polypeptide sequence is orthologous to G261
caacccccaaccaaccaaccagacccaaccgaagaagccgagccgaaccccaccccgccgatcagccgccatgcgctgaggccgaaccgccgcagcccgaggaggaggaggaggtggaggggatggagggcagtggcgggtcctcgtcgctgccgccgttcctcatcaagacgtacgagatggtggacgagccggccacggacgcggtggtggcgtggacgccgtccggcaccagcttcgtcgtcttcagccaggccgacttctgccgggatcttctccccaagtacttcaagcacaacaacttctccagcttcgtgcgccagctcaacacctacggctttaggaaggtagatccagaacaatgggaatttgcgaatgaagaattcatacgagaccagcggcatcgattgaaaaatatccataggcgcaagccaatattcagccattcatcgcacactcagggtgctgggccattagctgatagtgaaaggagagactatgaggaggaaatcgagaggctcaagtgtgagaatgcatcactaaacttacagcttgaaaggaagaaaactgatatggacagtaaaatgacggcttttgaaagacaaactacttgctatcgaggatcagcagaaaaatcttatttcttatgtcacagaaattgttaaggcgcctggatttctttttaacttcatagaaca

SEQ ID NO: 7702 - DNA, 830 bp, Hordeum vulgare
  misc_feature (657)..(657): n is a, c, g, or t
  misc_feature (733)..(733): n is a, c, g, or t
  Predicted polypeptide sequence is orthologous to G274
ccgagatagaattgagaacattgctgaaatgctttgctggaataaaatatatgagaaggaagatactgttatttggcagaaaaaggaaaattcaaatccatgccataacaagaatagtcgtactagcaagatgtgcaaagttcatttatggagatgacatctggtataagaaaatggaaacttgtataacaccaatcccagagggagcacatcagctacagaagtttccagagagactatttgtagttcctccaagaattcttgacagtacccaaggtgttacagaagaagtctatgaagaggataagaagctgtggaagaagcatgttgatacatacaagaggataaacaagctgatagggaagtcaaggtataggaatatcatggacatgaatgcaggccttggaagttttgctgcagcgctgaattctcccggctcctgggtcatgaacgttgtgcctacgatatcggagaggaacaacactcttggtatcatctatgagcgaggtcttattggcatataccatgactggtgcgaagcattctctacgtaccctaggacatatgacctgatacatgccagcggcgtcttcagtttgtacgagaacaagtgtgacctgggagacattcttcttgagatggataggatcctgcgtnctgagggcactgtcatactgcggggacatgtcgaggtgctgaacaaggtcaagaggaccgtggcggggatgcgatnggaagtccagctacttgatcacgaagatggccctcttggcctggaaaactctgattgctgttaaagatactgggttgcccggcaagaaggaaagatt

SEQ ID NO: 7703 - DNA, 713 bp, Hordeum vulgare
  Predicted polypeptide sequence is orthologous to G274
attaacagagagacactagttcatgctgagtgatgaatggaattaaattacaaaactgttacaacaatatactgctgccgatcaacagcaaggaagaaaccttggttgcttcattgctaccccggagaagtgtaggccattctgttcgcacctgaggactccgtatctcaattcctggacgccagcttcaaaggtgcatcccagaattccccgtgttagaatatgttcttgttcacgatgcggccgtctggtttccaccaacccaatactgcttcacagcgtacaagaccttctcacgcactaggggaccatcctcgtggtcaactaggttcgtgttccatctcatgccccgggcgagtttgttcacctttgtcaagacatcgacatcgtcacgcattataacagcgccttcaggcctcaagatgcggtccatctcaaggaggatgtcttccatgctgcacttattgctatacaaggtgaaaaggccactagcgtggataagatcataggtccttggataagtagagaaagcttcacaccagtcatggtaaatgccaatcaatcctcgctcataaacagcccccagggttgcaatctttgcaacggttggcaccacattcatcacccaagattttggggactcaatagccgcagcgaaacccccaaaacctgcattcatgtccatgatgtttctgtacctaccagtaagtaga

SEQ ID NO: 7704 - DNA, 644 bp, Hordeum vulgare
  Predicted polypeptide sequence is orthologous to G274
cacgcgtccgcgagttttgacatggcacattgctcgagatgttaatccatggagtggaagtaacggtatgtacatgatggaagttgatagggtacttaggccgggtgggtattgggtactgtcaggcccacccattggttggaaaattcactacaagggatggcaacggagcaaagaagatctccggagtgagcagagaaaaatagaacaattcgcagaacttctttgctggaagaagatatctgagaaggatggtattgccatatggagaaagagattaaatgacaaatcttgccccaggatgcaagataattcaaaagttgccaagtgtgagttgacaagcgacagtgatgtatggtataagaaaatggaagcctgtataactccccttcctgaggttaaaagtgtgtcagaggttgctggtggtcatctagagccatttccaaagaggctcaatgcagtaccacctcggatagcccgtggttttgtatccgggttctcagttcaaacatatcaggacgacaataaactctggcagaaacatgttaatgcttacaagaaaaccaatgacttgcttgatactggaaggtaccgcaacataatggacatgaatgcaggtcttggtagctttgctgctgtactgg

SEQ ID NO: 7705 - DNA, 826 bp, Hordeum vulgare
  Predicted polypeptide sequence is orthologous to G275, G837
tgaagatgttgaaatttggaacgccatgtcttctctcacaaagtccatgtgctggaaaatgggtaagaaaacaaaggatacattaaatcaagttggtatggccatatatcagaagccaatggacaacaactgctatgagaaaagatcagaagacagcccaccggtatgcaaggaaaccgacgatgcagatgctgcatggaatgtacctttacaagcgtgcatacccaaattgccgcctggtccatcagtaagaggatcaaaatggccagagatgtggcctcaaaggcttgagaagactcccttctggattgatggttctcgtgttggagtttatggaaaaccagcgaatgaagacttcgaggcagactatgcacactggaaacgtgttgtaagtaagtcgtatgtgaatggcatggggattgactggtccaaagtgagaaatgtcatggacatgagagccgtatacggaggttttgctgcagcactgagggaccaaaaaggctgggttatgaatatggggccaatcaatacgcctgacacactgggcatagataataaagcgaggctttggtaggaatgtgtcatagactgggggcggatagtttgagggactggacccgggaacgtagtgaccttgctgcacgggcgaccgtttgttttgggaggtctaaaggaagaagaggaggaggtgggaggataggaggactagagggagagggaggtgttgagggccaaggagggagatagggagggggggggcaacgaggggaggggaggggagggcatgagagcatggagaaaaaacccaggggagaaaaagagaaag

SEQ ID NO: 7706 - DNA, 899 bp, Hordeum vulgare
  Predicted polypeptide sequence is orthologous to G275, G837
ataaagggaaggataggataaatcgagtgggagtagcgattttccaaaagccaatggacaaccgctgctatgacggaagatctgctgcaaaccctcctctgtgtcgagagagtgataatcctgatgctgcctggaatgtttcattgcagtcttgcatgcataaattgcccgcagacccctccgtccgtggtttacagtggccggaagaatggccattgagggtggaaagaccaccttactggctgaaaagctctgaaactggagtatatggaaaacctgcccctgaggattttcaagcggactacgagcactggaagcgggtgatacaaaattcatatatggaaggcctgggtattgattggtctgctgtcagaaacgttatggacatgaaagctgtatacggagggtttgcagcagctttgcgaaacatgaagggtggggtcatgagtatagttccaatcgattcgcctgacacactcccaatcatataccagcgcgggctgtttggactctaccacacttgggtgagtcgtttagcacctacccgagaagctatgatctcgtgcacgcgaaccatcttttttccagattataaatgagcgtaagctgtcggaggaattgggggagtggacccattttaaagctaaaagggagcctgttgatatgcagattataaaacaatacccagggggattagtcgcaaggactctgcttgtgggtccggttatataccaaaaataaaaggcttaatggagaaaacctatagcccaggtatttatgagcccactatatgggtaagggtagcgctgcgtgttgtgctgtattattaatttctttgtgattttttacaagttagaaaatacacgagcgagaagcaacatacataaatgagagccggg

SEQ ID NO: 7707 - DNA, 832 bp, Hordeum vulgare
  Predicted polypeptide sequence is orthologous to G280
gaaaattcccccctccccgctgcccgcgcccgcactctagctctagagctcggctccaccgccgtgggctctagccgccgtcgctgccatggcgaccgaagggtctcccaagtccggtgacatcccgccctaccccgagatgattctcgcggctatcgaggcgctgggcgacactaacggctccaataagtcggccatttccagctacatcgaggagaagtacgagggcctcccttccgcgcacgcctccctcctcacggccaacctagccagcatgaaggaggccggcaagctcgccttcgtcaagaacaactacctcaaggccgacgcggtctccgccaccccggccaagcgcggccgcggccgcccgcccaaggaccccaacgcgccgcccaagcccaagccggatcccaacacgcccaagcgcggccgggggcgcccgcccaaagaccccatgtccgtcgccgtcaaggaggccgtcgccaaggccaccaccggcatgcccaatggccgcggtcggccgccgggccccctccgcgggccagaaggccaaggtaaccaaggaggctgagtctccggcgggcgcgtctggctcgctcctggcaagcgcggtcgtgggcccccacgcaaggtggcggcttgaagcccgcatgcctgtgccctttcggtccgtgtatttcgcccggggtaccaccggtggaaacctcctaagggtgacggtgcctggtccattccggccttcgaccaatagggggactcggatctaatggttcataagccggaaaccggatccataataactgggcccaagggatggattgttggatcgatc

SEQ ID NO: 7708 - DNA, 1114 bp, Hordeum vulgare
  Predicted polypeptide sequence is orthologous to G280
ttggaatgccagcttcgaccgcgcgtattaaccctcactaaagggaacaaaagctggagctccaccgcggtggcggccgctctagaactagtggatcccccgggctgcaggaattcggcaccagggccggtggctccgacagcgccgccgcggcgcaggcggccgcgttcaagaaggccaatgaggggaggaaggcgtagatcaaccggatcgccgtcgagagggctttaatttagctagctggctgcctatatctgtggcatgcgtgcgtttaggccggacggacgtgtgcgttgcgttttggttgtttcatttgagttcgtggtttggttgtgtacgttggtgtcttcatgggctagcttcgatctatcgtactatgtgtgttgtaatgaatctcgtttaagttttttgcagttcaaaaaaaaaaaaaaaaaaactcgagggggggcccggtacccaattcgccctatagggagtcgtattacgcgcgttcactggccgtcgttttacaagtgtcgccgccccggccctgtacctcctccattattttagtcgttgcactgatccgtggtactcttgttgcgacgtgaggtttgtgtgttcgtttactctcactgattatggttcccgccttcgtctcttgtctaggccctctagctatatatccatttacttcgctcactcccgtaatctggatctgttgtcactgcgttagcctgtagtcggagaccataccttcttgactagctactctcccgtcatctacctgcaacatcggctagatttcgacgaacgacatcatagtctgctatgattcgcgagtcgatgggtatgctgcggagtatcatgatccagctcgaatatctccccctccctcggtgacaggtatcccgctctccgccttctccgctcctcgcggcgcctcacccgtccgtgtctcttccctctcctcccctaatctgcggctagtctctctctgctccctcgtgcatcgctacctattcgcgttcgtggatagttcgatattcgtgcgtagccgtagtgtcgtcgtcgtttgtcctaggtgtctgcgtttatgtcctgctatgagtctagactgactttctgccctccc

SEQ ID NO: 7709 - DNA, 461 bp, Hordeum vulgare
  misc_feature (439)..(439): n is a, c, g, or t
  misc_feature (442)..(442): n is a, c, g, or t
  Predicted polypeptide sequence is orthologous to G287
gacatgagtccaagcccgggaggcaaagcaccaatgacgacgacgccgacgccggccccggcctgtatcagggctggcgctgcctgccggacgcccaaagccaaagcgcagaccccacgccaccgcggctcgcacgtgccggtgccggggccaccatcaggccgcctgacatgtcgaccctggactgctgggctccggacgggccccggttggcattgaacgggtgtcggtgggcggttggcgggaggagcccagtgctgccgctgcgtgatctgataataactcaggaatggggctgctgctgctgctgctggctgctaccaaccgtgcgttcggcgccaccggcaccggaataccagctgcgttgcgttgcgttgtgttgcatctttgcatggatggattatgtttaatgtacgtgagctgccacccaacccaccgnatngaaaaaaaaaaaaaaaaaa

SEQ ID NO: 7710 - DNA, 798 bp, Hordeum vulgare
  Predicted polypeptide sequence is orthologous to G291
gagagagactccatcatcgtcatggacgccttcgcgctccccgtcgagggcaccgagaccagggtcaacgcccaggccgacgcctacgagtacatggtcgagtactccaccatcaacaagcaggctggaaggttggaaaatgtggttgggtggtaccactcacatcctggttatggatgctggctgtcaggcattgatgtttcaactcagatgcttaatcagcagtttcaagaaccattcttggctgttgtgatagaccctacaaggactgtttctgctggtaaagtggacattggagcttttaggacatatccaaaagattacaagcctccggatgagcccgtgtctgagtatcagaccataccactcaacaagatagaagattttggtgttcactgcaaacagtactattctttggatataacctatttcaagtcatacctggactctaacctccttgatctactctggaacaagtactgggtcaacacattgtgttcgtaacaacttctggggcacagggattatgttgctggacaaatctttaatttagctgataaactagagcaggctgaaggggaactggcacgcagaagagtttggctgcttgtgccgtagcagggggagaaaatacatgaggaagcagtcctggcttaaggaacccggaatgggtctagatcgttgtgtaatcaggttcttggtagtgtgttggtggtgattagggaaatttctgtaaactctttgcgcccgggcctacataaattgaggagaatttcgacgggggtcatgccataaacg

SEQ ID NO: 7711 - DNA, 795 bp, Hordeum vulgare
  Predicted polypeptide sequence is orthologous to G307, G308, G309
agcaacgccatgttctactacggctccgtgctcgactccatggaggcgtccatgtccttcagccgcggcggcgccatcggcaacgggtccggcgccgacgcgtacctgcagagggagatcttcaacatcgtgtgctgcgagggcagcgcccgcacggagcgccacgagccgctcgcatactggtgcgcccggctctggcgcacgggcctcgcccacgtgccgctgggccccaccgcggccaatcaggcggccaagctcgtccgcgtctactccggcgacgggttccgcgtccaggagatcggcggctgcctctcgctcgcgtggcacgggcgccccctgttcacggcgtccgtgtggagcgcaatgcccgccgccgacggcgccggcacctccgagtccgagcagcacggtgacaagcacaagctgaagatgggcatcggcgagagcagcggcggccgtctgccgggcgccgccggggcgcaatgatgaaagagcttgagcgacggggccggttgaataattgttagagttggaagggaagttgttaatcggaacttatgcgcagtcgtgggaatcaagtcggacgcaagcattagtcagcgtggtatatgaaatcactctaaatctcagatggatatcgggctagttcgtctggggtaaataaagtgtgggtcttcaaacttgggaaactattcgccgggggaaaaaagacaggggagccattccttgcgtcaggggtggtaactgatttcggataacggtttctggatctatgtgggaagcaatagttggtac

SEQ ID NO: 7712 - DNA, 901 bp, Hordeum vulgare
  misc_feature (755)..(755): n is a, c, g, or t
  misc_feature (766)..(766): n is a, c, g, or t
  misc_feature (901)..(901): n is a, c, g, or t
  Predicted polypeptide sequence is orthologous to G307, G308, G309
agcaggggggcggggggctcgcccagttcgcgcacaccatccgcgtcgacttccagtatcgcggcctcgtcgccgccacgctcgcggacctggagccgttcatgctgcagccggagggcgaggaggaccctaacgaggagcccgaggtaatcgccgtgaactcagtggggggagatgcaccggctcctcgcgcagcccggcgccctcgagaaggtcctgggcacggtgcgcgccgtgcggccgaggatcgtcaccgtggtcgagcaggaggcgaaccacaactccggctcattcctggaccgcttcaccgagtccctgcactactactccaccatgttcgattctctcgagggcggcagctccggcggcccgtccgaggtctcatcggggggtgccgctcctgccgccggcgccggcacggaccaggtcatgtgcgaggtgtgcctggggcggcggatctgcaacgggggggcctgggagggcgcggagcgcacagagggggacgagacgctggggcgagtgggggaagcgggctgggcagcgcgtggggcgggacggttcccgtgggcgccgaggccggcgagggggggggggcggctggggggccgtgtgttgcgggtgggggaggggtgcaggggggcgggtagcgggggaggggtggtgagtggtggggggaggtgcgggctgttcgtataggcgcacctccggtgcgattcgatgtcggcgcccgcacgtagttatataggccgggagtnttgcgcgggcnaagagcaagactgcgcgtgaacacagcgggtggaaaaagcacgccgggactaccatcccagaagaccacgccgatagacttgatcacactaatggagggagtgtggggcccagtccacgacggggtaggtcggan

SEQ ID NO: 7713 - DNA, 699 bp, Hordeum vulgare
  misc_feature (663)..(663): n is a, c, g, or t
  Predicted polypeptide sequence is orthologous to G307, G308, G309
ttttttttttttttttttttctttttttttttttttttttttttttttttttttttttttgggtttttgggccttttttttttttttttttttttttttctctcaggctgactgactgacaagtttgaaagccacccttttttgaaccaaaacgaactaaaccgatttccatttgaaactgaaaggggattttatttgacaccctgactgatgactgacaaccgacttgacttaaacaaatggagaataagctccgactaaccaactgacactccaactttaacaattattaaaaccgccccggcgctttaactttttaataaatgggccccgggggggcccggaaaaaggccccccttgttttccccgatgcccattttaagcttgggcttgtaaccgggctgttcggactcggaggggccggccccctcgggggggggcattgtcctccacacggaccccgggaacagggggcgcccgtgccacccaagcgaaaggaaaccgccgattttctggacacggaacccgtcgccggagtaaacacggaccaacttggccgcctgattggccgcggtggggcccaacggcacgtgggcgaggcccgtgcgccaaaaccgggcgcaccactatgcgaacgggttgtggggcttctgcgggcgcttncctcgaaaacacgaagttgaagatctcctctgcagg

SEQ ID NO: 7714 - DNA, 638 bp, Hordeum vulgare
  misc_feature (502)..(502): n is a, c, g, or t
  misc_feature (579)..(579): n is a, c, g, or t
  Predicted polypeptide sequence is orthologous to G309
ttttttttttttttttttaaaacaggacgaggggctaaaaatgatctaacattatttgatgcaaatcaccaccaattcattcaacagaaaagcaacagatgaggaaacaccctggaatcaaacggaattcagatggctctggtttattttctcctcagctaatcacaaggaaccaaccccctttgttcccacacaatcgtccagccatccagcagaaacaaaaaaggagaaatcgttaagagagcgtcaccataattacaatcttctatcccaagggagcaccgccacgcaatgatcggcgaaatcttgccgtcatgtggtgcaactcataagccttctgctcttttagatcttccaggtcacgacagcatcattaatcgacatttgggggcaggggtcgcgaattcgcacgataaaacagtgcacttcaatcccactcctagcagctcatcagacgtcccagtgaacactcatcattgtacccttttctgttgaaaggcancaacagtttggggggaagcaagtggcttcgtccctaaccacgccaagctgtttttgcttcttggggctcaaaagggnggggttccgtcaattgagtatgtccctggtgcatccgggttttccaatttcccgaggct

SEQ ID NO: 7715 - DNA, 487 bp, Hordeum vulgare
  Predicted polypeptide sequence is orthologous to G324
ggcgatgttatgttctctctcgatgactttgaagctctgggaaataatgctggaccatcaacaagcccaccggccagtgaacgtaaacttttctccgatgttacacggcttggtttcgcgtctgcgcaagactcccctcctcttagagctgaaactggagacaccaataatgaaatcacgagggatcaagggccggtagcagcgtcttccatgtcctttgccagcatcctatcttctactagagctgctgcggacagcagaggtgagatgcctaaaccaaatggagtcggaaaggcgggcaagaagcgcaccaaggtgcttttatcgacaggcggtggccgccgatactaacgaaaactacactggaaaacatttggtcatttccgttgtacctcatgaacaatcttgtgtataatacggaagttggatttcttagttggtgtttgtacatagtatcttatttttgtgatgcgactcaaaaaaaaaa

SEQ ID NO: 7716 - DNA, 666 bp, Hordeum vulgare
  misc_feature (58)..(58): n is a, c, g, or t
  Predicted polypeptide sequence is orthologous to G325
cgggaattcggccattacggccggggatcttctcaacacacaacaaacaaacctagcntggtaaacaagacaggtagcaacaacaaaattagacaatggagggcaagaggatgctcactggcactaccagtttgaaggcgatcatgtgcctgctcatattgagcatcgctgtgcactcgaccaccgcagcgcaatgtggctgctgtgtaagcgcccgggcaaaagcatgttgttttgcttgtattgccgcaggtggctccgacacaatatgcaagaacacttgttgtttcccctgtattcttgccgattcggttgttgataagatggaagaaatgggagccaatgccgcgatgggagcggaagaataaaatgatatgcgtgcaccgctactagtatggatgccattcacatgcatatgatgcattgcttcaagctatggtcaagctatgttaatgtttaccaacaataagttgttgaatgtttggggacaactctggttgaaccatgtgtttgtctgaattacatatatgttatgcatttgtgcatgtgtgtcatctcacaagcatatttatttgctcctgctgcttgtaataaggccatagagagggtccacaatgatatgtagcgggcacgtatgttataatacaattatatattgtctgcgct

SEQ ID NO: 7717 - DNA, 845 bp, Hordeum vulgare
  misc_feature (2)..(3): n is a, c, g, or t
  misc_feature (41)..(41): n is a, c, g, or t
  misc_feature (103)..(103): n is a, c, g, or t
  misc_feature (467)..(467): n is a, c, g, or t
  misc_feature (715)..(715): n is a, c, g, or t
  misc_feature (733)..(733): n is a, c, g, or t
  misc_feature (825)..(825): n is a, c, g, or t
  Predicted polypeptide sequence is orthologous to G326, G1337
cnnactcaagggagtcgcccaatggaaagacgaatgatganggtcatacggcagttacatgagctcgcggaggtcgacatgggcggcggtcagataacacctngtgaggaggcagagcaagctgctcatcagttgccttcctggacacagccacactacactgctggaaatggcgattttggcacagataacagccatgaggttgcaaccatgccaacccctggttacgagaatggtggatggaacaacagcaatcatcatgccttaaatgatgcctgcaaggccgagtacgaacaggagcaggctccagcaagctcagctgaagcatgcttgtcatcgtttgttcaaatgccagaactttgccccagcatgagcaatggaagtatgatggacgatagccagcaggcaaatcctggtattggtatgccaatgcaagctttccccaaaagaagtggctttgatgttgntgctggccctgaccgcgacattgtcatttcccgctataaagaaaagaggaggacaagaagatttgacaaacaggtccgatatgagtcccgcaaagctcgtgcagacagcaggttgaggatcaaggggcgttttgcgaaggcaaatcagagttaagccttgactttgcagtatattttgcatattggacatatggaagaacactaattaggagtgagtgcagatggggcagaaggcgtgaacattttgnttgccttcagttgggcanatggtagctcgtgtcaatctgaataatgtatggtgccaacatatggctatattaatggtttgaggggagttgttctttagtccaacccttgnatatagtttccatctatgaa

SEQ ID NO: 7718 - DNA, 540 bp, Hordeum vulgare
  Predicted polypeptide sequence is orthologous to G326, G1337
gcaccttatataccagtgtaaaattaagctatgtgttctgaggagaaaagtagaggtctcttacaaaaaaaacaccgtgaatatgatcctctggatcacgatgctgaaaacgataacgaacacaaaaaaatagctgagcaatgcacggcatcatgcttaggtgcggcgcaggatgtcatctccgtgctgcgagcaaggaagaaggctcatccgccattgctgccggcattgagcgcttcattcgacttgacaaaacggcctttcacgcgcttccgggtatccgccctcagcttccgggactcataccggatgtgcttctcgtacctgcgattcttcctcttctctttgtaccgctgcatcgcgctatccctgtttagggcgagagtctcactgtcgatccttgtggtaggcctctcagctccagtcgggacgattgtttgatcaccaaaggagatctccctagtgggagctgctcctctgtcatgggaagagctcgccaaggtccctgaagcaggcacgttgctcccagaggttgttggg

SEQ ID NO: 7719 - DNA, 1384 bp, Hordeum vulgare
  misc_feature (602)..(602): n is a, c, g, or t
  misc_feature (604)..(604): n is a, c, g, or t
  misc_feature (606)..(607): n is a, c, g, or t
  Predicted polypeptide sequence is orthologous to G328, G2436, G2443
tggggactatccacgcgcattaaccctcctaaagggaacaaaagctggagctccaccgcggtggcggccgctctagaactagtggatcccccgggctgcaggaattcggcacgagggccagggtgcaccggtacagggagaagaggaagatgaggcggttcgagaagaccatcaggtacgcgtcgcggaaggcctacgccgagaccaggccacggatcaaggggcggttcgccaagcgcgccgacgccgacctcgaggtggaccagtacttctccgcagccgcgctgtctgactccagctgcggcgtcgtgccgactttctagggcggctcggtggagagaccatgagcgttcctccttccatggtcgatcgatcgacgcctgcatgttggttggctctccttaatttgccgaatatcctaaactttactggaggcatcaaagcttcacctgtaaatactaaatacagtattatggaaagatgccagatagatcttttcttgtaaaaaaaaaaaaaaaaaaaaactcgagggggggcccggtacccaattcgccctatagggagtcgtattacgcgcgttcactggccgtcgtttaacaatntngnntttttttttcttctctcttcttgtctcgctggctcttgtctctctgtcctttgcccggcttgttgttgtgctggtgtctgctgggttgggctggttgtgtcgtcgctctgctgtggtctcagcgtaaaactctctttttggggtgagaggctcctctagggaacctcgcaatgtttgtcacgtgttcgtagacctggtgttggtccccgctgtctcatgtgggtccgcttgatcattgggtgtccgtttggttaggccattgtggggttcttcctgcaaagatcggtttgtcggtcaacaatgtcggtgtgtagctctcggagggggcctcgtgtttgttggttcgtgttttccttcgaagagagttgctggggggcggcgttttttttctgagcgggaggtggtcgtgcactgatggtcgttagtattttctccgggggcgatcgtctttggtggcgggcgacacaatctccctttgtggagtggggctcgttgcgtagtcaaagaatatgtgtgggcgcttttcctccagtcgtctcccagctcagggtggggctcacctgctgtggcgtgtatctctccctcacacctccatgtctgttgtttgtatccccctcgcgacccgtctcgacggggtgcgcccgcctggcgctctctgctttggcgattacttgtggcgacagcagtgcccgcacgtctttggacgtagcgcgtggccgctccagtgtagagtctggcgggtctccgcgcgctattagctcgagatgttgccctccc

SEQ ID NO: 7720 - DNA, 1171 bp, Hordeum vulgare
  Predicted polypeptide sequence is orthologous to G328, G2436, G2443
gatgatcaaggccgagccggacctccgtggccagctgcgcggcagcgctggcgtcggcggcatgcagctgcagcagcgctgcgactcgtgccgctcggcgccgtgcgcgttctactgccgcgccgactcggcggcgctctgcgccgcgtgcgacgcggacgtgcactcggcgaacacgctggccagccgccaccgccgcgtcccgatgggcgcggtggccccggcctcccctgccggaggcgccttcgtcgtccgccccggcggcgtcaactcctcctggcccatccgcgagggccggaggtcctactacgacgaccgcgagggagaggaggaggaggcgacgtcgtggctgctgctcgatccgctccggggatcggaggcggatgcgccggcgttcggcgacgcgctcgtcgctgacttcctcgacctcggacgagcaggcgagaaggaggcgtcgagcaaggactaccacggccacgggatggagagcaacgagggcagccacgaccacgagctcgtcgtgcccggtgagccggtggcgcagctgcatgagcggcagggcttcacggcggagatggcgtacgatgcacaaaactctaaccatgggtacggatttggcgcaacattcgaacgcagcctttcaatgtcatcgtcaccggacaacagcagcaccgtccaggatgtgagcagctcgtacatgaggcgcagcgagagcagcgtcgacctcttctcaacggcggcgcacacgtcgccgcagttcatgggcatggcgatggacagggaggccagggtgcaccggtacagggagaagaggaagatgaggcggttcgagaagaccatcaggtacgcgtcgcggaaggcctacgccgagaccaggccacggatcaaggggcggttcgccaagcgcgccgacgccgacctcgaggtggaccagtacttctccgcagccgcgctgtctgactccagctgcggcgtcgtgccgactttctagggcggctcggtggagagaccatgagcgttcctccttccatggtcgatcgatcgacgcctgcatgttggttggctctccttaatttgccgaatatcctaaactttactggaggcatcaaagcttcacctgtaaatactaaatacagtattatggaaagatgccagatagatcttttcttgt

SEQ ID NO: 7721 - DNA, 643 bp, Hordeum vulgare
  Predicted polypeptide sequence is orthologous to G328
cggacgaggccttcctggtgcaaaaatgaccccttcctcccatacggggcaaagaaaactgtaatcccacacgtcccacgacccatctccttccaaaccccacgcccgatctcgtctctctccccagtaaacttgcctccacttgtgctcgtcggtccatcccctacacaagatctgttggcaggagccgtctcgatctagaggaaggggatgcatcccatcccgtcaagctgtcccttcccccgccgtggaagagagagcgagagatttgagagagggatgagcatagcgtggtgctggccgatcccgttcgttcccctcgcttgcgatccagaatcctcatcgggtgccatcgcgatcgtaccgctatttaccctcatccagcggggccgaagtctacggcacgagaggggtcaagaagcgcctggctggagacagatgagaggcgggtggaataggtggttgtccagctccggtgtggggtgaacgcagtggagacatagaggcgggacttctgtcggggctaagcgaacggcgagagagatagaggatcgtccatagccgcacatgctgaacaagcagagcatgcacctggagttgcgaggcgacctcaccatcctcctttgtactcggttgcaagttt

SEQ ID NO: 7722 - DNA, 618 bp, Hordeum vulgare
  Predicted polypeptide sequence is orthologous to G343
cgcaatataatggcgggcataatattgtataaccacccaggtgacgatgaatccaggactagagaaaatggttctctcaagcgaaagactgactgctagagctaacaaggagtttcaactgagacctaaccggattttcacgtccgattctttcctcctgactgatgatctacatgactacgaccccaatggcctctaagacccgacgcgacagactcgggagatgctcctgaccaccggcacaagttcacatatccgagtgcgagtgcgagtgcgagtgctcgttctcgttctcgacactcatcctcatctgcatcaccttcttgtgagaattggagtgcatgaagctcacgaaggttgggctgttggcgggcctgtactccggcagcagcctgccggacttgtacctcacgccgcacgcgttgcatagggtcttgggccctagagggccgctcctccactgcggtgttgtgtgggacaggcaatgggtgcaccgcttcacttcctcctccagtgggacctcctcattcacatatgtcttcttggtcctcctcttgccctgctcgtccacaaatgagatcttcttgatcctcttcttctcctgtggaggctcctcat

SEQ ID NO: 7723 - DNA, 529 bp, Hordeum vulgare
  Predicted polypeptide sequence is orthologous to G343
cggcacgagggaacaacagcggcggtggcagcgcggctggtccagacagctgcgtcacagcgctgccaggccgcggagcacgaagcaagcggtcgcgggcgagcgccgcggcggccgcagcatggcactccctcatgccgcgcccgccctcgcagccatcgccgtcgtcctcgtgttcgtcgtccgacttgccgtcctcgacgacggcacgacccagcggctccaactgtggcggccgcggtaagaagcagggacccgttgcctgcggggaggtgggcctggtggaaggcggcgtgcggcgctgcacgcactgcgcgtcggagaagacgccgcaatggcgaacgggcccgctggggcccaagacgctgtgcaacgcgtgcggcgtgaggttcaagtcagggcggctggtgccggagtaccggccggcggcaagccccaccttcctgctcacacaacactccaactctcaccgcaaggtcatggagctgcgccgacagaaggagctcgttctcatccgcggcagccaccg

SEQ ID NO: 7724 - DNA, 470 bp, Hordeum vulgare
  Predicted polypeptide sequence is orthologous to G351, G545
tttttttttttttttttttttttttttttttttttactcacaccaaacaaattaattaatcaatgaaagaaccgttctactgagatacagtacgtacgtactatatggaaaatatagaaattagatatatatgtactacgtacaccaatcgatggccagctccatcgatcgacctctacgctccactggctggctaggtacgtgttaacgggtgtacgtatcaccaaccggccgagcataagcaatccaaaagaatacacaccaactggttgatgattgaaaatttctttgatgatttagctacgccgggatcatcagcctcggcttcttgaatgccagcgggctgaggacctcctcctcatcggccggcaccggtacgcaccgctcgcgctcggtgacgacgacgatgtccggtagcgccggcaggttgaggtcgaaccgtcggctcgcgaccgcggtggtcccgccgc

SEQ ID NO: 7725 - DNA, 626 bp, Hordeum vulgare
  Predicted polypeptide sequence is orthologous to G351, G545
gatgttcatgttacacagtactgctagttcatgaccaatcataagttcatgttacacagtactgctagttcatgaccaatctctgtatgagtatgtatgaactctggactacaatatactgacgcctacacaacaactcaaggaggatacaagcactcctccgtcgtttacaaggaaccaacaagatctaggacctatatctacgtatatggctactggagtatgtatgtatgtatgtatgtagtattactcactcgctcactcactcaatctgtacaggagcagaacaaattaaaccaaacgaatgaacgaatttcaccactggatcgactggaccaaaaacttgggatggatcgatgggatccatgcagcagctagctgctcacgcggtgagaagccgaggcttcttgaaggcgagagggctctgcacctcctcgtcgtcctcccacatcatcttgcccttggcgcacggcctccacacgaactccggcacggccgggatgttcaggtcgaaggcccgggcggcggagctcccgttgccggtgctccccacctcggactcggcggccgcggcggccaggagctcggtggacgaggcggcgacgccgcccaacgcgccctcgtgc

SEQ ID NO: 7726 - DNA, 480 bp, Hordeum vulgare
  Predicted polypeptide sequence is orthologous to G353, G354, G2839
gaaagcaaaacgtagtctatcgtactgtaaattcgtaattacaatgtccaaccaataacctatctcaaaataccatcctaatcaaagacatgtacaagtgatttcctccctgaaaaaattgtgacaactagtgtacccagctagctacctagacgaatagctcgagcaagacgggcggctggtaattggcggcggtccggtgccccaccacctcctgatccggctccccgacgctgcgccacacccactgatcgccgtcgtcgccgccaccgccgccgccgcgcagcgccatctcctcgcggtgtcgccgcatgtggcccccgagcgcctggcccatctcgaacccgagcccgcagatgtggcactcgtgttgccgctcctcctgcttcttccgctccctgatggccctggcaacgccgacgccgagctccagcccgtgacggccccggaggtggctggtccggtgcccgcccagcgcct

SEQ ID NO: 7727 - DNA, 638 bp, Hordeum vulgare
  Predicted polypeptide sequence is orthologous to G353, G354, G2839
cagttaacgtgtatacataatctccgaaccaatgaatgaatgaatgaatcaagtcaccaaatatgtccacaaaagtacacgaatgaatgaaccaactaacgatcaatacctagctaagctacgagtatgtgtgtctgtgtgcagcgacgtacaaatctacacaggtcgatcacgaactctgtagcataactaaagttagctaatcatcaacctagacgaacagctcgagcaggacgggcggcggctgcgccaccgcggcggcggcggcctcctgctcgcggtggcggcgcatgtggcccccgagcgcctgccccatctcgaacccttgcccgcagacgtggcactggtgcgcctgcttctggtccgtggccttcttgtgctccggccccgtcccggcgagtgcgagcgcgagcccgttgcggccgcggaggtggctggtgcggtggccgccgagcgcctggaacgtcgggaaggagcggtcgcacgtcttgcacatgaactccccaccggcggcggcggcgcggcgcgtcctcttggtgctccggtcggcgccggcgccgagcgagagcgagagggagagagacacgagctgctccgccgatgatgctctctggtgcttcgtcatggaggtactatat

SEQ ID NO: 7728 - DNA, 710 bp, Hordeum vulgare
  Predicted polypeptide sequence is orthologous to G374
ctcgaggctcgaggtcaacatgtgcggcatgtgctactgagtgtgtcacacgattcttttctacaaaaatcccatatttccgagaggtgattgttatggctacatcatgtgatgtgtgcggctatcgcaactcagagttgaagcctggtggtgaaatcccagctaaaggaaagaaaacaacactgaccgtgcgaagcgtaaaagatcttagtcgtgatgtcataaagtcagattcagcagcagttagtgtacctgaacttgagttggagctgtcaagcggaacactgggtggcattgtcacaacagttgaaggtttaattgtgaaaatatgcgaggcactggagagagttcatggattccagttgggtgacagtacatatgaatggaagaagaagaaatgggatggtttcacagagagattagcaaagcttctaaatctagaagagccatggactttaattcttgatgatgcattggcggcttcatttattgctccagcgacagattcgctagaagatgataaacagctaacaattgaggagtatgagaggagctgggagcaaaacgaggagctgggcttgaatgacatggacacgtcctctgcggacatggcctacaacaccacgagcgcgtcataatcaggcttggtttagtcttcttgttgtgcgcaatggtgtaaccttgtatttgaaatttgatactttgtggtg

SEQ ID NO: 7729 - DNA, 1318 bp, Hordeum vulgare
  Predicted polypeptide sequence is orthologous to G375
ctatactacatactacccttcgttcacctgatggaggaagtgttttcgtccaactccaagagcaaggccggtcagatggcgggagaggcggcggcggcggccgagaagaagtctcggccgaagccagagcagaaggtggagtgccctcggtgcaagtctggtaacaccaagttctgctactacaacaactacagcatgtcccagccgcgctacttctgcaaggcctgccgccgctactggacccatggtggctccctccgcaacgtccccatcggtggtggttgccgcaagcccaaacgcccggggacctctgacgcccacaagctcggcatggcctcctcgtcggaacccacgggtgtcgtgcccccctcgaactgcacagggatgaactttgctaacgtcctcccgacgtttatgtctggtggctttgacattcaaagcagcctctccctgacaacttttgggtcatcatcctcatccaacccgacggcgttgatgtcccccggtgggacgacttcatttctggatgtgctgagaggtggtgcaggagggcttcttgatggcagcctcggtccaaacaatggctactactatggtgggcatgccaacggatcaagcattgggatgttgatgactccgccaacggtgtcgtttggcattccaagtccgatgcaacaacatggcggtctcgtggttggtggaaatggaataggtggcacaacttcttcaacatttcagggcagcgctggcgaggaaggagacgatggtacggggtccattatggggctccagtggcagccacatgttggtaatggtggcggtggtgttgttggattaggaggcgcgcatcatcttgggactgggaacaatgtgacgatgggcaacaacaacaataataacaaccagaacaacaataacggcggcggtgctggtgatgacgacgatggtgggtcatcgagggattgctactggatcaacaatggaggatcgaacccatggcaaagcctcctcaacagcacctccctgatgtaagtggaagaagaaaatgggaaatagaggccattgaattggagaattgggtcgatcattttcttattactgtcggtgcttcttttttgttacttgcttgaagtatttcgctcggtcattttcatgtgtattttaagaagggattattttgtttatttgagtgaaactcgagagagtgtgtcacattgggatgcttaatttaagtttatttgtttcttcacattaattatttaaggatttatggtttaatctttataaaagttatgttgtgtcaaaaaaaaaaaaaaaa

SEQ ID NO: 7730 - DNA, 608 bp, Hordeum vulgare
  Predicted polypeptide sequence is orthologous to G375
cggcacaaggcacagcccaccagcttccctgccttctccatatcccccctcttccttctccatagcttctcttctcctatccagcatcgatccacccccaccctcttccccatctccatgctcttcctaatcgatcgctgaatccgcatcttcttatagctagctagccaatcaccctttaacccgtcgacaaataacgaaacgagaacacagcgcgtgtgtagcaggtgtagaccatcgtcgtatctaggtttagtttgctgctggatcttggatttgccggagctacgtagtacatagctagcagctgactgcttgatcgaccgggaagcccaggcgatcgatgatggcaggagcagctcatccgatgcatttctgcatggactctgactggctcaagggcatcgtccccgaggaccagggtgggatggggtcgtcgtcgccgtcagaggagctgatcatcgcgtgcccggagccgatgcaggctcagcaggcggcggaccggcggctgcgcccgcagcacgaccagccgctcaagtgcccgcgctgcgactccacgcacaccaagttctgctactacaacaactacagcctctcccagccgcgct

SEQ ID NO: 7731 - DNA, 814 bp, Hordeum vulgare
  Predicted polypeptide sequence is orthologous to G378
ctggctgcctgcttcgtcctcgtcgattggccctcctcctcggatccctcgccggacccgatccagctccgccgaccggcctgctgctgttctctctgtctgtctctctctgcgtgcgtgggggtgatccaagggggcgaaggaggagtgaaggggcggatggatccgtcgggcgcgttcgcgcggagctccagcaatgtgtcgctcgcgtcgctggtgaggagcgggagcggcggcagcagcgggagcagccgcgggaggggcggcgccggcgggagccggaggatgatgcgccgggtgctccgcggggtcatcaccttcatcttcgccatcgctggcctgttcctgggagccgtcaccggcgggctcatcgggctggccacggagagcggcctcttccgcggcaccggaatcggcgccatcaccggggcgctggtgtccatcgaggtcgtcgactcctccatccgcctctggcgctcccgccggtccgggatctaggacatcttgtacgtgctcaatgtgatctacagcctcctaaccagcaggctcgtcctggaaaaggtggtcccggagtgcagcggggtggccgcgagccaatgaatgcaagcgactcgtcaggagttcaaggaaggccctagcctcttaaaagacaggggaaccaacaaaatgccaggggcggccttcgagaaattggccaggggaccatatgccttgagtgttaccagaaggcccgaggggaactttgcaggaatcgaaataccctacaagttttgtgtttaggaggagagggggaggcaggggcgctgtaggagag

SEQ ID NO: 7732 - DNA, 564 bp, Hordeum vulgare
  Predicted polypeptide sequence is orthologous to G378
cggcacgagggccagatgaacgccgcgggcgacggattcagcgacggaccgccgacgctctccgagatgtttgacatgggatccgcctccttcaaaggcatggctgcagacgccatcgcagagctccccgcgacgaccatcaccgagcagcaggccgccgtgcagaacggcggctgctccgtgtgcctccaggagttcgaggccggcgaggcggcgcggagcctgccggagtgccgccacacgttccacctgtcgtgcatagacgggtggctgtgccggcatgcgtcgtgcccgctgtgccgccgcgccgtctaggcttggcgtgtccggctccttaggatccatgtcaatgtgtgcatagccagcgtatacacacacgtgttacgtgcgtgtgtggcgctagcacgtatacggcacgcgcacgcacatacggaaagttcgttaatctcttgtagttagctagctgggttgagactgacattacatgatatgtatgccgacaagtacgttctttcgtgacttggttcgttgccttcataaggctggttgtgaacgtgtgtacag

SEQ ID NO: 7733 - DNA, 670 bp, Hordeum vulgare
  misc_feature (661)..(661): n is a, c, g, or t
  Predicted polypeptide sequence is orthologous to G378
gtccaccgaaagcggcatgctccgcggcgccggcgtgggagcagtctccggcgcagtcttctccattgaggctgtcgaatcctgcatcgagatttggagatctaccgaatccggaaaatatagcttcctctttgtgctagacatcatctctagcctcttcagtggacgaattgtttgggagaaagtcagtccagcactgcagcgtgcagtacaaagtcagatgagtttaatgagtacacctttcattgacaacaatgaccttttcgaaaccggctgtacgggcggtatgtcagcagctctgatcaacaagatcccagcaatcaggttcagcgctgcaaccgattctgctcaggaaactgacaggacctgctgttcagtatgccttcaggatttcggaccgcggcaatttgtgagagccttgcctcagtgccagcacattttccacgtgcgatgcatcgacgactggcttcagaggaactcatcctgcccactgtgcaggggtggtgttcatatagaccacatgtgcttatagtcgaatgcccgagctcgcgttccataatcgtgaaatagtcgtgtatacatagatgtttttctttcctcccttttgccagtctgtggagtgggggcaacgtttccggctgcacgttttctttgtcatagnaaaacgtga

SEQ ID NO: 7734 - DNA, 875 bp, Hordeum vulgare
  Predicted polypeptide sequence is orthologous to G380
gggcatcaagacggacagttcttgggtttctgggggtcaggtgaagctagttcgagcggcaatgcgctgaacattggtggtggtttgaggatcggtgaaaggcgcctgggtgctgatacacagcctttctttggataatgtggatatcaaccttaacgccagtggccatgatctctttggtcagagcacaaatgcgaatgccacctctcaagcctcacagcaaaatgctggatgttcccgtgctgataccacagcccaggctactgagcttagattgcatccttacagaactttcggtttagacgacgagcagccagagccgttcacttctttgaatgctttcgaacatcctttggggaatttctccctgatgccagaggacattgatcaaagaccaggcagttccctggacggccggcgtttagcgtgcaagaggaaaaacattgaaggagtccatgggcagttttcagcaggtgctagcacaagcttttcccacagaaatgataatgccttccatagtgttccttcttcaagtttcaatccaactcctggcccaaatgtgtcctctcataacttcttggtagctcccaaatgccttgaggaacaccttccgaactatggaacctctacaggaattgtatctggttggctccaatcctcctagggggggcgattacagtggtaggaaattccacgaaaagtttttgggcaaagactatcaacggttagcagggtagcccctctgggtgttttggcctccttacgggttctattcggcttctcgagttattattacccccgagcgccctgcctctcaagaaccagtttgattgacaccaaagcggctttgcctgtagctcctgcgaatcaccttg

SEQ ID NO: 7735 - DNA, 708 bp, Hordeum vulgare
  misc_feature (506)..(506): n is a, c, g, or t
  misc_feature (588)..(588): n is a, c, g, or t
  misc_feature (599)..(599): n is a, c, g, or t
  misc_feature (621)..(621): n is a, c, g, or t
  misc_feature (623)..(623): n is a, c, g, or t
  misc_feature (666)..(666): n is a, c, g, or t
  misc_feature (674)..(674): n is a, c, g, or t
  misc_feature (690)..(690): n is a, c, g, or t
  Predicted polypeptide sequence is orthologous to G384, G385
cgagatcctcatggacgtcaaccagtacgcggcagtgttctcgagcatcgtgtcaagggcggcgacgctggaggtgctgtccaccggcgtggctgggtgctacgacggcgcgctgcaggtcatgtcggtggagttccaggtgccgtcgccgctggtgccgacaagggagagctacttcgtgcgctactgcaagcgcaacgctgatggagcctgggccgtcgtcgatgtgtcgctggacggcctgcaaggggtcaagtgccggcgcaggccctccggttgcctcatccaggaggcgcccaacggctactccaaggtgacgtgggtggagcatgtggaggtggacgacaggtccgtgcacaacatctacaagccgctggtcggctccggcctggccttcggcgcccgccgggtgggtcggcgtcctcggccgccagtgcgagcgcctcgctagcgccatggccagcaacatccccaccagcgacatcggagtgatcacgagctcaganggggaggaagagcatgctgaagctggcggagaggatggtggcaagctttctgcggcggcgtgacggcctctgtggccccacnaatggacaacnctgtcggggagcggcgccgaanangttagggtcatgaacaagaaaagcgtcgacgacccagggaggncgccgggnattttcctcacgccgntacctcccttttggtccc

SEQ ID NO: 7736 - DNA, 1069 bp, Hordeum vulgare
  misc_feature (979)..(979): n is a, c, g, or t
  misc_feature (1010)..(1010): n is a, c, g, or t
  Predicted polypeptide sequence is orthologous to G386, G707
gaccgtgaacaatcttatctcctgcactatcaagaagatcaagacggcgctgcaatgcgcaacgcctgagtgttaggatggattttgccttggggatgaccggcgggcgctgagtctgagtcaagaacgaaccgcgcaatgaaaaaaaatcctttgctaggtgataaggatctttttgacaggtccttagcacaaagcaatggtggtggttcgggtattgactcggcctattccgtccggctgtttttccccagggccatgcattttatatattttttcagggacatgctatagtcccatcgttttagggtgaactttgggctggctcgttgccctgtgttttgcgcgtctttttttctgttgtaggggtgacctggtttccaggtagaccctcaaaaataccgggtagatctacggggccccccctttggtcctggtgagaggtttaaaataaaacttaaaccgttgaaaatcttttttgcacaaataatgttgtggcggttgttggggaaaaacatataatatttaaattatctgcatgatcactgacgtaataattttattttatctttgggggggggggcccgttcccaatttcgccttttaaaagagattttttataatatatctgtgcgggttgtttaacaattggtgaggtagggaaaacaccctggggtacacctaattttttgctcgcggcaacacttcctcttatcctcagattggggataattaagaaagaggcgccctataaattttctctcttccacaatatattgcccatacttatgatgcgcatattcgcttaaatgggccgttttattatttgtataaatatctcatgttattatcttactgtaatccctcacgtattttctatcaacatgcgcggcgattctgacgtcatattcttatactaaattacacattgactctactgttgcgtggttgtgttctcctgatattcagtaatctgtantcactctcataagaggtgtgtccgcacactncttgtgctgcaaaatgctgctatatgaaggttatacattcctttactgttatgcgtacg

SEQ ID NO: 7737 - DNA, 736 bp, Hordeum vulgare
  misc_feature (2)..(2): n is a, c, g, or t
  misc_feature (715)..(715): n is a, c, g, or t
  Predicted polypeptide sequence is orthologous to G388
tntccccttttaattgaagctaaaggttttcgaattacatgccatcatggcggcacaagcatctgttacaacaagcattattttcttccactgtaagactgtatacaggctgcagcatcatatcatcgcattaccagcgtccgttgttcgcctggcggcgatacgcggccgcagagacaccgttcagcccactcaccaggttgctgtagtcccccagctggtggtgttgttgcgggaacccatttgcgctcaacgatccgagattcatcgacgacggattggcagagccgccatgtccgtacagccaaggcttcgaggggctcatgtcagacaggccaccgttggtggcgtatgtgtccagcgaggagaactgcatctccctcgccccctggagagggctcatgtcgtaggccctcgagtacccatcgccatagtaccggtcagtggaattaaaccgaccgggagtgctggcagaagccatcatctccggatctgccaggctgcctctgctaaaccgcccaggactgccgacagaagacatctcggaatctgccaagttccctctgctaaaccgcctcgaactactgacagaagccatatccaaatctgccaagttgcctctgctaaaccgtccaggactactaaccgaagccatttctgaatctgctatgttgcctctgctaaaccgcccgagactgctgacagaagccatttncgaatctgctatgttgcctct

SEQ ID NO: 7738 - DNA, 1501 bp, Hordeum vulgare
  misc_feature (7)..(8): n is a, c, g, or t
  misc_feature (57)..(57): n is a, c, g, or t
  misc_feature (588)..(588): n is a, c, g, or t
  misc_feature (620)..(620): n is a, c, g, or t
  misc_feature (690)..(690): n is a, c, g, or t
  misc_feature (799)..(799): n is a, c, g, or t
  misc_feature (859)..(859): n is a, c, g, or t
  misc_feature (877)..(877): n is a, c, g, or t
  misc_feature (901)..(901): n is a, c, g, or t
  misc_feature (933)..(933): n is a, c, g, or t
  misc_feature (1045)..(1053): n is a, c, g, or t
  misc_feature (1055)..(1056): n is a, c, g, or t
  misc_feature (1059)..(1059): n is a, c, g, or t
  misc_feature (1062)..(1063): n is a, c, g, or t
  misc_feature (1084)..(1084): n is a, c, g, or t
  misc_feature (1099)..(1099): n is a, c, g, or t
  misc_feature (1439)..(1439): n is a, c, g, or t
  Predicted polypeptide sequence is orthologous to G390, G391, G438
tggggannccgctttaaatcgaagcccgatggatactaacggaacaaggcttgagcntcaccggcggggggggccgctctagaactagtggatcccccgggctgcaggaattcggcacgagacttgatcagtgcttaccattgctttccagttctcatatgagaaccaccttcgagagagtgtcgcggcaatggcgaggcagtatgtgaggactgtggtggcatcagtgcagagggtggccatggcaatcgctccttcccgtcctggtggacagatcgaaatgaagaaccctccaggatcccctgaggctcacacgcttgcgaggtggatcggcaggagctacaggtttcacaccggggcggaactcctttgcacggagtcacagagcgcggacgcatccctgaaagcgctgtggcagcactcggattcaatcatgtgctgttccctgaaggcagctcctgtgttcaccttcgccaaccaggccggcctggacatgctggagacgacgctgattgcgctccaggacatctcgctggagaagatcctcgacgatgatggccgcaaggcgctgtgctccgagttccccanaatcatgcagcagggtttcgcgtacctcccangcggcgtgtgcgtgtcgagcataggggcggccggtgtcgtacgagcaggcggtggcgtggaaggtgctgngcgacgacgacgcgccgcactgcctcgcctttcatgtcgtcaactggtccttcgtgtagcagcttgtagccagcattagaagtgatgagccaccctcggctaccgttcngttgcaaactgcgtctccgaaaaacattgtgtgccgcgctcgtcgctttgtcttggtcangaatcagacccttcagtntatcatcatatcatcattcatcanaaaaaaaaaaaaactcgaggggggcccggaancaatccgccttatagggaggtattacccgccctcactgcccggcgttttacaccgccgggattggagaaacacctgtgggtaccccaatttatattcgttttggcaacaaannnnnnnnntnnggntgnnggggggggcggtgtgcgtctntccactcctcaccantgattaagacgcgtggtacaacgcgtggtcgtgctgctgtggtgtttatatacaaactgtaaaaaagagtatcgactcgtcgcctgcttctccgataagacagtagtctgccagaaaagacacgcccggtgtatgccctgcctactacttatatattaaacgttacgatcctgaagcggtacaccgttgtgacgtggtaagtggctttcatggcgaatcagaaagccgatgagatgctttactgtgcatctgggagatggctgatgcctgtgtcgatgcgtgcgtcatgcaacggattacacggactgtcgtactgacgcactgagtgtaaatgactaancccgatctcgctcatgcgcgggattcgttcgaaagagttgcgtgctctcgctctagatcgcg

SEQ ID NO: 7739 - DNA, 397 bp, Hordeum vulgare
  Predicted polypeptide sequence is orthologous to G390, G391, G438
ggacaaggtgctggagtacgagcagggggggaagggcctcctgtgcgcggacctgatggccagcgtcgcggagcaggggttcgcgtgcgtcgagggcgggacgtgcgcgtcgagcatgggccggccggcgtcgtacgggaaggcggtggcgtggaaggtgctcgacgacggcggcgccggcgccgcccactgcgtgtgcttcgcgttcatcgactggtccttcgtttaggcgagggaccgatcgttgttgttgtagtcgccgtttgttgccaggtctcgggcgttggtgatgggcgcggtgcaatgcttggacgattatggtggtgttttgtacggcttgatggtgtgtgccgagaatcgtgatgctgtttgattgctttgtagtaaaaaaaaaaaa

SEQ ID NO: 7740 - DNA, 659 bp, Hordeum vulgare
  Predicted polypeptide sequence is orthologous to G390, G391, G438
cgtttcttgcctgggtaaattagtggaaatgtgagcagatttacacaaggtcagaattcttccggatgctggctcttcaaatctacaaacaaactagttaaagatagcatgaaactactttccagcggcagcggttctctcctacagagagagagagcaaaaatggagctgcgtgcgacgggcacggattgccttgggaggatgatcacacgaaagaccagttgacgaagcagaaggcaaggcagtgcacattgttgtcctcaccgactactttccatgctatagcattctcgaaggagacatggcggcccatcccagacaagcacacaccacctggcaggtaaacaaagccctgctccatcaactttgggatctcagagtatagtgcctttctaccagcttcatcaaatatcttgtccaacgagaggtcttgaagggcaacgaaagatgtttccaacatgttaatccccatctcgtttgcaaacgtaaatacaggcttttccttgaaagaacagcacaaaatagcatcttcatgatcccagagcattctcaataaagattccccagcttcatctgcctgtctaaataactcgacccccagatggaaccggtagctttggcatatccagcgagcaagtgttgcagcttcagggaagcca

SEQ ID NO: 7741 - DNA, 974 bp, Hordeum vulgare
  Predicted polypeptide sequence is orthologous to G391, G438
ttttttttttttatatttgccaaaatcttgggacattttgaaatatgtttaaacggattttagaaaccaagagaacatagcaaccctctaagatgcatgcatgcatctatttgaatacccaagcaggcaggcagaggccgtggatgtaccatcgtaattcgaccgtgggaatcccaacacggaatgcaggttgatgggcaccaagcaaacacatttgggtttccgttggtgtccaaaagaaaccatactaggagtaactccccacgtttagagctaacgctgcaaaaactactatcagttgcacattctcccttgtccggaacaaccaccaagaactgtatccatctgctcgtcacgcaccaccggccggccccgcggcatttggttcatcacacgaatgaccagttgacccaagcacaaggcgaggctgtggacgctgctttcctcaccgagcacctttcacgccaccacctggtcaaatgaaacatgccgactcatcccctacatgcacacaccctgaacggcagtgacacattgcgctgtttcaccatgtttgatatttccgtcaaacatcactttatttccaggctcggtaaaagaatttggctcaacgtgatagtctatgttatgcgactagggaattatctaacattgtcaagccccgtcttttaggaaaaagtataccctggtccttcctagatctgtaaagatatattgtgctgctttggatagtacttgctaaaggtgaaaactgtactataccataattgggtttaatcatacatgtatagccattaggacaacccgatagagaacataagcgtgcacccataaggcctccgagaaaactgcaattatgtatcgttgaaacactaaattaatataatcggaagtcacctggaacactactgcgtgtataaaatatatgtaaagatctctgtaggagtgataaacgcgttaacgaagcttacgcg

SEQ ID NO: 7742 - DNA, 603 bp, Hordeum vulgare
  misc_feature (566)..(566): n is a, c, g, or t
  Predicted polypeptide sequence is orthologous to G416
cagcttgtcaaccgagcaataagttaacgagaagcgatattctgaacatcgcctagcagtgagcagctagttgcatagcaacaattattctacgcaaaatagtccacatgtgtccgtcaggcacggggggcaggtgaactcaagaacgcgaacgttgctaatcctgcaattagcactggtatacgatgcggaagatggcagacacgctgcggacctgtccacttgcattctgatctatggcctagtctccctcggtatcttcgccgctgtcttctctgccttctgtagtgagatctacacagctagcttttggtatcaaaccaatacgtactgcaatatccattttctttctggcataatccaaatacgtttttggttctggaaacatttttttcattgaccctttgatcaacagatggcagtcctcttctgaaatcttttcatctatgcaggccacgtaggtatcatatttctttttcatccaaccatggaacgaaggtggcaatttttcaatttccagtttaatctgacccatgagcaaggggaacaatttcttttgatatatntcctccaaagcacaatagtaatcaaccttctgcttag

SEQ ID NO: 7743 - DNA, 317 bp, Hordeum vulgare
  Predicted polypeptide sequence is orthologous to G418
cacatcgatcatactaaagcgcaggatttctgcaaccatttcaactggaaacaaactgcggccgtctgacagaaaattcccatcccagactacaaaaatcacctcgcataatatactccaaacactgcaaatttcactgacaagcccggcatctgcgaccgcaccacacacagcccacacaaactccagaaaattaagacagacagtgtccggccgactacgagcgccgagatccagggcaccgaaacatgatcacggagaacctgaaaaccacaccccaaacctaacaaatcgcttccccggcacaacccccggag

SEQ ID NO: 7744 - DNA, 714 bp, Hordeum vulgare
  Predicted polypeptide sequence is orthologous to G419
atcggtgcaggtagcacctatatgggttgtggcactagattatgttcttgtctcctagcctgcaaaatcatgcagcagctcagaccccatgaggttcctatacggtagcaccacatcttcctcgtcagctccaaccatgagtgatgattgttgttgcatcatcatcgccggtgatgtgaacgctcgttgctgctggagtcccaaggtaagtgacaccgcgccattgccaacatcaccatgcaaagttgggtagccatggagctggccaccctcggcaacaagggaggatgggataaagcagtcactaggattgtttgtgctgctaaggcgatgacgactttcatctcgtatcgtcgcaaccttcgtccatgccgctaacttgtttttgtgatgatccgtgggggaaggttctcctctaccaccgctagcgccgttgtcatcatgttgtatggtttcttctgcatacatctcctctatcatgggcttccatagcctaacccttgcattgatgaaccagttggaaacctggcttcttgataacccggattggcgcgccaaaatgtgcttgtctacgtcatttggatacgggtggaggaagtgctcgaagagccacgagcggaggacggcgacggcacgctctggcaggccgcgttggggccgccacgggcagctctcaatggcggcggcaccaccatattgctggaacgccctttg

SEQ ID NO: 7745 - DNA, 651 bp, Hordeum vulgare
  misc_feature (13)..(13): n is a, c, g, or t
  Predicted polypeptide sequence is orthologous to G427
aaaaaacccaagnattttttttccttttgagtatatatatcagctcaacaattgcaacgcatatgcaaagtggtcagactagtagcgtgtacgtatgtcattaaggtgtcacctctgactaataactagatatacaattgaatcgagatcttcttatttctccctgtgtggcgtgtcaccgagatcttccgtgtgattaggcgtcaggtatatgcatgtatatatatactttgcacttttgcagctcccacctagctaccttttacgctttgatttgagggtggatgtctgtgagttgttgtgccagttgcgcttcctctggttgatgaaccagttgttgatttgcttcagctgcagtccagtctcttcaacgagcttggccttatcatcttccgtggggtagggccacttggcgtgttcctgccaccattgcttcagtatggtggtggtgtccccaggcaacttcccggccctcctcttccggagtatctcttccctcacgtctccaatccttgacttgaaaccctgtttgagttcaattttgagctcctgcctgaccctctccataagggaacgctccgtgtccgtgggcaccagagggccaaagcccatcatgtcgtgtccattcgagctcatatccagtggcgctgc

SEQ ID NO: 7746 - DNA, 666 bp, Hordeum vulgare
  Predicted polypeptide sequence is orthologous to G427
ttcggcacgagggacacggcgtccaccctgaagcttggtggcaagcccacgcgaaatggccgtacccaactgaggaggacaaggcgcggctggtgcaggagacggggctgcagctgaagcagatcaacaactggttcatcaaccagcgcaagcggaactggcacagcaacccgacctcgtcctcgtcggacaagagcaagagaaaaaggtgacggcaacgcggagcagtcctggtagggcggccggagacgaagaacgatcgaacccgttgtatgtacatagcgcttccatcttggagaaggcttgatatatttattggtccggggagatacgacacgacgcgacggcggtcatttgcgccggagtcgtctcccggacctcaacaccgtctccgtctgtactgtaccccaaaaagaaaaaagaaaaaacatgtagtggtaatgtacccgtagctgtttttgtggcgtgctgcgtgttgggaggacgcggcgtcgtgagtttgtatacgggctgttccgtaacgtgtgtcgtggatttgtgtgttgtgttgtgttgcgttaccgtgggaacggtggcaagggctgcgtgggtgatgtatgtttgtgtacctgtatttgtattactgaccttgattgatgcgtcgtcggtgctgtgctgtttgtccgt

SEQ ID NO: 7747 - DNA, 1536 bp, Hordeum vulgare
  misc_feature (1002)..(1002): n is a, c, g, or t
  misc_feature (1013)..(1013): n is a, c, g, or t
  misc_feature (1015)..(1015): n is a, c, g, or t
  misc_feature (1067)..(1067): n is a, c, g, or t
  Predicted polypeptide sequence is orthologous to G427
ccaccaacacccaaggcagcagcagcggatacatacgaagcgggagctatagcccgcgcgcgcaggcctgttcggccatggcgtaccagtaccaccaccaccaggaccacgcgctggggatggacgcggcggcggcggcggcggcgggggggaaccctggcggcggcggcttcgcgccgggcttaagcgcgggcggcgcgtgggagggggagaaggcggccgtcgaggcgcacccgctgtacgagcggctgctggaggcgcacgtcgcctgcctccgcgtcgccacccccgtcgaccagctcccccgcatcgacgcgcagatcgccgcgcgcgccccgcctcccatgccccccgccagcgcgctctccggcggcgaggagctcgacctcttcatgacacactacgtgctcctcctctgttccttcaaggaacagctccagcagcatgtgcgcgtccacgccatggaagcggtgatggcttgctgggagctcgagcagactttacagagtcttacaggggcatctcctggcgaaggcaccggggcaactatgtctgatgatgaagacaacccggtcgacagcgagagcaacatgttcgacggaaacgacgtgtccgatggcatgggcttcgggatgctaaccgagggtgagagatccttggtcgagcgcgtcaggcaagagctgaagcacgagcttaaacaggggtacagagaaaagcttgtggacatcagggaagagatactccggaagcgaagggccgggaagctcccgggagacacggcgtccaccttgaaggcttggtggcaagcccacgcgaaatggccgtacccaactgaggaggacaaggcgcggctggtgcaggagacggggctgcagctgaagcagatcaacaactggttcatcaaccagcgcaagcggaactggcacagcaacccgacctcgtcctcgtcggacaagagcaagagaaaaaggtacaattctcgccttaagacgccattttcanctgctcgagancnatctctctctctctctctctctccgggttggatttcattccctcttcattcncaaaaacaaaacaaaaaggaacaatgcaggtgacggcaacgcggagcagtcctggtagggcggccggagacgaagaacgatcgaacccgttgtatgtacatagcgcttccatcttggagaaggcttgatatatttattggtccggggagacacgacacgacgcgacggcggtcatttgcgccggagtcgtctcccagacctcaacaccgtctgtactgtaccccaaaaagaaaaaaagaaaaaacatgtagtggtaatgtacccgtagctgtttttgtggcgtgctgcgtgttgggaggacgcggcgtcgtgagtttgtatacgggctgttccgtaacgtgtgtcgtggatttgtgtgttgtgttgcgttaccgtgggaactgtggcaagggctgcgtgggtgatgtatgtttgtgtacctgtatttgtattactgaccttgattgatgcgtaaaaaaaaaaaaaaaaa

SEQ ID NO: 7748 - DNA, 210 bp, Hordeum vulgare
  Predicted polypeptide sequence is orthologous to G446
ctcctcaagcggaccgtagcgggcaggaggatcgtttggtcgccggagcttcggccccttgcgagcgggctcgttcctcgcgttctccatgccagtcgcggccgcagctgctccatcgcctccggtcatcaccggagtagcagcgccgccgccaggtcgcctccgtgtcgcgagaagaaaaggtatcaatgattcactgtgcgaaataag

SEQ ID NO: 7749 - DNA, 811 bp, Hordeum vulgare
  Predicted polypeptide sequence is orthologous to G447
ctcgtgccgaattcggcacgagcatttggtgtgcctgacatgtccttcaagcctggatgttcaggtgatattgctgttaatgatggtggaatgccaagccaaggattgtggaataatcaaacacagcggatgagaactttcacaaaggttcaaaagcgtggatccgtggggcgatcaatcgacatcacacggtatacaaattatgatgaactacggcatgatcttgcatgcatgtttggtattcaaggccagctcgaggacccgtacagaatggactggaagctagtctatgttgatcatgaaaacgacatcctccttgttggtgatgacccatgggaggagtttgtgagctgtgtgaagagcatcaaaatattatcatctgttgaagtgcaacagatgagtttggatggcgaccttggcggtatccctccacaaacacaagcctgtagcgcatccgatgatgcaaatgcatggagaggatcctgatgtaaatactaaatttaatgtgcttcttaccattatttaaagaaatacccagaggtttaaggacccaccacacagctagtgttactctgaggttagacctagagccgactcactgacaaaattggtcaaatgcttctggcgaaagatgttcagtgaaccggctttatcgcggaactgttgatgtcttgttgccactaaaattcggtgacctattccacatgatcagattagtttcctttttttgccataccacttgcttttgaatttcgtaagcctaccctgtgtttaacaggggatttgcaagctattggtaatcttacaagtt

SEQ ID NO: 7750 - DNA, 805 bp, Hordeum vulgare
  misc_feature (805)..(805): n is a, c, g, or t
  Predicted polypeptide sequence is orthologous to G447
cagaattgccaaagttaaataatagtgttaagtcaagtgcgatctcctcaaaattaccaaatgttgtgtccggccttcaaaattttatgaacaatgcactgccaacagacaacctggaaacagcttcgtcagcaacttcattatggccttcacaatcagatggacttctgcaccaaggtttcgccacttctaatttcaaccagcaccagatgttcaaagatgaacttcctgatgtagaaattcaaggtgtggacccaagtaacagtgccctctttgggatgaacagtgatggcccattagggtttcctatggaaacagaaggcttgttggaaaatgcacttgattctgtgaagtatcagaatcatttctcaactgatgatgagaacaactaccggatgcaaaaggatgcccgtcaagagatatcaacctccatggtttcacagtcatttggtcaatcagatatggcttttaattccatcgattctgcaattaatgatggcgccttaatgaacagaaattcttggcctcctgccgctccaccacagaggatgcgtacattcaccaaggtgtacaagcgtggagctgttggccggtccattgacattggtgggttctctggatatggagaactgaatcaagctttggcccgcatgtttggtatagaagggcaacttgaaaaccgacagagaataggttggaagctagtctacacagatcatgaagacgacgtccttacttttggtgataacccatgggaggagattgggaaatgcgttaagggcattaggatcctatccccctaagn

SEQ ID NO: 7751 - DNA, 719 bp, Hordeum vulgare
  misc_feature (587)..(587): n is a, c, g, or t
  Predicted polypeptide sequence is orthologous to G447
tagaaattccagggcaccggctcctgcacatcaacgcatgcgaacctacaccaaggtgcacaaacgtggtgctgtagggagatctatcgacatgaaccgttattcagggtatgatgaactgaagcatgacattgctcggatgtttggtatcgaagggcagcttggtgaccaaagtagagttggctggaaactagtatatgaagatcatgaaaaggatgttctactagttggtgatgacccatgggaggattttctgaactgtgtacggtgcatcaggattctttctccacaggaagaaatgcaaatgagattggttggtgactttggcgacggctttctacccaaccaagcttgcagcagctcagatgggggtcaaccttggtaactgagatcacatgtttgaatgaccaatgtagttccaggcgctgctggaccaatatttttgtcggccagtcccatgaaaacggatgctggtgatgatagttgacgatgatttaggctctgaaattccaaggccgagtgaacatgaatataaggaacaattcatacttttttgtctctattgtagtcttgtagctctgatgttntgttggccttgcaatctacatagccaacccatatttgctgctgccatgtagtatatgtcattgttgcctgatgtaacagtttgccacatactcagaggtcaactgctgtaactagctacagattctaaacga

SEQ ID NO: 7752 - DNA, 700 bp, Hordeum vulgare
  Predicted polypeptide sequence is orthologous to G447
gtttttttttcttttttttaacttgagactcatggagatcttaagaatttcctcacaacagaggaagcatcaggtaactacagaacttgccttaccaatagtacaacatatcccccctaaccctctccaattctaggtaagcttaatttacccatgcctacttcctttcttgtaacaactacacatataaacataacaccactaatccgatgagccgtttgcgctccaggatgtaagctgacagaatctacaacatcctggagccgcacacccaggatgtctacttagaccgacgccattgcggtgtgtatagactggtaaattaggtcattcaaactggtcgtatgaaccggtggaagggttgccggagttctggtcacagcgagccttccaggcattgcccccaccttccgagctgctgcacgcctggttggggacaatgctgctccccagatcgccgtccaagctcatctgctgcacttcctgaggcgaaaggatcctgatgcacttcacgcagttgacaaactcctcccaagggtcgtcgccaagaagtaggatgtcatcctcatgatctctgtagacaagtttccagccaatcctctgtcgttcctcaagttgcccctctatgctaaacattcgagccagagcctgctttaattcctcgtatccagcgtattgactaatgtcgatagaccggccc

SEQ ID NO: 7753 - DNA, 801 bp, Hordeum vulgare
  Predicted polypeptide sequence is orthologous to G450, G456
ggcgggcctcgggttcgaggagaccgagctgcggctcggcctgccaggcggcggcaacgaggctgaggaggcggtgaggagctccggcaagaggggctacgccgagaccatcgacctcatgctgaagctggagccagcgtcggcggccgcgccgccgtccgaggatgacgaggaagtggccgacggtgccgcggaggcgcagccgtctccggctgctgccgacgggcagttgaagcggtcgccgagccagagcagcgtggtcaccgcgcagccggaagaggaccccgagaagccgcgcgcgcccaaggcgcatgcggtggggtggccgccggtgcggtcgttccggaggaacatgctggcggcggcgctggtgaaggtgagcatggacggcgcgccctacctgcgcaaggtggacatgggcacctacaagagctaccaggagctgtccaaggccctggagaaaatgttcagctccttcaccatcggcaacgactgctcttaagcctcgggcatcaatggcatgaacgaaaccaagctgggcgacctggtaaccgggtccgactacgtgcccacctacgaagacaaggacggcgactggatgctcgtcggcgacgttcccctgggagatgttcgtcgcgttgtgcaaccgcctccggattatgaaaggatcagaaaccctcgggctcgcgccaagggcaatggagaaatgcaagaacaagaactggacgagggtccctttcaagaatataaatgggtctatgcttgccccactctgtaccctaatattactaagactggctc

SEQ ID NO: 7754 - DNA, 877 bp, Hordeum vulgare
  misc_feature (425)..(425): n is a, c, g, or t
  Predicted polypeptide sequence is orthologous to G450, G456
cagctcctcttcttcatcatcacgccccacccctccctctccctctccctctccggcccgaacaaaaagagctccttctacacctccccacctcctcctcggacttccttccttccttccatccatccttccatacatccaatgccgccgccgaatctccaagcgcgcgactacatcggcctgggccctgccgcgccatcctcctcctgctgctcctcctcgggcgagacgggcccgcacctcgcgctccgcctcggcctgccgggctgcggctcagcggacgaggccgccgtcgacgccgcgctcacgctcgggcccgctcctgccccgacacggggcggcgccaagcgtgggttcgccgactcgctgctccaccgtactgccggggcgggcggggaggaggacaagacgaagggtgaatcccncgccgccggacccggagccggagctcctccagccgcacaggctcaagttgtcggatggccacctgttcggagctaccggaagaacacgttagccggcaacgccacaaagaccaaagcggagagccaagggtagaagcgaggcgggatgctggctattcaagggcaagatggatggagccccatacctaaggaagggcgatcttaagactacttcagctttgacaaacctttccctggggctggaggaaaatggacacctgcttaaatactggccaaaaccgttacctggcaaaaattaaccaaagaaaggcttaccggggggagtagggcctaagctcctacagacccaaagtttgggcctttcctttgaaaacaaaaaacttaagggatgcctgatggggaactaccctgggaccttggacccacatcttcagggagaaccagagaagagg

SEQ ID NO: 7755 - DNA, 1024 bp, Hordeum vulgare
  Predicted polypeptide sequence is orthologous to G450, G456
tcagagaattgagcaccccccgggctgcaagttcgcctccccggctccgaccccgaccgcaagcgcgcctccacctccgaccccgactgcccctccccgacctccgccgccttcgactctcccccttcccccaaggcgcacgtggtgggctggccaccggttcggtccttccggaagaacgccctcgcgtccgcggcctcgtccaagaccaagttcgtcaaggtggccgtcgacggcgcgccctacctgcgcaaggtcgacctcaaggcttacgcgggctacacaagccctgcctcctacgaccagctcctcgccacgctccaggacaagttcatctcccacctaaccgtccgcaagcttggtaacgaggagatgaagctcgtggacgcgctgagcggcacggaatatgtgccaacgtacgaggacaaggacggcgactggatgctcgtcggagacgtcccctggagaaggtttgtggagacctgccagcgcatccgtctaatgaaaagctctgaggttgtcaatctaccaccaaaacctgtccgggaggcacaatccttgctcctttttctacagaccgcttcaaaagaagaaatgtcttttgctcaaggaggttctttcgcaaggttccgaagtaagaaaggggtacagccatctctacttttttgccccagaatgctattgagttccggaaagggccgttaacctggaattcccttctcccaggccagtgcagttgtttcctacaatgaaagatgggagaaaggtggagaagccctccaaaaatttaccccctacaagttcgtgtactggatgaaaaaataaccagaattgcccgtgtattccctgaggcgtgctttggttcctgggaaaaatagcgcttacgccgatgagaaaataaaaataatatacaacgccccggagagggggggcgagagatcaccatcatttagacccgtttatgtgaacatggatttacgaatccgccgggacgccgcggcgtgttcaacctaatagaagacct

SEQ ID NO: 7756 - DNA, 961 bp, Hordeum vulgare
  misc_feature (140)..(140): n is a, c, g, or t
  misc_feature (143)..(143): n is a, c, g, or t
  Predicted polypeptide sequence is orthologous to G450, G456
tttagtagtatgtatcatagttgcgcgtcatattgaatagagtgttgttgttctttattatctctgtcaatactatcttaattctaggagtgatatattatatatccgttaaggagtttcgggtttgttaaggggtgggntantgatattggagatcgtatttaagttttgtattctaagctggagctcaaccgcagtggcgttctggtctatattaaactaatggatccccctggctgaatgaattggcacgagggcctccggtccggtcgttccggaagaacatcctggcggagaagtcgtcgccggcggctgcggcgttcgtcaaggtgagcatggacggcgcgccttacctgcgcaaggtggacctcagcatgtacaagacctaccaggacctctccaaggccctcgagaagatgttcagctccttcaccatcggaaactgtggaacttaagggatgaacggcatgaacgagagcaagctgatggatctgctcaacggatccgagtacgttccaacgtacgaggacaaggacggcgactggatgctcgtcggggacgtcccgtgggaaatgttcgttgagtcatgcaagcgccttcggataatgaaaggatcagaagctattggccttgcaccaaggcgatggaaaaatgcaagaacaggaactatgggaagatgtactaaatgtttgcaagaatcaaatactataaccttgttgctaccctgatcaattctttggctaatctagtctgatctctgatagtgaatatttggttgtgactttctttcagtattagtccaatctatttgtatttctagaagagacccaacattgaatgtatttactgttgccataatgggtttttttttaaaaaaaaataaaaaaatcttagggggggccgtaccaatttccctattggaactgttttaacctcttaattgcccttatttaaaaatctc

SEQ ID NO: 7757 - DNA, 921 bp, Hordeum vulgare
  misc_feature (8)..(8): n is a, c, g, or t
  Predicted polypeptide sequence is orthologous to G450, G456
tgtagacngcgcgtaggaaccccactaaagggaacaaaagctggagctccaccgcggtggcggccgctctagaactagtggatcccccgggctgcatgaattcggcacgaggccgggaagaggggctatgaggacaccattgacttgaagctgacgctgcccaccggcggcatgcaggaagactccgccggcaagccggagccggcagccgacaaggccaagaggccggcagaggccgcggccgctgaccccgagaagccacctgctcccaaggcacaggctgtgggttggccaccagtccggtcgtaccgcaggaacgccatgaccgtccaatcggtgaagatcaagaaggaggaggagaccgagaagcagcagcctgctgctaccgctgctgctggcgccaacggctccaactttgtcaaggtgagcatggacggcgcgccctacctgcgcaaggtggatctcaagatgtacaacacctataaggacctctccattgctctgcacaagatgttcagcaccttcaccgcaactgggaatgaggggaagatggttgaggcagtgaacggttcagatgttgttactacttacgaagacaaggatggcgactggatgcttgttggagacgtcccatgggagatgtttgttgcttcatgcaaacgcttgatgatcatgaatggttccgaagccatcggtcttgcaccaagggccaaggacaagtacaagaacaagagcttaacatggggcagttagaggaagactatgatgccataaaggatggtgggttttggcaatgtggctggggggttcttaaaaaatataaaagggttttcaacccccacccccggccttacagacacggccaccccttgccccctgtcaaacatcgggtgggcggggacccaaaagccaaaaattttc

SEQ ID NO: 7758 - DNA, 563 bp, Hordeum vulgare
  Predicted polypeptide sequence is orthologous to G450, G456
caagctcccagcactttcaccatcaccatctttctatacgtagtagtagtagtagtagagagtgctacagacgagtaatgaaaccaacatcttttcacgactcaagagcatcgggcgaccgaaagcggtaagcgaagataatagctgtacacgttcctatctcctcatcagagcaaagccccctcctcctttcaggcagcaccattcgtaagggccacgcagtgcacctcaccgggcagctccaggtgctaggttcacggcctcggagttcttcatcaggcggacgcgttggcaggcctccacaaacatcttccagggggacgtcgccgacgagcatccaatcgccgtccttgtcctcgtaggtgggcacgtactccgtcccgttcaccgcgtccaccagcttcttctcgtcgttggcgaaccctcgtgccgaattcctgcagcccgggggatccactagttctagagcggccgccaccgcggtggagctccagcttttgttccctttagtgagggttaattgcgcgcttggcgtaatcatggtcatagctgtttcctgtgtg

SEQ ID NO: 7759 - DNA, 656 bp, Hordeum vulgare
  misc_feature (19)..(19): n is a, c, g, or t
  Predicted polypeptide sequence is orthologous to G451
aacttatctactacacggnacacccaagtcccggtcctttcttacatggctgcctgaacctctggctgtacaacatcagtacgtgcatgtactctactacctactactccgacaaaacagtactgctagtctgctaccgctactgcatgctacctgcgcgccgatccggccggactggccgccggagctcgcgcgcctgtgagtccctggacccagcctcgcgttcgtaccgagcgggtggatgcagatcagtacacttcacagagcgcgcgtgcgtgaaccggctagctcacgggtcacggcctccgtcgccgttcacccatggccggcccgatcatgcatgcgtctgtgtgtccgtctctgatcatgagccacgtacggcaagtttccatcgtctccggatcgcttcatttatgtatgtgtgcacgatcgtgtccttttcgtcgccatcatcgtgcttccgagcttttcattatcctcagcctcttgcaggacgagatgaacatgctgcaaaaccaaacgaagaaatcacccgttagttagactcatttttggtcagttggtatatgcaaattaattaagatgggtacgtgttggtgtgcttactcccaggggacgtcgccggcgagcatgaggtcgccgtccttgtcctcgta

SEQ ID NO: 7760 - DNA, 418 bp, Hordeum vulgare
  Predicted polypeptide sequence is orthologous to G464
tttttttttttttttttttgctaaccttaatttctttatgacttctcaaaccaacacaaaaatttcaagtgccgaaaaggggccaaatgttaaatccctagctgccgctatcatcaaaagattataactgaatcacatgagaagtgagatgacgagaagaaccgaaaatcaaatggtagaagaaagaaagaatcgcagaacaactttcctttgtttttctctctttaggtcacagatcgagatccaagcccgaatgcgcctccctcttggaagacgacgacgacgatggagacgacgcctcggcaccgtgcgaggggaattcgagcagcctcagcgtatggtcccttggccgccatgctgatgcgggcatctgcaatggcagtgcactgccataattgctcgattcgcccccgccatc

SEQ ID NO: 7761 - DNA, 731 bp, Hordeum vulgare
  misc_feature (681)..(681): n is a, c, g, or t
  Predicted polypeptide sequence is orthologous to G464
gccgaaaccaagaaggccgccgccgatgactccggctcgcagaaagacaaggaggagaccgagaagaagggccgggtgccagggtgggtgaaggtgaacatggatggggaggtcattgggaggaaggtggacctcaacgcccaccgctcgtacaagacccttgccttggcccttgagatcatgttcaccaagccgtccgccggcctttgcgcttctaatgctacgaagtccttgaagctgttagacaactcttctgaataccagatgacatatgaagacagggatggtgactggatgcttgttggagacgtcccttgggaaatgtttgttggctccgtgaagaggctaaggatcatgaggacatcggacgccagcggtctcgggccacggtttcaagtcagtcacagaaccgcagccttgacacgagggaggacatgagacgagggtgatgaagagccgccgaccgaccgaaagagctgtgtaccgtcgccggcaaaagcttgaaatacgtcgtgcatccgacaccgacgttccatgtccgagcagccagccactgtctctggcgcagccgttgtgattacttgtgtgtctagttgagatggcaggagctaggatgccctcttcctgctatctatctagtggtggtgactcggttcaaagcttgtagtatctattcttttnccaggccccctttccagttctgtccacacttggtgaagtgctgatcactg

SEQ ID NO: 7762 - DNA, 812 bp, Hordeum vulgare
  misc_feature (291)..(291): n is a, c, g, or t
  misc_feature (300)..(301): n is a, c, g, or t
  misc_feature (312)..(313): n is a, c, g, or t
  Predicted polypeptide sequence is orthologous to G468, G2866
cagattcctacacacgctcatatagcctctctctctctctcgtccgatggagtgcaaggcggcgagcgagccgtcctcgtcctcgtccgcgccctcttcttccatggatagctgtggcgccggcgggccgcgggcgacggcctccacggcgtcgtcccgctaccggccggcgatcgacggtggcctgagcacggaccttcacctcgggctcagcctccggtcgtcatgctcctcctccttccacacggggccgaccgcgtctccgctttccacttccaaggggagcacccnttgacgacnngacgaaaccgnnaaccccggcataggccacggcatgccggatccggcgtcggccgcagcggcggcgccggcggccatgggcagcagacgctgtttgtgaaggtgtacatggagggcgtccccataggccggaagctggatctgctgctgctggacggctacgacggcctcctcgccatcctaggccgcatgttcaacgcctccatcatacatccggatactgtcggccatgatcaccaagtggttcttggggagaagaaggctcgccatgttgtcacgtatcaagacaaggagggggactggttgatggccggggacgtaccgtgggagctgttcctggccgcgggtgtgaagaaattgaagatagcaagggcggattgatcaagcatctttgattgattcaggttatgcaaagtcatacagccgatgtgtggtcttgtggagtgaccctttatgtgatgctagtcggcggttacccttttgaggatcctgatgaccccaaaaatttcagg

SEQ ID NO: 7763 - DNA, 1054 bp, Hordeum vulgare
  misc_feature (465)..(465): n is a, c, g, or t
  misc_feature (467)..(467): n is a, c, g, or t
  Predicted polypeptide sequence is orthologous to G470
tggtagatcagtggatctgtcgaagtttggcgactatgacgaactcactgctgagctagacaggatgtttgaatttgatggtgaattgatgtcttcaaacagagactggcagattgtgtatactgatcctgagggtgacatgatgctggtgggagatgatccatgggaggagttctgcagcatagtgcgcaagatcttcatctacaccaaggaggaggtccagaagatgaactcgaaatcatccaccccaagaaaggaagaaggttccgcagatgctgatggcgcaaacgagaaggctcatctcgccgcgtcaagccatttagataactagccaactaggttgcgttaccccgattgaggcatgaggggaggtatcgcacggggagccttgttctgccctcgcacgggtcccagccagccagccaatgaagtaacttctgatggtttttggtgatcgccccctcncncgtgggattgcagcacaacaacaaccccagcgacaccgcttggatttaggtgatacttcctcctgcctaggtattgtaaaaaagaagaaaaactttggcggccttcctgatgggataatccgtgggttgcgtggttttagacattaagatatagggccaaaattctttattccggggccccctgtagagggcatagttagtcccttgcgctctccgcaagcgcgggaaataaagagtggattaatcatgggtggacaaatggggtgatacttccacgccgcgccgattgttctggagaacgaaatgagaatccaggtggggggcgcgggcagacaatatcctgcgggagggaattatgtgggggttggattatcctcggtgtagaaatatacatgtgggggatgatacgactcctaggtcagggaagagtacgtggggggcaaacaatatactcggcggggaaaatagcgtgggtgaaagtgacgagactcagcgggtgggtcgaaggagttagctcgatgtgaagagtagtggtgcgcgtacacggtgttctagtgtcatcgtcgcgtttctgttacctcgcaccg

SEQ ID NO: 7764 - DNA, 466 bp, Hordeum vulgare
  Predicted polypeptide sequence is orthologous to G470
agttgtatatctttcatttcaatagcacatcacatgaattacaatacatcatccatcgactcctctacacataaaggttcaaggcccaacaagtgcacaacaaaatagttctacaagtggaggtgtacagcaaaagggtgcaacaaatgcataatcacacatcatcatacttcaacacattacatcaatgataaacgaagcttcttgttccctcctcctgtcctgtcctctacttcttctgggtgcttcagatcatctcgatgaccataaccggctcgagccgatgaccaccggctcgacggccaccgcgttggcaaccgtgtaagaatgctgaaccccgatcacgtcaagttcgtggaggcttaggctgaccctgcagctcgcaccacgaaggaaagaaatatgtaaataagttagatccttgctcatgtcttacaaatagctgctagaataaatacttcaaagc

SEQ ID NO: 7765 - DNA, 833 bp, Hordeum vulgare
  misc_feature (596)..(596): n is a, c, g, or t
  Predicted polypeptide sequence is orthologous to G478
atcagctagctccacagttccacttctgcgacagctccccgagaagagccctagctagcttcgtcttcatcgcgcctcaccggaaggcatggaccgcaaggacaagtctcgcaagtccccctcagcagcgtccatggcagcgctcgccgcggcagctgcggccggcgacgtggcccaagccaacgggatgtccggtgaggaggaccagaagctgaagcttgtgaacgttcccgtggtttccgtcggtggctcgagctcctctgctgcggcggtggcggtgaggaggggcagtggtgctgctggcgccgtggcaacgggcgcggctggggcaggcgggccgagctgccaagccgagaggtgcggcgccgacctcaccgaggcgaagcggtaccaccgcaggcacaaggtgtgcgaggcgcactcaaaggctgctgtcgtggtcgtcgccggtctgcgccagcgcttttgtcagcaatgcagccgggtccccgagcttctggagttcgacgaccaaaagcgcatctgccgcccgcgcctgggcgggcacaaataaccgtcttatgaaaaatttagattaggggaacgggggggaaggntgcccccaccccccaaccagacggccctaaccaccctgggaacccgcccgttgaacattttcagaatagaataaccctacctaaacctgcctccctgtctttttgtcttccaaccttgcatttacttacaaaattttacttatggttcccacccacctccgagggtccggtccttaaccacctatgttgtccacttttcaatccccatggtaataaaggtaaaacttatcccggcct

SEQ ID NO: 7766 - DNA, 789 bp, Hordeum vulgare
  Predicted polypeptide sequence is orthologous to G483
gtcccttgactcttcttctcttcgtccttgaccgagggcgactctctgtctctccctctctctccgcctccgccgagggcttccaggaatcctccagcggagcagcgagacagggaccccttcgccaccaccgccaccgccgtttcctccgtcgtcccctccccgtaccggagatccggtgtttctcgtgctcagaagatatttggagatctcaatggaaccatcctcgcagcctgagcctgtggtgggtgtggccacttctgggtcacaagcatatcctcctgctgctgcctatccagctccagccatggttcctggaggtcctgccgccattcctcctggctcacagccagcagtgccattccccgctaatccagctcaactcagtgctcagcaccaactggtttaccaacaagcccagcaatttcaccaacaactgcagcaacagcagcagcagcaacttcgcgagttctgggctacccaaatggaagagattgagcaggcagctgacttcaagaaccacaccttaccactggcaaggataacaaagataatgaaggctgacgaggatgtccggatgatctccgcagaagctcctgttgtgtttgcaaaggcatgcgaggcgtttatcttagagttggacactgaggtcatggatgcacactgaggagaaacagcgccggaccttgcaaaagatgacattgcagctgccattaccaggactgacatctacgacttcttggtgggcatcatttcttaggatgacatgaagggagaaggcctggggct

SEQ ID NO: 7767 - DNA, 1045 bp, Hordeum vulgare
  Predicted polypeptide sequence is orthologous to G483
taacttccagataaaatatagtgaccgatcgagtttgcagttttgctaagggtgatggggaccgagaaaggcgaggaaggaacgggcgaggagcgcgtggaggtgcgcacggggccaaggccagcgctgccggcgccgcagcagcgggcggtggacgagttctggaggaagcagcaggaggagatggaggcaacggtggacttcaatgaccggatactgcccatggcccgcctcaagagggtcatccgcgccgaggaggacggcatgatgatcgccgcggacacgccggcgtacctggccaagctctgcgagctcttcgtgcaagagctcgccttgcgcgcctgggcgtgcgcccagtcccaccaccgccgcatcatactcgactcggacatcgccgaggccgtcgcctacaccgagtcctacgactttctcaccaccctgctccttgagcaccaaacgggaggcgcggctggtcggccgtgctactgctacgccggccacggttccgggaacggcggggaggtttatcaccgggaggcgccacgtgccggaccccattcctcccgcggaggtgcttggagtggggatatttcttgcacgtgcgctttctatttcgccgtctaacgccggcgttgggaatttagaatatatgctgagtctttttatggttacctaggtgacgttcgagagctttatagtatggggatggtcttcttattacttactaccatgaacgatgtggtcaagggtttatagtgtgactagatgtgagactgaataagtactttgatagatgtagcttgatgtagtaatatgctgataaggtcgctggtgtgagcggatgatatttgatccagggggaagtggttggaacaaagtatgttggatgtacgtagatagatgttggagataatgatgggagattggaagtaattcgagttgctggtaggttaccgatataagcctgtagtgtgggagtgtacgttcgtatttaaatttgtatttaagagtgtaattcgacgaagagtcagatagttattaggcg

SEQ ID NO: 7768 - DNA, 894 bp, Hordeum vulgare
  Predicted polypeptide sequence is orthologous to G502, G519
agcgccgacgaagcgcgtggcgccccgcgggggtcgcaccatggggatcaagaaggccctcgtgttctacgccggcaaggcgcccaagggggtcaagacggactggatcatgcatgagtaccgcctcgccgacgccggacgcgccgccgccagcaagaagggctccctgaggctggacgactgggtgctctgccggctgtacaacaagaagaacgagtgggagaagatgcagctgcagcagcagcagggggaaggggagaccatgatggagcccaaggcggaggagaacacggcgtccgacatggtcgtcacctcgcactcccactcccagtcccagtcgcactcgcactcgtggggcgaggcgcgcacgcccgagtcggagatcgtcgacaacgacccgtcgctgttccaccaggcgcaggcgacggcgttccagacgcagagccccgcggccgccgcggcgcaccaggagatgatggccaccctgatggtgcccaagaaggagggcggccgatgagggccagaagcaactgttcggggacctgaggtaccaccacgtccaagacatgtgcgacggccttgaaattgatgccccccggggacgaactgatttaatcctctttgtttccctccccagggtccgggggggcccagccgggtccgaggggatgccacgccggtgttgggcaccagaaagggggccctcgcaccgtcgatccagtcgaggagacgggcaggtaaattttttgcgtcggcgaaggaccgatatttgggcgctttggagtgcctgttgggacgcggaggggggtggccgggattgtctagaaaacccgcgggtgggcggggcggggtgtagtgtgtattgtagattagaaaccgccgcgctgggcgagg

SEQ ID NO: 7769 - DNA, 901 bp, Hordeum vulgare
  Predicted polypeptide sequence is orthologous to G504, G1425
gaaacgagccatcatcaaaagaggaggccccaggaggcggtatcacaaccatccagccagccagccagccgcctttctcttctctttcaacgccgggcgcccgcggagggccggtggagcgagcgagcgagcgaggagggggaggatgatgacggcaatggtgaaggccgaggcgatgacggcggaggcggaggggagcagcgggcggagggacgcggaggcggagctcaacctgccgccgggcttccgcttccaccccacggacgacgagctcgtcgtgcactacctctgcaggaaggtggcgggacagccgcagcccgtgccaatcatcgccgaggtcgatctctacaagttcaacccctgggatctgcccggggcgtgccccccttcttcctccctcccttctctccttactccttccaccatctgtctgattcaatgtgtatgtgcgccgtgctgacctcggccgcgggtttccgtgcagagagggcgctgttcgggagcagggagtggtactttttaacgccgcgcgaccgcaagtgccccaaagggtggcgccccaaccgagtccgccggaaccggtttctggaatgccacggtcgccaactaaccctgtgacgccccgggagagcggggggggtaccggttggatggaagaaggggctgaagagtttctctggtaagggccccatggtcgttaagaacgactggaagattcactaagtccaagtagtcacggcctacccccccctgcgaagaagagagccatgggcgagaaaagagaggggaagcttgtggtgtatgtggtaataaggtgaaaggggggtggtaaatgatgtgatgggatgccagtcggaggttgagatagtaaaagatgcgtattgaggaatcgaggagggtg

SEQ ID NO: 7770 - DNA, 678 bp, Hordeum vulgare
  Predicted polypeptide sequence is orthologous to G525
cggcacgaggccccaccggtatacggaccaaccgggccacggccgccggctactggaaggccactggaaaggacaaggaggtcttccaccaggcgaccacgagtctcatcggcatgaagaagacgttggtcttctacatgggtagggcgcctaggggggaaaagaccaactgggtaatgcacgagtataggcttgagagtggaaagcaaggaacacctggcctacccaccgacatcaccaccgccgccgccattaacgcatcttccaaggaggagtatgtggtttgcaggatattccataagagcactggactcaagaaggttgtgatgtcgtcgtacgccattcccatgccaatgtccatgggagcagcgcagcaacatggcttccttgaatctggtgcattgccttctctcatgggctatggcacatcatcgtcatcaccggcgccctcatcgttgctacctgcagcttcttcataccagctgcataacgtcggggtgagctcgtctatgatgggtagcgcgatgctcccgatgatgaatgaccactactttgggaaccaccactaccagaagatgcccaccccaccacagccgctgatgtcgttctaccaccaagaccaccacccgcagcaacaacaattgattcaaatgccgatgcaaatgcagatgggtgcag

SEQ ID NO: 7771 - DNA, 1200 bp, Hordeum vulgare
  misc_feature (186)..(186): n is a, c, g, or t
  misc_feature (778)..(778): n is a, c, g, or t
  Predicted polypeptide sequence is orthologous to G536
acccactccccactccgccaagaaacagcaactttcacacgcccacgcgcacacaccagatcgtcgacagcgatggcagcggcagcgggaacgagggaggagatggtctacatggcgaagctggcggagcaggccgagcggtacgaggagatggtcgagttcatggagagggtccgtggcacgacngagaccggctagctcaacgtataggagatgaacctgctttcaagtgcgtacaaggacctttatttgggggccgttgtgcttactggcccaatggtgtctccattgagcaaaaagaggaagggcgcggacctgcagggcacactttgcttggttgaagtgttccatacctactgttctaatgcctgatcacttaaatattctgggactagaatcccttattcttcattaaattaagacattatactccttcatgcaggtcatctaacgatgtccttctggatctgttgctcgtgaaaatgattgtaattatatactatcatgtactttatattcttgatgatataggaattgtacgctgttcgcgtttaggaacgtccatactgactatggatctgtacttttgatctactatgatcttgactaatgatagaatatcgcttcgtagattacgatatactgaacctatggattatcgatctattatgaaattgtgtgtcttctatgtagcatgatctatggtgctacgattgtactgttcagtgaacgactgatgtattagggtacgccttgatctatcgattgatctcttgcntgtcaggtacgactgaacgcgttaactgaatatgttatcgcttacgtgaactatcagatcaattgatgtactgtatgatacattacgtgcgctcatcgagcatatcttatctatgatttatcgatgtaattgatctcattgagcgattaatgtgatctttcttgcgaatggatcattatagcgtataggatgctcataactcttttcggatatgatggtattctatgttcgtaatgatgcaatatgatcgctatgatacatgtgatcatatacattgaatgtttctaatcgtatcgattatatctcgtgcgttcaacttgagtggttcgaaagaaattgagcatgtaggattatcgttatgttgtactgatctgactagttatactgattacatctttacgaatatatactcttaactatcg

SEQ ID NO: 7772 - DNA, 1136 bp, Hordeum vulgare
  Predicted polypeptide sequence is orthologous to G536
gacagccgcccgtcttgctcgagattgacctttggtgaccattagaaaccagagacactgaagatggcgcagcctgctgagctttcccgtgaggagaatgtgtacatggctaagcttgcagagcaggctgagaggtacgaggagatggttgagttcatggagaaggtggccaagacggttgactccgaggagctcaccgtcgaagagcgcaaccttctatcagttgcttacaagaatgttattggtgcccgccgtgcctcgtggcgcatcatttcctccatcgagcagaaggaagagagccgtggcaacgaggaccgtgtcacactcatcaaggactaccgtggaaagattgaagttgagctcactaagatttgtgatggtatcctcaagcttcttgattcccaccttgtcccctcatctaccgctccagagtccaaggtcttctacctgaagatgaagggtgattactacaggtaccttgcagagttcaagagtggaactgagaggaaggatgctgctgagaacaccatggtggcatacaaagctgctcaggagattgcactggcagagctgcccccgactcatcctattaggcttgggctggcactcaacttctcggtgttctactatgagatcctcaactctcctgaccgtgcttgcgacctcgccaagcaggcttttgacgaggccatctcggaattggactcactgagcgaggagtcctacaaggacagcactttgatcatgcagcttctccgtgataacctgacgctgtggacttccgacatctcggaggacgctgctgaagaaatgaaggatgctcccaagggtgaatctggagatggacagtaaacattgtctatgtgtccagaaacttgtctttcttgcttgttcagtgtagattgtaatgtcgtcagtgtggttgttggtaattggaggctccaatttgtgttgtgatagggaagcttgtagctgcctgccttgcttggttatcgggctgcactggttattgcctcttgttgaaccttcctgttactttggtggttctagaaatttctgctgctcttgtctgtgtggccccttgtctattcatctgcttttcttctttaggaagggcgtcttctgaaccctttcca

SEQ ID NO: 7773 - DNA, 1361 bp, Hordeum vulgare
  Predicted polypeptide sequence is orthologous to G536
gaccccacagccagcgcccactcgcccgagatccgctgccgaggcccgtgagaactccgccgcgccagaggaaaaggcactgaactaggttgtaacaaggaacagggaagatgtctaccgctgaggcaacccgtgaggagaatgtgtacatggccaagctcgctgagcaggctgagcgttacgaggaaatggtcgaattcatggagaaggttgcaaagaccgctgatgtcggtgagctcactgttgaggagcgcaacctgctgtctgtggcttacaagaatgtgattggtgcccggagggcatcctggaggatcatctcctccattgagcagaaggaggagagccgtgggaacgaggcctatgtcgcttcgatcaaggagtaccgtaccaggattgaaactgagctcagcaagatctgcgatggcatcctcaagcttctggactcccacctcgtcccctctgccactgcagcagagtccaaggtgttctatctgaaaatgaagggtgattaccacaggtaccttgcggagttcaaggccggtgctgagaggaaagaagcagctgagaacactcttgttgcgtacaagtcagcccaggacattgctcttgctgacttgcctaccactcacccgattaggcttgggcttgcactcaacttctcagtgttctactatgaaatcctgaactctccagaccgtgcttgcaaccttgccaagcaggcatttgatgaagctattgctgagctggactccctcggcgaggaatcctacaaggacagcaccttgatcatgcaacttcttcgtgacaacttgaccctctggacctccgataacgcagaggagggtggtgatgagatcaaggaagctgcctcaaagcctgagggagaggggcactgattggccctcaagagtgtgcccaagtttatttctgagtccatttacgcagctacctgtatcattcggatcataagatgtactagggtcggttgcactatgtgaatcataagatgtggtaggatggtgctatgcgaagcgtgtcgagctgaagtacctagtggactacagtcatgaggacggtcatgtggacatcgtcgcttcttagttcattagcagatttcaaactatttcctgtattgcagcacattattagtattgctgtattagcaattttcatggcttgttgatgattgatcatacttcgcgtaaggcgcccccaaagcttgtgcctttcttatgaggcaacaactgagattttcttgtctactttccctctcaaaataattgaagttctaggattcttcccttagcttaattatgaaatgtattttcttattattatatcgatccacatgttcaacatca

SEQ ID NO: 7774 - DNA, 1155 bp, Hordeum vulgare
  Predicted polypeptide sequence is orthologous to G536
aggagaccagcggcgacgcaggcgcaaaacgcagatttggcattcagaaaaaattaaagcagtaaactgtgaagatgtcggcaccaggggagctttcccgtgaggagaatgtgtacatggctaagctcgccgagcaggctgagaggtacgaggagatggttgagttcatggagaaggtggccaagaccgtcgactccgaggaactcactgtggaggagcgcaacctcctctctgttgcatacaagaatgtgattggagcccgccgtgcctcatggcgcatcatctcctccattgaacagaaggaggagagccgtggcaacgaggaccgggtcacactcatcaaggaataccgtggcaagatcgaaactgagcttagcaagatatgtgatggcattctcaagctgcttgaaacccaccttgttccgtcttccactgcccctgagtccaaggtcttctatcttaagatgaagggtgactactacaggtatcttgcggaattcaagagtgggcctgagaggaaggatgctgctgagaataccatggtggcatacaaggctgctcaggatattgctttggctgagctggctccaacacatccgattaggcttgggctggcactaaacttctcagtgttctattatgagatcctcaactcgcctgatcgtgcttgcaatcttgcaaagcaggcattcgatgaggccatttcggagctggacacactaagcgaagaatcctacaaggacagcaccttgatcatgcaactccttcgtgataacttgaccctctggacttccgacatcacggaggacaccgcggaggaggagatcagggaggctccgaagcatgactcgagcgaggggcagtaaagccggctttgcgacgccccgcaagctactagctagtgctcgctactgtcaatgacgttgcatgcaatgtggtctggatcgtgtcgtagccgtgtgttatggttgttgttgcaagatttggggctccccgtatgtgatgttgccggggaaggttgtggtcgctgcctgtaggcggctgcctcctggtctggcttgggggggagccacatgcactgctggtggtcgtggccgttcgtattttcgttctgccttaatgttgcttcttatcgtggaaaaaaaaaaaaaaaaa

SEQ ID NO: 7775 - DNA, 665 bp, Hordeum vulgare
  Predicted polypeptide sequence is orthologous to G536
ctgtaagacctggcacaataatctagtctaaagggttgggtactaggtttcggcatgctaagccgaaggaattttgattttaagaggtgaacaaagcggtctccgattgaaatatgagacccaatacagtatcgttcattagagagagggagatgcgaaagcaaacctactgggaattaacctccagaatatctttgtccagaactgctccatcttgtaattccactgtgctgccagacacgaaataccatattcccagcccgcttgccagctcctcgcatcaaacatcaacgccagagatcactgcatctctctactctgcagttgcttcagttgctgtttctttggttacagcttcgctttccttcatgtcaggaacatttgtggtggctgcctggtcagcggtagctgactcggcctccgatgaagtccagagggtcaggttgtctctcaagagttgcataatgagagtagagtccttgtaactttcttcgctgagggtatcaagctctgcaattgcatcatcaaatgcctgcttagcgagatggcaggcttgatcaggagaattgagtatttcatagtaaaatactgaaaagttaagggcaagtccaagacgaatggggtgagtcggtgcgagatcagtttgggcaacttcggttgcattt

SEQ ID NO: 7776 - DNA, 700 bp, Hordeum vulgare
  Predicted polypeptide sequence is orthologous to G536
accagcggcgacgcaggcgcaaaacgcagatttggcattcagaaaaaattaaagcagtaaactgtgaagatgtcggcaccaggggagctttcccgtgaggagaatgtgtacatggctaagctcgccgagtaggctgagaggtacgaggagatggttgagttcatggagaaggtggccaagaccgtcgactccgaggaactcactgtggaggagcgcaacctcctctctgttgcatacaagaatgtgattggagcccgccgtgcctcatggcgcatcatctcgtccattgaacagaaggaggagagccgtggcaacgaggaccgggtcacactcatcaaggaataccgtggcaagatcgaaactgagctcagcgagatatgtgatggcattctcaagctgcttgaaacctaccttgttccgtcttccactgccagcggccgctgctgaaaggaggccaccaaacacccaaggggctgaagcagtgtagcgtctgacatcgtgttctgaacgttaagttacgagctgaccatttggtgcggatatataggcgtcaggaaggtagccaaaattttgtcaagttgttattatgcattgtgagggccattttgggcacgttgcattacatgtaagtgatgaagacactgtaaatacacaacagctgcgcttagttcggcctcctgcgatgcaattgcaacgaaac

SEQ ID NO: 7777 - DNA, 700 bp, Hordeum vulgare
  Predicted polypeptide sequence is orthologous to G536
gctcgagcggccgctaatgtctctcaatggtaattttagtcactcaaggatggcaaattcgagtgatacacgccaaacttttattgaaaataaattgaagcattaaagttgtcatactggtgtcactaaacttgctataaaagacgttcaaagctatcatgtgctcgtgccacacgttatgtacttatcagggcagggacggaccatagttcaactgaacgggggccactcaaatttttgaattccctttgtatttgtgcacattttaaaacaaaacacttcaaaatgagcaactttatagaaggtgtgcccccagtcaaatatagcgcccccagtcaaaattttgtctgggtccgcccctgtatcagggtctttgctttttgtttgaaagggtgaaaaatgctctggcctcttgcatcgatgtatgaatgcaaccattttaattatctatatgccttattgtgagtttgtgaagtcaaaatgtatgactatgtggtgttgtttatgattatgtgatgttgttttgatgagcggccgctgcaggcttttgacgaggccatctcggaattggactcactgagcgaggagtcctacaaggacagcactttgatcatgcagcttctccgtgataacctgacgctgtggacttccgacatctcggaggacgccgctgaagaaatgaaggatgctcccaagggtg

SEQ ID NO: 7778 - DNA, 672 bp, Hordeum vulgare
  Predicted polypeptide sequence is orthologous to G536
gtcaagattttgatatactacctgataagcaatagattcaataaagccctacacgtggtgcaatttggagacaccttcccacgagccatgaccggattctccccttatatatctttccaatatcaacagttgaccataccaagcctgatagaattttcctcttgtcctcattaactcacaagtgtgcaggggttcagggcgatatctaacattcgcaaatgacgagcactggtatacatctggggtaataaaccagttggtagccgtcgtcatgtgttaaaaatctagtgtattcgaagtttgaagaattcatagttgtcctaacctctttatgtaaactctacatccttaagcatgctaccatcactccatcaacgatcaagttgtaagtacgggcccatcaagaccaaggacaagagggaacgtttaatttcggatttatatttgattcgctattcgtcgtcctttgaatctgtgggcaagtcttctttctctggttcagcggcaatttcatctttggtatcagcagtttctccattttcagcatctccactgtccgacgaagtccagagagtaagattgtctcggagtagttgcatgatcaaggtgctatctctgtaggattcttcggataaagaatcaagttccgcgatggcatcgtcaaaagcttgc

SEQ ID NO: 7779 - DNA, 846 bp, Hordeum vulgare
  Predicted polypeptide sequence is orthologous to G550
agaacaccgatgccccgtcagtagggtcttgtgctgaaggatgggcaaagggagaagagtcgagccagatgaactcgagggagagagttgcagcagatagatcgccaaattttgcgcagcacccgtgcatgaacggggcagccatgtggccattcagttgtgcaccatcgcctgcctatttcaccccaaacgtagcaattccattctatccagctgctgctgctgcctactggggctgcatggttccgggagcctggaacactccatggcagccgcagccgcagccgcagccgcagtctcagtgtcaatctagctcaccacctagtgccgcttctccggtatcaacaatgtccagttgcttccaatcccggaagcatcctagagatggtgatgaggaaagagataccaagggtaatggcaaggtgtgggtgcccaagacgatccggatcgatgacgtagatgaggtggccaggagttctatctggtcacttattgggatcaagggcgacaaggtgggcacggatgatggcaaaaggtgtaagcttgcaagggtttttgatccgaaggatgaggcgaagacgacaactcacagagtcgacaatagccctgtcattcttgaaggggaaccccagctgcactgtcgcgctcagtgaactttcaagaagagatcttgagcaccatctttatgcgtgcttctggtcttataaaacatgttgcatggtacagcttaaattttgtaccattaaataatggtttactagataagaagaccttgaaggttcaaaaatagctatatatcagtaccctgtaactggacgctggcctaaggtaactttgtaaaattgg

SEQ ID NO: 7780 - DNA, 1355 bp, Hordeum vulgare
  Predicted polypeptide sequence is orthologous to G550
tgtgcgccgctctagtactagtggatccccgggctgcaggaattcggcacgagacaaactgccacggtatatttattccaggaagcagtctagcacctcctggaattccattgcctataaaggaaaatcaaccagcagttaagtttgggtctgattccactctatctaactccatggcttctttgttgagagttgaagagcagaataagaacagcaaccttgcctcaacagcacatcccagaaatggtgagaaccagacatgtccaccttcagcaacaacttcagataatccacggaccgagtcagttaaagtaacagctggtgtacaacaaaatggaattgctggggattgcaatggcgtcactcccatgcctcctataccatgctttcccggccctccttttgtgtacccatggaatccagcatggaatggtgttcctgccatggcagcaccagtatgcccagtcccagctgaaccagcaaattgttcagaaaatggcaatggaggtactattcaatggaactttccaccaatggtgccgatgccaggtttctgtggcccacccattcctttcccactaatgccgccttccgtttggccattggtttctccttggcctaatggtgcatggagcgcgccatggcttggacctagttataacatgtcagcagcacctccaacaagcactagtacatgttcagatagtggttctccagtccttggcaaacaccctagggattctgatccacaaggtggtgagaaggcagaaaaatcctttgtggattcccaagacactccggattgatgaccccgacgaagctgcaaagagttcgatctggaccaccctgggggattgaaccggcgagcgttggatgtttagaccggtccagcagaaatctggtggccaggaggagatgtccaacgcagcccgagtcattgcagcgaaacctgcggcccaatccggtttttgagtttcaagggacgacgtgataagttaaattccgccggttcttttccccttcaagcatggtatatcaagaaaagatgttgtctgaagcctgattggggagttgaagttgtggaacgtacctacggtaaagggggttttcttttcccgttaattcttgtagaggtgtaacctccacgggccatgaccgaacgccagatgttgttgttgtaatgttatattgtaatacttgttcatgaccccgctttcgcttcaagttttaaaaaaaaaaaaaaaaaatcggaggggggcggtaccattcgcctaaggagtgttacccgctcctggccttgttaacagtgtattgggaaccggggtaccctttatgcctgccattcccttgcccgg

SEQ ID NO: 7781 - DNA, 574 bp, Hordeum vulgare
  Predicted polypeptide sequence is orthologous to G550
gtttttttttctttttttttatctggaaagagtaaccgctgtttatttgatacagtagtataaagagtcttcatcagtagcaatgttcaattgttacaacttgcaccgaaataataggactggcaaagcagggagtgtactcctgacttaacctaattacattgttacataaccagtttgtcaaatatttacagtacacacctcaagtaaattctcatgaaagctctttgcaagctccactgcaggttagtggctattcaaaaagctctcttttggtcttctccaatatcgcaaagctatactactatgtacaaattttactacaggacaagctatgttgtcaaaatgcattagataggcaacagacatcagtttaagagctctcctggaacgactgcgaccgagaaaacgctgcggggttcgcctgtaaagcacgggcaggccgtgcatctgttggctggcccttgctctcgcccttgaattggaaaggcttgaagacgccagggtctccaggtttgatgccaagagttgcccatatggaactcttcgctgcctcgtcggggtcatcgatgcg

SEQ ID NO: 7782 - DNA, 819 bp, Hordeum vulgare
  Predicted polypeptide sequence is orthologous to G557
gagaaccgcctgtcggcgcagcaggcccgggagcggaagaaggcctacatgacggagctggaggtcaaggccaaggacctcgagctccgcaatgccgagctcgagcagaaggtctccaccctccagaacgagaacaacacgctccgccagatactcaagaacacgacggcgcacgccgggaagaagccgagcggcggcggcggcaaggggggagacggcgtcaagaagcaccaccaccacttcggcaagagctagtagtagtaagagctgcgaccatggttgctgcttgctaggaaccgaacgcctgctcatctgaccattgttaggaacactgctgttgttgtttgccgccgcagtttgacgctcgtattgtcttttgcacctttttttttcacggtttgctgagaaggatgtctcactgtcactgttgtgtgtaccatgtgcattgtagcttggtgttagcgaggttgatctatgtgaacattggttgtgtattgtggaaaatcgaaaaatatgtacatacaagctcgggggggggcccgggccccaataggtcctatgtagaagagaatgacagaaaactggaccatgatttacaacagggcgactgggaaaacccagtcgttcccagctggatagccttgggagaatagcgccttagcacaattgcgtatatagcaaaaaggccccgacccaagcacccttagccaacagtgaacacctccaaagtgagaacgaggactgacgagccgggtctttggaatacatgtacgtgtgatttatgggttagcgcggtagtgtaacacattggccatacag

SEQ ID NO: 7783 - DNA, 666 bp, Hordeum vulgare
  Predicted polypeptide sequence is orthologous to G557
attcggcacgagggtggagccgaggaagaggagcacaagataggaagagaggagcagcggtagcctcgttttcctcgggattgggagggacgagagaggcggggagagaatgcaggagcagggggagagctcgcggccttcgagcagcgagaggtcgtccagctccggcaaccacatggagcacaaggaagggatggagagcgacgacgaaatagggacggtgccggagctaggcctggggccaagcggcgcgtccacgtccggcaggagggaagccgacgggccggagcgtgcccagtcctccaacgcgcaaggcagcgcgcgccgccgcggacgcaccccggctgacaaggagcacaagcgcctcaagaggttgctgaggaaccgggtatcagcccagcaggcaagggagaggaagaaagcttatttgggcgatctggaggtgaaggtgaaggacctagagaagaagaattcggagctggaagagaggcattccaccctacagaatgagaaccagatgctccgacagatcctgaagaacaccactgtgagcagaagagggccaagtgagggtcaatagcacagaagttgtaagggtcgattcgcagaattttcacagcagaatcaaagaagccctaggatcgaatatagctgcgttgattgatc

SEQ ID NO: 7784 - DNA, 898 bp, Hordeum vulgare
  misc_feature (797)..(797): n is a, c, g, or t
  Predicted polypeptide sequence is orthologous to G558, G578, G629, G1198, G1806
gccgcagtcgcgtactggtcgctgggctcatcgtgccggccaggagcggcggccgcggtagctcggggagcttgcagcagcggtggccgcaaaaggatcggcgacggcggcaccctactaccccgtagcctccgatagaggcccctcttcctgttcgagctttgtcacaacaaaggaatctctctgggagttacattgagcactaggaataatctgcaatggcagaggccagtcctagaacagaaacgtcagatgatactgatgaaaatcttatgcttgaaccagggaatgctgctcttgctgttgcttctgactctagtgacagatccagagacagaaacggagatcaaaagacaatgcgtcggcttgctcaaaatcgcgaggctgcaaggaaaagtcgtttgaggaaaaaggcatatgttcaacaattggagaatagcaggctaaagcttacccagctagagcaggagttgcaacgagctcgtcaacaagtttgcttttattgcttgtcactgtcttgagttctggttacaagacttcatttgaagtttgcttactgaaatttccttcacagggcatttttatatctagttcagcagaccagtcccattccatgagtggaaatggggcattggcttttgacacggagtacgcacggtggttggaagaacacaatcgacaagttaatgagctgagagctgcagttaatgctcatgcaggcgatactgagctgcgcagtgttgttgagaagatcatgtcacactatgatgagatttttaagcaaaaagaaatgcggncaaagcagatgtctttcatgtgttatcaggcatgtggaagacaccacctgagaggtgtttcctatggcttgaggtttccgaccttctgaccttttaaagcg

SEQ ID NO: 7785 - DNA, 851 bp, Hordeum vulgare
  misc_feature (159)..(159): n is a, c, g, or t
  misc_feature (368)..(368): n is a, c, g, or t
  misc_feature (422)..(422): n is a, c, g, or t
  Predicted polypeptide sequence is orthologous to G558, G578, G629, G1198, G1806
gcgcgggcggggggggggggaccaaatcagcgacaccgccggtcggagctcgtatcctcggaggaggaggaagaggtggcctccgggtagaagccgcgcggattcggtgcgggggctctgaggcacccctcccccccatccatcccgggcgggggcccnaggggggggggggcgaccatggccgcggcccgccggcgccacgccgagccccgctccggacgaccgcgccgaccgtacgccgccatacggttgtagtaaatcctaggcagctactaatctggattcttggagagaaaaattccggcaacgacccatctcccgcagcacaggctgggctcaccactttgctgttacgaaggggggagcanagtgatttgctgtctcattgtgattgtggtccgctgagtgatggcagatgctanctcaaggactgacaactcaactgtggtagacaacgacggcgagatctataggttagaacaaggagcaagtgggggggcaatcatggcttctaattcttccgataggtctgacagggccgacaaacccttgggaccaaaggacattgggtggtcttgcgtcaaatccgtgaggctgcaaggagaagtccactaaggaagaagtcttatggtgcaccgctagaaagcccggagctggagcttgcgcaaattgaagcgggagctccaaaaagcttccccacgagggaattttcaatttttagcctccggagaccaaacgcctgcctatgggtgggaacgcgggccatgactttccgaccataaaacccttagagggtgggggagccgaaccagcgattcagtgggggggggagtggagttgaggtgatgcga

SEQ ID NO: 7786 - DNA, 700 bp, Hordeum vulgare
  Predicted polypeptide sequence is orthologous to G558, G578, G629, G1198, G1806
cttatttttaacacaaattgaagtactgtttcaataatgaattctgggcttccttcatttgttcccactccaggatacattaaaccatttgactcaagaaaaatctgatgacagttctacgcgttctgacaagttctcccatttctggagcttcctttgtttcccagctctctgtttctcacatatctgctacattacatccaaaaaaatttcttcccagttgtttcgattatgctcctactttgaaggttagttccaaaatacatttgaatcagaaggcagaatattggctttcagatggatgtgctgcaatgcttagctctccgcaattgccttcatctgtcatcagtatctctcgagggcgagaagcccagagggagcttagggcacggaggcggttgtggtactcgccaatagccaggaaacatcgagctgcctgcctaactgtcagaatcctgtgcatctgatgaagagtctgctgcctcaagttatcagcctgtatgacaaaaccttccaggttggccagcttgccaagagcaactgccatgtcacccatgaagctccccatgttggtatcatcgctaagagacccgctgcctgccacagtgactgccaatgactgatggagctgctccaggccctgggtgagagcttcttctgcctgctgcaatgactgctcaaggctgcagatgccaaccat

SEQ ID NO: 7787 - DNA, 796 bp, Hordeum vulgare
  Predicted polypeptide sequence is orthologous to G559
tttttttttttttttttgtagatcttggaatatataatatacccttaaggtcctagacacgcagaaacaactcgtcggaaaccatttttaatgggaagactgactaccacagtgactcgctaaggaaggtactcatgtacaacaccaatatacgaccatacggtactacgacaaccatgttccacgctgagtattataccgccataaacaaaagaactcgggcagcatccgttgcacaaccactgctatccatcctacaacctgtctgatataatcaaaagatattattttctctccgctcgcacataccatcaccatccttcaactcatcatgcttggctagattcgagtttttccccctctgctattgagatccatgttctttgtaacttggtctatgctgattgctgcgactgctgctgctgttgctgttgctgagcctgctgtgtctgggatgactgctgctgttgatgttgctgctgctgctgctgtatttgcagctgctgcatttgaatcagctgggagttcatctgctgctgtaggcccgccttcgacatacgagcatcggtaatctcaccggttgcaagtttcagccgctggacctcacccgttaacgcttcattcagagcatctctcagctgcgcctgttgctccattgcttgcagccttattttcaactcattgttctgagtcgcaagtcctccagagtccctctgcagcatcgtcaattgtgctgaaagcgtaatcgcctctgtctgcaagacctgtaccttatgctcgagttcttgcctcgtgc

SEQ ID NO: 7788 - DNA, 810 bp, Hordeum vulgare
  Predicted polypeptide sequence is orthologous to G561, G562
ttttttttttttttccaagaaagtaaaattttactcctagcctttaaggacaatctattacagttttaacatgtacttaaccctctaacaaagctcatggtatcactaccataccagcaagagctcttctagtcttataccgtcctgatgtcacttcttgtagcacactaaaatataacaacaaatatagtaatctatcatacatttatctacaccttgtttcacaaacaactcactgaccagccatgactaagaccataaccaagtatgattatggagcttcaaaagggggtgaaacgctatcgggccatggcggggttagataataggaaactccaccaatcttctcgacttctacttcatggttggcactcaaatccagcccctcgttgtcgctcttgagcattcttatgtagctttgccgtctccgccatgatgcggctcggacggttcgacctggatgctcaaggtggtcacaacgctagggccctctgactgctgcattttatcatcgtgacctagtattttacccatcagctgtttattttccacttccatggttttgcagtcctccttgagctggtcgagttctgatctgagcgtgccgttcgcagctgtcagctcacttaccttctgggctagctcttcgcattcttgctgtttgcgtaatcttgatctccttgcagactctctgttggattgtttccttctctccctcttcagttcccgttcatccatctgagacagcgaagcgttactctgggaagaagctgcggcattcacctccccctgtcctaaggagcctcgtgc

SEQ ID NO: 7789 - DNA, 700 bp, Hordeum vulgare
  Predicted polypeptide sequence is orthologous to G561, G562
aacactaaatttgggtatatgttcccataacttcttgcatatactgtcttcacacttctagtttgtatggcaccacaggttcagaaatctcaaaaggtctttagaaaggttggcatgaagcacaacacccctatattacaacactgctaattaaaattacagtgaaaacatggacacaacgagacttcagcatcagtgcctaaaagtacagtagctgttgggaaccggaatacggagtaaatataaccgccggagttcctgattatactcatcaaacaaatatacctacactgtaacgccgatgttatgtgagcagcatgagcttgtttaaaccccaggtggcatgcaaggtattagtctgcgccagagaaatgcggcgaatcaatcagcttgcagctacaacatccgtcgtcgtgctggagccgaggagctggcggagcttgggctcgctgtgctccatgtggttgtttacacctgacttgtttgtgtcatcgatcatcgacaagaaattctccacaatgcgaggggaggaggatggagcagctgctgctgctgatttgtccagaggcatttctgcgtcagctggtgctgccgcgcccttaagtttcaccactagagcagaattctctaatctgagcttctcagagctttttgctagcttgccgatctcagattttagagatgtgttctcagctgtaag

SEQ ID NO: 7790 - DNA, 700 bp, Hordeum vulgare
  Predicted polypeptide sequence is orthologous to G565
cttttttcaatggaaaactcatgattgattgtctacatggtaatcaaagaaaacagactgatcacccagtccccctaacttcgaaacaacacgacacatgggaaatgaacccaaacaaaactacctagatccctacaaccaaacaacacctcataaatagaaagaattggataaaaattatgcctagcaggacaaggaaaccagtttgaggatgtaagactatgaacaaataaatctaaatgaaaggagtgcttgtttgcacgtaggtccataattagaaggtgatattacttttcacctgcagatatggagctaccctctgacctcacggcagcctctgcctccaacttcacggccgctgatcctttgccaatgtccagcccctggaaccgcccaagtgagtcttgctgcatcatatctgggaacgtgtttgggtgggatagcatctggtggcttgggacattgggatgaggtggttggaattgggatggcagctggtgaacacttgaatggtgctgaggtgcatgttgctcagaaagctggaagaaagacgggttgtatgggacatgatgcattcccgtattatatgcttcatcaggctttgtcatctcacccgtagcaatcttaagcctctccagttcctgcttgagtgtattattcagagcatcacgcagttgagcttgcagttccatggcctgca

SEQ ID NO: 7791 - DNA, 824 bp, Hordeum vulgare
  Predicted polypeptide sequence is orthologous to G583
gccgtcgtcgtcgggaatgcacgacaacggggcgcggtgccacgcggtggagatcgaggccaagatcctggggctggaggcgatgatccgcgtgcagtgccacaagcgcaaccacccggcggcgaagctgatgacggcgctgcgggagctggacctggacgtgtaccacgccagcgtctcggtggtgaaggacatcatgatccagcaggtggcggtgaagatggccacccgggtctactcccaggaacagctcaacgcggcgctctacggccgcctcgccgagccgggcgccgcgatgcaaatccggtgatgatccaactccatccaccaggtagtgacaaggaaaccttggtgctattactcaccaccgtatgatcgtcgccgtcgacgataatagcccgatcgacatggggatggagaaaggaggcgacgatcctgtcatgttgagggtggtgaagaaagtctctttaggagaatggacggatgatgatggatattaacggcgaggatcgatacttgctgagcatggggtgcagctgaagggagatgacaagaatgtaagcatcagtctaaacgcacagtcgctcgaggcggactgtgggggggccctggggacggcgtcgacaggtatagtggcggtgggtgggagccgaagttctgtggttggtgcatgtgtgatcgaaccaggttgcagtgagccctgtggtaaaaagggatgagtgccatatgggaggacccgttgtcctcgatatgtgcgtagatagtagtatattccagttacctaaccaggaggtggccacgtatgttcccttatatccatcacg

SEQ ID NO: 7792 - DNA, 535 bp, Hordeum vulgare
  Predicted polypeptide sequence is orthologous to G583
cggcacgaggagacgagccatcgccgccgccgcaaacactgtttccgttaagtgaagcggcggcgcggcgggcggggggctcgtttcttgcggcggcgacttcgtgctgtgcgtgcggccgccggccgtgaccaggtttgcctctcagctcgccgcaaaccctctttccggggagaaacggcgtcggcgacaccggcgcagcgagtggagcggccgccggtccaatcccaggggaagcaaaatcaatggagagagatgcacgcactattacccgctgacgatgctgtgatcagaatgagatatgctcactcctggttattcgtagtcagctccgagaaattagttctagcttgagtttcacaggtttgtttaacttattctagcctgtcactttagtggagggccttggcgggagcgggacgctgctctacctccttatcctggatgcaaaagctatcaggaatcgggttatctactttggttatcctggatacttagttgaacgctaggaggtgaagatggcgattgacttttg

SEQ ID NO: 7793 - DNA, 891 bp, Hordeum vulgare
  misc_feature (850)..(850): n is a, c, g, or t
  Predicted polypeptide sequence is orthologous to G590
gttttttttttttttttttttttttaactcaacagcgaaacgcttccgattattacaacaagcaggtactagtatgtacaagcatcgacatgaaaacgctccccatccgaaaaactgcaacttacaacaagcggccctacaaaggtgcatgacgaacaccatatcccgaagcacagcaggtcagcaaaaaaaaaaaaaaaggaaacagctcttgctagacctggaaaacgactccggggccggcgaacaccacacacgaacaggctgcatacagtgggcaagggctatcatggcgacactgctgccagcggactggaatgtgcgggcctgtgcggaacctactgccatggcggagacaggaagaggtaaacctacaaaaagaaatgagaaagaacggtcgtgcccggcgcccggttgatttgtgtaggggcgtattacggtcgtattgttagcgcggtgtaatgggttgttgtacttattttcatctttcgcgtgttagaagtaataccacatgtactgattgtgttgacttttggattgttggaagcgacagaaggaaaggtacggtttagattccgggcgtgcaacgagcgcgcgggtgcgcacggccgtaatggtatcatgattctgatactgggtaagtggttatgaagctggggggaggtctgtggtatgagttatgaaatcaagtgggtaaatgggggtgtgaaagtgggtgtttataatacatgtgcgcgtaacatgttagtgagacaacttgtgggcttgtcatggtggacataggtgtgtggtataagtgtgttaacttcgcggccaattgaacgttctggatttgtaactcgcgaggaantgaggtcaatattgttgttgtgtattattgttaagggttat

SEQ ID NO: 7794 - DNA, 602 bp, Hordeum vulgare
  misc_feature (533)..(533): n is a, c, g, or t
  Predicted polypeptide sequence is orthologous to G592
ggctgcaggcggtgatgtcgcagatctcggagatggtcggcgaggagatgggcggcggcggcagcagcggcgacgacgacgaggccggcagctacggcggcatcccagggtacccggtggtggccccctccggcaccggctgggacgagccgtcgccgtccccgccgccctcgctgctgacgtccgacggcatgtccgggccggccgcaaagcggcgcccgcgcgaggccgccaacggccggtcggggcagctgaagccgcagttcagcctgccagccggcagcaagccgtcgccggagattgcggccatcgagaagttcctccagttccaggactcggtgccgtgcaagatccgcgccaagcgcggctgcgccacccacccccgcagcatcgccgaacgggtgaggaggacgaagatcagcgagcggatacggaagctgcaggagctcgtccccaacatggagaagcaaaccaacacctccgacatgttggatctggctgtcgactacatcaaggagctccagatgcaggtncaggtgatgaacgacggccgggcgggctgcacctgctcggcgggcaggccgcagaagcacttcgccggc

SEQ ID NO: 7795 - DNA, 681 bp, Hordeum vulgare
  Predicted polypeptide sequence is orthologous to G597
attcggcacgagggcggggtccaactcgaatcctgacggcaagcgcagaggacgcccccctggatctggcaaaaagaaacagctcgatgccttaggttcagctgggacatcatttactcctcacataataactgtgaagcctaatgaggatgttgcctcgaaaataatgtctttttcacaacaaggcccacgtactacatgtataatctcagcaaacggtgcgctgtgcacagcaacactccgtcaaccagcaacctctggtggcatagtgacatatgagggccactttgatattctctctctgtcgggctcctttctgctcgcagaggatggtgacactcgcagcaggacaggtggtttgagtgttgctctggctggaagcgatggacgtgttgtaggaggttgtgttgctggaatgcttatggctgcaacgcctgtccaggttgtggtgggcagcttcatcgccgaaggtaataaaaagccaaaggaagaacagccgaagcgcgagccaacatctgtgccgatgccaacatctatgccgatgcagactgcttctggctttggtgcagcagcctctgctgctgcaactccatcagatggaacatcgagtgaccactctgacgacccagggagccctataggacccaacggcagcgcattcaacaacgcaggccatccgac

SEQ ID NO: 7796 - DNA, 700 bp, Hordeum vulgare
  Predicted polypeptide sequence is orthologous to G597
aacttaactcaaaattaatccacgttatccaacaggagaagtaggcctatgaggctaagacacgctaataatagaattgtagctacacaatgtccaacaagatcgacaggtactaacgtcacatagctacagcaaatgcagttagactcttgagctgcccgacagaaaacctagtggggcatttgaaaaccaacctactggatacatcttttacaggtcagaaagggaatgcaccagacagagactctgtggacgaattcctcgggtttggctcgatcgacctcaggctccagaggcagtgaggttcagatcgcccgacgatgcggttcttgatgcctcggcaggagctgactgaacaacagtggatgcccagttctggtctgcgctgtacgctgaagaagttacgatgttcattctcggggcggctgagctgtgctgcccttgctcgctgctgtgagtatccgcgctagagagctgaacagcaggaggtgcctggctaagggttggtgccgcgaccaccctcgccttcttctgcttcggctccatcggatagcttggcaggaagcttcccacgacaatctgaacaggactagctgctaccagaaggccagcaactccaccaccgacaacacgaccatctgggcttgcaagagaaacactcattccacctgaccgacttcgtgcaccactattttcagtt

SEQ ID NO: 7797 - DNA, 698 bp, Hordeum vulgare
  misc_feature (656)..(656): n is a, c, g, or t
  misc_feature (659)..(659): n is a, c, g, or t
  misc_feature (678)..(678): n is a, c, g, or t
  misc_feature (681)..(681): n is a, c, g, or t
  Predicted polypeptide sequence is orthologous to G597
gcgggaagggatctgttcggcttgcccaagagccagccggcgccggcgccggcagcgccgcagtcctccgcagccatgcagagcgtgcgcatggcgtacaccgcggacggcacacccgtgtttgccccggtgagctccgcggtcgcgccgccgggtttccaaacggcaggggcaccggcacatggctctaccatgtccgctgctcgggccgccggaggtaatggcgtcgcggcgccgcccggcatgggtgaaccgtcggcgaagaagaagcgcgggcggccaaggaagtacgggcccgacgcggccatgtctctggcactggtgaccgtgccgacggccgcgggctcggcagctgtgacgcagggtgcttctgggcggcccttctcacccacgctgccgggaaacttcgtgccatcggcgtcgccggatggagggaagaaacgtggccggcccaagggatctaccaacaagccccgcgtggaatggtggtgggccggcaggagttggattcacacctcatgttcttacggttcaagctggagaggatgtatcgtcaaagattatgtcattttctcagaatggaactcgtgcagtttgtgttctctcagcaaatggttccatatcaaatgtaacacttcgtcaaactggtacatcanggnggaaactgtaacatacganggnccgattttgagatactg

SEQ ID NO: 7798 - DNA, 811 bp, Hordeum vulgare
  Predicted polypeptide sequence is orthologous to G600, G2768
gtcagtttctgtgataaatgtattcgagattacattattacacaatcgaagtgcatttgtggagtgaaggtacttgcagattccctcatcccaaatcccacagttagaagcacaatcagcaatttgttaggaacaaggacttgcagcactgccagcggtacagggaagcacagaagttcttcaggaagcaacgctgatcccaaatcacagagccacaccacctcggctgctttggaaagggacacgaagcaatgtttggacagccagctatcgccagctgcttctgacgcccgcctccaggtcgccacagaacatgatcaagtcgaccggcctcagaagaattctgatctgaagagcaacactgaaggctctgcagggcgttcagcatagaaagctgtacctagcgctgacctccccaagccaaaggatgtgagcgaatcaacattgaagggcactgcagtttcatcagggaccttggaaccaaaagtggctaggtctgatcagtttaataataatcggaagaaggcttacttatctgaggctgtgcacccatacaatgcttgctatggtggcagcggggcattggatccttggtatgtattccctttttatggaggttattatttaggtactatttttaatcctattccattccttttccatttgtagggtcatagacttttgaggtgtacgatcgtataacgtttcttcgatatgcgcctgtaagttatatgttcgtcgatttttactcccattaccttatctcctataatattggcactcgaacagtttttctgaaaaatcaataaag

SEQ ID NO: 7799 - DNA, 585 bp, Hordeum vulgare
  misc_feature (404)..(404): n is a, c, g, or t
  Predicted polypeptide sequence is orthologous to G605, G1944
cggcacgagggttgtgcatgtgcctgccatgagcgcaagctctgagccacccaggcagaagcgcggccgtccgcggaagaacaccccagatggtaccaagctgccagctatcttccctgcaccatatcctattggtcttgtggcttccccgacaccagctctacccccgggcttcacgttgggattgtggggcgtaggcgtcgtgaggccccaggcaccaccagcactgccgtcgccattaccgccaccaccctttgagaattcaaaacaacgggccaagaagaagagggtatggccgccgagctccacaaccagcaagaagcagcgggagttggctgtagcagagccaggtgccactggattagttcctcaggtcatcacaatccaaggtggagaggatgtancagtgaaagtcatgtcctattgtgggaatgggtgggcagtttttatcatgtctgccgagggcgccgtacgcaatgtgacattgaagcaaccagcttcttcctgtggaactgttatttatgagggttattttgacattgtctctttgtctggcgtgtacgtgccgtcaaaaagtaatggact

SEQ ID NO: 7800 - DNA, 718 bp, Hordeum vulgare
  misc_feature (547)..(547): n is a, c, g, or t
  misc_feature (575)..(575): n is a, c, g, or t
  misc_feature (614)..(614): n is a, c, g, or t
  misc_feature (664)..(664): n is a, c, g, or t
  Predicted polypeptide sequence is orthologous to G605, G1944
gcaggaatgttttttttttttttttttttgatcgagcaccatatatttaatcacaaggacatacaaaatagatccacaaggaaaatgaattaattgcacggtgtaagtatgcatatataaattttgaactattgggggcatcgatgagttcagttcagttcatatggtgtataattttcaactatttgaatccctccgaatttctccgcacgtttgcagcgccctgagagcgagagacagacgagactagcttgctgagccagctcctgcggcttctgaagttctgaagactccacgacggagcagggctggctggccggcgagcactcgtcctcttaaccctccggagacggggacccttgattacctccgacgacggggtcctcctcgcctcggctgcgggcggtgccgacgccaccggctgcgcggtccagttctccaccctgaacgccgacgcgcccttgccggcccgcgcctggctgccgctgtacgagtccgccatgtcgccgccgctggagatggtgaaacccaccgtcggttgcgccgncaccgtcttcatctcgatcaccggtttnttgccttctgctccatctggtagctcggaaggaagtttncacaaccacctgaacagggcttgcaagcacaagaatgccagttacgccgnctccgatgacgcggccatcggcggttgctagagaagacgcttattctaccgcag

SEQ ID NO: 7801 - DNA, 1070 bp, Hordeum vulgare
  misc_feature (30)..(30): n is a, c, g, or t
  misc_feature (52)..(52): n is a, c, g, or t
  misc_feature (55)..(55): n is a, c, g, or t
  misc_feature (81)..(81): n is a, c, g, or t
  misc_feature (83)..(85): n is a, c, g, or t
  misc_feature (87)..(88): n is a, c, g, or t
  misc_feature (90)..(90): n is a, c, g, or t
  misc_feature (126)..(126): n is a, c, g, or t
  Predicted polypeptide sequence is orthologous to G611
cgtgactacaacagtactctcactcgtacnaccaattcttacacccatatcngantacctccctatctccactcatcacancnnncnncncaagagagcaagggtggcggagactcccatacacancccacccggttttttttaatgttaaaatttccggtccccccggcttgccgaattccggacgaggagccatggtgcaccaaacatgaataaattcattttaagcgacttcacagaaactgaacaagactacatggagcaaggcgtggttgtgagaacaaaagtctgtcgtcggaggggcagaactcgaaagcacaaatatccttctaaggctgcagggcatccagccattatgaaaaaagttggtgatgggaagcaatgtgacagacagtatacaccgtgtgggtgccaggaaatgtgcaacaaaaactggccctgtgccgaaaatgggacatgctgggaaaaatactgtgggtgttcaaaaagctgcaaaaacagatttagaggctgtcattgtgcaaaaaggtcatggcgaaacaggcaatgcccattgttttcggcccgtccagaatgtgatccccatgtttgccaaaactgctgggtgaactgtggagatagttcacttagcgagccccccaaaagaggggatggtttccactgcgggaacatgaaacccctccctaaacaccaccaaaggggtttgcttggaaaaaaaacaatgtttctggaaggggtggccttcattaaaaacccccgggccataaaaaagactttcttggagaagaccactggtggaattgatttctcaccaacaaaaacacaacaacctgggcgaaaaattttttacccgggccaaccctcgaattcttcttgggtttaaaaagaaccctttccttttggaggcaacttcccaagggggggggaaatttacaattaggcaaattaattttttctactcccaaactgctttttttaacgctgtttatgttgtgtccgggaaacatccagtgggttcttttctaactagggggcggacttttagcactctgaccccccctttttttatc

SEQ ID NO: 7802 - DNA, 851 bp, Hordeum vulgare
  misc_feature (845)..(845): n is a, c, g, or t
  Predicted polypeptide sequence is orthologous to G611
tcgacccacgcgtccggtggaacctggcgagagggtcgggggagaggaaggttgtgcatgtgcaggaggagaacctgtcggccgacgggatgctcgtgctctgcagctccggcaacggcgcacaaaccatcgttttgtagattatgaagctgtcgtcggttgataagattcctccctacaccacgtggatcttcctggacaatgcagaaaccaaagaatggccgatgatcaatcaattgctggtaggaggagaatttactatgattcagctcgcaacgaggctctaatctggagtgaaagtgatgaacaaattgcacaacctgaggaagagaagcatgttttcactgaagcagaagatcagctaatatggttcaacttgatattatgccaggcgagagacacatagagttagggaacggccgagctcgcctccgaggaagagagatgattgtcgtcccttggtcgaggatggagctgacacgctgtgacgccacagctattgaggctatccgtcaagtgtggccggatttgggcatctggtgttgtcacctaggctggtgtttctcctctatgcacgcttgctttatcgttgccggatcaatgcactcgaggaggcggcagtggatccctaggtttttcggtttttgaaagagaattttgtttttgcgattttctacatgcgttccatcagcaattgagaatcatgtgcaagccgtgagatttcggaaccactagattgtgacagtgcaggaagtaaaatatgcgtcggagacggctatgaaggcatcaacatgaaccggagggccgtgagggacatcaagaatatgatcagcatgtttgttcanattttc

SEQ ID NO: 7803 - DNA, 486 bp, Hordeum vulgare
  Predicted polypeptide sequence is orthologous to G611
ctcgagcggccctatcctgtcttttattgaactatggttttggactgctgataacttgcactggttgaccagctacaacgagttcctgtcccaaagtcaagaagagaacccgcatgcacgccgcctcagccggcgagcagcattgcttcgaagctagatgaaattgtcaaattatcgtctttggtacatcccgttccaaaaaccaatcccagagccctgtgttcttctaactcctatccctaatcctatctagttatattacgagctaatcggaaccttattcggggggtacaagttcggttctctagttaacatcaatattcttgttgataaacttggtgtttggtggatgcgcatcccttgggaatcggcaatactgtcgtgtgcacatgccattaaggacattcgggcaatgatgaccataaatacaatcatccacgtcgcaatcttggcctgctgtacaagggttctgacgtgacagcattg

SEQ ID NO: 7804 - DNA, 544 bp, Hordeum vulgare
  Predicted polypeptide sequence is orthologous to G618, G2057
gccgagcaggcgccgagccgcgcatgatgccgtggaacgtgcccgacccaggcggcgggagcaccggcggctacctgttcaacgtgtcgcagcaggcggcgcatatgcaggcggcgctgagtggccagagccagttcttcttccagaggggaccccttcagtccagtaaccagccctccgaccgaggatggccggagaccgtcgaagctgacgacaacaacccgatgcagcagcagcaccaccaagggggcttgaacccttccgtgtcggccatcgggttcgggcccggcgtcagcttctccgggttccgcgtccccgcgaggatgcagggcaacgaggagcacagcggcggcaatggcgacaagccgccgtccgtttcctcggcttcccgccactgacagcagcagcagtggacgacagatgacttcaccaccaacctccacagcgtaccagtaacgacatccgccatcagctcctccacttgcatcactggtgcgaaaagctaattcgatgccgcttcttcacaggagctggcgatcgattg

SEQ ID NO: 7805 - DNA, 688 bp, Hordeum vulgare
  misc_feature (628)..(628): n is a, c, g, or t
  Predicted polypeptide sequence is orthologous to G622
ttttttttttttttttttttttttttttgatggccaagcgaattaattatccgttgtgcagtgtcgcaataagtacagcactccttttttgttaattcacaactttgtacacatactctgcataaacaaagtgccttcttttcatatataataacatgcatggtgacaaggaaacactaagccctacatcaggaaacaggcctaatagtctattggcaaagcagtaatcatacaggaaggcaggaagggggcaggcaggtgaggcgggcagatagcacattctacattaatctacggcaaactgatgtaggatctgcgtcagcatccagcaatcccttgatccaaacaaagcacaatgattgagcctccaaccaaacatgttttttgggtggcaagagaccaatgcgggacggcggtggtgcgccagccttcatttcttgattcccactcgccatttacaacactgcccacaggaagatatttttgaggcatccaagggacatggttttgtcatgtgtccttagcttgtttgttgaccatatattctcactggaactgatatcctgcaaacattgacgaagcccttctgcagctttccaagtcaccaagtggatcttgggaaattggncacacaccggaacagcgcctggccaaacggacaaggaaacaagaaagctgggtaacctgg

SEQ ID NO: 7806 - DNA, 781 bp, Hordeum vulgare
  Predicted polypeptide sequence is orthologous to G624
ttttttttttttttactagtttggatggttgagccgatacatcaataaattatgcatgccgcttacatggtgccgaagagcgctgcccttacaatacacatacatacagggtaggcaacacctacaacagggcctgcctacagcaccaaccgactgatctatggtatacacgatatagcatcaacactgggaaatatgtcccccgcaacaggaaggaaactaaatccttttgtatggaaaaagtaataacacctacactacaactccaggcgccgcatatctccattggtatagacagttttcaatctggtgttatctatcaccactacggtgagccgcactaggctgcgttctctcggggaagtctcattgcaccgaccgcatctgattttggtgactgctcgtcttcccgttcaggctgaatgttcaggtcaatctggttcttcataggagaggataccatgctatgctccacggtttcttccgcatcttcaccatttccgttcacgttctggggagtgctagtaggactggtgctagccggcagcacatcttgtggaatcgactcgctcgactggccttgctctttcttgcgaggcggctcttccgattctttctcagacgcacgcttctcacgccgaagcatcagtgtcctaaaacgacggcgcaccgtcatacatacattgcaggtgcacgtctgcttgtgctttgggcccttcccactaggaggctgaatgcacacaatgcacgagcagccagggcgatggcgggggtgctttgt

SEQ ID NO: 7807 - DNA, 712 bp, Hordeum vulgare
  misc_feature (21)..(21): n is a, c, g, or t
  Predicted polypeptide sequence is orthologous to G635
tgttccacagaactgactatnattgttgatcagttcaaaactacacaacaacatggtagactggtaaacctagtttacttaactaccccaggcatctcatgcaatggcaaagaatgatacgaagcgattacttcctgaggctactgatcttgtcattgattcacgggctaccttacaatatgctgatctccaaattactatcgctaagctattacgggtctgtttcatttggttgccatttccccttcgcatgataaaaaaccatccatggctaaaaaataaggccatgtttgcatgctttcgccatccttcttgctctcctcgtatttctgaagcaatgatgtccacacagatttgcactgtgccggtgtacgagttatcccctgcttcaacaggctaccagatatctcttcccaaagaaccattcttcctttcacggattggaatttctcatccatttccccacgcagctgtattaagctcttaatttcctcgggcttccacttgttctttcttgaagatttagctggagcgggagctgaagtgctggaatccttatcagttatgctgatcttgccgagctttggtttgttcccttgagctgaagcattgacaattcttgcaatttttactgctgtaggggatttgaaggactcccaaaaatgatccaatgttttaggctgatgtaaatcagaagataagaatgattcac

SEQ ID NO: 7808 - DNA, 1555 bp, Hordeum vulgare
  Predicted polypeptide sequence is orthologous to G646
atgacatatggaggagagagaaggggcagcaatcccactacggtcatccacaagacattccttcctctccctctcttccgtgtgctcgagacgacatctagcagctgctcctccccgtccttccctcgcccctacttctctcctcctgttcatagcgcggccggcgaggatttccgtcggcgagcacgagaagcaattgggatcgatccttggatggatgcagcccagtggcaccaggggctagggctcgtgaagcccatggaggagatgatcatggctggaaacccaaatcctaatcctaatgggaacccgagcccacagccggcgccgccgtctggcgccgaagcccagagggctcccctccctggcccgccggcagcaggagcgggcgcggcggccgggacgggctccaccgagcggaaggcggcgcggccgcagaaggagaaggcaatcaactgcccgaggtgcaactctaccaacaccaagttctgctactacaacaactacagcctccagcagccgcgctacttctgcaagacgtgccgccgctactggaccgagggcggctcgctccgcaacgtgcccgtcggcggcggctcacggaagaacaagagatcgtcgtcctcggtggtgtcgtccgcggcgggcgccgtctctacatccggggcggcgtctgggacggtccccgtcggcgggatgccggccaagaacccgaagctgatgcacgagggcgcgcacgacctcaacctggcgttcccgcaccaccacggccgcgtcttgcacccgtccgagttcgcggcgttccctagcctggagagcagcagcgtctgcaacccgggaggcgccatggcggccaatggcgtgggcggtgggaggggcatgggcacgttttcagcgatggagctgctgaggagcaccggctgctacgtaccgctgccgcaggtgcagctcgggatgccgccggagtacgcagccgcggggtttgcgcttggcgagttccgcatgcccctgcagcatcagcagcaacatcaccagcagcagcagcagcagcagcaacaacatcaccagcatcagcatcagcatcagcaacaccagcagcagcagcagcagcagcaggttcagaacatgctcgggttctcgctggacacgggaggaggtggcgacggcgggggatacggcggcgggttgcagggggcgcaggagagcgcaacgggaaggatgctgttcccctttgaggacttgaagccgggggctaacgcagctggaggtggtggtgcaagtggcggtgatcagtttgagcacagcaaagagcaaggcggcggcggtggccatgagaccctggggttctggaataacagcatgatcgggaacggcagcagcaatgacgccggcggtggcggtggcggcggctcgtggtaggatggcgacagcatgcatggctcatgcacacgcggttgtcagcatgtggagatgatagggatagagacaagcgggttaataagcggtggtggtgattagtgttaaaaaaaaaaaaaaaaaaaaaaaaaaaaaaaaa

SEQ ID NO: 7809 - DNA, 537 bp, Hordeum vulgare
  Predicted polypeptide sequence is orthologous to G652, G1335
acgggggaggaggaggcggcggcacctgctacaactgcggcgagccgggccacatcgcccgtgactgccccaccagcagcggcttcggcgggggcggcggcggcggccgcttcggcggcggaggaggcggcggcggcggcgaccgctcctgctacaactgtggcgagcccggccacatctcccgcgagtgcaccaagtgaggggatctctgcccctcccgctctatagacgtcgcctaaatacctctcgtcttagttttgccgatcgatcgcagccgcctcgcagcttattttaccttggctccctttccccccctttccgttcttagggggaagctcggtccaaaagtaaattcagtcagtcagtcccgtgggaagggtaatttttgcctatgaatggtcccggtacccggtacccgttactctcagttgaaggtttaagggtctggatgaagggattattggcggcgaattttgggtgtgtggggattaataagaatgaaggaaattgcaaaaaaaaaaaaaaaaaaaaatctgg

SEQ ID NO: 7810 - DNA, 700 bp, Hordeum vulgare
  misc_feature (685)..(685): n is a, c, g, or t
  misc_feature (693)..(693): n is a, c, g, or t
  Predicted polypeptide sequence is orthologous to G652
ggaccacccgacgccttcccctaacacctccttccccacctgacaactccctctcccgcgaccaccttgcgcatccctctccagaggacgaccctctctccggcggatggccccctctctagaggacgaccctctctctggcggatggcccccctctccggtggacgccccctctcctacagccacggccaccctgcacctccctctccaacggatggcctcctcacgggctcctccctctaaccccatcaattttgtgcctcccatccgtggatctttcgtcattcccgcgagcggccatggtcgggatggcttgaccatagaccaatgcgacgacggtgagggggtcgtggtggtctgagccatggcggtagagacggcgacggtggtcaaggtggagaagcggtacgcgagctatagcaatggaggcagcgacggtaccagggaggaggagaagaggtgcgcgaggtacagtagtggaggcggtgccagaggtcgaggaggaggggcagtggcaagctttcggcggggtatgtcgggtgctcgctggaatccctaaccagtggaagcgactgaagaaccacaccatgcacgtgactgtatcaacgcctccaacccctaccatgactgcttcttcagcgatgtgttaagaagatttccgatgccaaatcgggtatcaccctgnctcttcanttggaaa

SEQ ID NO: 7811 - DNA, 1387 bp, Hordeum vulgare
  misc_feature (984)..(984): n is a, c, g, or t
  misc_feature (997)..(997): n is a, c, g, or t
  misc_feature (1097)..(1097): n is a, c, g, or t
  misc_feature (1168)..(1168): n is a, c, g, or t
  misc_feature (1170)..(1175): n is a, c, g, or t
  misc_feature (1177)..(1177): n is a, c, g, or t
  misc_feature (1183)..(1183): n is a, c, g, or t
  misc_feature (1212)..(1212): n is a, c, g, or t
  misc_feature (1266)..(1266): n is a, c, g, or t
  misc_feature (1306)..(1306): n is a, c, g, or t
  misc_feature (1337)..(1337): n is a, c, g, or t
  Predicted polypeptide sequence is orthologous to G652, G1335
ttcctgctacggttttagtccttcgttttcggcggcgcaagatgggggagagagtgaagggaaccgtgaagtggttcaacgtcaccggggggttcggcttcatctccccggaggacggcagcgacgacctcttcgtccaccagtccgccatcaaggccgacggctaccgcagcctcaacgagaacgacgtcgtcgagttcgatgtcatcaccggcgacgacgggcgcaccaaggcctccgacgtcaccgcaccaggaggaggcgctctagccggtggctcccgccctgtcgacggcggtggtgaccgcgggggccgcggcgggggcggctactgcggtggcggctacggtggtggcggtggcggctacagcggcggtggtggcggctacggcggtggaggtggcggctacggcagcggtggcagtggcggccgctacagaggaagaggcggcggccgtgagtgctacaagtgcggcgaggagggccacatctccacggactgcccccaaggcggcggtggtggtggtcggcatcggcctctgaagttgtaccttcacagtggcggtagacgatcttcactattgttacttatacttacctacaccgatcatctacactttatcgtccttcaccacgtcactagctacgttcgttctccaaccatccttctctctccactctacgcccttaacatcatccatcatcgctcgatacaactatccttcgctatatgattcaacttacgcactcagtcatcgattcgtcccttactctcataacacaaatccacacatcgcatcggatcgctcgtatccatctcaccatccgatcacatcgtcttctattccatctactccatcatcacatcatcgcactcatattctccatactcatatctactctgcacgtatccctcactgtgcacatgcgaccgtatacagtactcgatcttttgacaatcttactccacttcgcatcgctctnacactcgacatantactgcgtcacataactctgcatacgctctctctactctcactcgacactcgattgcatacagacacgacatctattcgctctcgcactctcatcgcatnccttatcacatcgtaactcgctcgtttctcgactttgttacttaccgtaatcttcaacgtgctatcatcangnnnnnnanatatgnattcgcaatccgtctcccaaccactaatngacactctacctgtactccgaactccatcctacatcgataccgcgaacatatangtgtctacatctggtctctactctaatctgacatctatangaacatccttatcggatacataactgcatcngtaatctgcatcgatgatacgaactcgcattcgcatctctagtacactcg

SEQ ID NO: 7812 - DNA, 585 bp, Hordeum vulgare
  misc_feature (29)..(29): n is a, c, g, or t
  misc_feature (47)..(47): n is a, c, g, or t
  misc_feature (511)..(511): n is a, c, g, or t
  Predicted polypeptide sequence is orthologous to G652, G1335
gggactgcttcaacggcggcgccggcggnggaggaggcggctactgnggaggaggaggcggcggcacctgctacaactgcggcgagccgggccacatcgcccgtgactgccccaccagcagcggcttcagcgggggcggcgggggcggccgcttctgcggcggatgaggccgcggcggcggcgaccgctcctgctacaactgtggcgagcccggccacatctgccgcgagtgcaccaagtgaggggatctctgcccctcccgctctatagacgtcgcctaaatacctctcgtcttagttttgccgatcgatcgcagccgcctcgcagcttattttaccttgctcccttctccccccttccgtgcttaggggaagctcgtccgaaagttaagtcagtcagtcagtccgtgtggatggttaattttgctatgaaatggtccggtacccgtacccgtactctcaattgatggttaaagtcgtgatgatggattattgtcgggggaaacaaaccncctaacatttacaatttgggtaaaaccaggcggcccccacctgttagggggccccggggggggcgcccgcccct

SEQ ID NO: 7813 - DNA, 865 bp, Hordeum vulgare
  misc_feature (26)..(26): n is a, c, g, or t
  Predicted polypeptide sequence is orthologous to G653
gggggcgctcgtggggttgttcgtcncatcgtcgcatcgggcgcaggggggcaggcagagatcagatcgggggagagggagaccacggcgacggcggcgaccatgttcagcgggacgcagcagaagtgcaaggtgtgcaccaagacggtctaccccatggaccaggtgtgcaccgacggcgccgtcttccaccgcgcctgcttcaagtgccaccactgcaagtccaccctctcctttagcagctactcctcgttcgaaggggtgccctactgcaagccccatttcgcgcagctgttcaaggagaccgggagctacaataagagcttccagtcacaatcccccgcgaaatctgcaacggacaagttgactcctgagctgactagatcgccaagcaaagctgctggcatgttttctggaacgcaggacaagtgcgccacttgtggtaaaacagcataccctcttgagaaggtgacagttgaagagaagtcttaccacaagtcctgcttcaaatgctctcatggaggctgcgccctctcagcctccaattacgcggcttttggaagcatcctctactgcaagccccatttctcacagcttttcagggagaaggggagctaccaacattctgatcaagtgcgccttcggtcaagcgcgcctcaataggcccaaaccgcacaggccgcggggtcaaacaccacaagcggctgctgaaatcccctggttatgctgccatctttaaagtggcctttgagcttggagattgggagcctcggccgttatttacaatggcacccgcgtgcgtctgggtcaacccccgggctccccgaccccatcattggttgtccctggggcttccggacccagt

SEQ ID NO: 7814 - DNA, 592 bp, Hordeum vulgare
  Predicted polypeptide sequence is orthologous to G657
cggagtgttttcctggtagaaccgatgtacaatgcctgcacaggtggcaaaaggttctaaatcctgagttgatcaaagggccatggtccaaagaagaagacgatatcattgttgaaatggtaaagaaatatggtccaaagaaatggtcaactattgcccaagctttgccaggacgtataggaaagcaatgtcgggaacggtggcacaatcatcttaaccctggcataaacaaggatgcatggacacaggaggaggaaattactcttatacatgctcatcgaatgtatggaaacaaatgggctgaattgacaaagtttttaccaggaaagacggacaattcaattaaaaaccactggaacagttctgtaaagaagaagattggttcatatatgtcatcaggtttacttgctcaagtctcgcgtctcccacttgttgaacaccatgcacattttagttcctcaccggcgataacccaacaaaacagtgaagacagtgagagcaatgctgtccgggaggttgaagattcatcagggtgtagtcaatcctcattgggcatagtttcttctcgaaaatgcaggcatgcaagcttggg

SEQ ID NO: 7815 - DNA, 876 bp, Hordeum vulgare
  Predicted polypeptide sequence is orthologous to G670
cgaactcaattctggagaacagtgtattcccatggacagatatcggagttgggcaagaaaaagataccagagttcagttagtggaggaactcaagtggcctgacttgcttcatggaacctttgcagaggcaaccacagcgatgcagaaccagagccagtcactatacgatgatgtgatcaaagcagagagccagttcaacatggaggggatatgtgcttcttggttccagaatcagcagccgcagcaacagctgcaagcagcatcagacatgtatgataaagacttacaaagaatgcccttgtcttttgagcatatctaggtactatgttctgccatacatggagcagagcagatcagcagaagctgagacttgtctcacgaattcgtgagcaggctatgctgaggtgcttgcatagatagatatgcgaggttgatacagtaatcaaccttcacaaccttcctcggctaaagatcatgcagtgccacggaaaagataactctgtcatcaggagtggcatcaaattgcacagaaaagtacattctggagtctcctttctttcctctaaaaaatgttgatatcttctgtcacgacagctcaacttttggaacttggatttttgtgactctctggttttcaaaaaattgacaggatggggaaaaactgctggtgacgggggttttaccaaacattcaagtgggtgtcccccactttttaacaccggccttcccgtagaattgaattaaatatggcaactggattttgttttcttgaggaaaatgtgcgacaaacggtgatgggttttttgtaaggcagaaaattgaaatttttgtgcccggcctttgttgcctgccaaatatagaatatcaattactac

SEQ ID NO: 7816 - DNA, 658 bp, Hordeum vulgare
  Predicted polypeptide sequence is orthologous to G671
acatacatgcatacatttatttattttctgctgatatttgaccataactcatcactgtgtgtctataagcaaaacggtggccattacatgaatccaaccatgcaccagtaacaacaacaaggtaaaagtctctctctatcttgtgtcttgaaccaggaagtccacaaggaaacaccacccatcccatggactggactagctttcatgcatccctcctcaagcttcacatgcctgcatttatcactggtgcggttccagtgttctgagcactctctgcgacgttcacagtatgagaaactgaagcagcaggagcacctggatttgctatcgacgagacaacagatatttcagcacatgttgtcaaggtactgaacatagtctgcaaaactggagcaaaaggagcacctgaatttgtcaatgacgaggtctcggaatttttagtaagatgtggtgcggtaccagacatggtgtttgtgactggagcaccaggaacaccttcattcccacttgacagaaattccaaaccagcttgcaaactttcatcaataagatctacgaaccacttccttgtcttgtgcgtcaatccactgtttaactcgtaactgcgagtcgacgaaggcagactctttttggtcctaaggtagatcttggcgagagt

SEQ ID NO: 7817 - DNA, 867 bp, Hordeum vulgare
  Predicted polypeptide sequence is orthologous to G715, G1646
gctcttcccccaatcccccgccccctcctcctcctccccgaaaccctagctgaaatggagcccaaatccaccacccctccgccgccgggccccgtgctgggcgctcccgtcgggtaccctccggccgccgtctaccctcccgcaccgccccccggctacccgcacgcgccggcgctctacgcgccccagccgcccccggccgccgtcgccgccgcgtcgcagcagaccgccgcgcagcagcagcagcagctgcaggtcttctgggcggagcagtaccgcgagatcgaggccaccacggacttcaagaaccacaacctgcccctcgcccgcatcaagaagatcatgaaggccgacgaggacgtccgcatgatcgccgccgaggcgcccgtcgtcttcgcccgcgcctgcgagatgttcatcctcgagctcacccaccgcggctgggcgcacgccgaggagaacaagcgccgcacgctgcagaagtctgacatcgccgccgccatcgcccgcaccgaggtctttgacttcctggtggacatcgtgccgcgggacgaggccaaggacgccgatgccgcccgtctcgcgggcatgccccatcccgccgccggcatgcctgccgtcaacaagggctactactatcgttcgaaacgataatgcccactctttttgttcccgccgaattcaatttccatcattaacatgaggactgaagaatagagacgcttacccttgcggatgtagtgtttcccgcctcacttatttcaccaatattattttagcctctaagaggaacccattacctgccgcgaattgttgccccgcaaatataaaccgcagccattatatgcgcagacaaaatattaaaca

SEQ ID NO: 7818 - DNA, 936 bp, Hordeum vulgare
  Predicted polypeptide sequence is orthologous to G718
cggcacgaggtgaaccgctcaattcttctggcggcagcggcaccttctcttccagctcggagatggggtatggctcctccaagagctccatatccgcgtcgatcgattcttcgtccaaggctgggagcaacatggagttcagatttgcgcccgtcaaaaaccctgacaggaacacgagcgaaaacactgagttgggtaaagttgacaacacgaggactggaacgtctccgtcgtctgtggtggcagtgagcagtggagagccggtgatcggcctgaagctcggcaagagaacctactttgaggatgtctgtggagggcagagtgtcaagagctcgccatcgggtgctgcgagtgtgccgaacaaatctcctgctttgagcaagaaggcaaaggcggaacaacagaaggcacataactcatactgtcaggttgaaggctgcaaggttgatctctcttctgttaaagagtaccatcgaaagcatagagtatgtgaacttcactctaaggctcccaaaagtgttgtcgctggtctggagcggcgcttttgccaacagtgcagcccggttcatgctttgtctgagtttgaccagaaaaaagcgaagctgccgtaagccgctcaatgaatattatttccgcaagcgggaggccactgcccagaagccattttcctttaagttcgtgaaggaaggtcttacaatgtttttttaattcccaggccacgggccaaattttctattagggaaaagccccaattttttgggaggggcccagcctccccaaattttcctcttggggaggaaccattaaggtttacaggggccgcccctttaaaaacctcttgggtggaaacaaaccccggggtaccccaacttaatggggctgtagaaaaaaacccctttttcccgtggggggataaccaaaaaggccccccccctc

SEQ ID NO: 7819 - DNA, 579 bp, Hordeum vulgare
  Predicted polypeptide sequence is orthologous to G732
aattgggtttttttttttttttttgtttagccatagctcacgtcatcacactaccagtaccacacaaacacgcattacattacacacaatatgataatatgctcccgagtcagagccacgggagactccctgcatcggccatgatatcatcgagctggtccggctggagcagcatctgaatctccggtggcagggacaggggcggcgccagtggcgactgcaggccgccgtacagctgcgtgaaggggaccgggatattctgtgcgttccttggaaccgccggcaagttccccgagcacgcggagctggaagttccgttgttccagaaggctgtacaggtagcaacgcgccgaagagagcacgcggttgtgttgttggaccaggctgcattgttgctgcatgagggcggtggtgacgcgcatggcctggttatagatctagacctgggccgcgcgagcggacaaactgccctcgcgctgttgcctatttacgcgggacctccgcgccgagaggcggttggaggtcttccgtttgcgctgccgctcctcctcggagatcgcgccgccacggcgttgaggc

SEQ ID NO: 7820 - DNA, 1674 bp, Hordeum vulgare
  Predicted polypeptide sequence is orthologous to G735
ccctcaacccatctcattccatacacaacccatgggttcgccatagccaaaacccatgctgtgctcgccgcgtgattgagcctctccaccgtcctctcttcgctggttcccacggggttaaccatacgatttctcgctcaattttgttctaatcaatcaccttgcccaaattccattccggaaacgtgcaatggagcccgtgttctcactgctggaggaggcgatgcccgagcccgactctaaccccggtcggacctcgccgccgcagctgcaggcacacgtgctcgccggaggagtcagaggagcaggaggagtgggcgtcggtgagatcgttggcgatggcgcgacagaattgtgcttcgacaagtccatggaggagccgtcgctgctcaacgtccccacggagccagtggcgaacccggacgcctcgacgcttcaccctaatcccacggcggaggtgagccgcaagaggcggtacgacgttcatgaggaggaggaggtggtgggggtcatccccacgccgcctgcggcgggcgcggtgctggaccccgtgggctacaacgcgatgctgagacggaagttggacgcgcatctcgccgccgtcgccatgtggaggactactcgaggaatttgccgacaaagctcccatgacaatagagcatcacaaaatccagattctatccaaggctcagaaaatcacactggagatgctagtgtgcaacaacttagctcttcctcatgggagccatcaccatcggatgatgatatggaaggggaggcacaaacaattggaactatgaatattagtgcagagaaagtgaacaaaagaaaagaatctaaccgggattcggcgagacgctcaaggagtagaaaagcagctcatacgaaggaactagaggagcaagtctcactattaagagttgcaaataactccttgatgagacatctagcagatgtaagtcacagatacgtcaataccgctattgacaatagggtattgaaggcaaatgttgaaaccctagaagcaaaggtaaagatggccgaggaaactatgaagagaattacatccaccaacaatttcccccaagcaatatctggcatgtcatctctcaggacccatttcagtggttcccaattggatggcatctttgatactacattgccaacccaaaacatgtcacttaaccatttttccactacagcaacaaattttgatgtgagcagcaactacatccccgagctagctccggcataccagatccatgatcaaatatcttcgctacatacgcaacctatgccatgcttggatcatcacccacggaggatgccctttggtattccaagtacattggtgcctaccccacaacgggaatccactacattggattcaaatgaaataggcaacatggtgatgcagtaggaattatgtgagagacctgagccggaattattattttaaaataaatattgtcgttgttcttggtggccattgggggtatttgtaatggtttctcaccttgttaagctcagacttgtttaaggaatatctatcattgttgtttcagaaagaacctatacattgttggtatcccataactaataaaatatatcaaaggttattggacaataaagtcatgtggttgagttaaaaaaaaaaaaaaaaaaaaaaaaaaa

SEQ ID NO: 7821 - DNA, 700 bp, Hordeum vulgare
  Predicted polypeptide sequence is orthologous to G735
ctttttttttcctccaaagtattcacccggcagcaatgacaacgcacagttttactaaatctgctgtgttccagaaacatagcgacgaggacactagaggtcacagccaatgaacaaatagcataggattatcaacatccaccaccaagatacgtctgcccaacaatagtttcttggacttcatggccccgaggaggtggccgctcctacgaggtcgatccggacgaagctggcccgccgcacatcctcttctggaggtgctccaggctcgccacacgatgcagcgagtcgggtctgcccatcttgctggtatccatggtctcgttgaggaagttgtcatcctcttgagccgaggaagccatctcgggcatgtatccgttgttaccaccagcctcgcttgtggagaagtaagcgctcaggtcgtccgggacggcagcgtcggaggtggcttctgatggagagccagtgaagggcatgctgagagatgacatgtcggaccctgcagggaacagagcgctcatgcctgtcacccgcttcaccgagtcctcggccatcttcacctttgctcttaaggtttcaacatccgcctttaacaccctattgtcaacagcagcaccattgtatttctgattaacatcagcaagccgccttaacagcgaggagttttcaactcttaactgtgatacctgtgcttcgagtt

SEQ ID NO: 7822 - DNA, 919 bp, Hordeum vulgare
  misc_feature (768)..(768): n is a, c, g, or t
  misc_feature (919)..(919): n is a, c, g, or t
  Predicted polypeptide sequence is orthologous to G740
tttttgggcacgagagattacaaaacacctctgagagaaaatgccgctgactggtgaggtgaagtggttcaacgagtccaagggattcggcttcatcacccccgaggacggcagcaaggacgtcttcgtccacttctcggcaatcaccgacgtcggcttcaagaccctcgccgagggccagcgtgtggaattcaccatcgaaaccggcgcaaaaggtccgtccgccgccaatgtcagggccatataggaggactatactatcggcatccttttgtgattggcttcaccaaaccgagcaaatggagtccacgagtgtaaaggattgctggtggttaggggactatggtcaccggtgcactgaagtctactaaagtgcctaggactttctttcctttcagcgtaacatctactgcttactgcaggggagggacgactgctgtttcgctattgcgtaagtacggactcacgcgcagtccgacagcctacaccgtcttatcactttttatcccccacatccgcatttcctctttccacaacgctctcatccaactcttttgccccttattgcgatcgcctaaatttcagtctcattcgtgggccccgggagttttcttctttgtcatttgcctgtcatgccgagtccttatagaaattattattgtctccaccccccacttttttgttccccgtcctgtttgcccccgcccccccagttcacccgcaccaatacattgcaccatgtggttagttagccccgcgatagacgcncgtacattatatcacgcttggtgaattatcagtataatgctcaacacctctatattcacccgatatctcctcaccttccaatgaaccgcctatataaccagtcacagctattgccactccgatattgctataccgcactgcgctacccccn

SEQ ID NO: 7823 - DNA, 516 bp, Hordeum vulgare
  Predicted polypeptide sequence is orthologous to G740
gcgaacaggttgagatccagagagagaggagactagagatacatactgagagaaaatgccgctgactggtgaggtgaagtggttcaacgagtccaagggattcggcttcatcacccccgacgacggcagcaaggacgtcttcgtccacttctcggcaatcactgacaacgccttcaagaccctcgccgagggccagcgtgtcgaattcatcatcgaaagcggcgcaaaaggcccatccgccgtcaaagtcaaggccatatagtattagtaggtggaggagtatcggcatccttttgtaattctctccatccatccacggaagggaggagaggtagccttcttcggccgagtccaagaatatgcagatttccgaaggactgctatttgtttgtgctcaattctcaccggtgcactaaaaatctgtactgtttctttcttttatttttgcgtcaaatctacatgggttaactactattccgttcgggtttgcaaggaatatggattttgtttaagtca

SEQ ID NO: 7824 - DNA, 699 bp, Hordeum vulgare
  misc_feature (583)..(583): n is a, c, g, or t
  Predicted polypeptide sequence is orthologous to G752
ttttttttttttttttttaactttagtgcaactgataacagtttggcattcacaagctggactcttcacagctcacacttcacagggcacaaatccatttgacattcacaaactggagtgaaccccggccaagattattcacaggtccacgagccacgactaccccatcacatcgcatagtaatttattttacaggttcgagacctcggctcctacatgatgttcggctcagttcagagagggcaacgctggagctttgcagactgggcaccagttcttctgcaggagccactggcgaatgcagcacacatggtactggtgctcgcaccgcaacctgccaacctcttcgcccttcacgaactcctcctggcatatgctgcatttgatgtcatctatggctgttttgtttccctttgcagcaactgggtctatataaacgccttctgatacatttcgcaaactgttcttcagaaagagcagtacttacgaatcctattctctcttctaatgctaatagttcctcataggacatgttgtcaatatccatccgcatgtcgctatggggggcatgggaggtaaaggnaccaagtaacagatttgtctccaagtacccgcaattgctcaaaagtaaagctcagcttccctggttcaatccctccccaagcactaagcaaatacctcccggcaaatggccttcca

SEQ ID NO: 7825 - DNA, 700 bp, Hordeum vulgare
  misc_feature (38)..(38): n is a, c, g, or t
  Predicted polypeptide sequence is orthologous to G752
gcacgaggtaacattcgaacaagaattcgtaaatatangaccacaacaatggaaactctactgctatcgggacaggctcacaaaactatggccacatccaaaatcttcacgtaacatcgggaaggagaacaggtgtttttccttatcgggccttagaaacagattgcatcaatagtgccgaatgtacaatctgttttgaagaatttaaagttgatgattggatgggtcgactggaatgcttttgccaatttcatttgaagtgcatcaggcagtggtttgaaatgagacctggacaatgtcctgttcatcagcatggctcaggttgataattgtgcttttcataataagttaatacgccaaacctgttttacgacgaagatctgtctaatatctataattacttcgttaagataggagtctttggttcctgctgctagggtattccaatttgtgttgcttcaaaaagctaaaagaggccagttataacctttcatctatcataaaaaattacctataaatgacctcctcatacgcctacgattcgaggatatgcatacatcaactgcatttttttcaagtccaactaatgaaccacgaagagcggtcaaagctcagtgcgccgataaacttacgataaaagtatgaagcacaaggagtctagtgagtctaatgtatttttaacagtgatagagattaactg

SEQ ID NO: 7826 - DNA, 830 bp, Hordeum vulgare
  Predicted polypeptide sequence is orthologous to G760
cagccttcctcgtcctcctcctccgccccggtggccgccccggatgacccgacctccctcgccccgggcttccgcttccacccaacagacgaggagctcgtctcctactacctcaagcgcaaggtgctcggccgcccgctcaaggtcgacgccatcgccgaagtagacctctacaagctcgagccatgggacctccccgcgaggtcgcgcctccgcagccgcgactcccagtggtacttcttcagccgcctcgaccgcaagcatgccaaccgcgcgcgcaccaaccgcgccactgcaggaggctactggaagaccaccggcaaggacagggaggtccgccatggcgctagggtcgtcgggatgaagaagacgctcgtcttccacgctggccgcgcgcctaagggcgagcgcaccaactgggtcatgcacgagtatcgccttgagggcgatggcgcagccgggatcccacaggattcatttgtagtgtgccgaatcttccagaaggctgggcctggtcctcaaaacggggcacagtatggagcacccttcgtcgaggaggagtgggaggctgatgaggatgatgattttggtcctctgcctgtggagaggaaccttcgttgttgagcatgaggctcctggtgctatggagaaaggatatcttcagatgaatgatctcattcaggacttggcggttcaaaatgagaaccggagtgttgctttgaccagttactgacactttcaaataccgccggcatttctaaagatttataaggaagttaggggacatttcttatgaccccaggtcttgtgtctaattactctaagaaaat

SEQ ID NO: 7827 - DNA, 676 bp, Hordeum vulgare
  Predicted polypeptide sequence is orthologous to G773, G1412
gcggctcaccatacggcgaggaagggcggaggagacgactcccttccaggtcccgctccagcgccggcgcgcaggcaactccggggtttctgaaaatgcctaggaggaagaagagtcggccaggtccagttgtaggtggcaggcgggcaggcaataagattgttggttttacatttttggctccccttttttaccacattgtttcgtatcagttgccacttttttccattagtacttgccaaaacaatagttcacttcaggttgatggaacggagcagaacatggcatcaccacaggacatttgcaagctctgcatgcacatcaacaaagatcaacgtattgctatcagagacatgggaactggaccgttcctcgacatcaagtgtggatacttgcacaacaccgtcgtgacatggttcacaaggttgtaccactcaggaaggagaggttttttcggacctggacgcggttcatcccgttgaccaaggaatctgttcattagattttgggcatccctcgtggagacatcgatgtcaaagatggaagccacattacatacataccctcatggatacgttgcggaacttgatgggcctgtaggtgttgacgacgacggcgagggggtcgatggcgaggcggtactcgtgcatgacccatgccgtcttggtgcccttgg

SEQ ID NO: 7828 - DNA, 700 bp, Hordeum vulgare
  Predicted polypeptide sequence is orthologous to G778
gatagtactacaaacacatcttcttcatgtaagcaactggcggtgacttgtacatacaggctaaataaagcgatgtcaaaaccatatacaagctagaatgattccaatacaacaaatcatgtgcagtttttggagtgtaaatatacgcgatgttgaagggtgcttgcggtgcgtcgacagatttttcatgtccaaagggaaatgctgtacatccaggcgcttgtaccagtttgtacgatcactctttggagctgcgtggctgggtctgctgttggcctagcttctggtacatggccatcatccggctgtacgcctccatgccgttcggttgagcttgctgttgctgctgctgctgctgctgctgcgcgttctgctgcgccgcttggcaggcgaggaaggcggagtaggcgtccggcacggcggcggcggcggcgggctgcttctgccggtcggcgccggcgccggcgttccagggctgcatggggacgaaaggcgtggacgggtgcatcatgggctgggcgaggccgggataggcgggctgggcgagtggcccggcggccatgttcatcattcctaggcccatctgcgccatctgggccatctgggccatctgggtcatgacggacatctgggccagctgcggcatggccatgggcatcatcatgctgctcattcggttcatcatctgcaccgtcgcctg

SEQ ID NO: 7829 - DNA, 892 bp, Hordeum vulgare
  misc_feature (811)..(811): n is a, c, g, or t
  misc_feature (817)..(817): n is a, c, g, or t
  Predicted polypeptide sequence is orthologous to G783
cccgggctgcaggaattcggcacgaggctcaagcgatcacggagaggagaagagtagaaccacaggcagacgaacccctcgaagagcagctctgagctctgcggcttgcgctcccgaatccgcagcccttccccgcttcgatcggagacgcaggggaggtgccggatcgagcttcgcggtcggcatggtgcccagggacatggtgaatgcccccgccgagaggctacacatccaagggtctgtagtgaacaagaagtgtgagaagaaggtgccaaagaaaatccacaagtcagagagggagaagcgtaagcgaggcacgcagaatgacctctttaatgagctgggagccatgctagaactagacaggcagaacaacgggaaggcatgtgtattgggtgacactacacggatactgaaggatttagtttcacaagtggaatctcttcggaaggagaataccacactgaagaatgaatctcactatgttgtgttggagagaaatgaactccgtgatgataacagtatgcttcgcaatgaaatcctggagcttcagaacaagcttaggatgggtctgcaaagcaaccctatttggagccaggatactacaagatcagccgtcgcagtaccttatcccacaagaggagtgttcccagtacagcattcaccacatccaccagtcatcacctcgacggcactttctctgcaacctgtaatcactgagcaatgctatgttgccccaccacgagagctacagctcttcccggaaagttcatctgcatccactgaagacagtgaactgtcacaagaccangggatntccaatagtgtaacacggcctcaggcacggtaccctacaccagtggtgatgtcgccagtgaacgaattctcatcc

SEQ ID NO: 7830 - DNA, 676 bp, Hordeum vulgare
  Predicted polypeptide sequence is orthologous to G783
ggcacgaggcacaaacacacacaccagcggatcaagatccacccaagcggagatagggcaagcaaggactgcttctttagatgtgaattcattacaggaaccagaatcttggaatggtggctgatgcggagagctcagattcaatggctggcagctcaaggtctgctgccgaaaagcacgttgacaggtgttttgacaaaagagcccaggaaaaggctccaaagaaaaatcatgaagctgagcgagagaaacttaagcgtgatcagttgaatgacctttttgttgagctcagcagtatgctagatcatgatcgacaaaatagtggaaaagctacagtattgggtgatgctgcgcgagtactacgagatttaattactcaagttgaatctcttagaaaggagcaatctacccttctaactgagtgccaatatgtcggttcagagaagaccgagctgcaagatgagaatactacactcaaagcccagataatagaactgcagaacgagcttggtgcaaggatcagaaaaaataacctgaatttaagcagccttggggtgtcacatccaatagggagcagctgcactgctaatttagcaactcacccaacgcggcatgatatatggagcaatacttctaatgtaagcaccatgcgcatggtgcccccaacaaacacact

SEQ ID NO: 7831 - DNA, 716 bp, Hordeum vulgare
  Predicted polypeptide sequence is orthologous to G789, G1494
gttagctagacattcgcgcgatttcccagcaaaaatgaaacaagagagatcaccatgatttgctacaattttcctgccgggatctcaaagggggcagaagatggaagaacttggttcccatcagcgtttcctctgctccatgtatatactgctgtacttgctgctgctgtgccgccgcagttcctttccattttattgttcctcttatctcgttttcgtaattacctcatcttttgtttgggtgtatcgcgtttcccggcgcggtgttggcggtagcggcaggcgtaccgctgccattgggcacgtggtggagcgtcggactctgctgcagggccttcggccctagcgggtagtagcccaccccctgcgcaaaatgctggtggtggtggtggtgggccggcggctgcaggtggtggtggttgacgccgaggaagtgcgcgtactgctccggcaggcttccctgctgctgcggtgccatgaagggcatccgcgccatggacgcgggccccatctgcggcaggtactggtgcatgcccgggaacatcaccgccggcggcgccgccatgccgccgcccatccacatcatctgcacctgcatctgcagcgtcttcaggtactcgatcgcctcgtccagcatcgacgccttgtcagtcttgttgcagtggggtatgagctcttgcagcgctcgcatcttctcgttgatcctgtctcgtctc

SEQ ID NO: 7832 - DNA, 713 bp, Hordeum vulgare
  Predicted polypeptide sequence is orthologous to G791
ctagccagccacggcggcggatccctcggggccacggccgccgagacgatggacggcggcgacccggtagaggaattcctcctcgtcgggggcggcgccggcgatggcggggacggcctcgccgccttctgcgacggaggacttgggattgaggatgtcagcggaggtgactctggtcttgggcaatctaatttggggaaaaggggcagagatgaacaatcttcatctggtccaaagtcaaaggcttgccgcgagaaaatgcggagggagaaactgaatgacaggtttcttgaattatgttcggttatgaattctggcaagcacggtggtcttgatgaatgttcggctagcaatcctgggaagagcgccaagttggataaagcaagtatcttgagcgatgcaactcgtatgttgacacagctcagaggcgagaccgaaaagctgaaggaatcaaatgcgaatcttcgagagacaatcaaggaccttaaggtggagaagaatgagctccgagatgaaaagttgagcctgaaggcagaaaaggaaaggctggaacaacaaatcaaagcagcaagtgctgctcctgtaggatttgctcctcacatgccttatccagctgcattccaccccgccgtcttccctcaatttgcaccaccttatcaagttccagccaacaaaagcggctcggtccctgctggatttccctggaatggcgg

SEQ ID NO: 7833 - DNA, 954 bp, Hordeum vulgare
  misc_feature (833)..(833): n is a, c, g, or t
  misc_feature (927)..(927): n is a, c, g, or t
  misc_feature (954)..(954): n is a, c, g, or t
  Predicted polypeptide sequence is orthologous to G791
ccggcgccaagaaaagatcccgtccagagtcgagcgcacaacccggcacaaaggcgtgccgagagaagctccggcgagacaggctcaacgaaaggttcaacgagctctgcgccgtcctggagcccgggaagccacccaaggccgacaaggtcgccatcctcagcgacgccactcgcctcctggaccagctgcgcgccgaggctcagcagctcaagtcctcaaacgagtcgctccaggactctatcaagagcctcaagtccgagaagtcggagctgcgagacgagaagacgaagctgaaggccgagagggagaggctggagcagatgctcaagggcgtcagcgctgctgctgctccccggcagttcatcccgcacccggccgccgctgcggcgccgcagttccacccggcggcagcgttcgcgcacgccggcaagttcgtcccggcgtacgcagccggctacccgccgccggcagccttctggcagtggataccgccgacgtcgctggacacgtgcaaggaccccgcgcactggccccccgttgcgtgatcagctcgatgacgcacggggggcatcgtcggaggatgtagaaggttgaccaaagcacgcgcccggagaaacatcggttcctgtgattgtgtagcggagactatgattatgtgtgggtataatgatccggcttgctggggtataatgatcaggctcccctgatccaattcctcgggaccgaacctattggaccgcctcttgacacgccttatggatatcgtgaattgaatataaattgggacgacgggggtttcttcctcctcccaaaaatagaaaataaagaantgaatcaaaaaatgaaagcagacggtaggatggtggtagagttgagtatcttgtttggcgtggccgcctacaccctctgtgcgatagaatggcnggatagagggaacataagagtggacan

SEQ ID NO: 7834 - DNA, 715 bp, Hordeum vulgare
  misc_feature (560)..(560): n is a, c, g, or t
  Predicted polypeptide sequence is orthologous to G791
caaccccgaaatatcccccaactccgacgcgaccgcgaaaccctagtcccccggcaaccttcgctggacccggggagccgctccggcgccatggcatccccggaaggatcaaactgggtcttcgactgccccctcatggacgaccttgctgccgccgacttcgccgcggtacccgcaggaggcttctactggaacccgccgatgccgccgcagatgcacactctggcgcaggccgtctccgccaccccggctcccaatccctgtgctgaaatcaatagctctgtttcggtggactgggaccatgccaaaggacaaccgaaaaataaacgtcctagatcagaaactggtgctcaacctagctccaaagcatgcagggagaaagttagaagggacaagctaaatgagaggttcttggaattgggtgctgtcttggacccggggaaaacacctaaaatcgacaaatgtgctatattaaatgatgctatccgtgcggtaactgaattgcgtagtgaagcagagaagttgaaggattcaaatgagtctctccaagagaagattanagagctgaaggctgagaagaatgagctgcgagatgagaagcaaaagctgaaggcggaaaaagagagcctggagcagcagattaagttcatgaatgcccgtcagagactcgtaccacacccttctgtcatcccagctactgcattcgctgccgccc

SEQ ID NO: 7835 - DNA, 698 bp, Hordeum vulgare
  Predicted polypeptide sequence is orthologous to G791
gaaaaaatgtattatacagtggacgaagggtagtagctctatagagcgcacaaaggccagcattctcctcatcaacaaaaactaccgcatgacaacaatagttaatctgaatcagagagactatgcgcaaccaatggatcaaacaactacgctgtttaaggttaccatgagttcatgtgatttaaacggtccaagcatcacgcaacaggcgggcaagcttcgctgtcctttgaggtgtcgacttcggagggcggcatcaactgccacatcggatatcccgggtaaccaacaaagggcatcatcagtttctgtgctgaagcgtgcccctgtgcatggaagggagccattggcgcctgagcaaatggggagtgcatcatggtaggatgaggcatataggctggagttgcagtcaatagtttcatctggtgctctaatgtctctttctctaatttcagcttctgcttctcgtcacgaagttcatccttctctgccttcaactctttaatcttgtcttctagacttccattggtatcctttagctgcttcgcttcagcacgaagctgagtaaccatgcgagtcgcatcacttaggatagcagctttgtcagcttttactggcttaccaggatccaatgtagtacccaattcaaggaacctgtcattcagcttgtctcttctcactttttccctacaagcctt

SEQ ID NO: 7836 - DNA, 627 bp, Hordeum vulgare
  misc_feature (427)..(427): n is a, c, g, or t
  Predicted polypeptide sequence is orthologous to G801
caggaattttttttttttttttttttgccataaaaggctaagcaccatttaaattaaaatgagcaccaaaccattcacaagaacttggacattgtttccaacatcagtagcactcgctcgaccaacactgacagcaatctgcctttttttataagccactaataattctacgatcccagtccccctcctcccctgatcactcgaatcgcccatctaacggccccaaccggtgccgtggcaataagatttcaattattccggaggggaagactgatactagagagcccaataggcccctcatcaacactctaagactaacaagcccctaaccctagcctcccctgtggggattacttgttctcctcggcggcggacgccaggggccggatcgttggcgctgggcggctgcatgaggagcgcggtgtantagggcacctgcacgaacggggcgacggggacggcggcggagggcgcctcctgcggggtgacgccggtgccggtggcggcgatgatggagggctcggcctggcggagcagccactcgatggtctcgccgtcggtgcggtggccgagctcgcgggtgagctggaagacgcgggccgcgaccatggccgggatgcggacccg

SEQ ID NO: 7837 - DNA, 655 bp, Hordeum vulgare
  misc_feature (30)..(30): n is a, c, g, or t
  misc_feature (37)..(37): n is a, c, g, or t
  Predicted polypeptide sequence is orthologous to G807
tgattcaacgccttcaactaatggaacagnaaccagnaagcagatgatggcacttctagcaatcgttgtccagaaccctagtcttctcaaccagcttgtgcagcagcagcagcagcagcagcgcaggaacagctggcgttatgaggatggaaacaagaaaaggaggttccctgctctagagcagggtcctgtaactgatcaggagacttctggcgcaggggctgaaattattcagtatcgcccccctgtccctgaaacctctagccaagtaatagcagatgaagcatatttgtcggccacagcagaaccaatctcaagtcctccacttaacatgcccatggacatcgacactgaaacgacctcagacaacctcaacacacaaggttcatccggggacatttttgctgacatgcctgctctaccagactttgatgacatgcaactgtggtttggcgaagacggggaacttactttaactattcaagattatgatgaatctccacagtcagagcaggactgtcagatggaagcacagcataaccacaataaccctcaatatgcttccaggtgatcaaggatgcgtgaggtgggcgccattggcagcgaaaacggcatctgtgcttaggtcatagtgtcgtatagcaatgtttgaaag

SEQ ID NO: 7838 - DNA, 926 bp, Hordeum vulgare
  Predicted polypeptide sequence is orthologous to G807
aacagcagaccactgaccatcagctgcagactttgggcaagcgtcttcatggaatggagcaacggcagcagcaaatgatgtctttcctggctaaagcaatgcagagtcctggcttcctagcacagtttgtacagcagaatgaaaacagcaaacgaagaatagtagctgccaacaagaaaaggaggctacctaagcaagatgatggcctgaaccctgaaagcgcattgttggatggccagataatcaagtatcagcctatgatcaatgaagcagccaaagcaatgctgaggaagatcctacagcaggatacctccccacacagatttgaatccatgggcaattcagataatctgttactggagaactgtatgccaagtgctcaaacttttgacagctcttcatcaacccggaattctgcagtcacccttgcagaggtcccaggcaactcgggcatgccatatatgcccacgagctctggactttcagcaatttgttcatcgtcaagcccccctgagatgcagtgtcctccagttctggacagcaactcatccacacaacttcccaacatgagtgctgtgccttctgtgccaaaggctatgacgccaggtctaagtgatatcagtattccaggattcccagatctgcatgatctcataacggaggacgcaattaacattcctgtagagaactatgcaatgcctggtcctgagtgtatattccccttacctgaaggcagtgatgactctgttcccatggaccccatcgaccctgatgagatcgatgacactcaaaagcttccgggcatatatgaattcctctgggagcacgttctttgggcacaccctttttttggttaaaacaaaagggctattcagggttgttgtcaacccggaaaccccaaagagaatggtggggccccacctcat

SEQ ID NO: 7839 - DNA, 956 bp, Hordeum vulgare
  misc_feature (617)..(617): n is a, c, g, or t
  misc_feature (619)..(619): n is a, c, g, or t
  misc_feature (632)..(632): n is a, c, g, or t
  misc_feature (634)..(636): n is a, c, g, or t
  misc_feature (638)..(639): n is a, c, g, or t
  misc_feature (642)..(643): n is a, c, g, or t
  misc_feature (646)..(647): n is a, c, g, or t
  misc_feature (661)..(661): n is a, c, g, or t
  misc_feature (727)..(727): n is a, c, g, or t
  misc_feature (940)..(940): n is a, c, g, or t
  Predicted polypeptide sequence is orthologous to G811
cccgggctgcaggaattcggcacgaggtggcgacgcccccctttacctctttctgtagctcctttgatctttatgccctcctcccctcactttatcaagaaatctcaggacaaatcttgaggcgcttttagagcgagagggagaccgatggcggcggcggcggcgagcgtcggaggcggggcggcgccgttcgtgtggaagacgtaccggatggtggaggacccggggacggacggcgtcatcgggtgggggaaggggaacaacagcttcgtcgtcgccgaccccttcgtcttctcgcagaccatgctgcccgcccacttcaagcacaacaacttctccagcttcgtccgccagctcaacacctatgtcagtccgttgattcatattactaatcctccatttgtcttgtccatttcctgtacttatcttgattcagagagggagagagagagagagatttctgtactccggtggagtacaagttcttatgtgcgtgtgtgtacaactgtgtatgcagtatgcgtgacattttttgggagtatatagttcgtctttaaaaaaaaaaaaaaaaaaaaacctggggggggggcccggcccccatttcccctttagggcgngntttttaccaaacncnnncnncanntanncttctcacctctcnttatcccctccccatctctctttaatctctctccctcacccccttcacttcttcaccttccccccnttctctcatcttaatttcatcttccccatttcccccccccctcccccctctttctccctcattcaatctctctccccctaaactttctagctccttttatcccgctctcacatatctcttcctactaatcctttttcggcaccctgagaggtcacgtccgtagcttttacttgacccaccgcttacgcccttgcctagccctacgcacacgtntcgtcgacgtcactca

SEQ ID NO: 7840 - DNA, 477 bp, Hordeum vulgare
  misc_feature (430)..(430): n is a, c, g, or t
  misc_feature (445)..(445): n is a, c, g, or t
  misc_feature (452)..(452): n is a, c, g, or t
  Predicted polypeptide sequence is orthologous to G811
gtccaggcggtgcagaggctgcgggacgagcggaggggcatggaggaggagctgcaggccatggaccgcaggctccgcgcggcggagaaccggccgggccagatgatggcgttcctcggcaagctcgcggacgacccgggcgtggtgctgcgcgccatggtcgccaagaaggaggagctggctgcagccggtgccggcggcatggatccaagaccagataagaggaggcggatcggggccgaggccgaggaggcagcacagagcagggccgtgccgttccccttctctaacgcgggacacgtgttctactaatagaccttgagagtggagagtagatagataggtgtacacgtgtgatgttttggtgtttatatgtatgtgtatacgtatgtatttctgtgaaaaacaacaaaactgtcccttttcaaanaaaaaaaaaaaaaanaaacccnaccaaaaaaaaaaaaaaaaaaaaaa

SEQ ID NO: 7841 - DNA, 1257 bp, Hordeum vulgare
  misc_feature (5)..(7): n is a, c, g, or t
  misc_feature (663)..(663): n is a, c, g, or t
  misc_feature (1150)..(1151): n is a, c, g, or t
  misc_feature (1160)..(1160): n is a, c, g, or t
  misc_feature (1162)..(1163): n is a, c, g, or t
  misc_feature (1165)..(1168): n is a, c, g, or t
  Predicted polypeptide sequence is orthologous to G831, G1202
tggtnnnaggttattatgatgctctcgtagcttactcgggggactgggatgaagctggcgctgcccagcttaatggtcttgaactagtggatcccccgggctgcaggaatttggcacgaggggtcaccgccgaaatgttcaacgaggataccaagttatggaagaagagagtggggcactacaagtccgtggtaagtcagtttgggcagaagggccggtaccgcaacttgcttgatatgaatgcccgctttggcggcttcgctgcggcattggcgggtgaccctatgtgggtgatgaacatggtcccaaccattggaaattcaacgactcttggggtgatatacgagcgtggcctcattggaaactaccaagactggtgcgagggcatgtccacctatccccggacctacgacctcattcatgctgattcagttttcagtctgtacaaggacaggtgtgagatggacaccatcctgctggagatggacaggatcctgaggccggagggcacggtgatcatcagggacgatgtggacctgctagtgaagataaagagcgtcgcggacgggatgagatggaatagccagatcgtggaccacgaagacggtccgctcgtccgggagaagctcctccttgttgtgaagacatacttggacacttggnggacgaggaaacaataggcgaacggcccccgaaaataaaagccattgagaaaacctggagaaaaaatttgaacagatatacttgggccaagaattgtcaacaaacccgggccctttccttcttaacttggtggtttcggccccttgtggggtttttttgaaagttttttaatctttggctgggggtccaattcttttttttgggtgaaaaaaatggtttaaaaccataagtgggaaaacattgcccccaagtattattggaccagattttttggaccatggggaaagggaaccagcccagcccaggcccaaaatggggggcaagaaccagagaaattccaattaatggttttctttggctggaaccaaagggggttggggccatggtaattaaagttttcccctttgggcttttttcttggccccttctttacctggaaatccagtcccccaagaatttatttaaagaacttacctcgcgggggganngaaacaaancnncnnnncccaaacctttagggggggggccccccggcccccccaattttcccccttatttggggagtccgttataagagggggcttttttctttgt

SEQ ID NO: 7842 - DNA, 605 bp, Hordeum vulgare
  misc_feature (44)..(44): n is a, c, g, or t
  Predicted polypeptide sequence is orthologous to G839, G1196
tcggcacgaggcctaaatgagtacccctacaatgcagaacaagnagactgcgtgaacgccttgacgccttgacaaagacagttgagctagggcgaaagtacttcccgcattgttcggatgttctcgacaagttcctcatcgaagaatccaccgatttgcacttccttgaaagcggcactgccgaggaccagtgcacccggaggtcgcgcttctctgaactcaaagaggatgtgaggaaggccttcagcaaagacaaggctgttgcagccatagcctcatcgacgtcctcgtattcaccgaggggcgatgggaaggttaatagacatggtcacaagaaggcgaggctgtcgcggtgataaatatgctccatgtcgctgtatcggtaggttaacgccggattcgtggagcggaggcgcgtgatgggttccggatagaagaggtggggggggggagcaaaggttttgttgacagtttgtagtgtagtgaaaccatgtatgtagatgcaaccaaagcaagcatatcggttctagtttgatcgttgcttggtgcatttcttgtagttgctgtggttttgacatgtgacaggcttcagtagatgatcttca

SEQ ID NO: 7843 - DNA, 816 bp, Hordeum vulgare
  Predicted polypeptide sequence is orthologous to G843
ttttttttttttttttggttgcacatgaatccgcattatcataaaccttatggacaaatgtttacatacatggtacatcattctccctcccctaaacctacaacaaaggcactatcacatcatcatcatcacagtacactttcaacagcaatggcgtctatctcctctttaaaaatcaaacagcaatggcaacaactcacgctacacattcccgctgccgggtaattttacaatttggctcgaatgccttattgcacttccttcagaaatctgacacaaatctcaatgtaacactgctacagccaagtcatgtaagtatagcctcctttctcacctgggcctccgtcgtgctgagaaaccaagatttggttctgggccaagcctagagcaggcagagcccaaattgcatagctaaaccatcggagcctcctcgttgttacccagcttttttgtcaccatatcgtaaaccgtatcgactttggcagggtcaactttaaacaatacatgggcatcttccttcttgacgatgttgcccttgaacatctcctgcatcaacacctcctgcattctcagataatgactgggtagcaatctgttctgacagcacagaagtttttcgctgacgcttaatagctctgccccaggaagaccaacaatgtcccaatcatcccattgcttagcgcttgttggtcctgtgctttttggagaatccctaccaccagcatccaaaatggcactacctttcttaagatccaaactcccatcagtctcaactttcataggccggtttgttttgtgccctgatttactatttga

SEQ ID NO: 7844 - DNA, 828 bp, Hordeum vulgare
  misc_feature (828)..(828): n is a, c, g, or t
  Predicted polypeptide sequence is orthologous to G852, G2633
ggctcaactccatcacggccgcgccgtctcctccgctctacgcggaggcgactccgaacaataagaacaactacagcgcggccatgacggggtcgccgtcgaactcgtccacttctacggcttcttcctcggcttcctgctcaccgccaatctcggccaccacggggcgtcaactactctccgaagcagcggttgccatcgccgacggcaactttgaaacggcagccgctaatctggcgactctcaagcgcgccgctaacccgcgcggtgacgcggagcaccggctggtggccatgatggtggccgtcttgtcttcgcgcattgtgcccactgcctcggcatcgtcccagcacctcgctgacctctgcagcgccgagcaccataccgggtgccagctcctccacgacatcacgccctgcttccgcctcgccctcgacgccgctaacatcgccatcgttgaagccgtcgccggccaccgcgccgtacatctggtggacttcgacatcaacgccccgcagcacgcgattctcatccagcgcctcgccgaccggcgcgtgccggggacatccctgcaggtgaccgccgtaaccgatcccacctcaccctttacgcagtctctaacagcgacgctccccggcgtcggggagcggctcaagaagctggcggagcgcgcccgcatagagtacagcttcagaattgtcagctgcagagcagcagagattgaggcatccaagctgggggtgcgagcccggggaggcgctggccgttaacctcgcctttgcgctctagcacgtgcctgacgagagcgtctcggcggcaaaccccggn

SEQ ID NO: 7845 - DNA, 1610 bp, Hordeum vulgare
  misc_feature (5)..(7): n is a, c, g, or t
  misc_feature (23)..(23): n is a, c, g, or t
  misc_feature (639)..(639): n is a, c, g, or t
  misc_feature (859)..(862): n is a, c, g, or t
  misc_feature (864)..(864): n is a, c, g, or t
  misc_feature (866)..(866): n is a, c, g, or t
  misc_feature (869)..(870): n is a, c, g, or t
  misc_feature (961)..(961): n is a, c, g, or t
  misc_feature (1299)..(1299): n is a, c, g, or t
  misc_feature (1301)..(1301): n is a, c, g, or t
  Predicted polypeptide sequence is orthologous to G852, G2633
ggggnnnccgattaaattgaggngcattgtatataacggaactgagctggagctgcaccgcggaggctgccgctctagaactagtggatcccccgggctgcaggaattcggcaccagacgttgcccagggacgacagggagcgggtcaacatggagcagcactgcctggcgagggaggtggtgaacctgatcgcgtgcgagggcgcggagcgggtggagcgacacgaggtgttcggcaagtggaaggcgcgcctcaccatggccggcttcaggccctcgccgctcagctcgctggtcaacgccaccatcagcaagctgctgcagagctactccgacaactacaagctcgccgagagggacggggcgctctacctcggctggaagaagaggcccctcgtggtctcgtccgcctggcactagcgctgcggtcgtcatatcatggccaactgctttgtgaccatgcttttcgtaggcgaatctagatgcatgcttaatgctttgctggactataggggtgtcctgctgatgctgttgctgctgctgctgctgtggagaagaatagctcctgtaacctgttgttgtaatgccgaacttaggtctaaaagcctgaatatggctgatgagatgtagtgtaagttnttaccgtatatgtttcagttttatgttttagtttcagacttctaatcgtaatcttgttgtctaatcaaaaaaaaaaaaaaaaaaaatctggggggggggcccggtaccccaatcgccctttatggggatcgtatttacggccgcttatggccgtttttttaaaaagttgggattgggaaaaaccctggggttacccaaatttaaatccctttggggagannnngngncgnngggtttcccaccacgcagacgggtaaaaaacatgggcggtcacccaataatctatgtgttctctgagatgcaaccgatacgtcaaagcacngatttaataactgatatttcacgtcattcattaataccctcgtgtacagcagtataatgaaactaacgatgtagcgtttgagagtttagtctgctggtacactatcatgtactagtaagttgcgtaagcgcaggggagctggtagcactcatatcgacgttctgcaccattgcgagtgtatatttctcagaatctcactacaagaacccgtttgtgtcatgtattgttcttagtatcgtagaagatatcgatcgagataatgtgattattcatacttatcgtgtagtctacgtgtgtaattttacagatgcatgatgctaaatagcgggtatggcgcncnttccattccttctcttgttctaccgtcggtctcctttggtgacatacatatagtggttgttcactttcggtattgacgttatcttataggaccgtgccatgttcactccaattgcatatcgatcaacgctcaatatgcagatgcaatgttagtctcacatcacatatcgtaccatgctcgacgaaatgagctaactgttcgcttccactatagtcagtcacacttcgttacgttgtatacgtacttatctgcatcatatatgcacgtagaacgcgtgatgggtgtaagcactatgattgttgttacagt

SEQ ID NO: 7846 - DNA, 700 bp, Hordeum vulgare
  Predicted polypeptide sequence is orthologous to G852, G2633
ctttttttgtggccaaactgtgcatatattactgcatgttctagttcccaaacagacacaacattatgttctagcaacataaatagatttatacatggagcagagtcgacatgtcatgattctatcccagaatacaacaacacattcgtgtgaccagttgctacagcagaacaacatggttcacccgggcgatcagccaaactcaattattctgacaagcagactcctaaaattagatagatcagccaagaactcctctgcggttcacaccctttttacaatctctgcaccagaagctcctaaaatacagcagtgctaatgcaacccaagtcagcgagctcgatctattgccacgcagaggcgacgatgagcgttttctctccccagccgaagtgaagtcccccatggtcctcctcaaacttgtacctgtcgcagtacgagctcaatagcgatcttattcctccgatgacgttgctgctaaatgggcatggcgcgaatccagccatcgtcattctcgccctccatttcccagcaacttcatacctctccacgcgatcagggccttcacaagccaagatgttcacaatttctcgtgcaaggcattgtctttccacattcattctatctggactttcccttggaagtgttgcgtccagtgaatcgaaaagggcggagtagtagtcatagacctcacggaacc

SEQ ID NO: 7847 - DNA, 674 bp, Hordeum vulgare
  Predicted polypeptide sequence is orthologous to G852, G2633
catccaacataatcaccacgaataccacacgggaaccgcaggaaaactgtaattatcatacaacttctacaatctaactgtcaatgctcaattcctggtctacatttaggcaacaaatgaggggtgtacagcatcatgtacaggtggtacatcaaaggagaccagggacttggctctataacctctgttttcttttcttcttccaatgagcatataaccgtcagtgccacgcagaggcggatatcaacttcctgctcttccagcccaggagcatcgccccatccttctcctccagcgtgtacttgtccgagtaacatgcaagaagcttcttgatcaccgagttcacatacgagctcagcgggtaaggcttgaagccagccatgctcagcctcgatttccacttgccaaggagctcatgcctctccagcggccgctggagcagacgactcataccaccattgttgtgaaggatagagaccaccaccaagtggttgctagtgcgtacgctcggtctgccgtgccgaggttccacgaagattactacggtcctggcgggcatgaacctaatcaccactaattaagccgctccctgaatatccaccgtactcatccctttgcagggcataattaccttcgtatggtagcaatcttcatcacctgtcctaatgctgctg

SEQ ID NO: 7848 - DNA, 700 bp, Hordeum vulgare
  Predicted polypeptide sequence is orthologous to G852, G2633
cgcaaaactgtagtattgtttcagggcagcaagcagcagaaggagattacaataaaccatcacgtcatcattacacaaaccaacgacatgcaacaggcgcctcttgtgcctgcatagcttttaatcgatctctaaacatcctccaattagcacagtagtactgtatgctacaagcatgtcaatcctagtccaacgggagcaaaccacaacacaccgaattcctagctataaacatatttatttatttatttaatcactacgccttcttctacgtcaccgcggtcgcggttttatcacagcaactcctggtgctgattccactgaattagatggccagtgagcatgggttccatctggggaaactgaaccgacaagcagcaaagccattgtaatctcaggttccgtctggagaaaccgaaccgacaagcagcaaagcccttatgagctcaggttccatatgagcttcttctcaggacttctcagcaccaagcagaagacacgaccaacactctgctcttccaaccaaggaaaaggactccgtccctctcctcaagcctgtagcaactgtggtagctattcagcagtgttttgatggtgttgttcaccactgaactcagcgggtacggcctaaatccagccattgcaaaccttgtcttccatttcccaaacacctcatgcctctctaccctttccgcaccct

SEQ ID NO: 7849 - DNA, 832 bp, Hordeum vulgare
  Predicted polypeptide sequence is orthologous to G861, G1140
gaccgcgaccgcaaccctcccgccgcatcggcgagtgagccgcgctcggtgctcccagccagcctgcctgcctgcctgcccgggcgacgcgcgctacctcggcgtgggtggtggcggggggagagagcgcgcgggggcggggagatcgatcggtcggtgaccgggacctaggaggagggaggaccggaggagacgcgatggcgcgggagcggagggagataaagcggatagagagcgcggcggcgcggcatgtcaccttctccaagcgccgccggggcctcttcaagaaggccgaagagctctccgtcctctgcgacgccgacgtcgcgctcatcgtcttctcctacaccggcaagctcttccaggtcgccagctccaggatgaatgagatcatcgacaagtacagcacgcattctaagaacctggggaaaacagaccagcctactcttgccttgaacttaaaacatagcaaatttgccaatttgaacgatcagcttgcagaagctagtcttcgacttagatgagaggcgaggagcttgagggataaagtgttgatgaacttccacagttggagaaaaaatctaaaacttgtctggacaaagggccttaaaacaaagaatcaacaattcttggaaccaattaaatgacctacacccaaagagtttacagtttggaggaggaatatttgaaacttgggaacccggttggcccaggttcctaaggtggggagggtttggggggtgtgttaccaaagatggtttttgtttaaatagggaaagatgttggtgtatggtggtgaatgattttgcagtggtgtgagcgcgaaggaagg

SEQ ID NO: 7850 - DNA, 1086 bp, Hordeum vulgare
  Predicted polypeptide sequence is orthologous to G861, G1140
ccaccccccgaccgacgccgcccgccgcagatctattgcaacacctcagccactgtggggagaggagaggaggggaggggaggagaggatggcggggaagagggagaggattgcgatacggaggatcgagaatctggcggccaggcaggtcaccttctccaagcgccggaggggcctcttcaagaaggccgaggagctctccatcctctgcgacgccgaggtcggcctcgccgtcttctccgccaccggcaagctcttccagttcgccagctccagcatgaaccagatcattgatcggtataactctcattccaagatacttaagaaagtagacgagccatctcagctggatttgcatgaggacagtaattgtgcaagactaagggacgagcttgcagaagcaagcctctggctccagcagatgagaggggaggaactccagagcctgaacgtccagcagcttcaggctctagagaagagcctcgagtccgggctcagctccgttctgaaaaccaagagccagaagatcatggaccagatcagcgagctagaaaaaaagagggtgcaactgatagaggagaacgcaaggctaaaggagcaactgcaggcgtccaagatggagatgcaggtcgccgctgatccactggtggtggtgtacgatgaagggcagtcatctgagtctgtcaccaacacgtcgtatccacgccctcccctcgacaccgaggacagctccgacacatctctcaggctcggattatcactcttcaactcgaagtgattggctggaaattacccgaagcgaagtgacgcttggtcacgaccaactcctgaatcgaaccacgcgctgcattgaataaacagtttgagcgcactggatgatgtgtgtaatctaaaagaagactggcttctgttatactccctccgtctcaaaataactgtctcaactttgtattagctctagtacaaagttgtactaagcttaagacacttattttaggaccgagggaatatatagcatagtgtggtacaataagagaacaggttcttgtgatattacctgctactgttttttccaaaaaaaaaacg

SEQ ID NO: 7851 - DNA, 785 bp, Hordeum vulgare
  Predicted polypeptide sequence is orthologous to G866, G883
gcgcgggatggagcacctcatcttgcagctctcccggacaggcaccagcgaaagctcgccggttgggtcctcggaggcgccggagcaggggaagcagcaggtagactgccgggagatcactgatatgaccgtgtcgaagttcaagaaggtgatttctatcctcaaccaccgcaccggtcacgccaggttccggcgcgggcctgtggtggcgcagtcccagggccccgccgtgtccgagccggcgccggtgagggcgtcttcgtctaggtccatgacgttggactgtaccaaggcgtgttacgggtacggtagctaccccgggttcagcggttctaccgagagctgattcttcgtgtggggtgtaacctgtgacggggagcgtgttagactggcgctgaggcagttgctgggttatgcagcctccggcgccttgtggcatggtggagtagatggcgatggaatatggaggttgtaaatagatagcgtttatggggagcaaggttgacgagtgttgggtataggggtggggagaaaagctgtgtacttgttgtgtgtgatattgtagtgggggggggggttggaggggtgattagggtgggggggcagtgagtgtggaggtaagctagatgagtttgaggccaagtagaagggcacaggtgtttgaaacgggtaggttggtgagggaggttgtgagaagagaagattggtgtaagttaagtgtgttgatggcaccatggatcattatagtggtaggtgaccagagggagtagttgagataaggaggc

SEQ ID NO: 7852 - DNA, 889 bp, Hordeum vulgare
  misc_feature (622)..(622): n is a, c, g, or t
  misc_feature (685)..(685): n is a, c, g, or t
  misc_feature (712)..(712): n is a, c, g, or t
  misc_feature (775)..(775): n is a, c, g, or t
  misc_feature (824)..(824): n is a, c, g, or t
  Predicted polypeptide sequence is orthologous to G866, G883
cagcagagccgcaggcgacctcacaccggcgaccatggccgtggacctcatgggctgctacaccccgcgacgcgccgacgaccagctcgccatccaggaggccgccaccgccggcctccgcagcctggagctcctggtctcctccctctccggcgcggcgccgtccaaggcgcagcaacaccagcaccagcagccgttcggcgagatcgccgaccaggccgtctccaagttccgcaaggtgatctccatcctcgaccgcaccggccacgcccgcttccgccgcggccccgtccagtcaccgccgccgccgcctcctccagctccggtcgctcctccgcctcccccaccgcgccctctcgccatcgagccggccaggccggcccctttgaccgtcgtggcgccggtgtcggtggccgccccggtccttcagccgcagagcctgacgctggacttcaccaagccgaacctgaccatgtcgggcgcgacgtccgtgacgtccacgtccttcttctcgtcggtgaccgccggcgaggggagcgtgtccaagggccgcagcctggtgtccgccggcaagccgccgctgtccgggcacaagaggaagccctgcgccggcgcgcactcngaggccaacaccacgggcagccgatgccactggctccagagaaggaagaaccgcgtgaagacnacggtgagagtgccggcggtgagcgcnaagtatcgttgactcccggccgacgagtactcgtggaagaaggccgggcagaagcccatcaanggatccccttacccacggggctacttacagggcaacaccgtacaatgtntgccggggaggaagcacgtgggagcccgccttggacaacccggcgatcctggtggggacccacag

SEQ ID NO: 7853 - DNA, 862 bp, Hordeum vulgare
  misc_feature (808)..(808): n is a, c, g, or t
  Predicted polypeptide sequence is orthologous to G896
agtgcatgaggtacatcctcaccgagcgcttcggcttcgccaacgactgcgtcctcatcctcaccgatgaggagagggacccgtgcaggcagcctaccaaggccaacatccgcatggccatgcattggctggtgcaggggtgtagctccggcgactccctggtgttccagttctccggcgccggcgcgcaggtccccgactgcgacggcgacgagcgggacggcatggacgaggccatctgccccgtcgactcgttccagcagggccccatcctggacgacgagatcaaccagtccatcgtccgcccgctcgttcacggcgtcaagctccacgccatcgtcgacgcctgccacaatgccaccgtccttgatctcccataccagagcaccttctccaatcagtacgggtgcctgaagtggatggactagcgccctttaaatggacctgcaagagcaccaacggagggcgtgccttgcttattagcggcagagttacgggaataatctatgaacgttctgctttagccaactcaacatatgagaactaaacaaaatttaaaaaagaagtgaataaaaaacaaaaacaaataggtaggtttgtttatttttttaaacaactataaaactttgatagaagataaaacaaaaggaccatattagttttaataaaaatgaaataaatttatggataaaagatattataataaaaatataaaaaaataataaaaataaaaaaaaaaaaaaaaaaaaaaaaaataaaaaaaatattttattttattaattaaattttattatttttattttttttntattatttttataaatattttataattaaatttatatttatttttttttattat

SEQ ID NO: 7854 - DNA, 567 bp, Hordeum vulgare
  Predicted polypeptide sequence is orthologous to G896
gctcgagcggccgctgggtacacacagaccacgatctggtgtctggaaaggaactagtggcggggaagctatttcatttagcggctgtgatgataatcagacatcagcagatacttcagccttgtcaaagatcacttcgactggggcaatgacattttgcttcattcaagctattgaacaaggccaggccgcaacatatgggagtatcctgaactccatgcgtccgacaatacggaacacgggaagtggtgcctcaatggctggaggcggtgcggttacatcactcatttcaatgcttctcacagggggaagcgctagtactggtggattgagacaggagccacagctaactgcatgtgatacatttgatgtgtatgcgaaaccattttcgctatgatacatttgtggtattctccactgtgttctgtgattctaccatgagtcgaggtttaaactatcatgtacagttaacagttgaaatggctcctccatatgtagagctaactttgtatcatgtgatgctcatattcgaattaaagtgtttgccccctttgaattgttctttgt

SEQ ID NO: 7855 - DNA, 873 bp, Hordeum vulgare
  Predicted polypeptide sequence is orthologous to G898
cagttcgtcggttggtggcgtgcgcctcaaaccctcgctcgccacgctcgggttggttctggagctgaagggaggtaaggtgagtataagcatcggaggtacatagcatgagtaataccagcggcgcacggcgtgccgcgcggaggcagctgcaagatgggtctgctgataaagttgttgtggacttggatgcaagctcgccggtggcggggaaccctcatgggttgtcggtcttccctggtgcacgcacatcgcctattgatgtggaagctcttgatgatgaggtgcaggcgctatctccttcacaagtacctcccccgggggtgaaccggagaactagagggcaacccgtgacaccattttctctggatgaagatgctatcctggaagagaattggagaattataaggcaatgtacgacgccattttatttcgatgaagatgctgccttggaagctatgccttctcacaacacgtggaacaaacgccaaagggttgcccctttgatatgtctctccccagaaaggggagaagggtccagcctgcagtcgaataatgcggtgacaattagtcaagagcctgcttaggtggtggttccaaaggaaccaaatttcacttgcccggtgtgccttaataagctagtggagccttcaacaacaaaatgtgccatatctttttgcaccgagtgcattaagcaagcccttccagttcaagaagaaagccctacctggcgcaaggccctgaggaagaacaactctccatcgatttaactctcccaacctcgatgggtaaagtccaacaccggatcattccggttgaagagggccctccccataaatattggtcgtgatgaacccggtgccagtgcttaaa

SEQ ID NO: 7856 - DNA, 942 bp, Hordeum vulgare
  misc_feature (783)..(783): n is a, c, g, or t
  misc_feature (827)..(827): n is a, c, g, or t
  misc_feature (838)..(838): n is a, c, g, or t
  misc_feature (859)..(859): n is a, c, g, or t
  misc_feature (910)..(910): n is a, c, g, or t
  misc_feature (914)..(914): n is a, c, g, or t
  misc_feature (942)..(942): n is a, c, g, or t
  Predicted polypeptide sequence is orthologous to G898
atgagtactcctaacggcacacggcgtgcctcacgaaggcaatcacaagatgccgataaggttgtcgtgaacctggtcacaagccccccagcggcgggcagccgacgtggagtatcagcctctaacgctggcgcgcgcacctcacccatcgatgtggaagcgctcgaggatgaagtgcaggtcgtgtcagcttcgcaagtgcctcagaggacgaaccggagaactaggaggcagcctgtgacagtagttgatctagaggcacatgttacccgggaaggagttactcatgatgataatgcaacagtgctttctcataacacaaggaacaaacggcaaagagttgcacctgtagtaaacatctctccagaaacaggagaaggatccagcttacagtcaaaaagtgcggggaaaactagcaaagagcctgtgaaggtgactccaaaggaacccatcttcacctgcccggtgtgttggaacaagctggacgagcccgccacaacaatgtgcggccacatcttctgcacaaactgcatcaagcaagccattcagttccagaagaaatgccctacctgccggaagcacctgaagatgaacaacttccaccgcatttaccttcctaacaccgctcgttaaggagtcctcccagggagaaccatggtggatcttctgctgaggagcattgttgtaccatcatcacctagatgaatgtatggaaatgggtcggtaggaattcagcgtcctgatgaccggagtggataaccttctgcctgaaaatgggttaancctgacaaacagagtgctgccctgaaaatgggttaacaaatttngcatgtaaccnttccattatatattttttggnggcaacataaaaatgttgatgttattaggctattagccttgcacggttgcncccnttctccatagttgctccgatgtaactgn

SEQ ID NO: 7857 - DNA, 1015 bp, Hordeum vulgare
  Predicted polypeptide sequence is orthologous to G912, G2107, G2513
gcacactcctcagtcctcagtaagctcaagcaccatgctcagactgttcaagaaggaagccgcctgccaatcacccagcactctgccggtagccatggacatgggccttgaggtctcgagctcctccccctcctcctcgtcggtgtcgtcctcgcccgagcacgcggcgaggcgggcgtcgccggcgaagcgccccgctgggcgcaccaagttccgggagacgcggcacccggtgtaccgcggcgtgcggcgccggggcaacaccgaacggtgggtctgcgaggtgcgcgtccccggcaagcgcggtgctcggctctggctcgggacgtacgccacggctgaggtcgccgcgcgcgcgaacgacgctgccatgctcgccctgggcggccgctccgccacgtgcctcaacttcgccgattccgcgtggctgctcgccgtgccgtccgccctgtccgatctcgcagacgtccggcgcgcggctgtcgaggccgtcgcggatttccagcgacgggaggctgccgatggctccctcgccatcgctgtccctaaggaggcctcctctggcgctccttcactatctccgtcgtctgggtccgacagtgccggttcgacggggacgtcggaaccttccgccaatggagtgttcgaggggcccgttgtaatggacagtgaaatgttcaggcttgacttgttcccggaaatggacctgggctcgtactacatgagcctcgcggaggcgctgctcatggacccgccgcctacagcgaccatcatccacgcgtacgaagacaacggcgacgggggagctgatgtccggctctggagctatagtgtcgatatgtgatttcccagatgattctgctctgttttgactgtgtactgactgctgagtagtttttttgtttccttaggaaagttttcctcttttagagtgaagatgttgtagctaataaactgaagctgcttccaatccagcactgaatgaaacagttttagtcgctgcaattcttatgcc

SEQ ID NO: 7858 - DNA, 915 bp, Hordeum vulgare
  Predicted polypeptide sequence is orthologous to G912, G2107, G2513
gtcctccggcgcttctccacacacagcaacttactcaaccacgcactccagtcaagcgtctccactaacactagctagctctagaaatggacgtcgccgacatcgcctccccgtccggccagcagaagcagcaggggcacaggacggtgtcgtcggagccgccgaagcggcccgcggggcggaccaagttccacgagacgcgccacccgctgtaccgcggcgtgcggcgccggggccgggtcgggcagtgggtgtgcgaggtgcgcgtgcccgggatcaagggctccaggctctggctcgggaccttcaccaaccccgagatggccgcgcgtgcccacgacgccgcggtgctcgcgctctccggccgcgccgcctgcctcaacttcgccgactccgcgtggcggatgcggccagtgctcgcgaccaccgggtcgtttggcttcagcagcacgcgggagatcaagcttgccgtcgccgtagccgtcgtcgcgttccagcagcagcagattattcttccagtagcgtgtccatcgccggaggcgcccgccagcccgagcgccgctctgttttacatctcgtccggcgacctgttggagctcgacgaggagcagtggtttggcggcatggacgccgggtcgtactacgcgagcttggcgcaggggatgctcgtggcgccgccggacgaaagagcgaggccagagaaccgcgagcacagcggcgtcgagacaccaataccactatggagctatttgttcgactgctaatttagcacgcagtgtaaagttgtttacatagttgtgttgtgttcctctttttttttttttttagaaaaggaggatctcatccgattcaattgtgctaagttaaactttgagtttgtgttatgctcaaaaatgctacacctacaaacacttc

SEQ ID NO: 7859 - DNA, 1010 bp, Hordeum vulgare
  Predicted polypeptide sequence is orthologous to G912, G2107, G2513
aaaccacctgcttccactccctccccctgcttacactccagcagccagcatagccaggcagccatggacgttggtgccctcagcagcgactactcgtcggggacgccgtccccggtgggcgcggacggcggcaacagtgagggcttctcgacgtacatgacggtgtcttcggctccgccgaagcggcgcgcggggcggaccaagttcaaggagacgcggcacccggtctacaagggcgtgcgccggaggaaccccgggaggtgggtctgcgaggtgcgggagccgcacagcaagcagaggatatggctcggcacgttcgagaccgcagagatggcggcgcgcgcgcacgacgtggccgcgctggcgctgcgcggccgcgccgcctgcctcaacttcgccgactctcctcgtcggctccgggtcccggccgtgggtgccagccctgatgagatacggcgggcggcggtagaggcggctgaggcattcctgccggcacccgaccagagcaatgcgcccgccgaggaggtagccgctgcaccaacgatgcagttcgccggtgatccgtactacgggatggacgatggtatggacttcgggatgcagggctacctcgacatggcgcaggggatgctcattgcccctcctccgttggtaggtccgtcagcgactgccggagacggcgacgatgacggtgaggtcagcttgtggagctactgattacgcgcatttgagttatgccatgtgtggtgcgacgaactactaatgcatgtgcagctttatatagtaatcgagtagaggaagtgtactgcatggttgccctttccttttctccactttgttctaaacttctctgggtaatgtacgtttgctctctgatgaactgcgatcagaagaagcagagggcctgatcttgagtgtagtgttcgagctccgaaggagtgttggggctagctatatgtatctcccttgtttattatgcatgagcggagtgtcttcgtcggtgtttggtt

SEQ ID NO: 7860 - DNA, 817 bp, Hordeum vulgare
  Predicted polypeptide sequence is orthologous to G912, G2107, G2513
ccacaacgcactctcgacgctagctgcgagccatggacacagttgccgcctggccgcaatttgaggggcaagactacatgacggtgtggccggaggagcaggagtaccggacggtttggtcggagccgccgaagcggcgggccggccggatcaagttgcaggagacgcgccacccggtgtaccgcggcgtgcgacgccgtggcaaggtcgggcagtgggtatgcgagctgcgcgtccccgtaagccggggttactccaggctctggctcggcaccttcgccaaccccgagatggcggcgcgcgcgcacgactccgccgcgctcgccctctccggccatgatgcgtgcctcaacttcgccgactccgcctggcggatgatgcccgtccacgcgactgggtcgttcaggctcgcccccgcgcaagagatcaaggacgccgtcgccgtcgccctcgaggtgttccaggggcagcacccagccgatgcgtgcacggccgaggggagcacgacccccatcacctcaagcgacctatcggggctggacgacgagcactggatcggcggcatggacgccgggtcctactacgcgagcttggcgcaggggatgctcatggagccgccggctgccggagggtggcgggaggacgacggcgaacacgacgacggcttcagcacgtccacgtcgctgtggagctactagttcgactgatcaagcagtgtaaattagtattagagttgtagtatcagtagctagtactactagctgtgttcttccaccaggcgtcaggcctggcaagcaatctcaaaccatgaatatgc

SEQ ID NO: 7861 - DNA, 599 bp, Hordeum vulgare
  misc_feature (12)..(12): n is a, c, g, or t
  Predicted polypeptide sequence is orthologous to G912, G2107, G2513
cggcacgagggngtaccttcgacaccgccgaggccgccgcgcgcgcgaacgacgccgccatgctcgcgctcgccgccgggggcgcgggctgcctcaacttcgccgactccgccgagctactcgccgtgccggctgcctcctcgtaccgcagcctcgacgaggtccgccacgccgtcgtggaggccgtcgaggacttgctgcggcgcgaggcgcacgcagaggacgacgcgctctcggtctcgggcacctcctcgtccgcgccctcctccatcaccgacgacgactcgtcctcttccccggcggacgagggctcgccgttcgagctggacgtcctgagcgacatgggctgggacctttactacgcgagcctggcgcaggggatgctcatggcgccgcctgcttccttggccgcggtgctcggcgattacggcgaggctcacctcgccgacgtgccactctggagctaccagagctagcaagctagttcgcgccacttccagtttttaccttccctttctgccgtcgtcttggcttccgattgatgccaaaattttgatgctgctgtacagtttctggtaatgtggtggtgcaaattgggg

SEQ ID NO: 7862 - DNA, 334 bp, Hordeum vulgare
  Predicted polypeptide sequence is orthologous to G912, G2107, G2513
gcaaaaagtaacggaaaaacaatctccaacggactgatggagtgggcgtgctgcggcagcggctactcgtcgtcgggaacgcagtccccggcggccggcgacggggaggagggctcgtacatgacggtgtcgtcggcgccgcccaagcggcgggccgggaggaccaaggtcagggagacgaggcacccggtgtacaagggggtgcgcagcaggaaccccgggcggtgggtctgcgaggtgcgcgagccgcaagggaagcagaggctatggctcggcaccttcgacaccgccgagatggcggcgcgcgcgcacgacgtcgccgccatggcgctcc

SEQ ID NO: 7863 - DNA, 1041 bp, Hordeum vulgare
  Predicted polypeptide sequence is orthologous to G912, G2107, G2513
caagctcgagcatctcgcacctagctcacagcagcaggcttgactgatccgcaaggaagcaccgagcactctgccggttgccatggacatgggcgaggtctcgagctctcccccctcctcttccaacgagaacgcgtcgggacggtcgtcgacggccaagcgcccggcggggcgcactaagttccgcgagacaaggcacccggtgtaccgcggcgtgcggcgccggggcaacgccgaacggtgggtatgcgaggtgcgcgtccccggcaagcgcggcgctcggctctggctcgggacttacgccacggccgagatcgcagcgcgcgcgaacgatgccgcaatgctcgccctgggcgtccgctccgccgcgcggctcaacttcccggactccgcgtggctgctcgccgtgccgtccgcgcactccgatctcgccgacgtccggcgcgcggcggtcgaggccgtcgcggacttgcagcgacgggaggccgccggtgggtccatcaccgccacagtcggggaggaggcctcccgtggcgctcctgcagaatcgtcgtctgagtctgaggatgccggttcgtcggagacgtcgaaaccttccgccggtggagacttggcggtaccggtcggaatggacgtcgaaatgttcaggcttgacttcttcccggaaatggagtttggctcgtactacgcgagcctcgcggaggcgctgctcatggacccgccgccggtggcgaacagcacgggcgcgtactgggataacggagagttcggcgaggtggcaactgagttcgcactctggagctagttgccgccgattctccttcgttttgattctgcagcctttttttttttcttcgcaaagttttcctatttcgggagaagactctgtagattgtactactctactactccctctgttctaaaatataagaccttttagagatttcagtagaaaactacatacgtagtaaaatgagtaaatctatattttaagataaaaaaaaaaaaaaaaaaaaaaaaaaaaaaaaaaaaaaaaaaaaa

SEQ ID NO: 7864 - DNA, 1111 bp, Hordeum vulgare
  Predicted polypeptide sequence is orthologous to G912, G2107, G2513
ttccagtacaaaaactactccacacctctcacgagcatgtcgaatccgattcagacggacgtcgccggcatcgcctccccgtccggccagcaggagcagcaggggcaccggacggtgtcgtcggagccgccgaagcggcccgcggggcgcaccaagttccacgagacgcgccaccctctgtaccgcggcgtgcgccgccgcggccgcgtcgggcagtgggtgtgcgaggtgcgcgtgcccgggatcaagggctccaggctctggctcggcaccttcaacacggccgagatggccgcccgcgcgcacgacgccgccgcgctcgcgctctccggccgcgccgcctgcctcaacttcgccgactccgcctggcggatgctgcccgtgctcgcggccgggtcgttcggcttcggcagcgcgcgggaggtcaaggccgccgtcgccgtcgccgtcgtggcgttccagcggaggcagattattccagtcgccgtcgccgtcgtggcgctccagaagcagcaggttccggtcgctgtcgccgtcgtgacgctccagcagaagcagcagcaggtcccggtcgccgtcgccgtctcggcgctccagcagcagcaggtcccggtcgccgtcgccgtcgtggcgctccagcagctgcaggttccggtcgccgtcgccgtcgtggcgctccaggagcagcagattattctaccagtcgcgtgcctggcgccggagttctacatgtcttcaggcgacctgctggagctcgacgaggagcagtggttcggcggaatggacgccgggtcgtactacgcgagcttggcgcaggggatgctcgtggcgccgccggacgaaagagcgaggccggagcacggcgagcagaccggcgtccagacgccgctatggagctgcttgttcaactaatttagcactactgtcaacatgtagatagttgcgttcttccagatttgggaggaaagagagtaggcagttggtactacttttggggaaaaggggctagattgcttaattcaacaattggtactgaactcgattgtgtatcgtgcactccatgaatcgaaatcaaggatttttgggagaagaaaaaaaaaaaaaaaaaaaa

SEQ ID NO: 7865 - DNA, 1036 bp, Hordeum vulgare
  Predicted polypeptide sequence is orthologous to G912, G2107, G2513
ctcgactcgagcaaccataacaaggacctcaagccggccaaagaagaaagaagagagccatccagagcagagcaagactactctctcttgttggactttgatcggagcaaagaagatgtgtcagatcaagaaggagatgagcggcgagtcgggctctccctgcagcggggagaactactactactcgccctcgacgtcgccggagcatcagcaggcgaagcagcaggcggcgtggacgtcggcgccggcgaagcggccggcggggcggaccaagttcagggagacgcgccacccggtgtaccgcggcgtgcggcgcaggggcaatgccgggcggtgggtgtgcgaggtgcgcgtgcccggcaggcgcgggagcaggctctggctcggtaccttcgacaccgccgaggccgccgcgcgcgcgaacgacgccgccatgctcgcgctcgccgccgggggcgcgggctgcctcaacttcgccgactccgccgagctactcgccgtgccggctgcctcctcgtaccgcagcctcgacgaggtccgccacgccgtcgtggaggccgtcgaggacttgctgcggcgcgaggcgcacgcggaggacgacgcgctctcggtctcttgcacctcctcgtccgcgccctcctccctcaccgacgacgagtcgtcctcttccccggcggccgagggctcgccgttcgagctggacgtcctgagcgacatgggatgggacctttactacgcgagcctggcgcaggggatgctcatggcgccgcctgcttccttggccgcggcgctcgccgattacggcgaggctcacctcgccgacgtgccactctggagctaccagagctagcgagctagttcgcgccacttccagtttttaccttccctttctgccgtcgtcttggcttccgattgatgccaaaattttggtgctgctgtacggtcattacttacagttcctggtaatgtgatggtgtaaattggggaaaaaaaaaaaaaaaaaaaaaaaaaaaaaaaaaaaaaaaaaaaaaaaaaa

SEQ ID NO: 7866 - DNA, 1285 bp, Hordeum vulgare
  Predicted polypeptide sequence is orthologous to G912, G2107, G2513
cgaccatacaacctcgatcacaaaaccaatgctagccagctgcagataagcgaatccatcgaccaaccgataccatacaagatggaccactgcggcgtgggcctctatggcgagtacgcgacggtgacgtcggcgccgcccaagcggccggcggggcggaccaagttcagggagacgcggcacccggtgtaccggggcgtgcggcggcgcggcgccgcggggcggtgggtctgcgaggtgcgcgagcccaacaagaagtcccgcatctggctcggcacctttgccacgcccgaggccgccgcgcgcgcccacgacgtcgccgcgctcgcgctccggggccgcgccgcctgcctcaacttcgccgactccgcggccctgctccgcgtcgacccggccacgctccgcactcccgaggacatccgagcagccgccatggcgctcgcccaggccgcctgcccccacgacgccgcgtcctcctctgcccccgccctgaaggcggcctctgcgccggcgccagcgatggtgatggtgcaggaggccgcggcggcgccgtacgacagctatgccacggccctgtacggcgacttgacggacctggacatgcattcctactactgctacgacgggatgagcggcggcggcgactggcagagcatctcgcgtatggacggagccgacgaagacggcatctacggcgcaggagacgtcgcgctctggagctactgattgtctgagattgatcggccggtttgttcagctaccgggtcctgctcaagtgctgctgcgcaacgtcgtcatacgatgaagaagatgaaacagagttcctggggaagaaagatccatgccagccgcaggacatgtcacagcaccaccggcaggccggcgccgcctcctccgcgtgcccatgcaatctgtcgatcggcagggcgtacttcttctgggaggtcacgtggtcagaacggactgagatttgagcgaagtgttgtctgaacgcacgacatacttgcatcagcgagtttcaagcacgcctactctgcttcccctgttcttcaaaagtggcgctaaaactgcacaatcccacatgagctagttttcgtagggtatagtgctagcaaaaatatgcacacccagtttgctgagtgattatacaaccagaagacctcactccaatttatttttcccttctatgtaaatactccctctgttcataaatatacgccattttagagatttacatataaactacatataaatgtatataaaaaaaaaaaaaaaaaaaaaaaaa

SEQ ID NO: 7867 - DNA, 892 bp, Hordeum vulgare
  Predicted polypeptide sequence is orthologous to G912, G2107, G2513
ctaagtcctccggcgcttctccacacacagcaacttactcaaccacgcactccagtcaagcgtctccactaacactagctagctctagaaatggacgtcgccgacatcgcctccccgtccggccagcagaagcagcaggggcacaggacggtgtcgtcggagccgccgaagcggcccgcggggcggaccaagttccacgagacgcgccacccgctgtaccgcggcgtgcggcgccggggccgggtcgggcagtgggtgtgcgaggtgcgcgtgcccgggatcaagggctccaggctctggctcgggaccttcaccaaccccgagatggccgcgcgcgcccacgacgccgcggtgctcgcgctctccggccgcgccgcctgcctcaacttcgccgactccgcgtggcggatgcggccagtgctcgcgaccaccgggtcgtttggcttcagcagcacgcgggagatcaagcttgccgtcgccgtagccgtcgtcgcgttccagcagcagcagattattcttccagtagcgtgtccatcgccggaggcgcccgccagcccgagcgccgctctgttttacatctcgtccggcgacctgttggagctcgacgaggagcagtggtttggaggcatggacgccgggtcgtactacgcgagcttggcgcaggggatgctcgtggcgccgccggacgaaagagcgaggccagagaaccgcgagcacagcggcgtcgagacaccaataccactatggagctatttgttcgactgctaatttagcacgcagtgtaaagttgtttacatagttgtgttgtgttcctctttttttttttttagaaaaggaggatctcatccgattcaattgtgctaagttaaactttgaaaaaaaaaaaaaaaaa

SEQ ID NO: 7868 - DNA, 967 bp, Hordeum vulgare
  Predicted polypeptide sequence is orthologous to G912, G2107, G2513
ctccacacacagcaacttactcaaccacgcactccagtcaagcgtctccactaacactagctagctctagaaatggacgtcgccgacatcgcctccccgtccggccagcagaagcagcaggggcacaggacggtgtcgtcggagccgccgaagcggcccgcggggcggaccaagttccacgagacgcgccacccgctgtaccgcggcgtgcggcgccggggccgggtcgggcagtgggtgtgcgaggtgcgcgtgcccgggatcaagggctccaggctctggctcgggaccttcaccaaccccgagatggccgcgcgcgcccacgacgccgcggtgctcgcgctctccggccgcgccgcctgcctcaacttcgccgactccgcgtggcggatgcggccagtgctcgcgaccaccgggtcgttcggcttcagcagcacgcgggagatcaagcttgccgtcgccgtagccgtcgtcgcgttccagcagcagcagattattcttccagtagcgtgtccatcgccggaggcgcccgccagcccgagcgccgctctgttttacatctcgtccggcgacctgttggagctcgacgaggagcagtggtttggaggcatggacgccgggtcgtactacgcgagcttggcgcaggggatgctcgtggcgccgccggacgaaagagcgaggccagagaaccgcgagcacagcggcgtcgagacaccaataccactatggagctatttgttcgactgctaatttagcacgcagtgtaaagttgtttacatagttgtgttgtgttcctctttttttttttttttagaaaaggaggatctcatccgattcaattgtgctaagttaaactttgagtttgtgttatgcttaaaaatgctacacctacaaacacttctacgtaagcttacttaaaacagttatttccttccctaaaaaaaaaaaaaaaaaaaaaaaaaaaaaa

SEQ ID NO: 7869 - DNA, 888 bp, Hordeum vulgare
  Predicted polypeptide sequence is orthologous to G912, G2107, G2513
ctccggcgcttctccacacacagcaacttactcaaccacgcactccagtcaagcgtctccactaacactagctagctctagaaatggacgtcgccgacatcgcctccccgtccggccagcagaagcagcaggggcacaggacggtgtcgtcggagccgccgaagcggcccgcggggcggaccaagttccacgagacgcgccacccgctgtaccgcggcgtgcggcgccggggccgggtcgggcagtgggtgtgcgaggtgcgcgtgcccgggatcaagggctccaggctctggctcgggaccttcaccaaccccgagatggccgcgcgtgcccacgacgccgcggtgctcgcgctctccggccgcgccgcctgcctcaacttcgccgactccgcgtggcggatgcggccagtgctcgcgaccaccgggtcgtttggcttcagcagcacgcgggagatcaagcttgccgtcgccgtagccgtcgtcgcgttccagcagcagcagattattcttccagtagcgtgtccatcgccggaggcgcccgccagcccgagcgccgctctgttttacatctcgtccggcgacctgttggagctcgacgaggagcagtggtttggcggcatggacgccgggtcgtactacgcgagcttggcgcaggggatgctcgtggcgccgccggacgaaagagcgaggccagagaaccgcgagcacagcggcgtcgagacaccaataccactatggagctatttgttcgactgctaatttagcacgcagtgtaaagttgtttacatagttgtgttgtgttcctctttttttttttttagaaaaggaggatctcatccgattcaattgtgctaagttaaactttgagttaaaaaaaaaaaaaaaa

SEQ ID NO: 7870 - DNA, 1454 bp, Hordeum vulgare
  Predicted polypeptide sequence is orthologous to G921
ggtgtttgagggaccaatggatccatggatgggcagccagccatccctgagcctcgacctgcacgtcggcctaccgccgatggggcacccgcaccaccaccagagccaataccaggcgccgccgatgatcgcgctggccaagcccaagatcctcgtggaggagaacttcatgccactcaagaaggaccctgaggttgcggttcttgagtcggagctacagcgggtgagcgaggagaaccggcggctgggcgagatgctcagggaggtggcctccaagtacgaggccctgcagggccagttcaccgacgtggtcacggccggcggcaacaacaaccactaccacaaccagccgtcctccgcgtcggagggcgggtcggtgtcgccgtcgaggaagcgcaagagcgaggagagcctcggcacgccgccaccgtcgcatactcagcagcagcactatgccgccggcctcgcgtacgcggtggcgccggaccaggcggagtgcacgtccggcgagccgtgcaagcgcatccgggaggagtgcaagcccgtcatctccaagcgctacgtccacgccgacccctccgacctcagcctggtggtgaaggacgggtaccaatggcgcaagtacgggcagaaggtgaccaaggacaacccatgccccagagcctacttccggtgctccttcgcccccggctgccccgtcaagaagaaggtgcagaggagcgccgaggacaagaccatactcgtggcgacgtacgagggcgagcacaaccacacccagcccccgccgtcgcagccgcagcagcagaacgacggctccggcgccggcaagaacgccgggaacgggaagccgccccaggcgccggccacgcctcaccacccgcagcagcagcacaagcaggaagcggcagcggtcgtcgtcagcggcgaatcggccgcggcggcgtccgagctgatccggcgcaacctggcggagcagatggccatgacgctgacgagggaccccagcttcaaggcggcgctggtcaccgcgctctccggccggatcctcgagctctcgccgaccagggacatcaattaatccccacaggagcaagccacatttcagaaacactgcccggctcaatttttcttgcggtgtcgattactccgttcggcattgcttgctgcctgcctccgccgcctccgtcaaagcctcgcagacaaagcatcaagaaccggacgcctgaccagcgaagaagacgcgatcggtttccggcgagcgaagatcggagttaccgctcgtgtacatagaccgcgaacacgacggcggcgagggaggttataacatgtaatgtactccagtagctaggataatgcagtcattcaaatgttccgttccataatttccatggaactcgattcgattcaatgagaaagtcaatcaagtcacggtataaaaaaaaaaaaaaaaaaaa

SEQ ID NO: 7871 - DNA, 700 bp, Hordeum vulgare
  Predicted polypeptide sequence is orthologous to G921
accttcttttcccctgaacattatttttctgtggtacgattcagatcctcaaatagcaagaaaaatgcaaattatgcagtacaattcgggggagaactaggccctaaatctcagcagagaagtgctaggaacttcctttctgaagctgtacaagaaaaccgcacgggcggagtttctgaagtatgcacagtctcaacagattctacttgaatgctaataatccggcagcttccgcaggatggcggcggcgagcgcgtcggtgaactttcggtcgccggtgagctcgcgggccatctgctccaccagagccgcccggaactccggcgacgcgacctcccggcacaccttcttcaggtccggctgcgcctcccctgctgcctcgaccacctgcacacctcccccgtccttggtgaggtccagcgtgatggtcgggccggaggagttgatggagatggagcacggcaccgggccgccgccccccgccgcgcagctcggcagctcgccggcccgcgtggggcgcgggtggttgtgctcgccctcgtacgtcgcctccaccatcgagctgtcctcggcgcttctctgcaccttcttcttgacagggcaggacggcgcgaaggcgcatcgaaagtaggctcggggggaggggttgtcccgtgtcaccttctgcccgtacttccgccattgatacccgtctttcaca

SEQ ID NO: 7872 - DNA, 987 bp, Hordeum vulgare
  Predicted polypeptide sequence is orthologous to G921
cgaggaagacatggaggagcagtggatgatcgggcagacttgcctcagcctcgccctcggtgtcggccagccgacggcgccgcgaggtgctcccccggtgaccaaggtgctcgtggaggaggacttcatgtcctccaagaaaaatcaccaggttgaggcgctggaggcggagctccggcgagtgggcgaggagaacaggaggctgggcgacatgctccgcgcgctggtggccaagtactccgacctgcagggaaaggtcagcggcatgatggcggcggccaacaaccaccaccagtcgttgactacgtctgagggcagttctgcggcctcgccggccaggaagcgcgcccgcagcgacagcctgaacaccgccgaccgcaatccttcgccaccgctcgccgcagccggcagcgtcaacgtaggcccaggccagccggagtgcacgtccgtccacgagcccggcgacagcaagcgcgtccgcgccgacgaggacaaggccagcagggtctccaaggtctacgtccacgccgacccctccgacctcagcctcgtggtgaaggatgggtaccaatggcggaagtacgggcagaaggtgaccaaggacaacccatgcccgagggcctacttccggtgctcgtctgcgccgtcgtgccaggtgaagaagaaggtgcagcgcagcgccgaggacaagaccgtgcttgtggccacgtacgacggcgaccacaaccacgcaccgccgcccaagcatcaaggctctggtggcaggaagagcggcgacgcagcccccgtccgcgtgtcaccaccggcgccggtgcttgtccagctgcagcgggagcaggaggcttcgacggcggatcaggtggccgacaggaagaacctggcggagcagatggcggcgacgctgacgagggaccccgggttcaaggcggcactcgtctccgcgctttctggtcggatccctgttgcttgatcggaaatctcccagca

SEQ ID NO: 7873 - DNA, 676 bp, Hordeum vulgare
  Predicted polypeptide sequence is orthologous to G926, G2632
ccactctaccgcagtatacaaacacacgccatccatcccgagtctgacaatcaatctcacacgcgcacagcctgctagttcttctccactcgcacacatccgacacaagaggggtgataacagaacgcgaaagccaagaatgaattgcctggacacagcagcaggccctgaatccccgaccagcccccacgccgtggcgacgtggcacgacggccggcggccaggaggagccgctgttctaggttgcatcaaggtgctgccacttcacgcctgacggagatgcaggtccggcggcaccacccggaggtagtcggaggcgctctgctcgcctttgcccgcctcggctccgccgccgccgtgctcgtccttcttcgtgttgaggaagcggccgccggtgcccctcgcccgacgcatcgcgtgctggtgccgggactcgtggaggtaaggcttcctggccttgatcgccttcctctcgagctcggccttggcgcgcgactgcctccgtctcaagatgccatggtactgcttcgcgttcacgtacaccggctcctccgacacttccagaggcagcggcatgcgcgagtgggtcagccccggtagctggaagtgagccactgcttgagcgccataggggccaaccatgcctgcgtagtaagcatcagggtacgggtacggt

SEQ ID NO: 7874 - DNA, 770 bp, Hordeum vulgare
  Predicted polypeptide sequence is orthologous to G929, G2344
catgacctctgtcgccgacgctgtttcaggtgatcatagagctgatgagcaacagcagaagcaagctgctcacgggaaccaggaagaggccccagctactagtataggtaatcaggcgatggcggcaacaccttccacagattatgtcacaccctatggccaccaggaagcttgccatgcaatgggtcaaattgcttacccaactattgatccatactatggaagcctttatgcggcctacggtggacaacctatgatgcatccaccaatggtcggaatgcatgcagccgcaataccgttgcctactgatgcaattgaagagcctgtgtatgtgaacgcgaagcaatataatgccatattaaggcggcgccaatctcgggctaaagcagagtcagaaaggaagcttatcaagggccgcaagccatatctccacgagtcgcggcatcaacatgccttgaaaagggccaggggagccggaggccggtttcttaacgcaaagtcagacgacaatgaagagcattctgattccagctccaaagataagcagaatggagttgcgccccgcagcagcaatggccaaccgtcttcctctcagtctcccaaaggcgcaacttcggccgacaagacgggaaaccctgaatgagatgctagaagtccgccggacgcgacgatccatgccaacagttttgtacagtatatatatgctagtgagcaagaagatcgcgccggcgggtgctgtaagatatatatctggaaccgctccgctctat

SEQ ID NO: 7875 - DNA, 719 bp, Hordeum vulgare
  Predicted polypeptide sequence is orthologous to G937
ttttttttttttatccaaaaactggagcacctttattccctttaggacagcaagagccgaacaatatacgaatctccctctatatatgtatgtaattctcggggcgaaaattggtggtctgcccgaaacgctcgcgaaaaaagcctcatgtacatcacaagaacaaggccatgatcagttcattttttgggcgctggatcaacgcccaatatccctggattcatggcctgcaccacaccctctcgatcgatcaggagtgtatgccgttattgtcatccatgccgcaaagctatctctacctctctctcatggaaatctcttgacggtcccaaaagccttcagatcatctccggctatagcctaccgacctgtcgtcttcctcagaactgtcgctgacggtgagtgccgagacggccacccctgaacaagagagctgaagggggccttcaggggaccgggactgcgagctgctttgctcctgatgagcccagagatctcccaccagcataatcggatggctagctgaggaagagctaggggacctctggttgtgcagacggtatttctggaggtggcttttcacttcatcgttggtgaggccatcaactttcatcacctccctgatttgctttggagtggcaacttgagggccaccgagttggtgcaaggcggcaacaaagtgccggtgaagctccggcgaccagcaccgcctcgtcttc

SEQ ID NO: 7876 - DNA, 651 bp, Hordeum vulgare
  Predicted polypeptide sequence is orthologous to G938
cggcacgagggtgcagtgcccgcacgccgaccacgcgctcggcttcctcgatcgcaacgcgcgcaacgcccaccagtacacctgcaggtacaaccagaaccaccccgccgcggccgcccagagcaagccggcgtcggccttcttcccgggggcgccctacagcccgcagagccaggctctcggcgggttcgacttcggcctgcccgtggccgaccagagatgcctcgccgggctgatgagcatgtacgagaccggcgtggccgcgcacagaggcgcaacaagcgacgacaccgctcccggcctgcagatcggcaccggcaaccatctggcgccacgctcgcttgctgactcgaacaaccatatgcagcagcagcatcatcagagcgcagcgttcttcatcggcgacgacgcgccgttcggcatggcggcgccggagctgggcaggttcggcgcagggttcgacctgtcagcggcggactacgccggcgccatgcagcagcagcagccgcagaagcacgttggacccaactggttctactgaacaagaacagccaaggaaccattcctcattagcatgtagctctaggccattagaattcataaggcttccattctcgatcagtccatggcgccttgcaacttgtaaggatc

SEQ ID NO: 7877 - DNA, 682 bp, Hordeum vulgare
  Predicted polypeptide sequence is orthologous to G956
cacgcgtccgcggacgcgtgggcggacgcgtgggcggacgcgtgggttggatcaacctttacaatgcctaataatgcatgcatatttagcatatggagtccctgggaacgacattaagcttttctcgctaatgcgaaagcctgttacaaggttggtggacagtccttcagtgcagctgaaatagagtttataatcctaaagatgaagacccatcacaccggccacaaatttctttgatgttagcccttcacaagttcagggtcaccgaggagcacagagatattcagtcgacgacacggagcccctggtgttgtttgcacttagcagcggaatgttctcctcaccgctgtcaggattttctcggccgagaacgttcggcagcagctgcaagaatcgatgagggactacatccgacgtcggtcgggatcaacgacaaggggaagctgactgtcccggcgctgctgcagagctacgccaagggcaggtggaggactcgctgctggccgactggatctgccggcagctaacgccggcccaggtcgcggcggtccagacacgacgtcgtcacgcaagcagcggctcctcgggttccgcagcttcagcgtcgtcccgttcgactcgtgttccggtacctcttcctgcctgaccagcactaggcagacgcagatcagtcttggcaccg

SEQ ID NO: 7878 - DNA, 1406 bp, Hordeum vulgare
  Predicted polypeptide sequence is orthologous to G962
gagatgactcgatcaaggccgacgaccaccatggggggatcagtgccagaccaacaccaccagcagcagcagcacgacggggaagtggacggtgggcagctgcagcacggcggcgagcacgtggagacggtgatgcccgggttccgtttccacccgacggaggaggagctgatcgagttctaccttcgtcgcaaggtggacggcaagcgcttcaacatcgacctcatcgcctccgtcgacctctaccgctacgacccatgggatctccccgcactagcgtcgatcggggacaaggagtggttcttctacgttcctcgggaccgcaagtaccggaacggcgaccggccgaacagggtgacgccgtcagggtactggaaggcaacgggggcggacaggatggtgaaagtcgtggagggcaaccgctccatcggcctcaagaagacgctcgtcttctacgttggcaaggcacccaagggactccgcagcagctggatcatgaacgagtaccgcctgccacacggtgaaaccgaacggtaccaaaaggaaatttcgctctgccgggtctataaacgcccagggattgacgacaaccttcacctcaccggcacaacaacaaggtcgtctggctccagagcggcggcaacgaggcacagtacagcagcacaccggacgtcagcggtggcaactcaccgccagcagccgccagtgtttgtcgaaggcgccggtcaccactcatcatctgctctcaaggcgtacaacgcgcacacgacccaaggaacaaatgcagccagcaccatgacatcactgtcagcggcaggggtgacgccaccggcgatgttccggtcgacggcctctgtagcctcgctgagctctacgaattcgacagaggaggatggcacgtcgctctaccaccaccacctgaagggacacaacaacccagcagtaatgcaactgcattcttccactcacgctgcgctgctcaacaccaattcctcggcaatggcgaccatcccgatcgacgagctgagtcgggcgattgggtcctacagtcaagcttcaaaccctaaccagcccacggcgccaatgcagggcccattgcttaacttccctagcttggagaagatctgggactggaatcctctcctagaatctccaaaggtttgcacaagcttcaagtaacttcttagttgcatgaatggatccatgcacttatcatatatatgcctcccattatttgtatacttatgtatatgtggacaattatccgagctagcaaggctatatatgtaatggaataggtaacaaattaaggccgttttagtcccatgcaattaatttgtgtaacactgtcttgtccatttcaattccgaataaaggttaatcaaaattaaaaaaaaaaaaaaaaa

SEQ ID NO: 7879 - DNA, 652 bp, Hordeum vulgare
  Predicted polypeptide sequence is orthologous to G979, G2106, G2131
cggcacgaggaaaagacccccatgctccagccgcgcaccacatggaccttcatctcgatccccagatcggtgccatcgcgaaccctaggtcgcctccatcccacaggccttcgccgccgtccctccaccgcgaacgccatcccggatgcattcgccgccaccccggatcttctcgccccccatcccatctcccgtatcttgttggtcattgcctctcagcgacggctatccctagcggcagttgcacgagagatggatcttcatcctctcgaacacaaccacagaggcgagacggccgccgccatcctccttcgcgctggccatcgtcgtcgtcgtctccgtcgcgaatcttcttggtggcggcaaggaaatcactcgcgcgccgccgtcgccgccgtcgccgtccttctcccactcttcttcgatcgccattccccacaggcgagcgcggacgcagaaggccgggagcgccaaggcgaaggcgacgcccaagcgggccaagaaagagtcgagcaggagcaacaaggagtctgacgcctccaccaatggcgccgccgcatctgggaagaggagctccatctacaggggggtcacaaggtggacatgcagatttgaggcatacctctgggacaagaagaaagggaggcaaggt

SEQ ID NO: 7880 - DNA, 538 bp, Hordeum vulgare
  misc_feature (8)..(8): n is a, c, g, or t
  Predicted polypeptide sequence is orthologous to G979
gcctgctntaattactgctctattgccttgcacttacaagcgcgcgagaacaatacacacaaaactcgatcaggaagttaacattgcaattagcaagatacgatagtaattaaggacattgtaacaaactgaaacattactggggcacacacacacaccagcttatgttatttgaagttctgaacacaccagcaggcgccgcagcatctggaggctctgccaaatcacacggccgttatgtatatctctaccgtacgtagaggctagctctacataccatccatgttgacctgtgcgcctgaccctcctgatacatccgggtgatttctggaccggatctcgacaacttcctctgtccggaaagcctccgtagttgccaacatggtgcgcttctgtagatctgcatgcgccttgtcgtcctcggcgcgggcgctgtagccggcgactcgctcgacgaggtcgtagaacacgtccaggagctgggcggcgaagctggccatgggagctcgtgctggtaaatttcaacctgcttagctta

SEQ ID NO: 7881 - DNA, 888 bp, Hordeum vulgare
  Predicted polypeptide sequence is orthologous to G987
aacaaagtacgttgtatgcatcaagttcttcagaagatgaaataacagacggtgtgccctcaaagtatatttctatgaaagtggggcatccggtcctcagaattgatggtaatcacttactggcagctgtcattgtcagtcaaattgcagcatagaaaaagggggtaaagaattgcttgttgctgtacgttttacccttgaagcttctgaagatgtagctgagcgacgatcttcctttcagttgaagcgttgggaagcttatgctaggcttcataagaaggtaactgagaaatggtggtgtgcaccaggacacggtgactggtcaacaaacctggagaagtacatactatgccgggatggtatataccataagcaagaccaatttgggagacttttgccgacatttattcaaataattgatttgacggaagaggaagaggaggagtactggatggttgtatctgcagtatttgaaggcaaagaaacctccactctgacatctgaatcgagcaacggtgatagatcaacttctgaccttccaatctttactcccttgagtgatcccatcaacaataaggttcatttgctcaagacaatgcttcaatgggaagaacaagtacgccgtccagcatcggtagcagagagaaatctcggcgcaaaaatccttaccgatccaattctttgcgaggtgggcattatctgttggccctttgggaagaatatgaggatgattcttggcaccacaacggctgaccccggtagaaaaaatggcgtggattgggaaacttctatgggtcaatgggcctaactcctgccggctcaaacctgagcttaagggttggagatttattccaaaggagggacgtaattgccaatttccccccaacg

SEQ ID NO: 7882 - DNA, 414 bp, Hordeum vulgare
  Predicted polypeptide sequence is orthologous to G988
caacgcgaggcgccgcaaagtggcttcgatcattcggacgccaatacacatgcgcgaaagacggcggacggatctaggcaacaccatgaattgcaaccgttgtgtcgttccaatgcagcggtgtcggttgcagaagtattttagatgaggaaccgcacaggagaaatgaccttatctctttgaatgctttacggttttatccttctgatttttgttatttctgaaaaaggcattgcatcatcttgcacgttcaaacgaagggcggtgtagttcttgctgatgatactatcacatgacctttttgaaggaaagacagagtcggtgaacgacagatttcatagcaactacagcttgtggcttcatccattttcttaactgatgagaaaaggccacatcaaggctcagcggccgcca

SEQ ID NO: 7883 - DNA, 862 bp, Hordeum vulgare
  Predicted polypeptide sequence is orthologous to G1006
taaacagagagctcgctcgctctccgtgaatgatgtcgaggaagaggaggaagaagaagaagaagtgtggagcacgctgctgctacgtacctggtcaggctctcggcagcgtgaatttgtagaagcatgcttgccgtgccttcttccgggtgcaccggaggctggcatgtgagcagggctgcttcagtgatgcagaagaaaaaaggcaagtcttatcggcaagggaaggctacgcctttcttccaggtctccctctctccatctaaatctgtgtttggaggagggggctacggttagtccttgtggtcattatcctgagttgcttgttctgtatggtgttcattgaatttttcagctacataataatggtcagttgtgtgagtcaatgggagtgttcatgtgtcagttcatctgtgtgtctgctgtgagtaagttaatgaaaagatgtgtgtcggctgggaagtcattagaaaaatatagaatgtgtgaattttactaagctccatcgagttaggcgatatggtcagtgaagttggaaatgtaagatccttatagctgtatgttgcattatagggcagaaggaagattgtccatgagggatgatcaaatgagtatgatatattgaacgttgtcggaggatgggcgaatgaattacgatttgaggattttggtcgattgatgttagaagtatgtatgacggactatagatgagtgatgacttgagaaagatctgtggatggtcgatttatgtaggcttggtaggactgcgaatattccattggatgatataattcattgatggatcgtataattgttcgattgcacgattgatcgactattattgattgactaaaggaatccg

SEQ ID NO: 7884 - DNA, 849 bp, Hordeum vulgare
  Predicted polypeptide sequence is orthologous to G1017, G2567
ttgggatgaaccggacctgctgcagaatgtgaagagggtgagcccatggctggttgagctggtctcaaacatgccggccattcaccttgctccattctcgcctcctcggaagaagctctgtgttccgttctacccggaccttccggtcgacggccagtttccgtctccgatgttccacggaaacccactcggacgcggcggcggcggcggtccgatgtgctatttcccggacggcactcctgcaggcatacagggagccaggcatgctcaatttggtatatctttatcagatctccaccttaacaaactgcagtcgagtctgtcaccgcacgggcttcaccaggtcgatcacggcgggcaaccgaggatcgccgcggggcttatcattggtcaccagtctgcgcgagacgacatctcgtgcatgctgaccattggcaatcaccagaacaacaacaattcagatgtcaagaaggcttcaccccagctgatgctctttggaaaacccatactcactgagcagcagatcactttaggtaactctcggggtttctctccatctgctgctaggaagagcacctctgatatgagcgccgaaaagtcggcgaataactctgatattccaagcccacaaagcaaccagaatggctctatgaaaaacttgtcctgtggaagagttccattgtgccaggacaacaaagtactcgatctcgggctggatatcgggcacttgaaggatttcattgcatcggaagacgtcgggcgcacccttgatctaacagttggtggctcgtatgaaagattatatcgggggctttcccacatgttcggattgaaaaacctagctgatat

SEQ ID NO: 7885 - DNA, 885 bp, Hordeum vulgare
  Predicted polypeptide sequence is orthologous to G1017, G2567
tgcccaacctccacctgccgtccttctcgccgccgcgcaagaagccgcggatcccgtcctacgccgacttccccttcgacgggcagctcttccacccgccgccgccgccgttcccgcccaaccacccgctggcgcacgatcaactcatgcaccacagcttccccttcttccccttcccggacagcaatggtgctcctctcgcagggatacagggagccaggcatgcgcaattcggtccgtccttttcggatctccaccccagcaacctgcagtcgagcctgctctactccggcggcgcccgccgcccgcccgcggcgaccgaccacgttgctccccgcgcaccaaggatcagcaccgacctcaccatcggcacctcgcccgcccgcgaagacgacgtcagggcgtgcaccccgccaaagaaggccggggacgtcaagactctgctgctcttcgggcaggcgatactgaccgaggagcagatgaagtcctcgccggtggccggcgggtgcggctcgcccaactgggacgcggagaaggcgcccaacctctcggaaggctccgggtccggctccggcgtgatccagggcagcccaagcaacaacaacaacaacaacacgtccctatggaggctgcagtggttcggggacagcggcagccatgcggcgccggagctggagctggaaccccggcagtgcaaagtgttcgtggagtccgaacgccggggggcgcaacctggaactttcggggctggggctgttcaaggacctggacggccgcatggtccgacatggtcggcatgggaccccgcctaagtggaggaaccacgtcctctaccggaacgccgccggcgaagggaagcacatcggcgataaacttttcaggcgg

SEQ ID NO: 7886 - DNA, 877 bp, Hordeum vulgare
  misc_feature (776)..(778): n is a, c, g, or t
  misc_feature (788)..(790): n is a, c, g, or t
  misc_feature (800)..(800): n is a, c, g, or t
  misc_feature (807)..(807): n is a, c, g, or t
  misc_feature (835)..(835): n is a, c, g, or t
  Predicted polypeptide sequence is orthologous to G1033
ggccggcggcaggatgaaggccaaggcgggatcccgcgccggcggctccaggctcgcggtgaagaagagcaaggccgacaaggaccccaacaagcccaagcgacccccgagcgccttcttcgtcttcatggataccttcaggaaggagtacagggagaagcaccccgacgtcaagctggcctccgtgattggcaaggccggtggtgagaagtggaagtctctgagtgacgctgagaaggctccctacaatgccaaggccgagaagctcaaggccgagtacaccaagaagatcaacgcctacaacaacccacaggcaggagaggcgtccggcgactctgacaagtccaagtccgaggtgaacgacgaggacgacggcagcgagggcgacgcgtgaagcggcagcagggggagggtggtctctggaacgtcgccgtttgatgcttctctgtttgccagtgtcaccgatcgatgatggatgtttgctgttagtttagctccttggtagtccctccctctctttcaggctctcctgctgctgctggtggtagtaatggtggctctagtcccatgtaggcattgtcctggatccgagtggcgaaattgctatagcccagtcgtctttctgtaggggcctgtgctcggaccggcatcttctgttgcgtcggttttatgctagtttagcctctgtcgaatgtacctagtggcgtgccccgtggcttttttaaagaatctcatatatattgggggtgaaaaagaaagaaaatggtctccgtttnnnaaaaaaatcnnncaaaaacacntttcccncattttctcacactttaaaaaaaaaaanaaccttgggggggggccggggccccaaatccccctaaatgag

SEQ ID NO: 7887 - DNA, 1030 bp, Hordeum vulgare
  Predicted polypeptide sequence is orthologous to G1033
ggacgcaaattactgtcgtagttctccataaagggaacaaaagctggagctccaccgcggtggcggccgctctagaactagtggatcccccgggctgcattaattcggcacgagcaagctcaagggcgagtacaacaaggccattgctgcctacaacaagggcgagagcactgctgctgccccaaagaaggccgctgccaaggaggtagaggaggaagatgaggaggaatccgacaagtccaagtcggagatcaatgacgacgatgacgatgagggtagcgatgaggacgaggatgacgacgagtgaagaagaagcatctttgctccggcggacaaggcgggagctgctgcgcgaggcccctgagctgtgggtggtggttgtcataaggagcctatccatctccactagaattatcccaagtttcacttcacaccgtcatgttgttttacctttttcatgtcgtccgtccatccgtcctgctataacggatagcgctccctgttggcgcccccgccggcggggtgctccttgcggtgttagggcgtatgtcctccgccgcgggtgtgcccctgcctgtacctacctagatggtcactctttccgtccattgtcatcggctaacattgtgataatatcagtttgggtaatgttaaaaaaaaaaaaaaaaaaaactcgagggggggcccggaacccaattcgccctaaagggagcccataaccccccttcactgcccccgttttaaaaatactatctcaccacagcccccttagacccaacttatcctttaccccactgaccactccgcgtgacctccccactatcaacatcgctcgtaacgcggctcccatacactctatcaccccaacactcaacccccctctctcgttagtaccgcaccaacgcttataatgacccctatccctatctctagaactctactgcgcaccatacactcctggttatagacagttgcaccctagatcttagcgatgactactagaacactgcaatacagctcaactctctct

SEQ ID NO: 7888 - DNA, 1367 bp, Hordeum vulgare
  misc_feature (6)..(6): n is a, c, g, or t
  misc_feature (30)..(30): n is a, c, g, or t
  misc_feature (426)..(426): n is a, c, g, or t
  misc_feature (784)..(785): n is a, c, g, or t
  misc_feature (790)..(790): n is a, c, g, or t
  misc_feature (798)..(800): n is a, c, g, or t
  misc_feature (804)..(854): n is a, c, g, or t
  misc_feature (929)..(929): n is a, c, g, or t
  misc_feature (937)..(937): n is a, c, g, or t
  misc_feature (985)..(993): n is a, c, g, or t
  misc_feature (996)..(997): n is a, c, g, or t
  misc_feature (1000)..(1000): n is a, c, g, or t
  Predicted polypeptide sequence is orthologous to G1033
cgggcntccgggaaatatctgaccctcctnctaaaggcacacaggctgaagctccaccgcggaggcggccgctctagaactagtggatcccccgggctgcaggaattcggcacgagcaggctcaaggccgccgttggttccagcaagaggaagaaggccgccgctgccgctggcaagcccaagcgcccgccctccgccttcttcgtcttcatgtctgacttcaggcagcagtacaacgcggagaaccccaacaacaagaatgtcgccaacgtgagcaaggctgcaggtgagaagtggagatctatgtctgatgaggacaaagcaccttatgtggagaaggctggacagaagaagcaggactatgagaagaccaaagccagcttcgagaacaaggagagtgtgagctccaagaaggccaagactcangatgatgaggaggctgagggctccaaatctgaggtcgaagacgagggtagcgatgaggataatgaagacgacgatgagtaaatagtgtatccaagcacgaggtagcaaattgggagttgggtccccgcgtagtgtactagtttgctatcctgctatcttcagtgttagatgatgaaatttggaagtagatgtgcctttgtgtgttaagggggcccctcttagacttgtggactcatggtttgagaagttgcttagtagtgtattagcagagagagagccgagaatgccactagctgtctcttgctaaccacttgtgtaagaacttgttttcattcgctaatctgatgactgcccaaannaaaanaaaaaaannnaaannnnnnnnnnnnnnnnnnnnnnnnnnnnnnnnnnnnnnnnnnnnnnnnnnnaaaaaaggggggggcgcgcgcgcccccccccccccactaggaggagaaaaccccccccccggcggcgggcggtanaaaaaaangggggggggaaacaaccccccccccccacaaatatggggcgggggagnnnnnnnnncgnncgnagcccccgggccacgaccccgtctcagaagcgctacgcgtcgagctgggcatcgacgggacgatggcagtgatgtggcggccatccctacgatgtaccctcaatccccgctccccgcgactggacaaagctggcatggcatgaggccgataacgatcctgtttcggtgagtagacgcgctcagtagctggagcatgcagacggcgacggcgatgtcgtgccgctgacgcgcagggctgcgacgtcagtgttctcgtctaacgagactgccccgagacgacgtcccgtatggctagagctatcgcaggccgagaagccgttgtacgcgataccgccgccttactgcaccacgaggcttgactgctcgg

SEQ ID NO: 7889 - DNA, 926 bp, Hordeum vulgare
  Predicted polypeptide sequence is orthologous to G1033
agttccgcgccgaagccctaaccctccccagagccctagccgctcgccgccccgccccgccaccatgaggtccaaggccaacggcgacgccgcgttcaaggcctccggcaagagcaagacggccaccggcggcgtcaccaagccgaagcgcgccccgacccccttcttcgtcttcctggctgagttcaggccgcagtacatggagaagcaccccgaggcaaagggcgtcgctgccgttaccaaggcggccggggagaagtggcgcagcatgtcggatgaggagaaggcaaagtatggtgggaagaaggcagatgcaccagcgagcaaggctgtgaagaagaaggagagcaccacctccaagaaggccaagaccgatgctgatgaggaggaagaaggttctgacaagtccaagtctgacgttgaggatgatgctgaggacgacgaggagtaaatagtggatgagggaacagcagtggtgcaaatcaacgcgtgctgcttaaggcttaactgccatgtcaatgtccttatgatgtaatgttatgtgaggagaatgttaaatgcgtactcctggtctgcggcatgctgggagagtctttgtttgactagtagcgaaaataagcctaaaacccttgactgcctatctttcggggacctccgcacctgtgggaaaccgcacttatgccttgtttttatctactggggctggagactaaccccctggtgggctgctgttatttgttggcgaaaaaaaaaaaaaaaaaataaaactggggggggggcccgggcccaatcccccttagggaaggagttatattacatgggcgcgtgtttacaggcggggatggaaaaacggggctcaccccttaacgcctgtgcgatacccttctcagtgggtataagagaagccacaccgggccttctaaagg

SEQ ID NO: 7890 - DNA, 627 bp, Hordeum vulgare
  Predicted polypeptide sequence is orthologous to G1049
ctggtattcgtaagtggtttatatctattacgaatgcttggtacaaagtactttccagagaattaagtaacattgttctcacctgaggtgggatgttcagaggcttgcttgtaaactgtaatgcactggttacagattcacaatcatgaaacagtttctacggttacgagcttctcagtatcagggccgtacgtggtggtgatgaacattcagatcaaacaattcatgtttcagttgctgggcttgcaaagtccaaccccacatctatcccatggtgagtagcgtgagcgacggaatcccctttggcacccctgtggggtgatggcagtttatcgaaggttaagatgggagtgttgtggcatgcggcgggggaaaactcatcaactatgctggccctcttcgtgcggagattatggcgacactacaaggagctagattggctggggagaaaaggatactgaatgtctaattttcagactgatcctttcacttctgggacctctccactgtttgttttgttatattgcagaaatgcagagcaaaagtcttttctaatatcaaaactttgatagctgtagcttctcctttgcaaacaggggctgtaataaagttgtgcatgctttggac

SEQ ID NO: 7891 - DNA, 819 bp, Hordeum vulgare
  Predicted polypeptide sequence is orthologous to G1050
agtttttttttttttttttttttttttttttgaaaaaacacagcacgctcgcaagcaggacatgctgtatctgtgtgtacttgcaaggtgagcaaaattatttcgtttacaaactgtagaacagagcacactcgaaagacaacaaataccggcaaacttttattagggtatacgcaatatttttaacgcgtgggtgatagctaggggactggaggtggcactgctggcagcgctgactcagctaggatgagggacgatacccgacaatttgaaacagtcaattaaccttaagagtgtcgtggtgaggaggagacgggaatagggaagctatgatgtgagaatggtggagacacaggctgtccgggtgcggacggcgcagagaaaggagcgagcgaagcgcgaatattatgggaaattagaagaggaaagtgcgtatggatgcggtgagacctaaaacttgatatttaggtagtggaagaagaggatagtgagttgtggaatatacttggtgttaatagtacgttatgtgaagccggatatgtctgtatcgggggattaatgttaaggagggaggcgtgtattaggagctggtaacgtgtcgtatacgatagtccggactgccatcgttatcttttttgagtgctcagaccgtgagtcgggttggaggtatgtgcttgaagtaaaattgatatactgatgggtggggagtgtgcataaaaagatatggaagagcatgaggagtatcggttgtaagagtggatatgtttaagatgatgggtaaggagttgagtgacggtagattgtagaagctaggtgtgt

SEQ ID NO: 7892 - DNA, 1290 bp, Hordeum vulgare
  misc_feature (145)..(145): n is a, c, g, or t
  misc_feature (148)..(148): n is a, c, g, or t
  misc_feature (152)..(152): n is a, c, g, or t
  misc_feature (183)..(183): n is a, c, g, or t
  misc_feature (188)..(189): n is a, c, g, or t
  misc_feature (195)..(195): n is a, c, g, or t
  misc_feature (906)..(939): n is a, c, g, or t
  misc_feature (947)..(990): n is a, c, g, or t
  misc_feature (992)..(999): n is a, c, g, or t
  Predicted polypeptide sequence is orthologous to G1051, G1052
gctcctagaactgagtggatcccccgtcgctgcgggcggcgcgggcgggccacgtcctcagcggcggcggcggcggcgggacgggtttgacaggctcgacgacgagcagctcatggccatgtggtccaagggcgacggggggtgnganaggncgggcttcggggaggcgggaggcgcggaggnggggnngcccancgcggggcgcaatggccgccacggacggcttcggtgaccccaagagggttaaaaggatattggcgaacaggcagtcagcgcagaggtcaagagtacgtaagttgcaatacatctcagagcttgaacgcagcgtcaccggtctccagatggaggtgtcagcactctctcctcgcgtggcctttctagatcatcagcggtcactactgaccgtcggcaacagccatctcaggcaaagaattgccgcccttgcacaagacaagatcttcaaagatgctcatcaagaggcactcaaagaggagattgagcgactacggcaactgttccaccaccagaagatcaaggccacaggcggcacagacatggccacggccacctcaatgcaggccaagcaagagctccttatgtgtgagggagccgcgatgcgatagaccaacaaggcgcaaccagcctttttgtggtgattttcttcattcactcatctcgattcatcgtgtggaaacacaccaatgttactagattatctgtgcagtttgacatgttcattgttcctgttcatgtgatgttcactcatccctatcgataattgtgttgggatgggaattgtcgtaaaaaaaaaaaaaaaaaaaaaaaaccccggggggggggccggcccccctcccgcctaaggggggggtttccccgggccccggggcgccctcccgtcgctgcgannnnnnnnnnnnnnnnnnnnnnnnnnnnnnnnnngggccggnnnnnnnnnnnnnnnnnnnnnnnnnnnnnnnnnnnnnnnnnnnntnnnnnnnnttattatatattggggcccccgcgccccgtgtgtgttggtgtttggggggtgagggagtgggccccccccccccggtggggtggtggggtttgtggccggtgtgtccggtggaggttgagtggggttgggggggggggaggagagggggtggagggagggaggggggggggagaggtgatatatggttttagtattttttaatttttaggagtggggggggaggggggggggggggggagggggggggggaggtgactgggggtggggtgggggtgtgggtgattggggtt

SEQ ID NO: 7893 - DNA, 710 bp, Hordeum vulgare
  misc_feature (563)..(563): n is a, c, g, or t
  Predicted polypeptide sequence is orthologous to G1062
gccgctgacggcgggggcgggagggcagaaaggggggttcttggcgcccccgctgtcggcgttcggcgacggcatggggtgggacgacgaggacgagctggatcagcagagcatggacgcctcctccttgggggtctccgcctcgctggagaatgcggcggtcggcgcgccggggggaggtggcggcggcggcaacgggaagggcaagaagaaggggatgccggccaagaacctgatggcggagcggcggcgcaggaagaagctcaacgaccgcctctacatgctgcgctccgtggtgcccaagatcagcaagatggacagggcttcaatcctcggtgacgcaattgactacctgaaggagctcctgcagaggatcagcgatcttcactccgagctcgagtctgctccaagctctgctgcactcggtggaccatcgacggccaataccttcctgccgtcgacgcccactctgcagccgttccccggccgcatcaaggaggagcggtgcccgccggccccgttccctagccccagcggccagcaggcgacggttgaggtgaggnatgagggaggggcaggcggtgaacatccacatgttctgcgcgcgcaggccgggcatcctgctgtccaccatgagggcgctggacagcctcggcctcgacatcgagcaggccgtcatcaggctgcttcgacggctttccccatggacg

SEQ ID NO: 7894 - DNA, 744 bp, Hordeum vulgare
  misc_feature (705)..(705): n is a, c, g, or t
  Predicted polypeptide sequence is orthologous to G1079
ccaccaccgcctccggcatactctgtgacttcttccatgccaccacactccgtgacatcctcaatgccgccatcaccactccccccaccactcataccgtttagtccgataaggataagaaagagggagaagagagatggtgaactcgacggggatgattccacggatgaagacgacgacactgacagctgctcaacgcctctgcccccaccgccgccgcccggtatggagtgggagtacacggacccaatcaccatgcgtcccttgtattttcttccatcttcgttggctgatcaggacgataaagaagtggcctcacaggtcagcatggatgacgattgggtggaaacaaacatagaatttgatgaactagatgaaagcgtctctcgcaatgctgatggcgttgttaggcgtatggaattgcatccagcaaagagcagggttctgggtgatgaaaactcatcaatggtgagcagctgggtaacaaaggactcagactcttcggttatggcctgggcgaatgacaagtcactggtagaaatagccaaggagattgatgagtacttcttgaaagcagccgcaagtgggactgatgttgttatacttttggattctgctaccgggcggctagatccttcagaggtgcaagtaaagaaaggaaaaaattcgaagtctgccaaggttttctctacactttcttggagntggtcattcaagtctgtgcatgctaacagagaatcctca

SEQ ID NO: 7895 - DNA, 856 bp, Hordeum vulgare
  Predicted polypeptide sequence is orthologous to G1108, G2394
gagctactcaggagctaatcgatgcattgccaacctacaaatttaaaccaaaacgaagcaaaaactgggttcttgatcatgcttcgagctcagagaatcttagcgagggcggcatcctgggcccaggaactaaaaaggaaaggattgtttcggctgaagatgctgtgtgctgcatctgccttactaagtacggagatgacgatgagcttcgcgagcttccttgcaaccatttgtttcatgtgcaatgtgtcgataaatggctcaagataaatgcagtatgcccactctgcaagacagagattggaggcgtggttcgatcattctttggattgccctttggccgccgccgtgttgataggatggcaggaagaggtgtagctagctcaagatttgaggtgtagaacacgtgcttgtgctccgatgtgtgctggctgtgtagggagttgaatgcctagggaagctcatgggattcaaggtgcggatgctgaggggaagacggtgagcgcttgtgtatagactatggtacgttttgttgccaagcgggttgcggctttgtggcggccgagggcgccggcaggtgtaggtcttataagcgggggtcggaggggagggggggcgagacgagatggacgcggtctggtctttgggtggagggggtcaatgtgtgaggggggacgggggagtgtttgtgtgcgtcttatttgaggggtgggtgtgtgggagaggggtgtcgtggcggcgagtgaagggagagtagtgtaggagacgagcggggggggagtgcgtggggtgtgtggggtggagggtagcgagtagagaaggtgtggcgcggggggtatcgagggggagagagcgg

SEQ ID NO: 7896 - DNA, 726 bp, Hordeum vulgare
  misc_feature (704)..(704): n is a, c, g, or t
  misc_feature (724)..(724): n is a, c, g, or t
  Predicted polypeptide sequence is orthologous to G1145
gggcgtagatagggatgtcgtgggaggagcccggcagcccgcagctgagcctgagcggcttcagctccctcccctccatctccagcaccgccgttcggccggcccgcctgccctccctctccctcagcatcggcaccggcggggaggaccagcacctggccgtcagcagcgacgacggccagaagagcgtccgggcgatgaagaacagggagtcggctctgcggtccagggccaggaagagggcctacacgcaggagctcgagaaggaggtccgccggctcgtcgaggacaacctcaaactcaagagacagtgcaagcagcttcaatctgagattgctgcactcaacgcccagcagccaagcaacaagcagggcagcccacacaggagaacttcttcaactcagttctagcaacgctgcatcagggatgctggatgcaggagggttaattttcatctactacgatctgattagcactggtagttggtttggcttcaattaattaactcagctgcccgatcgaaatgccatcgcgcgggcttgcttgcctcggctgatccatttcatctcatgtgaatttctctgcatgtattgttgtgcgcactaatcagcctggatgcccggaccagagagcacatgcaacctgcccgcgattaattgtgtggcagaatacctttataataataatgctgaatcgcgattcanaaaaaaaataaaaaaaaaanca

SEQ ID NO: 7897 - DNA, 785 bp, Hordeum vulgare
  Predicted polypeptide sequence is orthologous to G1145
ttgcactctcgaatcctcggatttatcacgcaccgaccaacatattattctctccctgccagcatagagctgcttctccaataaggatgcctgcttgaataaatcaaaatctgaacaatttttgcacaaggattaccaaaatcagaaagcttaccgtttcatgctatcaacaactgatcatcaacagtgccataggtcaaacataaaacacgcaaaatgagctgtgaaagcggtggcaccgccatcacgggcaagaagcgggacagggcccacatttagacactagaccgggaaggctctatgtataacctcaccctcagtgaggtcgatagccacctcggagcgccacttcttagtatgaaccttgatgagtttgcgaggagtgtgcttccatatgagaagaaccttccattaccaaatggcgctgggaattcatgcagtcaaagcacgtcagcttttggtttggaacgtcacggtagcagcattactgtgcccctgccattgagcaagaagacaggggatgaaatttggagagacatccagcacgaaccaggataatcagtgatgatgatgaaaagggagttcaggtcgtgaggcacagaatgtcgtttggggagataacacttgaaagagatcttgccaaagggctggaatagttaccggacaaaggtcaaaaagatgcttaagagttaatctgatgtttgaagaacctggaaaaaaggcccatttttaaaacttaagtcccggatttcccaccgggaccaaaggccatttgagcgccaatt

SEQ ID NO: 7898 - DNA, 596 bp, Hordeum vulgare
  Predicted polypeptide sequence is orthologous to G1145
cccataatgacctatgatgagataaagacagtctaacttatcatatacaaagaaggagctctgataaaattaaaacatgtacctagcagatttacacacactgacaaagcctcggaacagacagatcatctgggacatgctaggggtcgcctagggctgctactcatctacaaactctgaaccaccgggctgggataagctacaacacctcaggctaccaactgtttctatcataaccacggaaaacatacgagcagtgtaatctacaaaatttactatcgacctcaaacgggtgcagaacttgttctccggagttgatacttgggttctgggggaggcgcagaggttatcatcatctccaactccttctgcttcttcaacctctcgttctcctcttctagacgagacaccttgttttcgagctcattagtgtaagcctgcttcctcgctctggaccttgcagctgattccctgttttttatcattcttttttgccttctttctacgaccttatcaggtataccatctgaggcaccacgcttgcgcccaggtgtctgaggatcagaatgtgcatcgagcattggtgaagtaatctg

SEQ ID NO: 7899 - DNA, 914 bp, Hordeum vulgare
  Predicted polypeptide sequence is orthologous to G1146
gttacacaccctcatcctggagaagattccagtccttccattgctgctgtggttgcttcccaagactggcctgaggtcactaagtatgcaggattagttagcgcccaagcccataggcaagaattgatacaggatctttttaaagtatggcaagatccccaaagaggaactgtgactggtggcatgatcaaggagcttctcatttctttcaagagggcaaccggacagaaaccccagagaatcatattttacagggatggtgtcagcgagggccagttctatcaagttcttcggtatgaacttgatgccattagaaaggcatgtgcgtccttggagcccaattaccagcccccagttacttttgtagttgtccagaagcggcatcacaccaagctttttgctaataaccacaatgatcaacgtactggtgatagaagcggaaacatactgcctggcactggtggtggttcaaagatttggcatccgaacgagtttgatttctacttgtgtagccacgcttgcattaaggaacaaagccttctgcgtattattactactatgggatgagaacaattactgggggtggattgacactttaaaaacaacttgtgctaacgatgctaggggccccccgctttgtaaatttggcccccaccatttatgccaattgggaagcctcggcgtggttttattgggccggaacccggatgggggcctggaaatggtgcccgggcccccaaaggggaggataaacaggggtgggagagtgcgttggaggcgctcgccctcagggaacaggagaggtttgtgttcgttaagggcggcggtcgggcaattttgcaacgatatttataggtatgggtgggtttctcggtggggggggagaacacgcgacactacgcggacgaaatatt

SEQ ID NO: 7900 - DNA, 970 bp, Hordeum vulgare
  Predicted polypeptide sequence is orthologous to G1146
gttacttttgtggttgtccagaagcgtcaccacactaggctttttgctaacaatcacaatgatcagcgtactgtcgatagaagcgggaacatactgcctggcaccgttgttgattcgaagatctgccatccgacagaattcgatttctacttgtgtagccatgctggcattcagggaacaagccggcctgcccactatcatgttctctgggacgagaacaaatttactgctgatgagttgcaaactctcacaaacaacctgtgctacacgtatgctcgatgcacccgctctgtatcgattgttcctcctgcatactatgcccatctggcagccttccgggctcggttctacatggagccggacacctccgacagcgggtccgtggcgagcggtgcacgtggcggtcctccacagggcggtccacgcagcagcaccaggttttgggaacgttgctgtcaggcctctccccgccctcaaggaaaacgtcaagcgcgtcatgttttactgctaagatcctcgcagttaccgtgaggtaacttgaagcacctgtgagtcggattggggatgctgttcaacaccattgtgggaacctaaacccaagttatcttgctgtactcttgttcaacacccattctaaatacctgcaccgggatgggtgactagtgtgggcggtgcacaaaccttttaaagcttttcaacttgattggggcgtcatttagtctgttgcgttgcgcccgtgctgctgccagaaagctttgctttcatgggctgtgccgagtgagaaatctggcctagtcctatttttgtatcccctggtgtttaaaaattatttttgacccattggtgaaggaatcacttggctagcatgagccctttgtttccttgcttggacgcatccaacggaaaatttgtggggcgatgatgtatattggatggtatactcaaaaggaaacatgaactttaagtaaac

SEQ ID NO: 7901 - DNA, 673 bp, Hordeum vulgare
  Predicted polypeptide sequence is orthologous to G1146
acctggaatctcaagaaaagcattactggcttctcttgagaagttcaatgggtcccattgattgctatttgttaagtgaccatcaggaggtatccaacccagagcaggtggcacaagacaatttggatcatgcatccgcagctggaggttttgatgctccacgaccggtggatggtcatcaaagtcaagctcccgaaaagggagagggggacacaatcggcaaggacacatcgaacccatccaatacacatgaactgatgtctggcattctgagaatcataccgccagatactgatattgatgctgattactggctcgcttctgacgttgacgctactgaaacatgggccacttagacttggtccgcctcttacgtggcgaaatagcaatgattccacacaatgcacattctgatgaaggagatggagcctggatcaataggcccaccttcaacggagtcttccattgggtaatcttaaaagaatatgtgagacagatcttggattggtctctcaatgctgtttgacgaaacatatttttaagatgagcccgcagtatcttgcatatgtcgcccttataatcaatgtcaaggtgttttctcacttgcatgagcttgatcttcgttatcttctaagccggcaaactggagctctaaatcgcataattgacagag

SEQ ID NO: 7902 - DNA, 558 bp, Hordeum vulgare
  misc_feature (7)..(7): n is a, c, g, or t
  Predicted polypeptide sequence is orthologous to G1146
gagaagncaacagcaatcaactgcttatgtatcttataaaagcaagaaaaatactgatgagaatacagcaagtaacaaaaggcagagcttcagaaactgctgcagaaacaaacttacacacacgcaaaaataacgaacttgcaaacttacacttgacacctcttcaccgtgtgcattcgtcgggatagagccaggtgatcttaataaagcaacaacaaaagaagaaaaatagcgcaagccgtcgcttgaatgctcagattttcaagctccagacccttaaaagtattcgagattcaacgtttacaacataacaaagtacacaaatagatggtacttaagcaaacataggtcagcatagtacggcgcacgacatagccactggcagattattactactctcttcacataattacaaggacaagaagctgacacgccgacttaaggagcatattaagattgcccttcacgggcttcagcagtagaacatgacgttcttcacactgtccttcattgctggaaggggcttaacagctgcaccgccagggggccgagtaccac

SEQ ID NO: 7903 - DNA, 652 bp, Hordeum vulgare
  Predicted polypeptide sequence is orthologous to G1146
ccttaaaaattcttattgtttgcataatggtgtaaaacagtacagctcgcaggcactaataataccgtcaccgaaaccaccacaaccttaacagtaaaccatggcacgcttgacatcttggcaaggagaggccggacagcagcatatccaaaagccctggcgctgcatgccgcaagcaacggacccgctatccgaggtatctgtctccgtgtaaaatcgagcccaaaaggctgccagatgtgcataatacgctggaggaacgatcgatacagagcggatgcgcctagcattcgttacgtgtagcacgagttgtttttgggagtttgcaactcatcagcggtaaatttgttctcgttccacagaacaagataatgaagcaggctggcttgttccctgaatgccagcattggtacatatgtagcaatcaaattccatcagatggtaaatcttcgaatcaataacagtgcaaagaacaggcaggcagcatatttccggcttctatcaatagtatgtttcctgccaatggtggtgaaagccggcaagaacctccaagatcggcacgaggaagaggtgaagaatcgcaggcatggagaagaaagcatcatcagcgagaaacagggcaagcagcatcagcctgaattgtaagcgtaca

SEQ ID NO: 7904 - DNA, 614 bp, Hordeum vulgare
  Predicted polypeptide sequence is orthologous to G1146
gtggggaaacatatacagggtcgtagcattacatggaatcgtcaggcactgcaaatctggacagatgtttgaatgcgcaggccaataatctggtcaagacaaacagagcaatgccattcgaaaatctgtagggggcagagaggaattgaaatattcaggttgctcagaaaacatggcagcactgacagtctgatacatatagatacacttacgtgatgactgacgatattgcttttctaccacaacgaaaggattgccagatcaacaggtaattcggttggcatcatggcgaagagaggcgttgcccctaaactcagcagtaaaacatgacacgtttcacgttttccttgaggtcaggcagaggcttaacagcaacattccctgcagctctactgccgccgcgtgcgccagtagggccacggcctgtcgtggcaccactcgcgaccgagccaccgtcggaggtatccagttccatgtagaaccgagctcgaaaagccgcgaggtgagcatagtatgccggaggcacaatcgatacagaacgggtgcaccttgcgtaggtgtagcacaggttgttcgtgagagtctgcaaaccatccgcggtaaaattgttctca

SEQ ID NO: 7905 - DNA, 661 bp, Hordeum vulgare
  Predicted polypeptide sequence is orthologous to G1146
actgaattacctattggaaatgaaactgctcgctatggacactcctatccgttttcccactaggctcctacacaaatattgagaattgtagaattaacttgactcttagtaggccaaacagcctcaaagtttcggatggctatacatttgcgtgtgcataaaatatttcggaacgcaaagtctacaatacagaaatggtatttcgtctataatgacttgacacagctaattctgtaactaacaccgaaggttatggtttaatgattctcattctcatgcaatgagcttagatgtagtacatggaatccctcatactcggcggaataacaatgtcctcgatcgtttggttggtgccgccactcatcacactctgggcctcacttgggtcgaaaacttcagataagtagcagcgtacccttgtgcagagtaaatcagcatagtaagcaggaggacaaagactgacggcttttgttgctcgtccaaacagatgactcatattgtttgtcaattcctcaagggcatcagcgtgatttttgtgaccacccttaaccttattggaccggaaaatttcgtctattatcacatagtaatgacaggcacgtgctgttccctgaagacatgcatgggcttgtaggtaaaagtcccagtttcgagtctctgt

SEQ ID NO: 7906 - DNA, 700 bp, Hordeum vulgare
  Predicted polypeptide sequence is orthologous to G1146
agttgttagacataataattttattggcacatacaaaaagcggttcatacatatggaggcgcagaccatgtccaacaccacgcgacactggtgcattctccggcaggtgcacgcgcttccacttgggcagtagttacttctcgctgatgcccatcaccgttacgggttaccgctactacttgtcttgctccttggcgtctcctgctactgatcttcgaagccttgtgctaccgtcggagaagagtgaaccagccagccatgtccatgtgaccacacacaattttatgtttcctgtgagagcttaaattgcatattccacttgccaacttttggccagaatactttctccttgccttggtcaccaaatttcagcataggagggggtagcacacgacccttaattattgttagtctgttctcaaaagtcacaccgaattcctttgcatatggatcctcattgtatgggttcacaatattttcttatccgacgatcttcttcaccacctccttgcctttgatcaggaagaaggtgggcatggccttcacccccagcttggaagacgcgtccaggacatcgtcgacgtcgacgaagaggaagagcatgtcggggtgggtctgggcgagctcctcgaacttgtagcgctcctcgcgtcatgaatccgctcacggatgcatcttcttgagcccttccctccgctgc

SEQ ID NO: 7907 - DNA, 555 bp, Hordeum vulgare
  Predicted polypeptide sequence is orthologous to G1150
gccggccgacgcactactacatgctgaagaacgcgcacggcttcgagcgcgtggacctgcagaagctggtgtaccgcatgtgtttcgtgttcgcgcgctgcaccaagccggtgtcgctgacggcgcccatcaagtacgccgacatcgcggcctaccgtggcagggactactacgacagcaggatggcgtccctgcagtaccaccaggtccccgcgggtcctcccctgttcagggatatgcccgaggtgcacgaggctctcaaagacagcatgttcttcatctgatggcgcctgcttttcagcgtggtaagccccaatccaaccctgcgttctgcttcttgtctgcgccttcttgctgtgtatggtgaaggcctttggcgcttctgttaaggtacatgtttgctgtgttcagtactacaatgctcgtcaaattgactctttacagctttgctgtgttctgtacatgctcgccaaattggctcttacagctttgctgtcttgtgtacatgctcgccgaattggcttgttacaaacttgttctgcacaaaaaaaaaaa

SEQ ID NO: 7908 - DNA, 1220 bp, Hordeum vulgare
  misc_feature (1034)..(1034): n is a, c, g, or t
  misc_feature (1056)..(1057): n is a, c, g, or t
  misc_feature (1111)..(1111): n is a, c, g, or t
  misc_feature (1137)..(1138): n is a, c, g, or t
  misc_feature (1155)..(1156): n is a, c, g, or t
  Predicted polypeptide sequence is orthologous to G1190
cggagcgccgctctagaactagtggatcccccgggctgcaggaattcggcacagcggcagcgcatgaagcacgacgacggcaagtggaaggcggccaccaagcactacaaggcgctgctgcccgcgctggggagcgacaaggtgcggaacgtcatggacatgagcaccgtctacggcgggttcgcggcgagcctcgtcaaggaccccgtgtgggtcatgaacgtcgtcttctcctacgggcccaactccctcggcgtcgtctacgacagagggctcatcggcactaaccacgactggtgcgaggccttctccacgtacccacgtacgtacgacctgctgcacgccgacggcctgttcaccgcagaatcgcacagatgcgagatgaagtttgtgcttgttgagatggaccgcatccttcgcccgaccggctacgccatcatccgggacaacccatacttcctcgactccgtggcctccatcgccaaggggatgagatggacctgcgacaggcatgacaccgagaacaaggagaatgagaaggagaagctcctcatctgccacaagcagctctggtcggcaaagaaggcatagatacgatacgaaccagcagtcgcggtgacaagaattgggcatgatcccaatgggaaagcgagggtgattcatagtcagcaatttgatagacaagaggggtcatagtcatcaaaataaatacatgagttaatatatatagtttattcctattcataactgtatcatataggaggtccaatattagcaattgtctcacaacagttgttctttttctttccgaaaaaccggggagtaaaatttgtgagcgacggaagccgcagtggtatcaaatatatatgattcctaaacaatcattcttgttgtatcaagaatcagcggtggcattatattattttcaacaaaaaaaaaaaaaaatcgggggggccgaacccaatcccctaagggggttatcggcgcttcgccggctttaacctggccgggataccggcttcccccaaaccctngggccctcttactcataggagnnttaaaggtctcttccctctcctctcctaatctccagtgaggggaaagaaggggnggggaaaaaggagaagagaagggggnngttttgttttgcgctcnngggaggggacccccggggagagggggggcgcgaaggagggggggcaggggagaaggagcgagtg

SEQ ID NO: 7909 - DNA, 744 bp, Hordeum vulgare
  misc_feature (14)..(14): n is a, c, g, or t
  Predicted polypeptide sequence is orthologous to G1206
ttcttcctgagctnactttttctaagagaacatcgatcttttgcatagtccacctttcctcagttattgtgccagagaggttttggcagcactatacattttactcaacaccgttgtcatcaatttgtcctatcacacaaatccctcaagagacaatgtcagcaagcaaacggggaagagtggtaatgctccttcagaatgttcacggcatgatcaacggcatatattatcatcttcttcacctctaatttatcttcttttgccctgtggttcttaggaagcacacggaattgttgagttaacttgacacactcctggacattctcaggtgatacaaaatctatagcaattttcgtgcaagacttgagattccgtacttgatgcgggcacccagcagggataaaaactgcctctccaagtttttgtacaaatgtccaaggctcgactccatgctcctctttaagtctccttttatgttcctcagttagatagaatgtttcatcgtgtagagggttaaatgtcttttcaactggagaacaatatatatggcgaaattccttggaatgtttacgaaggtacgtttccagttctggaacgtcctccctcctgaaaatatcccataaagcacctccctcatcgtccttgctgtagttaggagagggtgtatggtttgaatccacgcaatttttgtgacatgcattacttccatcaattgaaaaattgccacaacattccttttcatct

SEQ ID NO: 7910 - DNA, 877 bp, Hordeum vulgare
  Predicted polypeptide sequence is orthologous to G1242
agaatttggtggtcgagctacctaggagagaaaggataaagagttacaatgagtctgaatgcttcaagcaagcacttcgccaagcagcaccagctaaacccaaggaactacggattccaaaaatgccaactttgcatgacttgcagttcttcaacagtcaaaggctaaatgagttgtatgaaaaggaagtccgatacctcgtgcaagccaaccagaagaaagataccactgatggtgaagatgaagatcagttggagccttttactgcagaggatgaggcggagaagaaacagttattggaagcgggttttgcaacatgggctaagagagacttcaacacatttattcgtgcatgtgagaaatatggtcgcaatgacatgaagagcatatcctctgaaatggaagggaaatcagaagaagaggttcaacgatatgctgaagttttcaaggagagatacaaggaactgagtgattatgaaagaattatgaaaaacattgaaaggggtgagggaaggataaatcgcaaggatgtgattatgacagccattgggaagaagttggaccgctataagaacccatggttagagttgaaagttcagtatggcacaagcaaagggaagttctataccgaggaatgcgaccggtttatgctatgcatgggacacaagcttggttacgggaagtgggatgaacttagagctgcctttcgcaagtcacccttggttcgaattgacttgtttgggaaagcgagaaatggccaagaactggctaggcgatgcgacacgcctgtcccgcttaattgggaaagagaatcaagaatacgatgaacgaaaagagccggcccgggaaagaaaagagagcttgcttaaaagagaat

SEQ ID NO: 7911 - DNA, 809 bp, Hordeum vulgare
  Predicted polypeptide sequence is orthologous to G1242
aatgcgggcaatatcttcattccttatatatgctatccttggaaacaaatacaatttcagcaaccaatgtcaacatcagcttctcggtattggcagctaatacaggacacaacaacaaaatcacattactacttgttccacttttaacatttaacatgaaaaataattacattacatgtagtgagaagaaacaaaagcaatttttctgttctgcctatcaatcctgctatatgaccaaagcatccaaggcaagcttcttatatatgctctctcgattactttttgctcaattgtatatactgcgatggaacattttctgtatcacacaaataaaagatatttctactcttccataaatatcaattaaaaacctcggcgcaaaaatggaagatatgaacttttttaacagttctatgtgcacgaacttcagcttgcaaatccactggagcaccagagtgtatgcaagcaagctttggtttgtatcccacataagacctctttttaacctggcaaggtcactaatttgtgttgctgatatttcatggcaacagagagggtattttgagaagagaactgcaaaataaagacctgaagaagacaatatcaatttgtaatagatcaagacaataccaatttgtaatagatcagtaatttgtttgcactataaaacaaatgttgagcttctttgaattctgaagtggagagcaaacttattgtattaggtacacctagctagatgcgctttgctgcatcatggtaagaatgccatggttatgaacgttatcaaaaaacaaaaattaaatacatct

SEQ ID NO: 7912 - DNA, 1070 bp, Hordeum vulgare
  misc_feature (657)..(657): n is a, c, g, or t
  misc_feature (678)..(679): n is a, c, g, or t
  misc_feature (693)..(694): n is a, c, g, or t
  misc_feature (741)..(741): n is a, c, g, or t
  misc_feature (798)..(798): n is a, c, g, or t
  misc_feature (870)..(870): n is a, c, g, or t
  misc_feature (913)..(913): n is a, c, g, or t
  misc_feature (972)..(972): n is a, c, g, or t
  misc_feature (1040)..(1040): n is a, c, g, or t
  Predicted polypeptide sequence is orthologous to G1272
gtgaagtctaaacttcctggggctcccaagtttctgttgtgtgtccttgccgagaggaagaactctgatgtttatggtccatggaagcgaaaatgccttgctgactttgggattgtcactcaatgtgtggccccaacaagggtcaatgaccaatatctgacaaatgttttgctgaagatcaatgcaaaacttggtggaatgaactcactgctacaaattgaaatgtccccaagtatacctcttgtatcaaaggtcccaactctcatcttgggaatggatgtgtcccatggatcccctggacagtctgatataccatccattgcagcagttgttggttctcgagaatggccccttgtctcgaaatatagggcttcagtgcgctcgcagtcaccaaagctagaaatgatagattcattgttcaagccacaaggaactgaagatgatggccttgttcgggagtgtctcattgacttctacaccagttctggaaagagaaaaccagatcagaatatcatcttcagggatggtgttagcgagagccagtttaatcaggtgctgaacatcgaattagatcaaattattgaggcctgcaaagtcttggatgaaaattggaaccccaagttcacactgattgttgctcagaagaataccacacanagtttttcatgcctggatctnnctgacatgtccctnnctgcactgttgttgataatgctgtctgccatccaggaaatatgactnttacatgtgcgctcatgctggaaatgatggggacacagggccacacattaccatatnctgcatgatgagaatacacttgccgccgatgacttgcaggatcttgggcattccctctcttatgtgtaccanaggagccaacagccatatcaggtggtgtctcaatctgttatgnactttgcagctgttcagggggcgcatttcataaagtttgagtagattccccgaccttgntcgaacaggttgttggacacactttcttgccacggccgggcagagctgctctctcttgagaacccganacatgtttttgtagcattacactgccgtta

SEQ ID NO: 7913 - DNA, 1009 bp, Hordeum vulgare
  misc_feature (869)..(869): n is a, c, g, or t
  Predicted polypeptide sequence is orthologous to G1272
atcttcagggatggagtcagcgaaagccagtttacccaggtgataaacatcgagcttgagcagatcatcgaggcatgcaagtgccttgacgacaagtgggagcccaagttcacagtcattgttgctcagaagaaccatcacaccagatttttccagacaaattcgccagaaaatgttcctcctggtacggtggtggataaacaagtgtgccatcccaagaactttgacttctacatgtgtgcgcatgctgggatgattggcacgtcgaggccaacgcattaccatgttctgcatgatgagattggcttcagcgcggacgagctccaggagtttgtccactcgctttcttatgtgtaccagaggagcacgacggcgatttcagtagctgctccaatagcgtacgcgcatctggcggcggcgcaagtgggcaccttcatgaagtttgaggacatgtcggacacttcgtcgagccagggagggggccacacgtcggtgggcagcgcctcggtgccggagctgcctcggctgcatgagaaagtgaagagctccatgttcttctgctgatgggctcggcttgtgtcgacttgatagatgctgaacttcgtcaccgggtggtctgattaaaaactatttatctatctatcaatctatctaatctaaggttgtagggtgcacttggaactttacttggtgggtgcccgtaaaatgaacaataaatcggtagtgcgttggttgcgcttctggagccaacggaaatgggccatgctttcgtcctgtgggggggttgtagacaacaacaaaccaactacttaccttttggaaactgggagggtggtgggcgaataagaaataattggggagaaaggcantgattgtgacacagttgtgtgaggtgaggggctcttttgatgtacgaacaatagaacgacgtccgcgatgatgaggaggtagtagaagcggggggcgagagcgaggtgagaggtgagtgtcgcccattacagagtgggag

SEQ ID NO: 7914 - DNA, 2263 bp, Hordeum vulgare
  Predicted polypeptide sequence is orthologous to G1313
ccccctccctctccctcctccctcaaaactctctctccctccctgaaaattctccgcatactggtgcccaagtggtgccggcatcccgctgagggcagagagagagagagagaaagagatcctcctcccctgtccccactcccctgatccgccgccgagccgggacgaggaggaggaggagctgcagctcagctccgccccagctcagcccccggagcccgagctgatcgacccgccggcagcgagattcggccagggcacgatcgacggagagatgtaccgggtgaagagcgagagcgactgcgagatgatgcaccaggaggaccagatggactcgccggtgggcgacgacggcagcagcggcggagggtcgcctcacaggggcggcgggccgcctctgaagaaggggccctggacgtccgcggaggacgccatcctggtggactacgtgaagaagcacggcgaggggaactggaacgcggtgcagaagaacaccgggctgttccggtgcggcaagagctgccgcctccggtgggcgaaccacctcaggcccaacctcaagaagggggccttcacccccgaggaggagaggctcatcatccagctccactccaagatgggcaacaagtgggctcggatggccgctcatttgccagggcgtactgataatgaaataaagaattactggaacactcgaataaagagatgtcagcgagccggtttgccaatatatcctgctagtgtatgcaatcaatcttcaaatgaagatcagcagggctccagcgatttcaactgcggcgagaatctttccagtgacctcctgaatggaaatggtctttatctgccagattttacctgtgacaatttcattgctaattcagaggctctatcttatgcaccacagctttcagctgtttcaataagcagtttgcttggccagagctttgcatccaaaaactgcggcttcatggatcaagtaaaccaagcagggatgctaaaacagtctgaccctttactccctggattgagcgacaccatcaatggcgcgctctcctcggtcgatcaattctcaaatgactctgagaagctcaagcaggctcttggttttgactatctccacgaagccaactctagcagcaagattattgcaccatttgggggtgcgcttactggcagccatgcctttttaaatggcaccttctctacttctaggaccatcaatggtcctttgaagatggagctcccttcactccaagataccgaatctgatccgaatagctggctcaagtataccgtggctcctgcgatgcagcctacggagttggttgatccgtacctgcagtccccgacagcaactccgtcagtgaaatcggagtgtgcttcgccgaggaacagcggcctcttggaagagctgcttcatgaagctcagggactaagatctgggaagaatcagcagctctccgtgagaagttcaagttcctctgtcagcacgccgtgtgataccacggtggttagcccggagtttgatctctgtcaggaatattgggaagaacgtctgaatgaatatgccccattcagtggcaattcactcactggatccaccgctcctatgagtgctgcgtcgcctgatgtttttcagctctccaaaatttctcctgcacaaagcccttcactgggatctggagagcaggcaatggagcctgcatatgagcccggggcaggggacacttcgtctcatcctgaaaacttgaggccagacgcgttcttctccgggaacacggcggactcgtccgtcttcaacaacgccatagccatgctcctgggcaacgacatgaacacggagtgcaagcctgttttcggcgacggtatcatgtttgatacttcggtgtggagcaacttgcctcatgcttgtcaaatgtcggaggaattcaaatgagttcctcaccgaacctccagcggagtcgaaggagattcttggtatccctcaccctgattgttttgaggaaaaattcagagaaagcctcatcgattgtatacgctgctgcgtgcgtacgcggctgctaccagatgcgctctccgttcaactaagccccttttccccaataaagttggcggagataagccggttatctattttttgtttgtttgtttcgaactagagaacccttttttgtcatctctgtggcatttatttgaacaatgtaagatcagttactgcttaaaaaaaaaaaaaaaaaaaaaaaaaaaaaaaaaaaaaaaaaaa

SEQ ID NO: 7915 - DNA, 288 bp, Hordeum vulgare
  Predicted polypeptide sequence is orthologous to G1313
gtctcccggggtgcaaaccacagggagtgaaatttccgcttttcgcagagctcaagaaaggaagtctgaagagtgtcgtgtgaacatgattaagttctgagcgactgactggttgactgcttccaaatctgatgcatgttaccacaagatttgaagcttggatggtgggaagtgacctgtcctgctttgtaaattgcactaataggtagatttcgaccggctatgtttttatacttgtagtcggtcggtgtgtgggaagttgggatgagaatgaacaaaaaaaaaaaa

SEQ ID NO: 7916 - DNA, 568 bp, Hordeum vulgare
  misc_feature (444)..(444): n is a, c, g, or t
  Predicted polypeptide sequence is orthologous to G1328
gcgaaggggagattccagttgaagcctcttgttgtgactgaattgattcaggtatgtagcatgcaagcagagcaaaggatgaacttaacaattaccaaatctacctcatttgatttgataagcacctcctttctctaacgtcatcagttggggtggaacctagtctccaagcagcatacacaatttttctccaatttcgtcgtttttcttaaagagaaatagcataaggagaaaccattactgattcaaaagataaatggatgattatatgggtgcatggcaactatacaacaattatgaagacgatgttcctgttcatgataatgatgatgatgatggaggctttcagttttaattaagttgtagggaatggagttcttgctagatgatgttcctcgttaagttttagataagttgtacgaatgttgatggatggttcaagtntaagttttcttgtgaagaaaatatttagattgcacatcacatttgggatgatgttcctcatgtaatatcattactgtaatccaacaattttatctaatatatgatttcttccaaaaaaaaaaaa

SEQ ID NO: 7917 - DNA, 697 bp, Hordeum vulgare
  Predicted polypeptide sequence is orthologous to G1363, G1782
gccgatctatgtaaatgcgaagcaataccatgccattctccgaaggagacagctccgcgcaaaattagaggctgaaaataagcttgtcaaaagtcgcaagccgtacctccatgagtccaggcatcagcacgcgatgaagcgggctcgggggacaggcgggcggttcctcaacgcgaaggagaagtccgaggcggcttccggtggcggcaatgcatcggcgaggtctgggcatgccagcgttcctgcggacggcggcatgttctcgaagcacgaccacaccttaccgtccggtgacttccattaccgcgcgagagggggcgcctagggcggcgccgttgccccctggcaaatcatccttggcttatgtgtgtggcgaccgtcaactcggtcgaatgataatactgtagtaaactgaaagatttggggattgaaactgttacttggggtgtttggtagacagtctgttccgtttggggacgaagcgggccagtctctctgttgggggttgattcatggcacgggatgtgctgctaagctggagccctgcttagaactgttttgctggaacttttatggggtaataagggacctgatgtttgatactgggagcactcctgagtcggcgtcaattaccattcgccggcgttgatcctttgcgcacgtggggggtgtgtttatttagaactagaaaaaaaaa

SEQ ID NO: 7918 - DNA, 898 bp, Hordeum vulgare
  misc_feature (537)..(537): n is a, c, g, or t
  misc_feature (641)..(641): n is a, c, g, or t
  misc_feature (706)..(706): n is a, c, g, or t
  misc_feature (741)..(741): n is a, c, g, or t
  misc_feature (743)..(743): n is a, c, g, or t
  misc_feature (745)..(746): n is a, c, g, or t
  misc_feature (847)..(847): n is a, c, g, or t
  Predicted polypeptide sequence is orthologous to G1363, G1782
atctttctcggtccaaggaagattccaccggacagggccagaggagaggatctcgaagggagaattcgggggagagaaatgttgattggagctaagtgataccgtcatataacgctaaaacttgtgcgtacaatggaggatcatcctggccatcctatttccaactatgatttcctgtcagggaatggctgtcattcgaagaaattagttgataagaattacgaccaggactcctcatcaaccaagtctgaccggtcacaacaagaagcacctgcaatgactgacagtagtctaaatgagcaacacgtctcaagaccctcatcacaatctgacaatgacaatgatcatgggaagcctgatcagcacatgataaagtcactgttatctttggggaacccagatactgttgctccccctccaatgcttgcctgtagccaatcatttgcatatattccttatcctgctgatgcttacgctggggtctttccaggatatgcctcacacgctattgttcatccccaattaaatgctgcaacnaaactctcgtgtgccgctccctgttgagcctgcagcagaagagccaatgtttgttaatgcgaagcaataccatgcaattcttaggaggagacagatacgtgctnaattggaggcccccaaatagctggtgaaagcccggaagccataccttcatgaaatctcgcaccgncatgccatgaagcgagctcgtggaacaggagggcngntnnctcacacaaaggcactcgaggagcagaagcagaagcaggcttcaggtgggtgcagctgtacaaaggtccttgggcagaatacagtccttcagagtagtccnaccttgcacccttggcatcagctccttcacatgtcagcttttcacaccgga

SEQ ID NO: 7919 - DNA, 718 bp, Hordeum vulgare
  Predicted polypeptide sequence is orthologous to G1363, G1782
gagagggagcgcaaagggacggcggaggaggcaagcttagcttcccggggcggaggcaccgagagactaggagaggacgggagggaggaggcgcgtgggagccatgcttctcccctcttcgtcttcctcctacgatcccaaaggtgactcctttgggaaatcggttgacgattctatgaggtcaactttgacttttggggaaaagcattctgtatttacaagtcaaaacactgactatggccacccaatggcttgcatttcatacccattcagtgattctggttctggagtttgggcagcctatgggtcacaggccatgttccatcccctcaccgcgggaggagggtcatctgcaacagcaagggttcccctgcctctcgaattagcggcggatgagcccatatttgtcaatcccaaacaatacaatgggattctccggcgaaggcagctgcgcgctaagttagaggcccagaacaaactcaccaaaaacagaaagccctacctccatgagtctcgtcatcttcacgcaatgaagcgagcaagaggctccggtggacgtttcctcaattccaaacagctccaacagcagcagcagtctggcagtgcctgcacgaaggccattgcggatggcgcaaattccttgggctcaacctatctacgggctgggtagtggcgcagccggagatcgacccacctcggcatccaagacgatatcctc

SEQ ID NO: 7920 - DNA, 180 bp, Hordeum vulgare
  Predicted polypeptide sequence is orthologous to G1380
tttttttttttttttttttccaaaaccccaaagaaagggttcttgaaccaaaaacccaaacaaggttctttacgggatctaaaacaacaaatctccaaggaacttttcggacccccagaaaacagggaacttcgaaaaggcccccaacttgtttgctagaaaccccctaaaaccaaaacg

SEQ ID NO: 7921 - DNA, 2354 bp, Hordeum vulgare
  Predicted polypeptide sequence is orthologous to G1382
agatcatgcatcgttgagccgcttggtgggcgagacggctcgatgggctccccgagcgggcacgcgggctcgatgaagtactccccgtgcttcacttctgcgccacggtgatctccttgggtcgggtccaagccgaaacctagctccggggacctcccctcgcccgccgggagctcgcccgagaagccctaccccgcggatcgacgcgtcgcggcgctcgccggcgcgggcgcgaggtacaaggccatgtcccccgcgcggctgccgatctcgcgcgagtcctgcctcaccatccccgccggcttcagcccctcagcgctcctcgactcccccgtgctcctcaccaacttcaaggttgaaccttcaccaacaactggtagtctgggcatggctgcgattctgcacaagagcgctcatccagacatgctgccttcgccacgggataaatctgttcgtaatgcccatgaagataggggttctagggattttgaattcaagcctcatctgaattcgtcttctcaatcactggctcctgctatgagtgatctaaaaaaacatgagcattctatgcaaaatcagagtatgaatcccagctcatcatctagcaatatggtgaatgaaaacagacctccctgttcacgtgagtcgagtcttacagtgaatgtaagtgctcagaaccaacctgttggaatggttggtttgactgacagcatgcctgctgaagttggtacatctgagccgcagcagatgaatagctctgacaatgccatgcaagagccgcagtctgaaaatgttgctgacaagtcggcagatgatggctacaactggcggaaatacgggcagaagcatgtcaagggaagtgaaaaccctagaagttactacaagtgcacacatcctaattgtgaagtaaaaaagctattggagcgtgcagttgatggtctgatcacggaagttgtctataagggacgccacaatcatcctaagccccagcccaataggaggttagctggtggtgcagttccttcaaaccagggtgaagaacgatatgacggcgcttcagctgctgatgataaatcttccaatgctcttagcaaccttgctaatccggtacattcgcctggtatggttgagcctgttccagcttcagttagtgatgatgacatcgatgctggaggtggaagaccctaccctggggatgatgctactgaggaggaggatttagagtcgaaacgcaggaaaatggagtctgctggtattgatgctgctctgatgggtaaacctaaccgtgagccccgtgtcgtcgttcaaactgtaagtgaggttgacatcttggatgatggctatcgttggcggaaatatggacagaaagttgtcaaaggaaaccccaatccacggagttactacaaatgcacaagcacaggatgccctgtgaggaagcatgttgagagagcatcacacgatcctaaatcagtgataacaacgtatgaaggaaaacataaccatgaagtccctgctgcgaggaatgcaacccatgagatgtccgcgcctcccatgaagaacgtcgtgcatcagattaacagcaatatgcccagcagcattggtggcatgatgagggcatgtgaagccaggaactacaccaaccaatattctcaggcggctgaaaccgacactgtcagtcttgatcttggtgttggaatcagcccaaaccacagcgacgcgacaaaccaaatgcagtcttcaggtcctgaccagatgcagtatcaaatgcaaaccatgggttcgatgtacggcaacatgagacatccatcatcaatggcagcgccagcggtacaaggaaactctgctgcccgcatgtatggttcgagagaagagaaaggtaacgaagggtttactttcagagccacaccgatggaccattcagctaacctatgctatagcagtgctgggaacttggtcatgggtccatgagagggaatgagagtgtctgcaaatgctcatagctccatgaatcatatattaccaacaatgctttgtaatgacaatctcttcagcaagattctcaattgtctcaattgtgtatcggttacaagtcagttcagccggaggcaagtatgctagtataagctatacgtgggggcactgcagcaaatacgcatgtgtctttttaagtgcggaaaaggcccttgctgtatgtagcatcgcagccctacattcgttgtacagcgaacctaatatgattaattaattagattatgagaatttggtttcgtgaactgtctaatcttctgtactggaatattgatagaaatatagattatggtaattttctttaaaaaaaaaaaaaaaaaaaaaaa

SEQ ID NO: 7922 - DNA, 485 bp, Hordeum vulgare
  Predicted polypeptide sequence is orthologous to G1451
cgtgatctgccagctgcacgacgtcacaatgcatgccgatgtggagaccgacgaagtgtacgcgcagatgacgctgcagccgctgaacccacaagagcagaacgacgcctacctgccggccgagatggggatcatgagcaagcagccgaccaactacttctgcaagacgctgacggccagcgacaccagcacgcacggcggcttctccgtgccccgccgtgccgccgagcgcgtcttcccccctctggatttcacgcagcagcctcctgctcaggagctaattgcgcgggatattcatgacgtcgagtggaagttcagacacatcttccgaggccagccaaaacgacacttgctaacaactggctggagtgtctttgttagcgccaaaagactcgttgctggagactcagtgctattcatatggaatgagaaaaaccagctttggctgggaatcaggcgtgccaaccggacacagactgtgatcg

SEQ ID NO: 7923 - DNA, 524 bp, Hordeum vulgare
  Predicted polypeptide sequence is orthologous to G1480
tttttttttttttttttttgctcacaagaattcgacatgattctttattcatattagcacttgaaactaacaagagaccgaggaaatacattaatcgcctagtagttcaccaatggggatgatcgaagaacccgcgtcatcagttaaaaatgtcgatggcgggtttttaccatgaatgaatattgactgcaacgacggcacgacaggatcacgggcacggcaggaagaccatggcgccgataggatggcagtatggcatctgcactttgctggatttcgtctcaagctgggcagacgccattgccacggtcaagtaccttcacccttctagaactagaagcttggcacgactccatgggaagcaacgtgaaaccctacgctgttgtcggagaaggagagccagaatttggcggcctcggcggcgctcgtgttgccgtcgtccgtcgccgccgcggcagggcgtttgacgaagcggcccttgaccctcggccgcgcctcggcgtacgccttgcggggaggcgtag

SEQ ID NO: 7924 - DNA, 1230 bp, Hordeum vulgare
  Predicted polypeptide sequence is orthologous to G1480
ccgagcgaaaaagcttggctgagagtcgcctgctcactgcagccaatcacggcggtggcgctggtgctagctgcgcttgtcgaactgtgagcgcgtgccatggagggggaggagaagccggtggtcggcggagcctactggggcgtgggcgcgagggcgtgcgattcgtgcgccaccgaggcggccaggctcttctgccgcgccgacgccgcgttcctctgcgccggctgcgacgcgcgcgcgcacggctccgggtcgcgccacgcccgggtctggctctgcgaggtctgcgagcacgcgcccgcggccgtcacctgcaaggccgacgccgccgtgctctgcgcgtcctgcgacgccgacatccacgccgccaacccgctcgcgcgccggcacgagcgcgtccccgtcgcgcccttcttcggcgcggccgccgacgcgcacaagcccttcccgtcgtcgggagcccaggccggcgcggcggcctctgccgaggacgacgggagcaacgacgccgaggcggcctcgtggctgctccccgagcccgatcacaaggatggcgccaacggtgctaccgcggacgtcttcttcgcggattccgaccattacctcgacctcgacttcgcgcggtcaatggacgacatcaaggccatcagcgtgcagctcaacggccagcccgagatcgacctcaatggcggcaacaaaggcttctactccgaccactccatgaaccacagcttatcgtcgtctgaggcggcggtggttcccgacgcggcggcggcgccggtggtgagcaggggaagggagcgggaggcgcggctgatgcggtacagggagaagcgcaagagccggcggttcgagaagaccatccggtacgcgtcccgcaaggcgtacgcggagacgcggccgcgcgtcaagggccggttcgccaagcgcacgggaacggcggacgccgacgccctggaggagcacgaggagatgtactcctcggcggcggccgccgtcgccgcgctcatggcgcccggccccgaccacgactacggcgtggacggcgtggtgccgaccttggtgtaattttgttgcatgcatgcacgcacgcaaagcctcgtctagcatttgatcactcaattgtatatgcatgattacgcgggagcgatccagacttccaatccaaccccccctccttaatttttgcccgatccctgtatttttcacctgtagcatatcatcatc

SEQ ID NO: 7925 - DNA, 1056 bp, Hordeum vulgare
  misc_feature (487)..(487): n is a, c, g, or t
  misc_feature (739)..(739): n is a, c, g, or t
  Predicted polypeptide sequence is orthologous to G1480
cggcacgaggtcgttcggcggctcggtggacggggagaagcaggacgccgtggtgaacctgaacgacgctctggaggccggccccgacgggaaggagaacgtgaagctggacttcctgttcgcggacatgatggaccctttcttcggctccgagctcccgcgcttcccgcacgctgacagcgttgtccccagcggtggcgcggtggaactggacttcggtggcgttgccgccgccgcagccgtcgtttccaacccgtcctacagctcctacacggcggcgtcgatcggtggaagcggctcctcgtcggaggtcggcttggtgccggacgcgatctgtggccgaggcggcggcatcatcgagctggacttcgcacagtccaaggccgcgtatctgccgtacacccccacgcctagccacagtactgtctcctcggtggatgttgggcctgtgccggagcggagcgaaagcgccgtcgcggcggcgacnccggcgatgggggaggggagggaggcgcgtttgatgcggtaccgcgagaagcgcaagaaccggcggtttgagaagaccatccggtacgcgtcccggaaagcctacgccgagagccggccgcgcgtcaaggggcgcttcgccaagcgcgccgacgacgccgacgccgacgccgtcgcagcgggcacgatcaccgcgccgcgtccctgcgtgctcgacttcagcggctacggcgtggtgcccaccttctgaggnggcgcctaacttcgtgtcctgcttcctccggcgaacgtgccggctgcgtgcctaattaacccggcgcggcatggccggcacgagcgcgccgacgtgcatgcgtcgtgttccctcttgtataattgcatgtaatgtttttcgagctggctgatcgctggctggagtggagtatactgctgacatgcatgcgcgcacgcatgtttcgctagaactagaatagaataatgcagatagttctagctgactagtctacctgtacccttttttgggctagcttgatgggaaattatgctagggcgacgtaacgtctttgctgg

SEQ ID NO: 7926 - DNA, 1455 bp, Hordeum vulgare
  Predicted polypeptide sequence is orthologous to G1480
cagcgccattgcctgccggagctaagaggatcgaccgggtacgctcagcttagggctattaggtagttagttatgatggagctgcgcaagtactggggcgtggggggaaggcggtgcggggggtgcgagggggcggcgccggcggcggtgcactgccgggactgcgcggggtacctgtgcacggggtgcgacgcgcgcccggcgcacgcgcgggcgggccacgagcgcgtctgggtgtgcgaggtctgcgaggtcagccccgccgccgtcacctgcaaggccgacgccgccgtgctctgcgcggcctgcgacgccgacatccaccacgccaaccccctcgccgagcgccacgtgcgcgtgcccatcgcgcccatcggctcccccgaggccgccgcggtggccgccgaggccatgatgctctgcggcgccggcgacggggacgccagggcggatcccgacgaggtgcacgaccagttgcaccaccacggacacgggggcatgctgaacctcaacgtggaggccggcaaggagggcgggaagatggactacctcttctccgacctcgtcgacccttacctcgccgtcgactttacccgcttcgcccacgccgacagcgtcgtgcccaacggcgtcgccaccgccgcggtacccgccgtcgtcgacctggacttcgcgtgcgggatcggcgccaagccgccgccgtcctacagctcctcatacacggccaacggctccggcgcgcacagcggctcatcatcggaggtcggcgtggtgccggaggccatccacggcggcgcggggagcttcgagctggacttcacccggcccaagccgcaggcgtacatgcccgcgtacaccccggcgccgccgagccacggcgtgggcatgcagcaggcgtcggcggtggacatggggtacctgacggtgccggagcggccggtggcggtgaccggggagggcagggtggcgaggctgatgcggtaccgggagaagaggaagaaccgccggttcgagaagaccatccggtacgcgtccaggaaggcctacgccgagtccaggccgcgcgtcaagggccgcttcgccaagcgcgccgaccaggacgccgacggcgacggcgacgacctggacgcggaggcgcatgccgtgccgtcttccacatcctacttgctcgacttcggttacggcgtcgtgccgtccttctgatccgtacgtcggcgcgcagcacgggccggccgccttgtacttgtaccattgatgcatgtacagagtaccgtaggggactagtaatccatgtactctcctgagctagttcgatcgcgctagtgatgtactagtagcaatactgtaaactgtaacagtagtattctggccaatacgctcgtttaattttggatcgccgaaaactagtactactagccgcaacatatggatcatcaattattattccgttttact

SEQ ID NO: 7927 - DNA, 539 bp, Hordeum vulgare
  Predicted polypeptide sequence is orthologous to G1480
taccctgaacactccatgaaccacagcatgtcaacgtccgaggtagcggtggttccggacgcgctgtcagccggcggggccccggcgccagcgccgtcggtggcggtggtagcgagcaaggggaaggagcgggaggcccggctgatgcggtaccgggagaagcgcaagaaccggcggttccagaagaccatccgctacgcgtcccgcaaggcgtacgccgagacgcggccgcgcatcaagggccggttcgccaagcgcaccgccgaggacgacgcgctggagcaggacgggccgttctcgcccgcgtcgtcggcgcacctggcatcggacggtgactacggcgtcgtgccgtcgttctgaggactctgctatagttttggcgcgcgcatccgtccgagtgcgcgcgagtgcggggtggctgcgacgcgtgctccgtgtaacattgaataatctgtacagttttgttccatgggattagtactgtgaccgtgccgacctgatgtactcactgttttccttctcccgaatccagtttttgt

SEQ ID NO: 7928 - DNA, 902 bp, Hordeum vulgare
  misc_feature (45)..(45): n is a, c, g, or t
  misc_feature (54)..(54): n is a, c, g, or t
  misc_feature (658)..(658): n is a, c, g, or t
  misc_feature (662)..(663): n is a, c, g, or t
  misc_feature (665)..(667): n is a, c, g, or t
  misc_feature (670)..(671): n is a, c, g, or t
  misc_feature (673)..(674): n is a, c, g, or t
  misc_feature (676)..(676): n is a, c, g, or t
  misc_feature (688)..(688): n is a, c, g, or t
  misc_feature (691)..(691): n is a, c, g, or t
  misc_feature (693)..(694): n is a, c, g, or t
  misc_feature (696)..(700): n is a, c, g, or t
  misc_feature (753)..(753): n is a, c, g, or t
  misc_feature (884)..(884): n is a, c, g, or t
  Predicted polypeptide sequence is orthologous to G1482
cctcgggtctgcagggaattcggcacgaggagaatacttatgtgntttgtatanatccttcacttaggtttctgcagtgaggttaacacatttttgtggagtgctgatcagtagctgcgcaagtcatttccatccaagctgaccatttcatctcgtctatctgcagacgagtgatgccaagcaagcgccaagggcgcgaggcgggaacaccagcaggagacgaaacgggcagaagcagaagctgtcgtcgaagcacgatgtctcgtccgaggacgagatgctgagcccgcagcagcccagagtagtatgaccctcgatgcaaccatctggtcccttgtcgccttatgtcctgaccatgtcaatggtcactcggtatcgcactgcagccgatagagcgccagcgccggaagctgttacgaggggggatgcttcgtcgaaggctatgtaggccccccttagaaggtttgtaagagaacctagtgtgtgagactcatcgatgttaccgcattcttttttctcggtttgtgacgctatgttgttgttgttgttgttgttgtggttgttgttgggcattgtactctcgattgattcagtgtccattgctgttatgatggaagaagaaagctccttgttgtggtgaaaaaaaaaaaaaaaaaanacannannnaannannanaaaaaaaaaaanaanannannnnnaaaaatacgtggggggggggccccgccccaattcccccttaaagggggggagntaaccgccgttactactattttactgccacccccgcaactgccacctagtcggcaatcgaccccgttattttgccttcttgcgagtgcgaatgtgtttgctggtcgttgtatttcggccgcttgtagcggnttgaaaaggaaatatttg

SEQ ID NO: 7929 - DNA, 1031 bp, Hordeum vulgare
  misc_feature (872)..(872): n is a, c, g, or t
  Predicted polypeptide sequence is orthologous to G1488
gcctgcactgcaaggcggtggagacgccgcagcggaggtcaaggccgatggggcggggtaccctctgcaacgcctgcggagtctggtacagtaaaaacgggacgctgccggagcaccgtccggtggcaagcccaatcgtcgattcgccactggagagccagatctgggagcccgacgtgcctggggccatctacctggtcagaaagtcggccacggagaggcggcctcccaagacagaagccgcgccagcgccacggccggggacgagctgcttgcactgcgggtcgtcagagccacctttgtggatagaagggtccatggggcggagggaagtctgcaccgcctgcggcatgcggtacaagaaggggaggatgctgccggagtgccgtccagctgggtgctcagtgacggattcctggcagaagagcccaatcatcaactcccctccggagagtcccatctgggagcctgaggcgcctccggccgtgcacctgccaagaaagccttcgaagaagaagaataggaggcggtcgagaagccaagccccttctgtgccatggccggcaaataaggggagaggtgccagcattgtgggtcgtcagagacgccccagtggaaggaggggccaaaagggcgaagcacgctgtgcaacgcgtgcggcgtgcggttcaggccggggatgctgctgccggagtaccggcccatggcaagccccacatttgtggccttcaaacatgccaattcccaccggaaggtgcttcatatgctttggaccaggcctagacacgataagcattcgtcaccgttgcctgccatcaagttgccaactcttaccaatcctgtagaccttccgaacaactaacaagtagttntgcccatgaaaaccgccaaaaatggggctacttgaaaaccataaaacgcccgactgaagtaactatctttttagtaggcgactttccacctctttttttggtaaatatatttaattcttcttctccgcaattataactagagtgaataaaactcttccc

SEQ ID NO: 7930 - DNA, 610 bp, Hordeum vulgare
  Predicted polypeptide sequence is orthologous to G1504
cggcacgaggtgagtgcattgctgagtccaactcgcagcccaagaagaagaagaaggccaagaggccgacccctccagtcacctctgacgctgagggcgacgcggactacgaggaaggcggtggcgccgcgctcccggccggcgaggtgcggaggtgcacgcattgccagatcgagaagacgccgcagtggcgtgcggggcctctggggcccaagacgctctgcaacgcctgtggcgtgcgctacaagtccggccgcctctttccggagtaccgcccggcggccagccccaccttcgtgccagccatccattccaactcccacaagaaggtggtggagatgcgccagaaggttgaacccaagggcgacgacctcctgcagtttatccgccgccgggattgagctccccgcaccggcatcggtcgccggacggtcggtctcgtcccccttagctattatatatgtatacatgctagtatgtatgcattgcatgcttgcttccaagtagtcagtcagtcatcgtcgtccatcgtcatggacagtagtgctcagcattgccttcatgcatccacccaccaccatcatcgccatgcatcggtttcagtcagcat

SEQ ID NO: 7931 - DNA, 661 bp, Hordeum vulgare
  misc_feature (10)..(10): n is a, c, g, or t
  misc_feature (627)..(627): n is a, c, g, or t
  misc_feature (655)..(655): n is a, c, g, or t
  misc_feature (657)..(657): n is a, c, g, or t
  Predicted polypeptide sequence is orthologous to G1506
cgttggcagnacgcacattgtacaatgtaaatcagggcgataatgacggtgcaagcatgaacaaaccgcacaaagccctaccggtgatcggtaaataaagataccatgatgatccaagaacctaagggaaactactgctaccgcctgtttctatgctggttgctagtctacggttgcttgaggcggccctcgccatcagcaaccacgtctgcggaggtggagcttcgggctactgagctaagttgaaatggttggtaaagaagctctgcctctggctgccgtgcattgagaggaacctccagcagcaagtcttgatcagaattatccatgtactgtggaggggccagcatggatattttatctgggggtaacatgagtaagttaaatggcgctcctccagatttgggcaaaaatgaacctttgaactgaggagccatagtcacagatttgcaaacttttttggcaatcctcatggttccttctgggcagctttgcaactggctttcgtgaggccttttgagaggcttcatgttggatttggtaaggtctttcaaagcactggtattttcatttcctcctgtttccttagtgtcttctccctctaaagctactgaaactaaagctgancctacattttccagggtatgctgctttnantaat

SEQ ID NO: 7932 - DNA, 810 bp, Hordeum vulgare
  Predicted polypeptide sequence is orthologous to G1512
actcgactctcggaggccagcgaaccctgggcggcggcgcgcgtgcggattggattccttcccagtaccgtgagttcttcaaccagaactgtctgcaacagatagcatcctgattgctatggaaggtgggggaatggaccaggtttgcatggctgccatgaccaaccaaccttcagtatctgataacaagctgatgaagaacatcagcggggagatgcctgcaacagcaactgctggaagcggctcctttgactgcaacatctgcctcgacttcgctgcagatccggtcgttaccctttgtggccatctctactgctggccttgcatctacgagtggctgcggccatcggtggtatcagctaccagcggcaacagcacttcagcaaggcagcattgccccgtgtgcaaggccatactatttgttgacagccttgtgccactctatggccgtggtggtggctcaaagaaataattggatgggtcggccattctcaaacggtcaaccgtgcaccgtgggaatgttgggcagtagcacccgcgaaccagggtggttgatcctgcgcatcagagcattgggcccggcgctgccgttccaggcctggtggatagactgcgccaagtgctagcttggggcgaccggtgtgtggttgtgtgacactagtataccgaaaggagctagaggggggaagcctagcgtggcttaagcactgatagttagtagtaggcggcgaccatagtagtagagagaccataggaccaataacccggaagtattaagaagtgaggccagacaggatggggaggaatgat

SEQ ID NO: 7933 - DNA, 700 bp, Hordeum vulgare
  Predicted polypeptide sequence is orthologous to G1519
aggatgagctaaatttatactggtctaaatgttaaatgtagtagatgtggcaagaatacataggtggtacagacaagcggatcagcaaaacattcgaccggaaacaggcatacgtacagaaaacaaaaactggtctatcatcctagccattcattcttctaccctacaaaattcgcttgtgtccaacatgaacttatacaagggtatatctatctgtccgcactacaactttttcttatcttcattttcaaacttgtccttggtgctacagcccgactgttcttcaacttcatcgactggttttctactcatcctccttttggtataacaaattatgtcctcgtcttgatggagcctgtggggaatgatacgatcccttgctaccgcaagcaatggtcttctagaaatccgaatgatatatacaaattaaacttgaatgggtaataggagttctgcatagggggcattcaggcttctcattgcaccactccattatgcagttccagcagaagacatgcccgcaggttgtggcagtaggattctgccgggtgctgagacagagagtgcacttgctcttgctactggatgcctctgaaccagaagccaaatctacagctttgccacgacggatgtcactgatgatatttccatcttcatttagaacagggacactccgacctgtagatgaaagatagcttcc

SEQ ID NO: 7934 - DNA, 847 bp, Hordeum vulgare
  misc_feature (643)..(643): n is a, c, g, or t
  Predicted polypeptide sequence is orthologous to G1554
tctggatgtaggagagatcggcatgggcgcagatttgagcctggatttgaagatgttcgcggccaagagcctggggcgggccagggaagcgccggcggccgccatggacgactgtatccggaggctggaggaggagaagagcaagatcgaggtgttccggcgcgagctccccctctgcgcacgcctcctcgctgacgtgattgatgtgatgaagaaggaggtggaggagaagaagagaggtggcgaccgaggagagaacaaggaggacgccggcgcaggcgacaagagcaactggatgagcaccgcgcagctctggaccggcgattccgtccgaggggacgatgcttccgagaagcaggatgagaggaggaggtcctcggagccggaatctcatgacggcgctgtcttgccgttcaaggccgtgggctccggtgccccggcgttcgcgccgccgagtttgaggaaggacgacaaggctgttcggatgccggatctgccgtttctgtcgccggcaccgatcaagacctctctggctgctgctaccggcggcgctgaagaaagccgccgtcagcttgtgggattcgcgcaagaagcggcgagggctgctgccgccctggcgccggctgccccttccatgagcctncaggctcagtcgcgacagacagcacaacagcagcagcaagcgaagaatggccgggggtgcctgtacaacaggactgcacccacattgcaagctgagctgcgcaacctgggagggcccaggttgctctacaaagaagtcggggatagtcgaaggggatggctggccaatgttaatggagaaccatcggaaaatacaggtgagcag

SEQ ID NO: 7935 - DNA, 647 bp, Hordeum vulgare
  Predicted polypeptide sequence is orthologous to G1560
atataccacataatccggtgtggaaccgcaatacaatcagtctatgagactatgactataaattagcactacaatatacaatacagctatcaatacaatggtatacagattaaatggttatgaattctggtagagttttggatcgttgttacttagacgacccagctttcgcgctacgcgtcgacatatctagatctcctcctttccagctctagcatctcagcctcatccctcattccttcactcagcagctcctcccagaagtcatcagtcagctcggcctcaccgcagccctgactccgaccacctttgtcatcctccatgcccttcctgatcccttgaatgttcattgctaaattctccagctctgaaaattccctgtcctcaaaaatgaatgtggactcgagttgctcactctgactcgtcccctcagggccaaggaacggcattacgttgatggacctcctcctcttcgttgggtaagggtcctcgaggtccttcagtttatcttgttgctggacaagctggagaaagaagtcagggttctgtattgctcttgccaggaaacccatcatctggagctgcttctgctccgcccggtgtagcctctcctccatggctcgcatgtcagctctcgtgctctgctg

SEQ ID NO: 7936 - DNA, 206 bp, Hordeum vulgare
  Predicted polypeptide sequence is orthologous to G1591
tgactacatacatccgtatgtggtatatagtggaatctctaaaatgtcttatatttaggaacggagggagtacatgatacatgggtatttttatttcaaaaggggaacatgatatcatacgtttggctgtaatgtaatgcacagtcgaaagacaaatgccatcttggtctagaatgtgaataaacttctttcggcagcggccgcca

SEQ ID NO: 7937 - DNA, 840 bp, Hordeum vulgare
  Predicted polypeptide sequence is orthologous to G1635
cagcaacccctcgctcaaacaatcatcagctagcagcctcgaatcatcagcatggcttctgctggccgtcgtcccacggtgctcctgcagatcgctctcttcgtcgtcgtcacggcggtcatcatcaacagctccgtctgccttgccgccggtggccacgacagcaccggcactgtagtaattggtccaggcaccggtagtggtagcaatgacccaaaccatcctgttttcccgtcgccgcctggtaaaccctacaccggccgtgggtgccgcacagtttactgatgtagaccaccggtaggtggccaaccctgaaaacacccgtgcgcatacccgcctattttccaaaacaatgcaaggatgaaagatgaaaaacctacgggcggcctaaatgcttatattatatgcatgcatgcattccttactgcatctattgattctactgtatcgtgagccagataccctacaagattggcgcatccttgatacatgtcatatagcagttggttaacatgaccaaacatgatttgcacttgtagtgatcatctacacgtatcccctcatgatgttgtttgagaacgtgcaattcaagtgatagattctgcatggagggtaccacgtgacgccatgtctctctacgttgaggtcgagtgattaatacaaaaatgcactaggccgagccaagtgtttagagcgaacaataaatatatgacaagaacgattcgcgcaagatatatatcttaaaactgcccgatatgatggcccaatatccatatgtgcacgctcagtcgtgttatacgtatatataataaataatgataacgacactcgtttatctcg

SEQ ID NO: 7938 - DNA, 797 bp, Hordeum vulgare
  misc_feature (11)..(11): n is a, c, g, or t
  misc_feature (29)..(29): n is a, c, g, or t
  misc_feature (795)..(795): n is a, c, g, or t
  Predicted polypeptide sequence is orthologous to G1635
ggttctttagnaacacattggcacaaagnaccgctgtccaaatccgaagccatgcccagaagtttttctccaaggtggtgcgcgaacccggagctaaaattgagatcgagatccctccccctaggccaaagaggaagccgctgcatccatatcctcgcaagcgtgcggactcttgcaacggggcaaacccagcaaatggaccatccaagcttgctcaaatttcatcatcttctggttctgaccaagagaatggttctcccgtgtcagtgttgtctgcaatgcagtcggatgcttttggatcatcgatgtcaaacccgtcatctcgcagtacttccccagagtcgtcagatgaggagaataatgttcctccaatggtcagcagagaggaaggtcaacaaacagggataaatcaatcccacaaggaggctgatcaggaaaacaaagatacgggtacctccgaagaggattcttctggtgaggtgcaggtaacaagcgtgaagctgttcgggaagacggtcgtcatcccagacccgaggaaaaggtgctccccggatccaggctcagggcatgaaaacggagggcaaacctcacattcctctaacaaaggaacatcacaagccccactggctgtagagattccaacacatacaaagggagaacaaatctcacaatcctctaacaaggcaacatcacaagccccattggctgtagagggtccgacgtatacaaagggagagcaaatctcacaattcttttacaaggcaacttcacaagccccactggctgtagaaattnca

SEQ ID NO: 7939 - DNA, 700 bp, Hordeum vulgare
  Predicted polypeptide sequence is orthologous to G1652
aattgaacagaattttgatcatccaaacacagggtcggtcagcaagaagatagtacgccgctcccactaagccgagtaatctcaatttgtgacaacgagcaatgaatccaaattaaagttaggctagaactgaacgaatccaaatgaaatgaagtgaaattcagaggatcatctgaacacggatctcaagttccaggttgatgtgcgatccaaaacttcagtccaacaccaaacatcatccctggagacctctgaccatatgaaaccaaaccaccatcctttcggttcatctatgcggaaccacttcctgcttctgctgcatctgaaggagcacaaacacaaaccaaaagcgagatcaactgctacaataagaatccaccaatacctctaatccaccttatattgattatgatggaactcgtgatgagaactagaagaccacacgggcaataggcatgttatctgacctacctaaaatccccttgaacatacaccatcatagtgatctccacatatcagatcccatccggcatgggaacacaaacgaaccaacagttactgacctgacaccgcaacagacacacagcagaggtttgcatatgtaggcacagacttcctaaataaatcctgcagtgcaacccacacacttataggaagaccaacacagggatcaagagtacagatataaccgatcaaacaa

SEQ ID NO: 7940 - DNA, 589 bp, Hordeum vulgare
  Predicted polypeptide sequence is orthologous to G1660
caataaagatgatctcaatttctcagtacattaatcagcaggccattagcattagctcatgttaacaacggcaacatgctactgtagctcaggtcacagacattcagattgtacagactacagagcaaagcaacacctacagcacattgattcaaataatttcatgtacatctcgtcccggaggcttttgcattcagaccttcatgctgcttcttcagtcatgctgcacttgagaggccatctgaattttgtttcattttcaactgaggaaccagctgcagcaccggaaccgggacggcacgcggccggtcttccggatgcgctgcacctgacgggccagccggactgcccgccggttccgcctcgcttcgaccctcgcctgcttcccctccaccttgtagctcaacgtggacagcctcttggtcaggctgttctttgcccgcgccttcatttggtcggcctgcacctctgcatgcctcatcttggcttcgaatttcgatttctgacagttctcccactcctgaatcctcacctccttcctctgatatcttgatgcgagcttgcacttcttggactctgcccatgccgt

SEQ ID NO: 7941 - DNA, 476 bp, Hordeum vulgare
  Predicted polypeptide sequence is orthologous to G1662
ggcgaggagggcataggctgctgccaaggacgaggctgcggcgaaagctagtgctgctgccatcgaggctatcattggccatagaaggaaaacagaaggtgagacagcagaacctgcatctactccaaacgctctcggcggcgggtttctcagcaggcttggcctcagttcgcctggagaaggtgcgcctcaagacaccccaataataagcactgaaacaaaagatgggcaggagcaattttgatggtcatgagccttcatgtcctgcatttgttctgagcactagtcgtgcattttcgtatcgattctaggggcatcaatctgtatgaactctgatggctacaaaggtttctaactttcgactgtatctccagttgagaccttgtgtaactatgattgatgcataacaatagagcaataaccatgagatcttgatgaattgtcatcaatagtataaaaaaaaaaaaaaaaaaaaa

SEQ ID NO: 7942 - DNA, 628 bp, Hordeum vulgare
  misc_feature (582)..(582): n is a, c, g, or t
  misc_feature (616)..(616): n is a, c, g, or t
  Predicted polypeptide sequence is orthologous to G1662
acgtgtcttcaactcttcatactccctcctgcaaaattttgattcatgtactaaccctaactgcaccagttgagttttaatgtttctagcctgtgccctacttgatcggctacatcaacctgctggagcagattttgcacaccatgaacccagctctgtttactggtgctgctctcacacttgaactcaatcaggccttgtgctgtactcaagccaaagcagcttgtctctggtaaacctttccctggctcagtccactctgggagctcactgtataccccataaactacacttttattgttttttgacagcacacctccaatgtgtttgctcttcagcttcaatatgacctgtaattatccagacttgctgttaactgatattcaactgtgtataatgtacacctattcatcagaaccttgatattcccgttaagaaaataatgagaagggggttatcctagtcggaaaatctattcaccagaatgagacgagttatttaaacgcaaacctttttgtgtcctattttacaagtgaagctctggaggggaattggcctacctgtgacctcttgttgatgtanattgaaacccgtctcttgtgtaaatgcccttttnttggtgcgtttt

SEQ ID NO: 7943 - DNA, 697 bp, Hordeum vulgare
  Predicted polypeptide sequence is orthologous to G1662
gcggcggtacgtgccggtttctgtagttcaagatcaaaggcaagaatctgccaaatctgatgatgagaacaaggctaatgatggagaaccttcatctacggaaacagagcagtctattgggaaaactaatatcgatgatatacttatggatgaatcccaggcatcagatgaggttcgagattctggaaattttgttggtggaaccgacctaaatttgaacctgggtctgaaagaccccgatgttgaagatgaaggtgatacagttgaagatgaaggtgatacagtagcggccgctcacacgtagtaaaatctactaactctctatctcatcgttttgtatgcattacaatacagagctgaactaaactacagtaccttacaagagtatcatcaacaccattatgtcatatatatgtaacaacccccttatatcacaacatactatcacctcagaccgagcagacggctcacacatcaacccattttcactaccgactccagcttatctcccacacgatcctccgcggcaacttgtcgaagcaggttctgcacatcgtccacccagttctgcttactcgcgccgtcctggcactcgaattctacgataccttgcgccgtgctcaggccgaagcagcatttctcatccatgaaggccttccccggctcgatcacccacgtcggaagctcgctgtatacg

SEQ ID NO: 7944 - DNA, 700 bp, Hordeum vulgare
  misc_feature (620)..(620): n is a, c, g, or t
  Predicted polypeptide sequence is orthologous to G1672, G2802
gatggtgcacgggcgacacaaggggtgcaagaagatcctagtcttgtacatcaacttcggtaagacacgaaaggcagagaagactaattgggtgatgcaccagtaccacctcggcgacctagaggacgagaaggagggggagttgatcgtatcaaaggtattctatcggacacagccacggcagagtgccgctgccacaacatcgacattattgcatgagccttcgaccgctactgccgtccagatgctgcgacagcaacaccaaatgctgaagcaaggtgatgaggtaacttacttagatgaataagggaaatgaggggcaggaccaacagcaacagaaattcgaccacagtcctgctggcttggaaggactaataatggcctgcaaatcagcaagtacaaaagaaatacttttatatcaggatgtcgagaggaaggaagagaaattatatcacaatgtccaaaggaccaacatcccatttaaaagcacagaaccacgatagtattcaactattcattgccacaacaatatgcgcatgggcttttatttatatcgttgcttcactcccaattaacaccttctagataatattgacaattgtaattttattttgtcctgngaaagggaatgagaatcaattttattattctgatcaattatgtgcgggattagtggattgtcttgttgacaacgcaacaa

SEQ ID NO: 7945 - DNA, 638 bp, Hordeum vulgare
  Predicted polypeptide sequence is orthologous to G1706
tttttttttttttttgagcattcttggaaggaaagtttcaggaatatgaaggtagcttcaaaccgatacaagaacataaacaacgcagcatgcagcagaaatcacatgatctgtaagctatcacaaattggcgcaatagagtaaggtggcatgactacggaaaacttatctccccatgagattaaccaattccaattaaaacctgaatatgaaaattagactagaataattataggtaagaaattaatggagtggcactaagaagagaaatattagctagtatcacagtacagagtcacatcacatgttcaatttatccccagtgccacctctcttcaaccatggaaggctccctgcttctgaacaatcatctgagccagcaggtaacttgcccttgagattagaccactgccaaatcttcgacatggagaagctctcccctttgttccgtgcgcaaattttctttccctccataatgtccgcattgacacaacttattcccggaggtcttaatctcatcgcaccaccatttctagctcggcccggctggagagccacctgaagttctgaagtcccaagaacatactgataagtgcccatagagaagcatttccttgcatccaaactgctcctcgtgc

SEQ ID NO: 7946 - DNA, 819 bp, Hordeum vulgare
  Predicted polypeptide sequence is orthologous to G1752, G2512
cttcaacacccccgaggcggccgccatggcatactgaccacggccgccttctccgtgcggggcgccgccgccatcctcaactaccccgtcgaccgcgtccaggagtcgctgcgcaccctcgcgctccgtccagacacggccggagggtcccccgtgctggccctcaagcgccgccactccatccgcaagcgatcccccaacaaggccaagaagaccaccgccggtgctaccatcctcgctcccaccaacaccaagatgatcacgacgaacgacgtcgaccaggcggcagccgcgtcgacggcgggctctggcgtggtggagcttgaggacctgggcgccgactacctggaggagctgctccgggtgtccgacgagccgtcggcgtcatctaccatggtgatgacagggtacgatcaccaacaccatcaccatgtttatgtggacgaccaatcggcgctcaccaacatggggccgatgctattccctcattgctagctagctacctagctccatccatccatccatcatccctcctctggtttgagttgaattgcaaatagtgcccacccagatcaaccgaacgctccatcagtcgtagccagtttcctttcttccttttcagcagcagccttttttctttttctttttcttgttgctgttggttgccaagttgcatgccccggcaccggcaattagtcaggcgggaaaacggccaagggacaacgggttttggatgcatgaatggtatgtatgccccctctcttttcaacggtcggagcggaccttataaaaagaaacttgttttggaaaaaaaaaaag

SEQ ID NO: 7947 - DNA, 681 bp, Hordeum vulgare
  Predicted polypeptide sequence is orthologous to G1767
aagggaagagagggggtactaggtaggaatgtacaaatcatcaggctgttacaagggataggatttcgcctccacgcacacacatctcggctaacttagtacacaaattatttgatccattccgctccgcatccaaacacatgtcaaaaacacaaacaatcccagccgccgcccccgctgcattcttcctcctttcaccaatcacctcaaatcgctatcaccacacacaagccccatccgccttgtccatagtccaaattccacccttctccatcctcaaaaaattacttcggtaccaccaatgaagctccacatccctccttgcaagcctgccaaatccgagaaactcctccgaaaacagtttggcctctcaatcagaatgtgtgtgtagcataagatgcggcaggttgggctatgcggcttggcttatccccggcacaaaataattccttcatttatccccggcaagattagaatttgcatcccataacaacccatgcttgccgtacttcacatttgaagcggttatgcactctcgacagggaacagcccaaggtttccttcgccatgcgctctctttggccgccacgttgtatgagccttgaccacgtcagctccagactccagctggagcagatggtcgcactggatggcggaatctgggccgccgtccgcgcattc

SEQ ID NO: 7948 - DNA, 727 bp, Hordeum vulgare
  misc_feature (543)..(543): n is a, c, g, or t
  Predicted polypeptide sequence is orthologous to G1772
caaaaatccgcgaccaaactgccgagctttccttctccccgaagcctttccggaaaaaccctcgccccccttcccccaaccccggccgcgatcaacccccgccaccgccatggccagcgacgacgacgactgctactactactgcgacgacgacggcgacggcgacggggaggcggacgaggaggcggccgactggaacggcctggcggtgggggcggacgaggacgacctcggcctgctcgaggaggaaccgccgcccccggagcgccgcgtcgactgctgggctattacaggagacaccctttctgcagcccagcaagaagacttgtccatagtgatgaatttgctcaatataaagcagcaccaggcacgctctctgttcatcttccaccgatggaagatagactgcatctatgattgccttgacaggaaggggcgcgaccgcatgctcagagaagcaggcattgtactgcaggagaagaatagcatgctaataggtgcctcaagaacaccctcgacaagtgtccagtgcaatgtgtgctntgatgatgacttgtccccggctgctgtctcaactatggactgtggccattgcttctgcaatgactgttggacagagcacttcaatgcagccatagacggtggcaagaagcagatacgttgcatggaggtgaaatgcttggctatttgcgatgagggcattgggcaccgcctacttggccagaag

SEQ ID NO: 7949 - DNA, 690 bp, Hordeum vulgare
  misc_feature (616)..(616): n is a, c, g, or t
  Predicted polypeptide sequence is orthologous to G1772
agagagcttgaagcagttacttctacaataaatttgcaatttgcagcacaaacatagtagaacatgtctagagttctcttccccccccaaaaaaaaagtcatcttctcgctcaaggggtagatttggcattataggaactatgcacaacggcatcatgtcatgtcatgatatacaagaggacaagttgaaagttttgctctattggtcgggatcacagccccagggcgaggttgcggccctagggcaacaaaagagaacacaaattcctttatgtagctgaagaaacacaggtcagctgtacagttgcagcggaatgttccgtcagatactggagcttcagatcttgtccgccacttcggctggcacgttgagatcaaaaagagcaccgccgccatgagcatctcttctttctctcttgtgagacgggcgtccactgttgtcggaacttgatccgtgcagctgaagaataggtcgctttcccgtaagagatgagcctgattcactacataaaccaggttgactcttgtgttcatcctgactacatttcatagatggggcaatattatgaggcgtgcggagagggtacacaaatcattctcaatgcactgatacatntgcttgcagagcctatctaccacattggaaagattgataacatgcttcattgtatccataacctcctcgtcgct

SEQ ID NO: 7950 - DNA, 700 bp, Hordeum vulgare
  Predicted polypeptide sequence is orthologous to G1777
gtttttttttcttaatttgatcaatcagtactttattttgtgttggagaaaaggggattgaaattcacacctccgagtagatcattaattatacacttttgagaatttagttcattcttgtatgcccgcttcccaaactgttcgactctgacaacttcttccatgattttgtcggcgctacgaattgagaacggaatttcagaccaccgcttccacgttgacacaaaagcccgtatattttcagctagccaagtacaatcgttgtagcagtacatgcttccagcaggctgatgggcataacaagcagatgatgccgcacgataaatgactaaaatttggattgatagattcagcaacccagacgcacattcggctaagagattctcaatatttctgaaaaaaatcagcttaggaagggacggttgggttatatcatttatacgttggtaggttgagatcggcaaaatcctcgaatgtttcaataactgtttttagaactacttggggtaaggcagaaatccaataattttcatttcctcttaatttttgcttatcctggaagtagttcaatgaggatgcagcacttgtggaccctaactgtgacgcgtggttttctaccctgtctttccttatttcaggacttttatcttctattgtttcttcaccccagccccaggcatcgactacttcgtcttctaag

SEQ ID NO: 7951 - DNA, 904 bp, Hordeum vulgare
  misc_feature (498)..(498): n is a, c, g, or t
  Predicted polypeptide sequence is orthologous to G1789, G1911
gtagttcaggtcataggtcgaggtacgtacatagcagctttgccagcttaattgtcgatcgaggaaccaatcgtcgagcgacgtcaatggcttctctgtcaatgagcgtggggtggacgccgaagcagaacaagctgttcgagcaggcgctggcggtgcacgacagggacacgcccgaccgctggcacaacatcgccagggctgtcggcggcggcaagtcggcggacgacgtgaggcgctactacgagctgctcgtccatgacatcgcccgtatcgaggccggcaaggtgcccttccccgcctaccgtcccccatgtcccggccccggccacaacgccagctacgaggccgacaggttgaagcacctgaagatctaggagataatcggttaatggacaagaaatgatgcacactaagcagatggattgaacgaagcaacatgtgcatatggggctttggggtgtaccttttactataagcgtggctgcgtgggcattntggtcatgtaatatatacatgccaaacctacccggccgaaaaaagtcggcccgaccatgcagtggcatgcatgtttcataatacactagtgggctattggctaggggggcttttaagtatgtactggagaccggacttgtgcttctttaaaaaaaaaaataatttataataatataaattattatatttattatattaaaataaaataagggaaaaaatgaaaaagaaatatataatataataactctggggggggggcccggggccacatttgctccttaagggggtggttataaaatattttgtgcgcgcgttttataaacggtggggagtgggaaaaccctgtggggtccccatcttattaactttggaggaaaattccactttttacaagtgggggagaaag

SEQ ID NO: 7952 - DNA, 638 bp, Hordeum vulgare
  Predicted polypeptide sequence is orthologous to G1789, G1911
atcgtagctctgaagtgcgagaaacatactactctactcctcattcccatccaggtcgagatgtcttctgggtctacgagctcatcccgtggcggcgccaacgcggtgtggagcgtcagggagaacaagctgttcgaggaggcactcgccaactacggcgagggcacgcccgaccgctggcacaaggtgtcgcgcgccatgggcgggaccaagacggccgacgaggtgcgcaaccactatgagatcctcgaggaagacatcaagctcatcgagtctggcagggtcccgttccccaagtacaagtacaggaactgattcatcgcggagcgaagcatctgaattctgaagttcctgcaatgaggagaaccggttgataatctagcgtttacctggaataaaaagaagaaaacatgtgtgtgtgtgtatgtctgtgtgtgtacgcgcgcgcgtgcgtgcgtgtgtgtatgttgtggttttaagtttgtaagcaaatcaagtgcggttgctcttgcagacaatagcatgtagttttaagtcttccccaataagttccggagtaaacatcagtaatgtaaatctcctgtacttatttgtaatgtttatgaacatgtgcttggtaccaaaaaaaaaaaaaaagg

SEQ ID NO: 7953 - DNA, 615 bp, Hordeum vulgare
  Predicted polypeptide sequence is orthologous to G1797, G1798
gcggaattttttttttttttttttttttcacatacatataattcgttaaattaatttggatagaaaaacaaataaaagcatatgcatgcagatcgatcttgcgaccaattcttttttataagacctgcactgcacgcatgctgcagcctgtcaattattttttgcatcgctatctcccagtctcacaccgacctaattgaatcgattttatatatggacaaacatatttgatcgatttttgaatcgatcttcatggactgattgattgagcagatttaatcaatcaattctctactgctgctagctagacgacccgggccttccaatgaccagctcagtctccacttccatgtaatggccgtgccgctcgtccctctcattttcttcagctccagcaccatcaggcgatgtttcagcagcagcagcagtcgccagctctagcagaggcagcgccttgtactcttcacggagtaccgagttctccatcaacaacttcctctccttctccctcagctccgagattttatccagcattttctgttgcttcttttgccggatgcagcttaggctctttccagctgcagcttcagctcgtgcagctcatgggacgaacag

SEQ ID NO: 7954 - DNA, 768 bp, Hordeum vulgare
  Predicted polypeptide sequence is orthologous to G1804
gcggagatgcaggaggaagcaccctatgccggcaggggtcgttctccctgcctcccccgctgtgccgcaagacggtggaggaggtgtgggctgagatcaatagggagccccgcccggtgcatgcccagcctcaggccgcgcgaccctaaccgcagcctcctgtgcagccacctgcggggaacggcggcggtgcggttgcggccaacggccggcaggggacgctaggcgagatgacgctggagcacttccttgtcaaggccggcgtggtccgaggatctgtggccggcggccaggcgcctatgccgggcggcatggtccatggacagatgaaccccttgcagcaggggcagcagcctgtcccaatgatgtaccagatggcaccggccaacgggatgttcccggtgatgggcgacggcctggggttcgtccccaacggttattcagggatgcccttggtgccgccaccaccaccttgtaggggtggggcgggtttccctatcccccgggtctttgcacgggaaggagccccatgacgccttctttcttgatgaactgcttggtcaaatggccgataatagaaatacgggagggccccggacatggctgactctaaggggaccaattgttgccaaaggtcccctctgacgatcccctctgcccgttggcctagaaacccttttttaaaaccctcaaccggcaaaaacttaacccgggtttatcgcggggctcttttaacacttaactaaacccttgtggaaagaggacatg

SEQ ID NO: 7955 - DNA, 691 bp, Hordeum vulgare
  Predicted polypeptide sequence is orthologous to G1835
cggcacgaggggccaactagcgaggaaccctaacaataatccgtagttccgatccgcaaggcctgcgacgatggcggcttccgtccgcgaggcgtcgatgaggatcctgcgtccggcgggtgaggggcttcgccggctcatccacgccccgcagcattccggatccatcagtgtctttggggaaggctaccgcgcaacgcaaatccagcagtcaaaagaggacctgtataatctcatcgctgacgcccaggccaattctgcggcttctcaggaagacaaaatggtgctcaagactctctgcacacatgtcaagcccagaccacatgaccctcaatggcgccggataactactgccaagaaggtgaccaagtggactgcaacatcaattgtgcttgctacttgtgcgatcgctttccctgccttagccaaccgccctgactatcgtgttactactgcatgtgagcagaagacagtggagcaatgcaggctgcctgagagtgtggcccagcaaggggcgcagaagctttagaagcaagtgaagggaagacaaaatacatcttgtttgatggagaagcaagacggatatcagttctattcctgcactatgttagttaggtctcttgaaatatgtctggtcgcattgtaagataatttgtgatgttgctgacatggtatgttatcctttctgcct

SEQ ID NO: 7956 - DNA, 550 bp, Hordeum vulgare
  misc_feature (461)..(461): n is a, c, g, or t
  Predicted polypeptide sequence is orthologous to G1852
ttttttttttttttttttttttttttttttttttttttttttgcgaaatttgattccaaatggaagaggggctacagaacacatgcaaagaatcacaccacacctcagcacttgactctttctaaagaaccaacaatgcagtagtactccatagctatttccgcatcaacctgatatcagtgctaatccctccaacccatccccaaaagacacaaaatcaggggaatctaaaggggggaaaggcgaaaatgttataaacgtggacacaactaaactatcctgatgtcaatggtagcttccaaaatgttttcgtcgctacgagtattttctcagcactgcctgattcgggctcactgtcatgtacctgagtagtccaccgaatcgactgcgctacctgtacagccttgttgatcacatctggggagtcccgtatgacaagcaagttccttctgggcgcagtntgcggtccatctccaacatgacatcaaacaggtcacatctgctccttccggactttggggcccttaacaaagaattggttccatcaagc

SEQ ID NO: 7957 - DNA, 849 bp, Hordeum vulgare
  misc_feature (468)..(468): n is a, c, g, or t
  misc_feature (614)..(614): n is a, c, g, or t
  misc_feature (620)..(621): n is a, c, g, or t
  misc_feature (639)..(639): n is a, c, g, or t
  Predicted polypeptide sequence is orthologous to G1855
gagcgagggttcatcggcacttaccaggactggtgtgaagccttctcgacgtatccgagaacctacgaccttttgcacgccgacagtttgttcagcatctaccaggacaggtgcgacataaccgacatcctcctggagatggacaggatactgaggcccgagggcacggcgatcatccgcgacacggtcgacgtgctcaccaaggtccaggccatcggcaatcggatgcggtgggacagccgcatcctggaccacgaggacgggcccttcaacccggagaaggtcctggtggcggtcaagacgtactggacggcggacccgtcggagcacagctgagctgcagctctccgaactcagaaatggcttgcgcggtaaccggccgtgatggtgatgatcgtgtcggtttcgccatctcagtgtgtgtttgtgtgtgtagtaagcagtgcgcttggttctctcgcctttttntgtctaattctttggagttcgggtcgaaatgaaaaccagaaaatacgtcgaacagagcataggttttaattagcttggacgaccagagattgctactatgtactactacccaagattgactaactggaaaaaataggtctttaaanaaaaannaaaaaaaatataaaaaanaaaaaaaataaaacctggggggggggggcccgcggaccccaacttcgcccttttagggagggcgtatttacatttcaccgggcgcgtgctttttaaaagcgttgtgtaaatggggaaaaacccgtggcgtttcccaactttaattgggccttggagcacaatcccccctttttgccgggtggcggtataagcagagagaggccgcccacg

SEQ ID NO: 7958 - DNA, 582 bp, Hordeum vulgare
  Predicted polypeptide sequence is orthologous to G1863, G2334
cggcacgaggcaagcgttcaaacgcaaaaacagcacgcacagcacgcaccagacactcagacagccacgggtgaagggcacactccagagatgaccgagcgaaggcaggaggaacactcgccgccgtccaagctcccccgcctctccggcgccgatgacgacgccgacgccaacgacggcgtaggcacggtgaccatggccgcgccgttgccgctggctcttgggctgggcctcggcgtgggcggctgctgcagtgacagcaggcgcagcgacgcggaggccacgcggccgtcggcgctgacgttcatgcagcggcaggagctggagcaccaggtgctcatctaccgctacttcgccgccaacgctcccgtgcccgtgcacctcgtcctccccatctggaagagcctcgccgcctcctcctccgctcctcagaggttcccatcactggcggggctggggagcatgtgctacgaccagaggagcagcatggagccggagccggacaggtgccggcgcacggacggcaagaagtggcggtgctcgcacggcgtggtgccggggcacaagtactgcgagcgccac

SEQ ID NO: 7959 - DNA, 552 bp, Hordeum vulgare
  Predicted polypeptide sequence is orthologous to G1863, G2334
cggcacgagggggagccctgtccttcttcggcggcggcggcggcgacttcgacgacgactcggctgcggtgaagcaggagaaccagacgctgcggcccttcttcgacgagtggcccaaggacagggactcgtggccggagctgcaagaccacgatgccaacaacaacagcaacgccttctcagccaccaagctgtccatctccatgccggtcaccagctccgacttctccggcaccaccgccggctcccgctcgcccaacggtatatactcccggtgaacggcgtcggccggcctgatctctgctgatttgccgtggtcacgacggacgtcctcaaatcatcacagatgagcgaaccggccgacccgatcgaatgtgtctgtgagccgactgcagcttgcttgctcattttgtatggatcgtcgtccagcaggaacaaaacactactcctttaatttcctttctttaatttcacaacgttttttctgggttttgccgtgtatcggccggaactgtactaccaagttttctatagcctcgatggtcatgcacg

SEQ ID NO: 7960 - DNA, 615 bp, Hordeum vulgare
  Predicted polypeptide sequence is orthologous to G1863, G2334
aatggataacacacatcatatttgatcttcaagagagctgccaatactacacttaacttgcaagcttttgccattaatcaacactatctacatacttaacgcacgcctagagatcatccaaacttaattaacactatgccaaactagaatagtaatcgatcagcgtgcagttgatgtccagctcgtctcaacttcaaatcacagcccatatatacaggctaaaaaccaaagattaaaatcgctggagaaacgatttaggggcggcctgtcttagcagctataccggatgctgcatcgcgggcaatggagacaaatagaggcgacttttccggaggggggagatgatttctagaggtttctgccgatcttgaagccctatagaggatttggcggcggcagcagctatctcggctattttatgggagatggagatctgatttcatgctaaaaaacactcgaccacgctgctatcggcttagccagcataaactctaattcatgctaaaaaccactcggggacgcacatcatcaggtcatcgtcccgccccagcacgtctgccccgctgaaacccggctgctgctggcaggttcccgtcgagaaggacgagctcgggc

SEQ ID NO: 7961 - DNA, 649 bp, Hordeum vulgare
  Predicted polypeptide sequence is orthologous to G1868
aactccaactaaaccaactaatacatagatttttttttcaatgctcatatagattctgcaggtctctacgcgatttgatgtaacgggtcaacaaaacagacaattgaaatcaacaatacaccacaacagaagctgaaggactcgaacacataataaagaaagaaaatacaaaaaatatataccaataaacactagacatgaacatagttttagttatttgtgattccacaagaccagccggaacacttgaaaagagagctgggcctccgaggttgtgcgttctaccggcaccccatgagataggaattattagtgctgtgattctctggtacaggacccactttttagtgttgctgctggacacgagacttaggattccagttggaggatctaacttgggctctcgatccattttgtcagttaagatgttccataagctgactggcaactcttgcttctgaaaacctcacctagaggtccatcgtcaagtgtttccctagttactggcgaccaagtttcctgcaacctataacctttttctgatgaactgcccgctccatgtgtaatgtaagactggtcaagatcatgatgcaacttcagtggtaaaaatgctactttgtcacaatttgaagaagaatgtgatgacgag

SEQ ID NO: 7962 - DNA, 335 bp, Hordeum vulgare
  Predicted polypeptide sequence is orthologous to G1927
cagcagtacattctaaccaggcctaccctgattgagcactcagtttcattaggtccctttgttcatagcctgacatccttgtgctgtttctggtcctgtaaacttaatttttcattccatttgttcgattttagttgaaattcgttgtaatctcagttgctgatttttgtagacacggtccctgggttcctcccacctgtttgtttcgggttcattttctgtgtgcttgatatgttgtttgggattatattgagaaactaggaggagcttcctcccagaatactgtgttgctgttgttgggactgactatttttgttgtcagaaaaaaaaaaaaa

SEQ ID NO: 7963 - DNA, 985 bp, Hordeum vulgare
  Predicted polypeptide sequence is orthologous to G1928
gagaactagtctcgagtttttttttttttttttttttgcttgaaatgtatgtaactcttgtatacccgtatacaaacctgtataccgccgaaaaaagaagaagagaaaaaaaacagacatcaggggactcttacatcgatgtacaattctttggccttaacacgaggatgaacacctatgttacgcagggacttgcttgctctaccggccaccccctctgcctccttggccggtttgggggacagaagagaggcttttttattacacagaacgaatcaataaataatggaatggcacgagaggaattacaaggtgaaaaagaacagtcgccgtcgtcggtgatggtgtgatgtgatggcgatgatcgactcgaggaggtgatgcatgttcgagcggtgactcggtgatggtgatgtttcgaggttatagcttctctggaactggaagtatactgatggatgagcaatggtgctgaacctttattgaaccatggcgaggaaggagctcgacggaatcgatgtcggcgctgctgtcgtcccggtggttgccggtggaggtgcattgttggcgccgaccgagtttgggcctctgaaattgtattctgtactggatttttgccgtctgtcctcgcccgtccctgcccgtagtcaggtgtaggtcattcgcccaatgtcgtccccttgtcggtcctcgtccgaaggtacacctcccgttagcggcatgttcgttcaagctccctaacaatggtcttctgggcttttttacccccaaatacaacttcaaacgtgtgccgtcgtcggctatgtttgcccaattattttttgggaccctgcacgggttacgaactccatcagtagttcctccttgcagttggcactgagaattttatcccctcaaattcgatattatatcattcacccagatatagagttttaagctcctccgaaccgggaggaacctaataacaatactgtggggtgtgggg

SEQ ID NO: 7964 - DNA, 700 bp, Hordeum vulgare
  misc_feature (224)..(224): n is a, c, g, or t
  misc_feature (611)..(611): n is a, c, g, or t
  misc_feature (658)..(658): n is a, c, g, or t
  misc_feature (685)..(685): n is a, c, g, or t
  Predicted polypeptide sequence is orthologous to G1928
gctcgagtttttttttttttttttttttgacgacggatgcatgtattattttcacgtaggtttcgttgatccgaactttaccttacagttggcttctaccccaaaagaaactccaaagcttgcttaacttgcaacttgcaagatcaagatcaaagagagagagagagagagagagagagagaggttacccagttcaaaacggacgtatcccctgctgaatgtanagggtagcagcaagcagtactcagcgtctgcggtgatgagatgcgactatgcaactgttatgatggctagctatggctacccatgccatgccatggctcgttgctgctctgctgctgctgcggctgtggctgcccttgttgttgtgggtcgtagcagggcgccatgttgatgttgttgctggccgtgttcacggcggcgcccatgcacgacgagtcaaagccggcgaggccgaggatgtcgcggtgcgagaaggcgcgcaaccccaggaagtccctggtcatgccgtcgttggcccctcccgaagcgccttcctcaccgctccggccttgggaggcggtcctggcgaggctcatcatctgctggttgctgaggcacgagaggccgancccgaacgtggcactgccggtggcgctggtccgccgaaccggccatntgcgtgtagtgcactccccgcccccgncagcgccggccccgc

SEQ ID NO: 7965 - DNA, 346 bp, Hordeum vulgare
  Predicted polypeptide sequence is orthologous to G1950
ttttttttttttttttcccaaacgcaacctgccctctccgtgtgagactcgatccaacggaaagacagatagacaaccaaccgatccaatcgatgatgatcaatcggcagatcacttcatcattcttgcttaaaacctatgcactaatccgaaccaaaacggaacagacagacacacacacgagacactactatgaacagcaaaacagacacgcagcgcatgcgtatgcatgcagcaagttcggtctaaaaccagcagcgcatgcatatgcatgccccaagttcagtccacaacaacaacaaccaacgaacctactactactaccaaaataaacaatccctcgtgc

SEQ ID NO: 7966 - DNA, 868 bp, Hordeum vulgare
  Predicted polypeptide sequence is orthologous to G1958
ttgcaatgtagctagtcctcccaatggcaactctgcagccaaacaacggatgaggtggactccagaactccatgaatgcttcgtagactctgtaaataagcttggtggtagcgaaaaagctactcccaagggtgtgctgaagcttatgaaagttgacggtttgacaatatatcatgtgaaaagccatctgcagaagtaccgaacagctcgctataagccagacgtaacggaaggtacagcagacaaaaggactaccactgaagagttgactctagacctgaaatcgagcatggatcttactgaagcgttgcgccttcagatggaagttcacaaacgtcttgatgaacaacttgagtacccatagaaagttgcagttgcaaattgaagaacaagggaagtgtctacaaatgatgtgtgaaaagcaaactaaatctaatacggaaaaggggcaggatctattctcgagagctcaaccaccctatttacgggtccaggccatgttgggactgaactcggaagctgatgctcggtgtttcctgcttaaggtagaaagaacctttcggttccaaaataagtaaaacgacttacgtgtcagaattatccacggtgttgactgattcgcgtctttagcacccctacttcaccttaagtagaattatgtccacgtattaattgaacttcgcgtgactcccatcttcactccccgttccttttactgtacacggattgagaacgtctccccgtatacttattcggtctgcatccgcgttacccctccctttgtgattccgcccattcttaccgccatattttgacctaagaaaattgaaatacgtgtacgttagtcacgtctccctatttttccgct

SEQ ID NO: 7967 - DNA, 718 bp, Hordeum vulgare
  misc_feature (24)..(24): n is a, c, g, or t
  Predicted polypeptide sequence is orthologous to G1958
gtgagaaacaaaggtaaatacatncctggccgtgtttggtaccataaaacatgctccaaacactagaggtggcagcgaatataacaaatacttggattagtgcataatcaaatgcctaagatgctattgagtttctagaaacgagtgaaagcggagaagtcaaaccccctcaaaacagtacatcagtgcgaatttgcttgcgctgccttctggaaaaaaactagatcatccacgtgacacggaatcatcgcttccgtgactgtgggtactgtacagctaaacctagttcaaagaaatgctcacccctttctcccacagataaaagacaacttgattctagtttcacagcaagcagtcaaattgaagtcaaattcatggctagtggggttcacatcttcaggagagcatggttagatcttcattccttatcacctgattctgctcgctcggttgttccattttgactgttatttggaacatccttcacggtagaagattctggggggtcagaaggtaactttgatccttctgccgacgttgaagcatccagcgccttgtctgcagcaggattgcattgctgctcgatcataatctgaaggcacttcccttgctcctcgattctcagctgcagacttctttgcacctcaagttgttcatggagccgctttttgaagttctaactggagacgtaatgcttcggtgagatcaaaattccctt

SEQ ID NO: 7968 - DNA, 661 bp, Hordeum vulgare
  Predicted polypeptide sequence is orthologous to G2011
cggcacgaggggcgcatggaccacacgcacaccggcaccaacaccacgcccgccgcagtcaccgcctccgccgccgactccatggacgccgcgctgctgctcgagcccaagctcgagatgctgcagcagcagctgccctcgcccccgggccactacgccgcgctggaccatcacctgatcccgcccccgcccgcgctggtggtgccctgcgagccgccgcggcccctcgaggcgctgctgcaggggcagcagctgccgccgttcctgtccaagacgtacgacctcgtcagcgagccgcagctggacggggtcatctcctggggccccgccggcaacagcttcgtcgtctggaacccttccaccttcgcccgcgacgtgctcccgcacaacttcaagcacaacaacttctccagcttcgtcaggcagctcaacacctatggctttcgcaaggttcatgctgatagatgggagtttgctcacgagggatttctgcggggcagcaaacatttgttgaagacgattgtcaggcgccggtcgtcgccgacgcaacaaagcagccttcagcctggttcatctgtattcaggaagatccagtcaggttcttctggtgagtccactctggaccctgaactgagctccctgagaagggagaagaacgcgc

SEQ ID NO: 7969 - DNA, 629 bp, Hordeum vulgare
  misc_feature (3)..(3): n is a, c, g, or t
  Predicted polypeptide sequence is orthologous to G2030
aancacaaattacaactttggaggttgtgtctatctcatgatagactcaacaaatgtcacaaccgagactactctttcacaggcagacgactttgtcctggttccccatcagatggttcattgcttgaatcgttgcaattgaagaaccttttcaaacgttgcacccactttttccccttctccttcactaagcttcccaattcgtcaaatgacaacaagacatggatgacgatgtagatgatcacagcaatgacgagtgcaaaaatgtacacagatgtcttcaacttcctgcagctgcccgcggcatatgccccaagtaaaccaagcaagtccaataccattgctgttttcatggcaaagagagatctcttgtacttgcttattgtgttgttcagtaggaggatgaccattaccattgaggccatgaatgctgtggcgttgcaatagaagaataccttgtatcgtgttaggttggtatcatggaggattgggtcacctgcaaaatggccatccttgtcatcaggccaaactcctccaggcggaagcagaccagcttggtatgtgacagtgactgcaagagttccaatcagcatcaaatctttgcgccatttgtgctctggtctcttact

SEQ ID NO: 7970 - DNA, 1300 bp, Hordeum vulgare
  Predicted polypeptide sequence is orthologous to G2071
gtggggagggccggagggggtcatggacttcaggagcagcaacggcgggtcgtcctcggagcgcaggccggctgcggagggggcgtcgctgacgaggcaggggtccatctattccctgacgttcgaggagttccagagcacgctcggcgggggcgccggcgtcggaggcggcgacctcggcaaggatttcagctccatgaacatggacgagctgctccggagcatctggaccgccgaggagagccaggccatggctgcctcggcctcgggcgcgggcgccggcgcgccgccgatgtcgctgcagggccagggctccctcacgctgccccgcaccctcagcgccaagacggtcgacgaggtgtggcgcaacctcgtgcgcgacgacccgcttccggtgggggcggagggtgccgagccgcagccccatcggcaggccacgctcggggagatgaccctcgaggagttcctggtcaaagccggcgtggtgcgagagatccccaccgctcctgcggtgccgcccccgcccatgcagccgcggccggtccctgttgcccctaaaggcgctaccttctacgggaatttcccgagcgccaacgacgtcggtacggcggcgctggggttcccgccggtcgccatgggggatctggccttgggcaatgggctcatgccgagggcactcggtatgggcggcgcccccctggttgtgcaaactgcggtcaagccggttgattccggcagcaaggggagcgaggatctctcatcgccgtccgaaccaatgccgtactcgttcgaggggattgtgagggggaggaggaccggcggcggcgtggagaaggtggtggagaggaggcagaggaggatgatcaagaacagggagtccgccgccaggtcccgcgcccgcaagcaggcttatacaatggagttggaggctgaggttcagaagctcaaggatctgaacgaggaactggtgaagaaacagaccgagatactgaaaatgcagaaaagagaggcccctgaaatgaaggaccagtttggacggaagaagaggcagtgcttacgaagaacgctgaccgggccctggtgaggatcaaggagtcaacatcgacattccgccggtctacctgctttgtacatataatttgctctattgtaaaccgatgatggaccagacctgtgcttgattgaccttctagtttcctttctcgtgctgcttcagagaccgctgacctgtaggctagtgtgtagtcgaggaggggagccgtaagtaagaaccgctgtaatttggcagttgtccttcaga

SEQ ID NO: 7971 - DNA, 883 bp, Hordeum vulgare
  Predicted polypeptide sequence is orthologous to G2142
gattttgcgatcatgctgtggaaaaatgcacagagtaaagggcaaatcccagaagatgcctcgcctgacccttcacaattcatcagaaatggggcctcccctggattcaatatcacaggcaaacttgatgataaccacaccgcggtagcatctgcagctatctcaggggcacaggatcaggcagaaaccgaccacatggctagtgtgtcctgtagatcggcggatactccaacaaatattttgaataatgtttcgccccagtcccaaccacaatgggcagacccatctggggtggatgattgcgcggtgaacagtgacgtgttaaataaccaacaattgatgattgatgaaggaacaatcagcgtgtcaagccaatattcccaagagctactcaacacattgactcatgctcttcaagctcgggtattgatttgtcccaagccaacatctctgtccagatcaacctgggcaagcgagctgtcaaaagacctaccgctggacaatctccagtttaaggagacaccgatctaggcccgacaacgacatgatgggccatcaccaggcgatgcttggcgccgccgctgccgaagagccttcgcacgcaacgaagcggtataaaccgggcaacacctgacgacggcgaaccatcgcacattctccaccaagaaccggatgatcatgctttcctctggcggattgccagcgggaaaccttgaaaatgcatgttcattatggtggccacaaaactattgggcacttcttcactttaatttgccggcgcaccctttttatttttcgaagaagtgagaacaagacaaaaacctccattgcgattgggaaaggtcttgtggaaaaaatgctaatacccgcttcctgtgattca

SEQ ID NO: 7972 - DNA, 791 bp, Hordeum vulgare
  misc_feature (651)..(651): n is a, c, g, or t
  misc_feature (657)..(657): n is a, c, g, or t
  misc_feature (696)..(696): n is a, c, g, or t
  misc_feature (699)..(699): n is a, c, g, or t
  Predicted polypeptide sequence is orthologous to G2145
ctccaccgcgcgtgggcggtccgcatctagtaactagtcggaatcccccgggactgcaggtaattccgcacgagcaagggcaagggcgcctcggtctccttcacggagggcgagaaggtgctcgcctaccacgggcccctcctctacgaggccaagatggaacgtcggagtcgtctgcatcgtgaaagctcgggccggccacggaccggcgagcgacccccacaacttgtatgcaaagagaagaagggagaagatcaacgacaagctttgggttttgcagaagctggtgcccaacggaaccaaagtggatctcagcactatgctcgaggaggcagtcctctaccttaagtttttgcagctacagatcaagtagctcggagaggaagaagaaagaagaggagttgcatgctggatgaatctagattactccaacccaaccccagtacttggtagatgttataccttcaggaagaatgtttttttttccgggcttcccccttttaacttgggcccttcaaagggggttaaagggggccttaattggggggggggaaaaaaaacacgcgtttgttaaaaaactttttttttttttttagagagttgtttttgggggcccccccaccaatataagtaagttgtgttggtcgagangttgcnggggtgggtggggggaaaaaaaaaaataaatttatgagnggngatatgaaacccgctttttcttgtcccgttgtgcggcgggggaaaaacagcgtaacaatatacagtaggttgtttgtcgctggcgcccgcca

SEQ ID NO: 7973 - DNA, 840 bp, Hordeum vulgare
  Predicted polypeptide sequence is orthologous to G2146
ctcacgtagaccacagcgccacgccacgccgcgcctacccttaccgcacgtagcgtagctactagagagccggctagctagcacatttcattgattgtcctgcggatccgttcagcatggagatcgcgaggaggaggaggtcgctgtgctcgagccgtcgccgccggtcggcggcggtggggcggaaggtgcgggagctgcgccggctggtgcccggagcgtccgttatgcccaccgaccggctgctccttcgtacggccgactacatcgcgcagctccgggccagggtggagctcctcagggcgctctcggagctctgcgaaggccatggccatggcgactcccctagctagttggctgcctgtggtatgccgtatatatacgtggatatctcgccacgtataaaaggggaggtatatattgaacaattatggttgattaagtagcgtataattgagtactacctaggtgcgaatatgcatacgaatcgtatgtgtcccagaagtatataggaggtttggttttctgtccaatatcttcttggaatcttcgcgtccgaatcataattctgggaggattattgaactcctacttggggatcgcggatcaatcttgcggtgctatggggaaacaatcctggacccgattggaggtatagagtgacaccggcttacaacgggatatcgtcataacgcgtggtcggcctacgcacgagctgaccctatctccctgggggggagccccgatccccaaattccctcctatatggtgtctctttaaaaattaatggaggccgccattaaaaccctgtggaatgaggaaaacaccctgcttggcgcc

SEQ ID NO: 7974 - DNA, 601 bp, Hordeum vulgare
  Predicted polypeptide sequence is orthologous to G2150
tttttttttttattatatataatggcaatacaaatgatgtactattacacatcttcaatgcaatcccctcttatttgagggagaatggataggaagggtgccgcgctacctaccgatcgatcttgctactaggcttagcagaagaaaggagctataccgtcagtcacacggccggccgcgctccattttcttgttcaaaataaccatgggtgggtggaaattagaagctaagacactgctagggcccaacattgttaggttgaatctcagagtgcttccatggacggcaagcaagcttggctgacatgactggctctcaggctctgaattgcttctcctccctatgtacagcgggcgtcgtcaaggcgttcggtggtgggatcgagcttcttccctggtgatcatgtcaaagctccattttcatgtggaccgtctgcaacgagccgtcgtagctgttggacgaagtggcgatctcctggctctgccccatgtccatctgaaccacgctctgcagatcttgccagaaagccccaacctgagaggcggggtcgctgaagaagtgctgctgctgctggtgcaaccccatgggccggcagaaagg

SEQ ID NO: 7975 - DNA, 682 bp, Hordeum vulgare
  Predicted polypeptide sequence is orthologous to G2156
ttttttttttttttcaaccaatagttcagcaagcagcagctcactgaaattaattactatcatcacgagtaaatactgagttaggcaattgattacactggtaataatgtagtagcttctgacacggcacacacgacacgataccatgaaactacagcagtcacaagcacagcatccagtactacaataagtacaccagttactagagaggttcagattattgaaggcacggtggctgaaatcacactcgatttacattgtacaagatgcagacaaacctaacgcacaattttactggtggcagaggcctagttgttgccagcagaagtacgtcaattttaactgatactgaggctacatgtcccaaatcgctaactgtccaatccaggccatgttccgcttgcagctgtgttggcggctggggctggggctggggctggggttgctgcatttgatgtacctggggttgaggttggggcagtggcggcacttgcgtcggctgatgtggttgctgatggagctgcagttaaaattgcaggggattgctggggcctgaagttgcaacaccagtggtgcccggccgcaaatggagccgcaattgaaattgcacaagttgcctggggttgaatctgaagaattgaggttgcaagggttgcctgtggttaaaggctgattataccgc

SEQ ID NO: 7976 - DNA, 435 bp, Hordeum vulgare
  misc_feature (46)..(46): n is a, c, g, or t
  misc_feature (131)..(131): n is a, c, g, or t
  misc_feature (381)..(381): n is a, c, g, or t
  Predicted polypeptide sequence is orthologous to G2157
cacgactttttttttttttttttttttaagtcgattggttactcancataactgactgaatcaagccaatttacaaatgtggtccttgaaattgaccaaaacaagttggaagagtagagcattggatgtanctagtttcagtcagccatggagaaatggatggatatccactgaaccaccaaagtgccggcctgttcattcctgatcagcagctgcagcagtttacactgtccaaacttgtgttgtgtggggagtagactaggtcaaggtcgacggtgtcctcgttgggatttgggatcccggtcgtcgtcctcgtccatggagacccgcggctgcggaagcagaggaggcccagcccgatacgcccttgcaccccatggncagtggccgcaggagcacgttcgaggaagaggagccgcgagtgggggcaagaga

SEQ ID NO: 7977 - DNA, 371 bp, Hordeum vulgare
  Predicted polypeptide sequence is orthologous to G2157
ggttgaaaataggggggaatggttagttagaaagaaagaatcctaatcaacgtgtaaccttatgtaactctttgtatgtctagcatttttgttttatttcagtttggtccgtctgtaatcttggtgtcccgtacgagagtacgaagctgtgggacgctgctatggccactggaggacggtggtccgtttgttggtggtggctgccggctgccactgttgccggacggccctctctttctctctcagctcgaggacacgctcctgtctgaagaaatgggacaaggaaatgtgcatcgcagagttatgctctgcttttatgttgttcttctccttttattgagtaataaaactagatcgtgccaaaaaaaaaa

SEQ ID NO: 7978 - DNA, 601 bp, Hordeum vulgare
  misc_feature (21)..(21): n is a, c, g, or t
  misc_feature (30)..(30): n is a, c, g, or t
  Predicted polypeptide sequence is orthologous to G2192
acagcaagtgaataaaagganctaacttcnaaactgttcaatttcggcacaacaaaagtgtcatattacaacaacttcagttcttaactgtacccccaggacttcctgcaccacgtgctaaatatgtacatcatcgacaacacgcgcatcttgcaacgttacacatattcttacaagaaaaaaaattggtgcttcagtcgaacacagtaaagctgctaatgctatctagcaacacgactagcttaacaacatgtaaaaactgacctcctggaacaacttgtacatacccattgaaaaaaaaaagttaaaaatgttgatctgggtatcaaccggagcttccacaagaactaccaatgtgggccgcgacatcgctaaccaatagcctgataacatgggtaccagaatgccgggagatttctatgcattcttccaagtccgcattgcaagccaacttcacccactcgtgatcatcgtcaaggtacttgatatcaaacatgccagcatccatcctcagccttttggcaacctcatctttcaatgccataacgctgctagaacacgggaagcggaaccttacaatgtcttccttaaagctcgcctt

SEQ ID NO: 7979 - DNA, 617 bp, Hordeum vulgare
  Predicted polypeptide sequence is orthologous to G2227
cggccgaggtccctctccaggtctcctcccccgctgcctgcccgaaacccccaattcgaaaatcgatttggggattccggcgtcccgagcttcccagatccgcgccatcgctcggccgcccgtccgatccgcgcccgcggccgccgtcggagctgaccgttcgggggatttctcggagggggctcttgctagaccgctcccgatggcgtcgtccccggtctcctactggtgctaccactgcagccgcttcgtgcgggtctccccggccaccgtcgtctgccccgactgcgacggcggcttcctcgagcagttcccccagccgccgccgccgcggggcggcggcggcagcggccggcgcggggccatgaacccggtgatcgtgctgcggggcggctcgctctccggcttcgagctctactacgaggacggctccggcgacgggctgcggccgctgcccggcgacgtctcgcacctcctcatgggctccgggttccaccgcctgctcgaccagttctccaggctcgaggcggccgcgccgcgcccgccggcgtccaaggccgcggtcgagtcgatgccctccgtgaccgtcgccgggggagccggcgcccactgcgcgg

SEQ ID NO: 7980 - DNA, 634 bp, Hordeum vulgare
  Predicted polypeptide sequence is orthologous to G2251
agggacgccctatgctgctgctctccctcgtcggcctctgccgctccccgcgccgctccgtggacgacgccccgctgcccgaggaggtcaaggcgcggctcccggccgtcgagttctcttggctggcgcgtccggagcagcagcagcaggggtgccacgacggcgcggcggcgtgcatcgtgtgcctggagaggctggaggcggcggacgaggtgcggcggctgggcaactgcgcgcacgccttccaccgcggctgcatcgacgggtggatcgacctcggccggaccacgtgcccgctctgccgctcccacctactgccgcgcgcgcggagggccagccccagcctcctcacgcgcgtttggtgagcaccaaccgcgcgcccgatcgttagctcggacgcccccacgtctttccttttcccagcgcggtggcggccggcagctgggtccggggaggtggcgccgcaatgctgcacggagattcgcgatctggaccggctacatgtatatttattctggggtctatacattatctcaaaattgagattatttagctttagggtttgtatatatagagcacaccaataggtgcatacgcataggtttctattctcctggagaacgattaattagtc

SEQ ID NO: 7981 - DNA, 247 bp, Hordeum vulgare
  misc_feature (228)..(228): n is a, c, g, or t
  Predicted polypeptide sequence is orthologous to G2291
ttttttttttttttttttttgtacttaagtccttctaaattctgatgccttttgcacattttctttcctgaataaaggaatatcagaaggtatcatcatttcagtccaaagaggggctctaaaactcgagtaacacaaattacacccctgaatctgggaaagctaaagaggtgacagggggagatctaaagttctttttcttatgtatggtacacaggaaaacgttangatctttcaggatgatcat

SEQ ID NO: 7982 - DNA, 562 bp, Hordeum vulgare
  misc_feature (436)..(436): n is a, c, g, or t
  Predicted polypeptide sequence is orthologous to G2346
cgttggtccagcgaccccagtcgtcgagggcatgccatcgtcgctgcttggtctctagcttcgagctggagcaggtccatctactccagccatcccgctgttggcctccctcctctccagactccttacaggacgactaaccaagcaggaagactaacggtcatctccctccgctcctgaccaggatgctgcaggtgtaggtgatggagaagaaactatgcagagcttggagaagaatagtagaagaggagccttgggacacacgagcaaagatgttagaggaaggcacaactgcattgtttggtggagggcgccacaagacagaaactcacgcggagaaccagacactgcagctccctgtctggtgaggcgtgtgacttccccttcctcctgttatggccgtcaggagaaggagagcgagcagtggcgaatgtanaaataatttccaggtgtggcggagcttataaaggagaaaagcatgcaaaatgcaaatgtccaaaaactctctagactattatatatatagcactttgtgttctgcaaatacaactaatatccaaat

SEQ ID NO: 7983 - DNA, 575 bp, Hordeum vulgare
  Predicted polypeptide sequence is orthologous to G2348
cggcacgaggggaagttctcttgatcagcctaaattcagatcacttctttcgtttgatggagagtacttgaagcatgattgttgccgtctaacgtcttatgaaacctttggtcgcatgaaaagtggtgatcctacatttgattctcaacaggaagttttccggataaacatcactcaaaaaagctggatactcatggacctggttttgtagaagtggaaaacgtgtttgggctatcaaattttgtccctatccttttcggtagcaaacagttatgttttgaactagagaggatacaagatgctctttgtggttcttccaagtacaagagtgcaaatggagagttacctggtgttacttctaacccttgcgagctttgggaacttcaacaaactgcaatgtcgggatttctgatagagattgggtggttattaaagaagccctctccagatgaatttaaaaatttactaagtaaaacaaatatcaagagatggatatgtgtgttgaagttcttgatacagaacaattttattaatgttcttgaaatgattttgatgtcatcggacaacatcatagg

SEQ ID NO: 7984 - DNA, 997 bp, Hordeum vulgare
  Predicted polypeptide sequence is orthologous to G2457, G2459
gcccatacatatctctctctccatcgatctgacctacatacacacagagaaagttagagaagcagcagtcgtacatgtaacctagcctggagttctccaagccaacgcttcttcttcttcttcttggctgccgcctggcgaacctcgccgtagtctgaacggccagggaggggggcagcgaggcggcggcgccaggggataatcagaaggaatgtcgtcgtcgggccagatcgcaccggcagaacaagtctgctacgtccactgcaacttctgcaacaccgtactcgcggtgagtgtccctgggaacagcatgttcaacgtcgtgacggtccggtgtgggcactgcacgaacctgctttcggtgagcctgagagggcaggtgcactcgccgctccctgctgctgcacaggcccaggagagcagcctgggcaagcccagtggcatcaacggcttcattcgtgatcacagcgtctacaatcacccggagtttggttcctcttccacgtcgtgcctccaaattccagctggccacgatgatgttctcctcccaaaatgatctgctgcatgaacagacgctacacgcacgctctacggagaaaggcaacgtgttccttctgcgacaacagaatcttaaggaagaaatccaaggataaagcaacaaccccgactttaccacagggaggcctcacccccccgcaagaactgggccattacccaaacttcatttgggctacccccggagcaacgggggaaagagctgcctaaaaaagccccccgggtgcaaaaaaaccaaggtttgtttctagaccaagggggttggggccaaaaaaagaagaggcttatatgagtgaaggggggcgccatatttatttgtcaccaccgcgcctggtgggaaccaccgggcacccaataaagatagaggcctccacgtatctgagattaaaaccgcgaggtggggggcgaacaaccaagctgagctggaattatagatgggtct

SEQ ID NO: 7985 - DNA, 849 bp, Hordeum vulgare
  misc_feature (685)..(685): n is a, c, g, or t
  misc_feature (744)..(744): n is a, c, g, or t
  misc_feature (766)..(766): n is a, c, g, or t
  misc_feature (768)..(769): n is a, c, g, or t
  Predicted polypeptide sequence is orthologous to G2457, G2459
tcggcacagatcgcgccgccggaacatgtctgctacgtgcactgcaacttctgcaacacaattctcgcggtcagtgttccaagtaatagcatgttgaacatggtcaccgtccgttgcgggcactgcactagcctgctatcggtgaacttgaggggattaatccagtcaccacttcctgtgcaagatcattctcaggagaatttcaaggcccaaaacatcagctttcatggaaattaccctgactatggcacatcttctaaataccggatgccaatgatgttctccacaaaaagtgaccaggagcatatgctacacatgcgacctcctgagaagaggcagcgggtcccttcagcgtataaccgatttattaaggaagagatacgaaggataaaagcaaacaaccctgacataagccacagagaagccttcagcaccgcagcaaagaattgggcacatttcccaaacattcatttcggactaggctccaatgagagcagcaagaagctggacgagaccatcgccacgcctatcccccagaaagttcaaggtctctactgagacatgcagtcctatatgaatgatattttcatattgtaagtaacttaaggaaaattgaaagtatttctgaatcagtttgtgagtgcatacatagatcatgagcgaatgatatgcatgaagtgagaanagagcatatggtaggtgcatgcagctagctaacgtccatgcatataaaaaacgcccttngatcgccagcttgggtattaantnngctgaaatatcactttccttgaacatgtttgtggtattaggaattggtttggctaggtgcaaaaaaaaaaaaaaaaaaaa

SEQ ID NO: 7986 - DNA, 456 bp, Hordeum vulgare
  Predicted polypeptide sequence is orthologous to G2520
acataaatccatggaatacatgaaggttgcgaatacatgaggaacagtcctgaatcccaaggtcaaaacaaaaaggcaccgtgctcggcggttctctctaaatacatgtccgacgtctctaccagcaattacagctccaaaaactatgaataaaaccgcatttggaacgagatggttgcacaaaaaaattgatctacgatatgaaagtgggggttgattggccgaggattcatcgcacgctttgttgggtgccaccctgaatttgttctgctcatgtcactctttcataggtgccgccaatctgcatgtgaagccattctgaagccggcgagccctgggcgtactctcttggtgtttgtgggtcaaatgtaagccctggagctgtgttgtatgtcggcgcagcaaaatctttagttggaaatgtttcaactccgttgtgagcatgggcatgggcat

SEQ ID NO: 7987 - DNA, 770 bp, Hordeum vulgare
  Predicted polypeptide sequence is orthologous to G2522
gcttgacgacgccgcccagaagaagaagcgcggccggccgcccggcaccgggaagaagctctcctcaaccaccagtaaaccctccggcaatgcgttccccggttcagctgggacgagcttcactccccacatcatcacagcatctccttcagaggatgtcgccgggaagatcgcggcattcgcgagccagtcgccgagggcggtatgcgtgctctcggcgatgggctccgtctccagggccgtcctccgccacccggcagatcatcctccttcctacaacaatccctccatttacgagggattgtatgaaatcctgagtttatctggctcttacaatctgaacgagggccagcaaaatcaaaccgatgggatcagcgtcacgctctgcagcccggagaggcatgtcattggaggtgttctgggtggagcattggtagctgccagtactgtgcaggtggtgctagggacttttgtgcaaggagggtgcaaatcggagtgcaggaaaggccgggaaccggcggcgggcttggggcccaagacactgagccgcactggaccagacggggcggggcccggctggagagatggccggggcctggcgcggcctgcatgggggcgacagaggggatgggcgggcgggggggtgtggggcccggcggacgggcttaggggtgggggcttcgggtggggggtgggtgtatgggtggggccctatcgttgcgaagaaaaatcgttgtaggcgcgaaggagggagccggggtgttgttatt

SEQ ID NO: 7988 - DNA, 552 bp, Hordeum vulgare
  Predicted polypeptide sequence is orthologous to G2543
gaagcacgaccaccgctacacgacgctctagattcaaacacttgtggtcattcaacgaatgtccccaccccaccaacgagatgcagcaccccgatctcagtcgtgaccacggtctcgaggcccgtcaaattaagttttggttccagaaccagtggatgtaggtgaatgtgtctgctaagaacaatctcttgattgtccaaagtttctatattttttaccatgatctggttttcaactgtttcctaaatggaatgaaatttggtcgagggacttggaggtgaggccagtaacatggctaaggtcctcctttagccgggcgttctccatgcgcagcttctgctcgtcaaagtagtccttgacaacgggtgggccattatagttgaggcagatgaagttcttgagtgcctcgcacatgtcgatgttttgccaccggatcttgtttctctccacgtggagaaagcagcagtcctgccactcgtgttgccctgccatgcgaacacaacaaacaccgggcatccagattccattatgtttaggaactagtttgaaacg

SEQ ID NO: 7989 - DNA, 580 bp, Hordeum vulgare
  misc_feature (486)..(486): n is a, c, g, or t
  misc_feature (536)..(536): n is a, c, g, or t
  Predicted polypeptide sequence is orthologous to G2559
tttttttttttttttttttacacaattctcttacaaatttaaccagatatcaaatcatccaacaggaaaacacacacacaccaatggcttgcaaaacacatgtacacacaccactaacaagtcatgcacgaaagccgtaagtaacaaccccaacatatgtacactctgaagatcgagagtgtcgatggcttcctcgattcacagttctcatgctttcaggagcccaaagagcttcgtcggggcttcgcctttggcacggtacttggctgccatctcctccgccatgattatctcctcgcctcgcttcgcctccgccatcgctctcttctcctccgccgacttgtggagcatcgcgagcttgttcttcagcttctccttgtacgctgctttcttcttttccagttgctcctcgatctttttcagttcggcctccatctccgcttccttggcgtgctcccatgaagtgatgaaggacagattcttggncgccctgttctcagctctcgccttctcgctctcctcccaggcgtttgatnagcgtcgttctccttctcggacataatcttggggagataaggat

SEQ ID NO: 7990 - DNA, 847 bp, Hordeum vulgare
  Predicted polypeptide sequence is orthologous to G2592, G2713
aatcttcctattcactttccttgtgtatatgcagtgccgggaagctcattcacaaagcccggaggtctaggacatcggtgaatctctggttgtcatagcagagcttctggcagatctgtctttccgcagcataaaccgcgatgttagagagagcttcagaagcttatcaaggccgtgctttgaggtgaggatttcaggcctccctggtctttccggccatcatcaccggcggaagtctttccggccaccgggtgagctgcaccgcggagctgtggtggctgaccagaatggctgggttggtcttcctcctgaatcacttcgagatgtgatgaataggctggaggaaggcgagagcacttggccctcccgcaaagatgttgtggcttgtgcggctgtctgcagtgcgtggagagagatctgcaaagatatagttcagagcccggagttctgtgggaaactcactcttccggtgtcgcttaaacagccaggacctcgagatggattaatccagtgctttattagaagggacaaatcaacactaacctattatctctacctgtgccttagccctgctgtgcttactgagaacgggaagttcctgctagcacctaagaggaatcgtcggacaacatacaccgaatacataatttctgtggattctaaaaacatctcacggtcaagcgacggctatgttggaaaaatgaggtcgaatttccttggcactaagttcatcgtctatgacactcagcccccctaccattgccggagcctcatcccatgccagcgccgtaggccgtcgtatctttttcaggagggtctccccgaaggtgcctacggttgcttcccc

SEQ ID NO: 7991 - DNA, 700 bp, Hordeum vulgare
  misc_feature (3)..(3): n is a, c, g, or t
  misc_feature (589)..(589): n is a, c, g, or t
  Predicted polypeptide sequence is orthologous to G2592, G2713
tcnctaaaggcgacacccagcccccctacaatggggctatagttccttcagttggacggagtagccggagattcaactccaagaaagtgtctcccaaggtgccatccggtagctacaacatagctcaggtgtcttacgagctaaatgttcttggcacgaggggccctaggcggatgaattgcatcatgcactccatacctgcctcctctgtcgagcccggcggcacagtccctgggcagcctgaccagatcatggcccgagccctagaggactcgtttcgcagcatgagctccttctccaagtcatccatcatggaccagtccaccgatttcagcagctcgcgttatttcagcagctcccggtttctttcggacattgccggaggtgcgataagccgcgatgaagacggggagaacaaggagaggccgctggtgctccgcaacaaggttccgaggtggcaccgagcagctgcagtgctggtgcctcaacttccgcggccgcgtgaccatcgcctcggtgaagaacttccagctgatcgcggcgccgagccagccgccgccagccccggcaggtgccccgaccccgaccncgtcgcagcctgccccggcgccggagcaggacaagatcatcctgcagttcggcaaggtgtccaaggacatgttcaccatggactaccggctacccgcttgtccggcgtttc

SEQ ID NO: 7992 - DNA, 692 bp, Hordeum vulgare
  misc_feature (7)..(7): n is a, c, g, or t
  Predicted polypeptide sequence is orthologous to G2592, G2713
cctgggnaactggggatagactctaggttttggctttgccggcaccggcaaataatgtactccgccacttacagtatgctccctccgtctcaaaataagtgtctcagctttatactagttttagtataaagttatactaagcttgaaacatttattttgaggcggagcgagtattaatcatgcacagaaaataaattacatagagagatagctatattatatacaccaccggacaaacttcaggcgacggtctacccaatacttgtgattccgtttttctccccccttcttccagctgccatcattttccccagcaccttgtttcattcacaagcaatcttggtatcaaaactgcttagacatattgcaaatgattgaaatgctgatatcgggtagcggtagtccatggtgaacaagtctttgcctatctttccaaactggagaatcaccttgtcatgctcctggctaactggtccattgtcatctgaagccaccagctgaaagttcttcactgacgcaaccgtcacccgcccacggaaattgaggcaccaacattgcagttgttcatgccaccgaggagacttgttcttcagcaccagcttctcttcgtcctgagcctgagcgggtgcactgtctatccgagcagatttagatctgaagaatggaatcgacgggaaggagtcaaggttgct

SEQ ID NO: 7993 - DNA, 674 bp, Hordeum vulgare
  misc_feature (593)..(593): n is a, c, g, or t
  Predicted polypeptide sequence is orthologous to G2592, G2713
ctgctgggctaacttgccttccgaattgcttcgagatgttattgagagattggaggctagtgaggctacatggccttgtaggaagaatgttgttgcttgtgcagctgtctgcagaacatggagagagatgtgtaaagagattgtaaaaaatccggagttttgtggaaagatcacttttcctgtgtccctcaagcagcctggccctcgggatggaactatgcagtgcttcattaagcgggatagatctacccaaacctactacctgtacctctgccttacctcagctgtgcttgtcgaaaatggcaaattccttctgtcagcaaaaaggatctgccgtgcaacatgtacagaatatataatatctatgaacgcgaacagtatatcaaggtctaccgacacctacattggaaaaatgaggtcaaatttccttggcaccaagtttgtaatgtatgacacacagcctccttacaatgcaagtagtgtttcacattctgggacgacaagccgaagattctactccaagaaagggtcggcgaaggttccttgcagcacatacagcatagctcaggtctcctatgagctcaacgtcttgngaacccgtggtcctaggcggatgcgctgcgtaatgcactccatccctgcctcatcgctcgaggctggtggcagtgtccctt

SEQ ID NO: 7994 - DNA, 612 bp, Hordeum vulgare
  Predicted polypeptide sequence is orthologous to G2592, G2713
cggcacgaggctcatccagtacttacagtatagcgcaggtttcgtatgagctgaatgtcttggggactcggggccctaggcggatgaactgtgttatgaactccatacctgcctcatcacttgaggctggtggcactgttccatgccagccggacaatgccgttgctcattcccttgatgagtcatttggcagcatctccttctccaagtcatccactagggaccgctccatccgattcagcagcacccgattctctgacatctcaataggtggctccaggaatggaggccaggcattgggtgataaagatgagtgcaaggagtggccactaattctccgcaacaaggcaccaagatggcacgaccagttgcagtgctggtgcctcaactttaagggcagggtgaccgttgcgtctgtgaagaacttccaacttgttgctgcgacacagactactgctgaagaccggacctcttcacagcctgccccgccacctccatctgagcatgacaaggtgatattgcaatttggtaaggttgccaaggacatgttcacaatggactaccgatacccgctgtcagccttccaggcctttgcaatctgcctcagcagct

SEQ ID NO: 7995 - DNA, 671 bp, Hordeum vulgare
  Predicted polypeptide sequence is orthologous to G2592, G2713
gggaggcaggccaagaatcacatgcttttcatgtatgatacgtccagttcttcaatactacaacagcaagcacaattacaacccaggaaaaacacgacggcgaagcacaaacatgagctaagaacctaacgaaccagggcgtcgccgccgtctgatctgcaccggcgccccttcgtcgcttcgctttggtcttggtgtcacaaattattcacaggccagtttcgtgtcgaagctactcaggcagatggcgaacgcctggaaggccgacagagggtagcggtagtccatggtgaacatgtccctcgcaaccttcccaaactgcaggatcaccttgtcggggtcgacggggccgggctgcgagggggtcggggcgcctgccggcggcgggttcgacgcggcggtcagctggaagttcttcaccgaggcgatggtcacgcggccgcggaagttgaggcaccagcactgcagctgctcatgccacctcgggggcttgttgcggagcaccagcggccgctccttgacctcgccgtccccgtcgcagtccgtcagcccgccgccgctgatctcggagaagcgggcgctgttgaagtccatggactggtccatgatggacctggagaaggtggcgctgctccggaacgactgggagaaggacgtgatgctgcggaatg

SEQ ID NO: 7996 - DNA, 661 bp, Hordeum vulgare
  misc_feature (175)..(175): n is a, c, g, or t
  Predicted polypeptide sequence is orthologous to G2604
ggtatacaggaccaatattgattagcttcacctagacctggttagccaactcttgttggtgagttggtgtaacctgctcgactgatatccgcggacgaacattccgctctccaatttcagtgacaaaaagacacaaagaacatttaaccgcaggagccccaaaaggatacatcangcaatgtctcacattgtccacagtgtacattcccaacttcatgtgcttccaatactaggtttattgtccgacaggcagaacactgtacatgaacggcacctctaggataagcaataagttcatagcagcttccacacaccatttgacctatttctttgtttacgaaagggggtggtggtggtggcagaagttccaccgcgtccaatgaacaaggagcggcctgaacatttggagaagatgactgctgccttagctggggcaatgacccctctgctccattctccaatcgcgggagtactgtagttgcactgtccatgtttgcatccatcgcctgcgatgctggcggtagcagaactgttccctctgagttaacagtaacacaatctgtggcaggtacatgcaccggggtgtccacagcatgtgtcgtaacagaattcatctgtggctctagctgtggcaataacccgctcttcgacggtgatgaca

SEQ ID NO: 7997 - DNA, 751 bp, Hordeum vulgare
  misc_feature (445)..(445): n is a, c, g, or t
  Predicted polypeptide sequence is orthologous to G2604
gacaaaatcccatccggaatcaacttctccccctccgatcctctttctccccccttccccgccgcctccgccggcgagaatcgccggcgcgcccgttgcaacgacccaggagccctctgtcacgggcgggcctctccccggagccaccggagggctgggacgggcggccagtctcgtccagagccgcttcgattgcaggtatgcagagccagatcgtgtgccaccgttgccggagggtgctggcctacccgtcaggggcgcccagcgtgtgctgcgccatgtgccgagccatcaccggcgtgccacccccagcgccagcagtggaaatggctcagcttatatgtggtggttgccgaactttgctgatgtacacccgtaatgcagacactgtgagatgctcatgttgcaatacagtcaatcttgtcagaccaatcaataatatacnccacgtgaattgggggtcgtgccggacactttgatgtatccacattgaacaccttctggcaatgggccatctgcgattttttacaatactgaaataacacctgtaactgcacatgtccaaggcctcttaaatgaatttgatataatgttataaacttttggtccccatttaaccccaaaatgtacccttgtgttagaaacctaaaatggtgaaaaaagggtaactggtcaagacttataaacagaattccctggaaaaaatgaataaaatgatttaacagaaaaaaccttttttgggattttaaaa

SEQ ID NO: 7998 - DNA, 670 bp, Hordeum vulgare
  Predicted polypeptide sequence is orthologous to G2604
ctcgactcgctcgctcgtctcgacatctgcaccggatcgagctcagcaaagcccgagccggaggcgctcgtctgcccggggagcggcgccatgcgggtccgcctcttcctctgaaccgggcaagcgcgagccgccttcttcctccggctcggcgtcggcggcgacgacgagcgtcggtggcggcatagcacggtccagcgacgagcaggatttcatgtagaggagggcaatctgttctcatcccctcgacttccagcagagcgtgcgaagtctcttccgcagcaacgacgacgccggctcaggcagccgcgggcacggcaatgccggttcctcttgccccttacccaactcctcctgcgcccttcacgccacccgctcccaatgcaggggctcaaagccaacttgtctgctctgggtgccggaatctgctcatgtatcctgccggcgcaacgtcggtatgctgcgcggtttgcagtaccgtgaccgctgttccggctcctgagaccgagatggcgcagctagtttgcggaggatgccacactcttctgatgtacatacgtggtgccacaagtgtacagtgttcttgctgccacactgtcaacctggcaatggaagcgaatcaggttgcgcatgtaaactgtgggagttgccgaatgctgctcatgtacca

SEQ ID NO: 7999 - DNA, 287 bp, Hordeum vulgare
  Predicted polypeptide sequence is orthologous to G2604
ttcttgctgccacactgtcaacctggcaatggaagcgaatcaggttgcgcatgtaaactgtgggagttgccgaatgctgctcatgtaccagtacggcgcaaggtccgtcaaatgtgcagtctgcagtttcgtgacatcagttggggcatcatcgggtgcagagcagaagcccagcaactgaaatcctgcaagttcattacgaaggcagcttcccgaaataagaatgctttgagtgcacatgtatagagttcttcccagaagcaaccttttcctcccagcggccgcca

SEQ ID NO: 8000 - DNA, 870 bp, Hordeum vulgare
  Predicted polypeptide sequence is orthologous to G2636
ctcgtcttctacaccgggagggcgcccaagggcgagaagtccggctgggtcatgcacgagtaccgcctcaacgccaagctccacgccgccagcaccagccgcggctccctccccggcagcagggccgcgtcgtcctcgtcgtccaagaacgagtgggtgctgtgcagggtgttcaagaagagcctcgtaggcgtagtgtcgccggcgccggcgtcgtcagcagcaaggaaaagcggcgtggggatgatcgaggagataggttccaccgtggccgccgtcaccccgctccctccgctcctggacatgtccggctccggcgcctccttcgaccaggcggcgcacgtgacctgcttctccaacaacgcgctggaggcggaccagttcttcaacccaacggtgacggaccaagaccagcacagtctagccacatactacccgctaacaagcttggagcagtgcggggggcaagtgcaccacggggagagcctggacctggggcatgtcctggggagcaggaggaccaccgtgggagaggtaacaacatgaggcactgacaataacgagtaaggacgggcggtggcaggatagaacagatataggtgggctagtgagaagaaccacgacaagcaaagaagggaaagagtaggatatgggactgtggacaggaatggtgagtggaagggctatagcgtggtggggcaaggccgatggagaagtaggaggaacgccggagtggaggtgaggtgtggaagtgggagggtatatacaggttgtgtgtaggtcgtctgggacgaggcggtcggggggtggcggtggaggcgaatagagagtgggggtgagaaggggagagaggtgtgggggaggagtgag

SEQ ID NO: 8001 - DNA, 424 bp, Hordeum vulgare
  Predicted polypeptide sequence is orthologous to G2691
tttttttttttttttttttatgtcggcagttgatatgccaaattcattgatcaaaagagggtgttacaagagtccacagaagagaaaaacagcgcaaaaggacagcgcaaaaataaaagaaagaaaaagattcatggacagtaccacaaacccaagctctaccatcaattgtgcccaccattggaatccatcgttgggatctccaaggtgacgctcctcggagaaaatgatgttgaggacactgtcgtcacccgatctcacactgcctgatcttagattttcatccggagatctcacgtcgttggtaggaagggcaaacggctccacaacaatacctctaaggagggagacgacatccataaatgccgttattgccggcaacaacaaggtcgatgcaagattttcatccggagtcgagccttcc

SEQ ID NO: 8002 - DNA, 1542 bp, Hordeum vulgare
  Predicted polypeptide sequence is orthologous to G2702
gtacttgcagccttggagatcgacctggtctctagataggatagctagtacagtccataactacatctttgctaggagatcgggctgggcaatgaggaagcccgtggagtgcccggcgacgaagtgcagtggtggtgtggcgccaggaaacagcaatgtggctgcagcggcggccaagctgcggaaggggctgtggtcgccggaggaggacgagaggcttgtggcgtacatgctgcggagcggtcaggggtcgtggagcgacgtggcacgcaacgccgggttacagcggtgcggcaagagctgccgcctccggtggatcaactacctccgtccggacctcaagcgcggcgccttctcgccacatgaggaggacctcatcgtcaacctccacgccatcctcggcaacagatggtctcagatcgcagccaggttaccggggcgcaccgacaacgagatcaagaacttctggaactccaccatcaagaagcggctgaagatgaactcggccgcttcgtctccggcgaccacggaatgtgcgtcaccgcccgagcccaacctcgacggcggcagtgccagctgcctcgacctcaccagccaggaggacgggagccaccacgcaatgaaaagcatgtggatggactcatcctcctcctcctcttcgtcttcgtcgatgcagcaggggagccgaccgtcaacaatggctccggcggcaaacaggggctacgggggcctcctcctgcccctcccggaccaagtctgcggcgtcgcaccttccacccacacgtcgttgccgccgttcttccaagaccattcatcgtttaagcaggtttctcccttgcggaccggtggctactaccctcacggaatggcaatggaaggagcaggtggctgcttcatgggagaagaagctgtaggcggtggaggcgaacgtagtgtcgtcttcaacgtgccccctctactagagcccatggcagtagcattgcaagaccaaaccttaatggcatcaactggtaacagcaacaataaccatcgaaacactaacagtactgcagagggcaccacactgagcagcaaaaatggctgcaacatcaatgacgacaacaccagtaagaacaacatcaacagtgtggtctcgtactgggagcagcatggtcagcagcagcacatgagcaggaacgtagtcatgggggagtgggacttggaggagctcatgaaagacgtgtcatgcttgcctttccttgatttccaagttgagtgatgacacgctgttgggggccacctcctacctgcgtgcctaaactacatgcatatacgaatatacatatataattaagtatatatacacatgcatacgttaaaggtagtctttttttccttgacattatttacatgatgtacgcaagatttcttcagcagccactacttcacttttgatactacatatatctttgatgaattcattcttgtatacagatactcatgcctatgcaaataattcaagcaaagttacttgagttaataaaaaaaaaaaaaaaaaaaaaa

SEQ ID NO: 8003 - DNA, 734 bp, Hordeum vulgare
  misc_feature (8)..(8): n is a, c, g, or t
  misc_feature (531)..(531): n is a, c, g, or t
  misc_feature (575)..(575): n is a, c, g, or t
  Predicted polypeptide sequence is orthologous to G2717
gaaaaaanccctccgaaaagagattagggtttctggtcggctagttcatacggtgaggagcacgggaagggaggcggaactcgggagatgggcgcgccgaagcagaagtggacgtcggaggaggaggaggcgctgcggcgcggcgtgctcaagcacggggctggcaagtggcgcaccatccagaaggatcccgagttcagccccgtcctctcctcccgctccaacatcgacctcaaggacaaatggaggaatttgagtttcagtgcaagtggactgggttcaagggataaacaaagggttccaaggccgaaagcaccttcgtcctccccatcacctagcccgcagcttctgcttctcccggccccaaatagtgttgccgatgctgctccaccagaagattctgaaaaaagcccacatgatgacaagactccgagtccaaagttgtacagtgccatgatcctggaagctcttggcgaactgaaagagccaaatggttcagaagttactacaatttgcaattttatagagcanaggcatgagggtgcaaccaaatttagaaggttgctttgtgcganaatacgaaggcttataggcgtgaacaaaagtgagaagattgacaagtcctataagctgacggattcatatgcaaaaagggctctggctccaatgaaagattcatttctcaagaagaaggatcccgccaagtcatccaaggcagcaaagggtctagccct

SEQ ID NO: 8004 - DNA, 864 bp, Hordeum vulgare
  misc_feature (841)..(841): n is a, c, g, or t
  Predicted polypeptide sequence is orthologous to G2717
aagcacggggccgggaaatggcgcaccatactcaaggaccccgagttcagcaacatcctgcgctaccgctccaacgttgacctcaaggacaagtggaggaacatgaatgtcacagtgaacgcgtcgggctctcgcgacaaggtgcggacgacggcgacgacgacgcccacggctaagaagccgaggtctgctccgaagcaggaaagccagtcgatggcggtcaccagcatcacctctgacggcgatgacgacgtcgtcgacgtgaagcctatcataaagccgatcgtaacgtttactacagggaataaatcgctatccaggctagaaaatatcatactggaggccgtgaagaccttgaatgaacctacagggtcatacaaaacagccgttgctaattacatagaggaacaatactggccacctgctgattttgatcatgtactgtctgcaaaactgaatgagttgacatcatctggcaaattgatgaaggtgaatcggaagtacaggatagcccctagctcgtcttatctagaaggacgaagctccaaaatggtgctgcttgatgatataaaaaaggagccaaccaaggtagagaaggtacagagggatggctctacagcccacactaaatcacaagtagatgctgaaccttgaccgatgagaaacatgagcgcagaagaggctgcacctgcacgcgcttgtgcggggtgctgaagcggaagctatcatggcgggaagctgaagccccagtgagagaaccggaggcttgagaaagctgatgctgtaacttggcccagaccttgcgggagacagaatgttggccttaaaaaacaggattgangttagactgtaatttcgagggga

SEQ ID NO: 8005 - DNA, 1168 bp, Hordeum vulgare
  misc_feature (11)..(11): n is a, c, g, or t
  misc_feature (19)..(19): n is a, c, g, or t
  misc_feature (36)..(36): n is a, c, g, or t
  misc_feature (719)..(719): n is a, c, g, or t
  misc_feature (779)..(779): n is a, c, g, or t
  misc_feature (873)..(873): n is a, c, g, or t
  Predicted polypeptide sequence is orthologous to G2717
ggggggttttnccttgacntccctgatcgatacccnttctaaagggaacagaagctggagctgcaccgcggaggcggccgctctagaactagtggatcccccgggctgctggaattcggcttgagggccggcgttgccaagcacgggccgggaaagtggcggaccatcctccgcgacacggacttcagcgccgtccttcacctccgatccaatgttgacctcaaggacaagtggcgcaacttgagtgtcactgctggaggatatggctcaagagaaaaggcaagaatggcattgaaacaaggcaagcgtgttcccaaggttaacactgaaccaatggacgttgatgcagataatctggacaatgttcatgatacagtcattgattcaaaaccattggcaatggttgttgaacccagccagcatgaattcagttcagagaagtcagttgctaggcttgatgatctcatattagaagctataaagaagcttaaggagtcttcgggatcaaataaaacggccatcgcttcatacattgaggagcaatactggccacctactgattttcaacgcttactatctacaaaattgaaggcactggttgctaccggaaaattgacgaaggccaaccaaaaatacagggttgcaccaagtttagtctcgttaggtggaaggagcaccaaggtgcactcaaccgaagatgacaaacgaaatattagttntagacaactaactaagcctcaagtggatgctgaactggatatgatgacacacatgaatanggagaggcagcagcatttgctgccaaagcagttgctgaggcagaagttgccaatgcggaagctgaagaagcaacaagggctgcagaagctgcanaaagctgaggctgaagctgcaaaaggcttttcttgaagctggcatggttgactggggcaaaacaaaaaaggctggctctggcgaatcttccgaggcttggttgaactttctcttactaacttgggccctgcacaatttggccttttaatcagcagaaactttgtcccgaaaaaatgggttttgtttgggccccaaaagcttttggtcgaatccagaaatttcttggattagcccttatagaataaaaaggtttcaatgaaaggggagggggtttttaaacatcttggtcgtgggg

SEQ ID NO: 8006 - DNA, 692 bp, Hordeum vulgare
  misc_feature (608)..(608): n is a, c, g, or t
  Predicted polypeptide sequence is orthologous to G2717
cggcacgagggctcttagagctggcatagcaaagcatggagtgggaagttgccgtgtgatattgacagatcaagaatttagttccatcttgagctgccggtcaaatgttgatctaaaggacaagtggcgcaacatgaacgtattttccactgaatcaggctctatgaataagggaaggactgccacgaagaagaaccgagctactcctaagaggaacgatcactcaatggcaatcagcacagttgcttctgatgttgatgacgaaattgttgatgaacagcctatagcatcagtgtcaagtgaagtgtggaatgttttaattccgaagaaatctcggtcaaggctaaacaatatcatattggaatctgtaaagaacttgaatgagcctacagggtcacacagaactacgattgctaattacatagaggaggaatatttgccacctggtgattttgatcacatattgtctgcaaacttgaaggacttgaccaccagtggagaactgatagaggtaaatcggaattacaggattgcacctgcacctggttcaatgtactctgagggacgaagccctgaaacactgctagtagaatacatacaaggagagncccagatgacagagagcgatgatattgaaacccttacaaaatctcgagttgatgctgaattggcgcatatgataaccatgaccg

SEQ ID NO: 8007 - DNA, 672 bp, Hordeum vulgare
  misc_feature (633)..(633): n is a, c, g, or t
  Predicted polypeptide sequence is orthologous to G2724
aaccgagttgtggtttgtttttttttaaaacagtcaaaaatcaaattgcaaaatcctcagggaaattctggaaaatacaattgtgtctgcaacttttttttgctgatcatgctaaaattctggagattgagggcaattcaattgccaaagctgggcaaattgcagattgagggccattcaattgcaagagctgggcaaatttgtctgagtgaagatcaaaaggtcaatgagttgttccaatgcctatgaacttcttttagttctacaactagcggtttttcctctctgtacctatctcccctgatgtactacttgcgaatatagcccttgtacctaagtgttcacaacctggcttgattacttgaccctgtactggccttcgcctttacacatgtagaactggggtgctagataataaagctgctgactcttggctcttgaattgcatctggtctatttaggttgcaccttgcttcattgcatagatctgtggagtcctccatcttaaaaactgccatgtcaaggatggcgggaaagatgttcttgcctagtttttactatttcactagcccactgtagatagtctctcgcgcatcagctcaaaatatggatccaccccgacagagcaaactngccccgtgtaaataagtgcctgcttgctactatttgcta

SEQ ID NO: 8008 - DNA, 633 bp, Hordeum vulgare
  Predicted polypeptide sequence is orthologous to G2743
gttcctgcaagcactgcagcagctgggcgggtcccacgtggcgacaccgaagcagatccgggagctgatgaaggtcgacggcctcaccaacgacgaggtcaagagccatttgcagaagtaccgtttgcacacgtcaaggcggccgagctccacggcccagagcagcggcgccgccaccaccactcagcccgcgccgcagttcttcgtggtgggcagctgcatctgggttccccagcaggagtatgccgctgcggccgccgccgcggcagcagcaacagatgcaacaaatgtggcgccgggaagcgcgaacaaagtatacgctccgacggcgacgttgccatcaggggtgaagccacactcaaaagagcagtcgagtaggcggtcggaaggcccgatgagcggcgacacgggcggcgttaactcggactcggacaacccagctatgtcgtcgtcgtcgtcgcaaaccacatctgcagggcatccttagcgtataaccttcggagttgggacctacatagcctagagaaatagagtgtataagatcacattttgcagcaaggtaggccacattatttgttgttgtacacacatgcaagagagactagaaaatacgagtaaatagcaaaaaaaaaa

SEQ ID NO: 8009 - DNA, 693 bp, Hordeum vulgare
  Predicted polypeptide sequence is orthologous to G2754
actgggagtaacagtctcatttccagactccttcagcagactactattaccataacagtcttaacatagctactagggtggttgccttggatgaaggcacgagctcgagttacatcgcaacacagctcgccaaaggatcgatcagctcctaatctagggggtgcggtatacactgcaacgccctgtcgtccataattacttaggggggataggcctttgacatgtccacatcatgtcacaaaaacacaggcggcgaacacaaaaacactggagggtgtcggtgtggtcgtcaggcgccaggcctgccgcccgcacgaggttggctcagctggtgagcgtcgagagcatgccgccgccagcagccaacacgacctcccagccaggccctttcagggggaagtgcgggacggcatcagcagccgcacgcgcaccggtgaggtccctccggtccatcaccttcaggaggtcctcgtcgctgatgtctgtctggatcatcctgtcttcctcgtcctgctcgtccctcagaagcgccagcagctctccctcatctaaggcattaggcttcgcggcatcttgctggaactgtcccttcccaatcacgacgtgctctagcttcaactttccaaaagctttcttgataatccgtccctcaacagaattggatgtcgccaaccgataaacatgaactggctg

SEQ ID NO: 8010 - DNA, 546 bp, Hordeum vulgare
  misc_feature (68)..(68): n is a, c, g, or t
  misc_feature (123)..(123): n is a, c, g, or t
  Predicted polypeptide sequence is orthologous to G2763
ttgccttgtcagtaacaatggccggcttctgctgccaaacaaactcccatgtgtgaccgcacacaggnagccacagctcacaaaacgtagtactactggagggggtgtggggggtacacgagnatgagcaggcaagaaatgttcctcctacccaactaatgcacaattgcatccactctggggctcaaaacctctaaccatgggcgctgcggtgggccggaccgagacggaggcgcggcatcccatcacgcgccgtagatggcggagagcctccgcagggcggccaccttgagctcgaggatgcagatgtactcggcggtctgccggagcagcacgtcgacatcggcgtcccgggcgtccgggactatcttcttgagctccctcagcctcctcagcaccatgtgctggaagggcctcctgtgcatcagcgatgccaccacccccttggcctttcccaccgtgaaggtggccttccttctcatctctctctgtgtatctctccctctctccctccccaggttgctgtgtcactaacttgtgctgtgc

SEQ ID NO: 8011 - DNA, 426 bp, Hordeum vulgare
  misc_feature (424)..(424): n is a, c, g, or t
  Predicted polypeptide sequence is orthologous to G2765
tttttttttttttttttttttttttttatacgcgaaagtatttattaacgatcacacaatgggaacacctagtattagtagtacaaattagaggagcgtcggaacagcgtgccttcctttttcagtcgtagcatagcaacagtagccaacggaacggatgtccatttaagtatttgaccccgagcctccgggcagagcagggcagagcacctttataactcccagctccgtttccctcacacgtacggtaacgggtaaccaaaaccaaccccccactctcagctccccgctaatcatctacgcgcgacctcgcaggcgttcagccgttgcgcacggagccaagctaagctagccaggcaaggcggtggcatggggaacgctctggccggcaggcggcgggcggcgaaggtgatgacggtggtcngc

SEQ ID NO: 8012 - DNA, 629 bp, Hordeum vulgare
  Predicted polypeptide sequence is orthologous to G2766
tgccttacatacttaaatataacacattctacttgtcacctcctagtagtcttgaagccattgaagctaatccatagtacaaccaaggaaggagaagatgggcatggagactacttgacgtgcgaaaggcatttacaacttaatccccggaagcaaaacttggtcttgctaatcacattggtacaaagtacaaacataacctcgcatatctggttctgtggcgtcagcacttctgatcggctgagcaggagcagtttccttggtcctgttttagtttctcaatttggtcctgcaacactttgatgtagtctacagcaatgtccagcatgtctgaagtatttgtttgcttatccatgttgggcacgaggtcttgcaacctcctaagcctcttgctgatccttgttcttctttccctctcagcgatgcttcgcgggtgagtagcgcagccgcgcttggcgcggactctgcaggcgacggagtcctgctgcagctgcaggtagtcgtccatgccgggcatgtccagagacgagccaaactgtgagtcgatgttgctgaagctggtgaccatgccgtcgtcgccgtcggccatcaccttggccttcttgccgccgggcggcgcggagaagatc

SEQ ID NO: 8013 - DNA, 849 bp, Hordeum vulgare
  misc_feature (849)..(849): n is a, c, g, or t
  Predicted polypeptide sequence is orthologous to G2783
aactgggccagtgctggcgaaaagcgtgatgataccccagactatacaatttttgttggggacttggcagctgatgttacagactacatgttacaggagacattcagggtccattacccttcagtgaagggcgcaaaagttgtgactgacaagatgacaatgcgttcaaagggttatgggtttgtcaagtttggtgatcccacagagcaagctcgtgccatgactgagatgaatggaatgccctgttcttccagacctatgcgcattggtccagcagcaaataggaagacaacaggggttcaggagagagtaccaattccaaatacaaatactcaaggagctcagtctgacaatgatcctaacaataccaccatatttgttggcggccttgaccccaatgtcactgaagatgccttgaaacaagtgtttgctccatatggggaagtcgtccatgtcaagatccctgttgggaagagatgtggctttgttcagtatgctaacaggccttctgctgagcaagctctgcaattgctgcaagggaccttggttggtggtcagaacgtgaggctttcatggtgacgaagcccttcgaacaaacaaactcagcctcaggaagccacccagtggggtgcaggtgctgctgccggtgctgctggtggttactatgcttgatatggacaagggtacgaggctaatggacaagggtatgcacagccccaagaccctaacatgtttgggtatggaacctatgcctgttttccaaactaacaacaacccagcagttgccccttaaccggccaccgccccaacagtgagcccttcccaatggggttttccaaacatgaaaan

SEQ ID NO: 8014 - DNA, 767 bp, Hordeum vulgare
  misc_feature (672)..(672): n is a, c, g, or t
  misc_feature (729)..(729): n is a, c, g, or t
  Predicted polypeptide sequence is orthologous to G2783
ctctggataggggacctgcagtactggatggacgagaactatgtctacaattgcttcgcgagcaccggcgaggtacaatctgttaaactaattcgtgacaagcagactggacaacttcaaggttatggctttattgaattcacaagccgtgctggtgctgaaagagttcttcagacattcaacggggcaatgatgccaaatgttgagatgacatacagattgaactgggcgactgctggtgaaaaacatgatgacggcgctgattacacaatatttgttggtgatttggctgctgatgtcaccgactacttattgcaagagacatttagggcacaatacccctctgttaagggtgcaaaagttgtaacagacaaattgacaatgcgctcaaagggctatggctttgtgaaatttggtgatcctacagaacaaactcgtgcaatgactgaaatgaatgggatgatctgttcttccaggcccatgcgtattggtccagctgcaaataagcaaaaagcaaatggagttcaagagaaagtaccaactgctcaggggattcagactgacaatgatcctagcaattccaccatatttgttggtggccttgacccgagcgccactgaggatgtgttaaaacaagttttcactccgtacggagaagtggtccatgttaanatacctgtgggcaaaagatgtggttttgttcaatatgctagcagatcctccgcagangaagccctgctaatgctgcaaggtaccatgattgaagg

SEQ ID NO: 8015 - DNA, 1203 bp, Hordeum vulgare
  Predicted polypeptide sequence is orthologous to G2834
aacaaagggcggactggactacaatctgagctctggtggatctgaactggaactgggacgagaaaacgttcagaaatttccatgaaagcttcgtcgtccatggcaagcgacgcgtcaaggaacacagaccctggccaacatggtgttcgtttcagttccatggaccagtcttgctatgcaagacctggccagtcaatccctgcttatcctccgttctttggccctaaatcttccaactttcaccttcctgatgacagtgcgggtaaagcttgtgatccttttgaaccgaatcctccagcgaatgagcctataccaaatcgggatccttatgcaatgctgaacaaccttaccttccttgaccagaagatcaagcaggtgaaagatatagcgccatccatgggtaaccgacggagccacgttggtggtgcttcctgctagcttgccgcaaagccccagctcgtcactgccgacctcgacttcatcataattcaactcaatttcacctgccggactcatgcttccttacatgaaaaccccccttccttacagcaatccaacggtcagccaataaacacccctggttctaccatgggcttcggcttcaactggaaatcacggccaatcccaacccaggcacgcaatgactccctgacattatacacacatcttgactttgaagagctcgatgaactaccctttatacaccctcatgatgaaaacgatggatcggatccaattgcccaatatcttgtggccgtgtaaaggtctgcaaccggttcacctggaaaacccataactccacggaaaactcagatgtgtggaaggctcaatcctcccccctgcgtcttatgcggtcttgaatgcgaaacgggaaaatttaacacctctccctctcctgcgttctaccggccgggcctctacgggtgccctcctagtctcctcagggctagcaaatataacaatacctgtaccttgtaaccctgaagatcttgctccatcccacacactaaggttcttgccactgctcgtcacgcgcaccccaacgcagtatccatcaacaaatccgagtcgaaacccaaagaccactgacggactcctcacgcctcaatcaatcttctgagttataactaatatcgcccactacgtctataaacacctacaaaaatctctgcttctcatgaacacctcgctaacacacctcct

SEQ ID NO: 8016 - DNA, 671 bp, Hordeum vulgare
  Predicted polypeptide sequence is orthologous to G2834
agtgaataactaacatctgggatatgtttctgccacaggacaataggtacagaataacaagggagcgacgaggagactggcaaagtgattccagactctactgcgccatacaaacaagggcatatgcccccgctgctcttgttagaaacctctgcgttgttcttcataagcatctcccaactgctctttcagccacttacgcagccaacgcctcttgctgttgttagcaccccaaacagaacttgcaacactgctattgcccagctgctgcccgtccagaccagattgtgccaccagcaggtacaccatcatctttgagctcctccatccattccttgaagaactccggatcaaaaccaccttcaccgccatcttccccgtcttcgattcctccttcatccattatatcaaggggtgcctctgtagtccctgtcactgcatccttgttcagcggggacatggctggcatatggccttcaaagagggcgagatggccgaacagcttgtccttgcgggagaaggtggtgccacaggagcagcgccactgtgcctcctcaccgcagtggcggaggtggctgcggagatcggcaagaacagcaaaacgcttcttgccaccgcagcgctcgcacgcgtagagtttggggcagtggctgcgtcggaagtggttgcgc

SEQ ID NO: 8017 - DNA, 360 bp, Hordeum vulgare
  Predicted polypeptide sequence is orthologous to G2837
agaaggtcaaggagtatgtatacgggtcaggttcacacaagaaaccaaatggcaagcacgacaatagtagtgatgatgactcagatggtggtggtggaaagggcaagaaggcaaagaagacccgcttcactcacaccgcgaagggaaagggcaaatccaaagcttgatgagagatgtagtattaaccaccgctgctggagctcattttgggtaccatatcgcgtcctagtcgtagtttaacatgctgaagcatgatcatcttaagaaacaaacattttagagttcgttttgtgttgcttttgaaccctgatgtgctgaagccttgtggtaccatggcagtatgccacagccatcttgagc

SEQ ID NO: 8018 - DNA, 599 bp, Hordeum vulgare
  Predicted polypeptide sequence is orthologous to G2846
cttgcatgcaggtgctcagcgccccatacctcaagagcggccatcatcagcatcaagtgccacagtacctcaagagctcgagcaatggtagccccgacaagtcgtgcaaggacggcggcgaggtgtcgctcaagggccgggggctgtgcctggtgccgatatcaagcaccttcgccgtggccagcgacgtgcccgtcgacttctggactcccttcgccccacaattcaggtagacgaggaagaagaaggcttgatgaacgtacggctccgatccgatcgatcagaagcaaccacgcacagatcgatccgacgacgacgttcctcgatgatcttggtcgacaagctatatatctagtagtaacagcctatgatcataatttgtaacatgtagtaggaccaccaaggaaggaagcttgattaaattatatggctagctagctagatgaacctttggaatgagtgcttgaagacttgggctcattcttcaggttcatcgtcaagaaataatctatctattgaccaagggatgatctgctagctagctgagaagatcagtactactagtgggattatgtcgcgccgatcaaaaaaaaaaaaaa

SEQ ID NO: 8019 - DNA, 700 bp, Hordeum vulgare
  Predicted polypeptide sequence is orthologous to G2851
ccccgggctgcaggaattcggcacgaggcccaactcccagctgagccagatgctcttggctttctctcctaggtcatgcatcacctcgaacctcgacggcggcttgctggacttctccaaaggtgttgcgccggcgcccgcaccggagctgtggaatcaacaatcggataactcgtctgagagtaacagcactgcaactggatcagctcccaagaaggctagggttcaaggcggctcttcttcgggacagtctattctgaaggtaaggaaggagaagctcggggataaaataacagcacttcatcaaatagtttccccatttggcaagaccgacactgcgtccgtgctgcaagagactattggctatatcggattcctcctgagtcaaatagaggctctcagctacccgtatttgggacatggcactggagcctccgtacgtcaccaagctcagctgaaccatggtgatcacataaatgcctcagccgaagcagcccataccgagcaggatgcacaagatggcgagagcaagaagtcggacctgaggagcagagggatgtgcctggtgccggtgtcgtgcattacctcgcgtctgggcgccgacaacgcctctgatttctggcagccggcgccgccgctcggcggcatcatcctgcgctaggatcatcaaattgtttacacaccgcgcacgcgcgtaaat

SEQ ID NO: 8020 - DNA, 644 bp, Hordeum vulgare
  Predicted polypeptide sequence is orthologous to G2854
ctcacgcgcgtgcacgtcgacttggtgaatccaacaattcggcacgagataagttggtaatttggattctaacgtgactgaagaccatttgtgagaggtcttcagcccatatggtcagttggtgcatgtgaagattccacaaaacaagcgttgtggatttgttcaatttgctgataggagttgtgctgaagaagcactccgaatactgaacgggactcagttgggtggacaaagtattcggctttcatggggtcgtagcacatcaaacaagcaggcccaagcagatccaaaccagtggaacgctggatattatggatacagccaaggatatggttacggctatggcgctgccccacaagaccccaacatgtactatggagggtatcctgggtatggaaattatcaacagccacagctacagcaacaagtcggatatagcttagtgctgatattaacgatctttcgtggctgctgttctctctttactagtattatgaacttatgctacttgatttctcctttggttcgctatagggggattataaactaaaggctgtgttattcaattgttaaatacatatgcactgtttaaacgctcttctattacaaaaatttggactaaaaaaaaaaaaaaaaactcgaag

SEQ ID NO: 8021 - DNA, 890 bp, Hordeum vulgare
  misc_feature (62)..(62): n is a, c, g, or t
  misc_feature (776)..(777): n is a, c, g, or t
  Predicted polypeptide sequence is orthologous to G2854
cccgggctgcaggaattcggcacgaggcttgttgtgctggggacaagcggggtgacgatggnttctgatcacacaatatttgttggtgatttggctgccgatgttactgatgccatgttggaagagatattcaaagccacctacccatcagttaaaggtgctaatgttgttactgacagggccactggtcgctccaaaggatatggttttgtacgctttggagatctaaatgagcagacacgtgctatgactgagatgaatggagtgccattgtctacgagacaaatgaggattgggcctgcagctaacaagaagaatatgggtgctcagcagacatactcaactaatgcagggtaccagagctctcaagtaaatgaggcggcgaatgatcccaacaatactacaatctttgtgggcgggttagattccaatatagatgagaactatctaaggcaagtttttactccatatggcgaagttggttatgtgaagattcctgtaggcaagcgttgtggatttgtccaatttaccagcagggcgtgcgctgagcaggccatcagtgcgctgaatgggtctcagattggtagttccaatgttcgtctttcatggggccgtagccaaaacaaacagcctccccagcaggatgcaaaccagggtaatggcaacagctactatggatataaacagggtcctgatgcttactatggtgcacccaatgcgcaagatcctagcatgcaaaactatggatactctggttatgggcagttacgatcagnncacacagccaccacagcagcagcaaccttcacagcaggcaccaccacagcagcaacagcagccagccccccagcaggcaatgaccatcgaaggcgatgggagctcaatcagag

SEQ ID NO: 8022 - DNA, 384 bp, Hordeum vulgare
  Predicted polypeptide sequence is orthologous to G2885
ttttttttttttttatcttttggggatgtcatgtgaacttcgagcacaccaagtaaaaaatcacaattgtataggtacatgttagagataaaggacaatcgactggatgaacaacttcttcatagagaagataatgtcatagcctatttagtctattttgtagtaaaatggaatcaaacatccgatgaagatttcagaatgtctaattttcttggatgattttggaaggtacatataaagattgtccaagtgaacatggtgaagatacaaacttggagcgcagatacaaaaaccaaatcagtcttggaaaaaattaattagttccttcttggattcatgctgcttttcaccttgacaagttgaaggactgatgatgcctcgtgc

SEQ ID NO: 8023 - DNA, 643 bp, Hordeum vulgare
  Predicted polypeptide sequence is orthologous to G2898
aggagttcttcgacaggtacaacaggcagttgagatcagaaagggaaggccggagcagcagcggcagcagcagcaatagcagctcctaatgatgtacaggagttgcgtgctgcttagatgttagccattctgcacttggtagaacgaataattagaagatcgatggggcgggaggtcagctaacgccgcacgatctatgtgtggtggttgcatgtacagggtcaggttggcaggaaacctaagccaactcgtactgttgcggtattcttcagatgtaattgtactcatcatgtatcaatctcccacggctctcggagcggccgctggaggatttccggaaaacgtatcaggaagaaaatccaagtgtaaaagcaatgcaggatgtagggaaagcatgcggcgagaaatggaataaaatggcatttgaggaaaaggtgaagtattatgatcaagctaccgagaggcgtgccgagtttgagaaggcgatggctcagtacagcaagaaaaagataaacggtgaattgtccgaggaatcagagtagaagtgaacattgggttctgatgatgccacaagttaaatggatgaatcattcaaatgtatattacgtgcctgaacattgtacgaattctgttatcaatagat

SEQ ID NO: 8024 - DNA, 527 bp, Hordeum vulgare
  Predicted polypeptide sequence is orthologous to G2907
ttttttttttttttttttagcacaagaatttacaactagtctggtaaaacgaacaagtcacagcctaactggtctagtaaaagcccatcaacgtcacaaaatagtggacatcggtgtgtctaaaagctcatctgcgcacaaatcctccaaatcaaccatgaaatcacctccatcgaccccagctgcgtcgcttagcatcttatcctgtatcgccttggactcttgtagttctgtaacacaggcttgcagcctactgtattgttctcttgcttctgggtattgagtcattgatttcacacgagctaatgacctctgtagtctgccttcagcctgcttcctaccgtccttcaagaaatcatattcatcttcaccttctgcagttccaccttctgcaggttggatctgcgaggacggcccttcaagttgtttgtcaggttggaaaccacgcaagccccttccctttctcctccacctcagtataactttctccacgatgcccactgaccagattacctttctctgggtgc

SEQ ID NO: 8025 - DNA, 688 bp, Hordeum vulgare
  Predicted polypeptide sequence is orthologous to G2964
ggcacgagggcacgcctattgctccatctcttgatgatccccgttccatggcacctcttcctggccgcatgggcagtcggatggaaccaccatcaggtcctgctgcaacgtttggtgcttcagcaactgcgaaaattagtgtggatgcttcccttgcaggagccattattgggaaaggtggtgtgcactccaagcagatatgtcgtcaaacaggtgcaaagctatctattcgggaacatgagtcagatccatcacttaggaacatcgagctcgaaggatcatttgagcaaattaaagaagccagtgcaatggttagagaactaatcagcagcctgggtccagtaccaggtccagccaaaacagctggtgcacatggtggtcaagggcatccgggaagcaactacaaaacaaagttgtgcgacaattttgcaaagggaagttgcacttttggagaaagatgtcactttgcacacggtgcagccgagttgcggaagtcggtggtgtgagggctaaacaagtgcattctaagtagttaataggattgagatattatgcagtcttgtatgagttagagcctcgtttaacattctagctgtgttatactatctagttgaagtgacacgtattgaggtttttatttttaccattttagccccttacttcataaaaaaaaaaaaaaaactcgaag

SEQ ID NO: 8026 - DNA, 677 bp, Hordeum vulgare
  Predicted polypeptide sequence is orthologous to G2969
ataaacagggttagatcttgatttacttaagaaaaagatcaaaacacgaaatttagccatcgaagacatcacacgctacataacttatcgggtatgggcatatggcagggctcgactcgtctcgacgtcatggtgtaccaagtggtcgatcggatccagcaacagaacggggggcagccaatgtgcagtgccactgccatgccatgcagccaaaacttgaggtcgccccccctgttgacgatcgccggcagtgatcgagtgacggacaaactggcacacacccactaacctaacgaaaaagaagatgacgggacaagcaaaagcgggaaacggctatacacactagtgctccatgcacatgccacgtacggctagccgccgtacatgatgacgaagcacgggagcacggcccgggggttgaacaccagcagctcgccgtcgtcctccccccctcgtccgccgccgcccggcggcacgggcaccatggaatcgtaggccaccttgtcgccatcgccgtcgccgtcgccgccgcgaacgacgcgtcccgccacgacgcggcacaccagcatggcacggcgcacctgcaggaacgcgaactcgcgctccacctcctccggcagcgacgcgtgcgcggcccacccggaggagtacgtggcgatgccgtccacgtccgcctg

SEQ ID NO: 8027 - DNA, 700 bp, Hordeum vulgare
  Predicted polypeptide sequence is orthologous to G2981, G2982
aactgtctgatgatctccaaaacatcaagttacgtaacgaaacactgcaaagctcagcagagaacgtcaatggcatccgccttccatttgtattggtcaagacatctaggaaagcaagggtggaaattgagatttcagaagactcaaagtttgcccatttcgagttcaatggtgcaccattcacattgcacgatgacctctcaatcctcgaggggataaggcgtaacagcataggaagagctggccgtgccaccctccactagagactgaagaatattacaaatgaagtaaaagtgtcagagctggcacagccagattcttttgcacagctatgtatagctatatgttctcatgaaaacttgacctagtttataggacaatctctcaggcttgagaagattttaacctgcaaattttgtctcctttttgtgcctagcaggttattaggtctaagatagatgattcgtatatgtgctgctatgtatacattgatagcagctttggcggcacaagcttcgttgagcggccgctgtgccgaatgtttctcagtgctttacattctgagatgaaacttttatccgcaccttgcatgccaaggtcaaaaactttcactgctacaaccatctgtttttggtttagctttgctctgtacacagaaccgcaacttcctctcccgatcaagttagattctgtgaagttc

SEQ ID NO: 8028 - DNA, 336 bp, Hordeum vulgare
  Predicted polypeptide sequence is orthologous to G2990
agtaaggaaatggatgcattcacattcgggtttccataatcctcattcaccgtctagttgttataagagtattaaccgattcgattcggaacttcagcaaaaataccaatgagtagtactgtatgattgatctatcaagaagcagtcaagagcttaagatagttttgaccaagactctgaatcgtctggtcgatcagccagccgcctagctcgcaccgtccgtcacttcggcgatcttggcgcgaccgccgtggaccgccgcgtggggcctgcctcgacatcgccgtcctccctcttctccacgaccgccgcctcctcctcctcgccgttctccgt

SEQ ID NO: 8029 - DNA, 897 bp, Hordeum vulgare
  Predicted polypeptide sequence is orthologous to G2996
accggagggagtccgacttccccgcgggggccgagggctcgcccttctctcccaccgcaatggtcccctacggaggcgtgccgcaccaccagttctcgccctactaccgcaccccggcgggctacctgcaccaccaccagcaccacatggccgccgcagccgccgcggtcgccgccgctgccgcaggccaccctcgaccgctggcgctcccgtccacctcccacagcggccgcgacgacgccgaggagctgtcgggcatggcggcagggcccatgtcggcgctggccccgctgagcagcatgtccctgggcgcgggcccgtcggggtacggctccgggtccgggtccggcaagaagcggttccgcaccaagttcacccaggagcagaaggacaagatgctggccttcgcggagcgcgtggggtggcgcatccagaagcacgacgaggcggccgtgctgcacttctgcgacgaggtgggcgtcaagcgccacgtcctcaaggtctggatgcacaacaacaagcacaccctcggcaagaagccgcccagcatttgacgccgcatgcaaccaccaccaccaccccaagaaaaagccgcatgcacgacgcatctggcgtcatgggcctcagccgagctagctgatcgacccaccatggcatggctagccccccgataggtaccagcatctgcatgttgctttcttgttcagcttatagccattgcattcgcgcttgacggcgttcccctccggcccgaacggggcatggcttgctgggctggctggctggctaacattaaggttaatccggtaccagaagtccttgggtcttgggatggaattaggtggttccctattctattccattgcattccggggttatatatctaatgtggccccc

SEQ ID NO: 8030 - DNA, 519 bp, Hordeum vulgare
  Predicted polypeptide sequence is orthologous to G2998, G2999
cggcacgaggcagagctacttcgccacttgctttccctttcaaacgttcgtctcgcgccgcctaagatggggcctcggcaggaccggtccgccgtcgacggggggcaaggtaacggcgcgcggccagccatcgtccggtacagggagtgccagcgcaacctcctggccgggaacggccggcatgtcgttgacggctgccaaggcttcatggcgtcaataggcgtcgatgaggctaccacgttcctctgcgcggcgtgtggctgccaccgcagcttccacaggcgcgaggtcgtcgacgagttcggcgtcgactaccatgctccggggacgccccccgccaacgaaagccgccgttgaagcaatgaagcttattgctgatgcctcttgttgctcacggtgaattggatctggctggatcatgcatggcccaggcgcagctagtagtgttttaattcgtcttccttgtcgtcttatgaaatttgtgcggatgaataatttgcggggaggccccgtccgcgt

SEQ ID NO: 8031 - DNA, 642 bp, Hordeum vulgare
  Predicted polypeptide sequence is orthologous to G3003
agcttctgtcgaaatttagtgcactacatcttatctaatcagaagaaatacaagtataaccgtttggaccaagcttcatcacgctgtaaccttatgtaatcccacaaatttttaatacaaaatcgcatacaggaagaattgaaacatggaggtttaatctcaaatctgacttttgaaccccatatctatcattgcaccgtgataattgaacatagacaccaacttcaccctatccaaactcgcgaccagtcacaatagacaaaaatttgatattaaagaatttcgtgttcgtgaggttcattgcagtcgtaccgtggtttggttcagaacctgacatgccaagccattattcaacacgcttgcgcttctttcgagcctgtgtatcagtacagacactggaatcttgaatcgagcgatctgtatctgatccagacgttgccgcggcgacacgaaatagaactgaccccaaagattgcaactgatcaccgtcgccatcatcgcctatcatctcaccatcttcgagcaagcccataacaatagcaccgcttccgtgagttcgtgcatgctgagataagttatcgcttcgtgagaatctctttccacattcatggcattcaaatggtttatcctgggtgtgcaaag

SEQ ID NO: 8032 - DNA, 866 bp, Hordeum vulgare
  Predicted polypeptide sequence is orthologous to G3055
tggcagcacacgaggtaggccacggaacagagagaggagcaccagatcccgatcatgacgtcgaccaacgtggtgcctggtgacagcgtgtatggcagagcgtacaaggggcggcactgcaagaagttctacaccgaggagggatgcccttatggcgacacatgcactttcttgcatgatgagcagtccaaggcgcgtgagagcgtcgcaattagcctatcgccgtcggttggcgggggcagctacaactctgctggagatgccggcgttccaaatggacctacaattctgaagccgtcgaattgtaagacgcagatttgagacaagtgggagatgactgggtactgccctttttgtaacaaatggcactttggctcacagaacttgttaactccacaattacggggggggacttgcgcacattgacggggggggattgcattaactgcggactggaaccggcggggcgtcctctaacttgttgtggaattactgaccgatgccatccggggcgacgaagcgacggttcccctgacaggaaggagttgtagtgtttccctttgtctacccacggtcggggggtgttgcggggcccttcgggctagggtagggccccgttgggttcggcttgggtgctggtggactgggagacgagagggggtttaaattaacgcgcgcgtatggtgtgttccacagatgagtcactggggtagagggagaacattcgttggcacgagatgcggccgcgtatagtgctattctacacctacacccttacgagagctgactgtatcattggtggatgagacggtctcggcagcatcgagatggggatgtgtaatcgccatgcgcgccgggtcacgtcg

SEQ ID NO: 8033 - DNA, 700 bp, Hordeum vulgare
  misc_feature (566)..(566): n is a, c, g, or t
  Predicted polypeptide sequence is orthologous to G3059
tcgagtttttttttttttgggggggggggttttttttggaaaaaaataccaacttatatatactgcaaaaatccactgacattaccaaggaaaaacggaaaaacaatctgaaaaaagcaataaagctgctatacaaaatctactgctgggcgtaaagcactgactttattggatcatgtggggagcttccccgcttcccttcgaaaaacacatttaaagacaaattgtcacctaaaagccacaccgacgacctatataatacatatttgaacctgtcactgagtattcacattgcctgggctgctgggcgctaactctaccgttcgggatcatttacgttcttatattatacgtagttatatataatacatacatatcttatttaccccgttgggatttttgtacatttttcccgtgtatgcgcaggcttgatttgagacgggaaaaaaggggttcagactctggcggaagagacgtgcacccggcctcaacggctgcggaggaagcgctcggcggccctaaaccaatggcggaagtggcaaccgtggccctaagggcaaactttncccttgagcacatgccggagaacttgggcttgtaccgcgggtgggggattaaggggcccaaacttcgaaaccccgtgcccaaactgggcctgggcgccctaaggggccccccccctctttttccccattgtgcg

SEQ ID NO: 8034 - DNA, 832 bp, Hordeum vulgare
  misc_feature (17)..(17): n is a, c, g, or t
  Predicted polypeptide sequence is orthologous to G3060
gtttcacgcgccgtcgncgacgccgacttcgcctcgccctttccccgagctctccatggacgcgggccgcaagagggccctgccggaaggcaccaacggcggcgccggcaccaagcgcgccagagaatcggagtcgggtcaaacgggtgtaggaagcaaatcgaagccatgcaccaaatttttcagcactgctggttgtccctttggttcgagttgccatttttctccataacttccctggaagtcaccaggctgtttcaaagatgaccaacttgggtggtccagctgtttcagctcctccaggaagaatgcccatgggacctggtgttcctgatgggccaccacccagcatgaagactcgcttgtgtaacaagttcaacacagcagaaggttgtaaatgggggaacaagtgtcattttgctcatggagagagggagcttggcaagcccatgctgttgaacaactcaatggcacctccaatgggaccaagacccaatggtcacttccagcccccaccgatgcctggccctgacatggttcctccctcaacctttggcgctttggccacagccaagatcagtgttgatgcatcccttgctggcgccattattgggaagggtggagtcaacacaaagcacatatcccgaatgactggggccaaactggccatccgggataatgaggcagaccccacccataaaaacattgagctcgaagggatcgttgatcaggtaaaccatgccagtgcaatggttgaaggagcttatatcttcccattggtgggaaccgccccctcctaaagcaaagaccgccagggaggggtccctggggg

SEQ ID NO: 8035 - DNA, 840 bp, Hordeum vulgare
  misc_feature (449)..(450): n is a, c, g, or t
  Predicted polypeptide sequence is orthologous to G3060
gtttttttttttttgttgtgctggaaatataatgagcaaatttgccatattaaaacgcgtgagaaaccgttcaaaagttggaagcacaccagagggaaaaaaacacggcattccacttaaccctacaataaaaaacctcaaaagcaaatccattctcggatatttatcggttacagcgagctgatcacactcaagccatggggccatgacagtacctcccaaccaacaacagggttatgcaactgaatcaatatgaccaggggggaacgggttctgagctcaaacttggtaaaggcttttaatcatgaaaagccatgaaaaaaaagcatttctgaagccggagccgacttgcgcagttcactttcaccatgggcaaagtggcatctgtctccaaatgtgcaagagccttttgtgaagtgtcacacacttaggtcttgaaggtgattccnnaagcccttgaagaacccgttgccttgtataatttagttgaaggaggggccgtctcccacctgtacgaaaaatttagtcttgtttccacattggcgggggggcttggtaagaacctagaccaaccggaacccgttagggcctatagagatttaattgggggggggattttggaccaaatttaactcaggaagggcctcgttgggccccgcattcagctcgggtaatatggtacttggggggggaccctccgccctttcgagtatggttgtgggtataattaagggggtggtcttgtatccattttgtacttttgcgggaaaggcctaaaagggggccattaattctatgaaacggacaacctcgtggtgtggggaaacaacaactggaacg

SEQ ID NO: 8036 - DNA, 650 bp, Hordeum vulgare
  Predicted polypeptide sequence is orthologous to G3067
gttttaaagcacgtaacaaaagcaatccttggtttccgtcgatgtcgtgtagcaaatagcactgcgtagtgaccaccaggaaaggaaaatggtgagaagcaatcagctcctacacgtgaaggcattcacgtacattcacaggaatatggacaaacgcatctggccgatactaccaacaggcagcccgtgcaaacgttaacagagtggcaaaccgagagagaaagaatggttaattcgagggctcggttagcgcgggaatgggatggatggatggatggatcaaggcttgcagatgaccacgaagcacgggagcagcgccctcgggttcagcaggtagagctcctcgatgttggcgtatggcccgaccttgccggccagcgagtcgaacccggtctgccccacgaactccctcacgttctccagcggcttgtgcaccctgccggcgatcaccctgcacaccagcagcgccctgcgcgcgccgccggccgccgccggggcgtcttcctcgtcggcggactcgaacgcccggccgctggtggacgtggtgaagacgccgacgctggccttgccctccttcttggagttggagttggacgaggaggagaagccgtggcggatgatgcggcagacggcgcacttgtcggaagcgc

SEQ ID NO: 8037 - DNA, 841 bp, Hordeum vulgare
  Predicted polypeptide sequence is orthologous to G3074
gcttcctctccctccgatccgatgtccccgccttcgtcccccgcgccgatccgacctccagccgccgcgttctctccgccggggacgctccctccggcgccgccggctccgcgccatgaggaagaagctcgacacccgcttccccgcgcctcggattaagaagatcatgcaagcagatgaagatgttggcaagattgctctagctgtacctgttcttgtgtccaaagcgttggagctatttttgcaagacttgtgtgataggacatataatatcacaattgaaaaaggggtcaaaacagtgagttcatcgcatttgaaacagtgcattcatagttatgatgtgtatgattttttgaagaacgtagccagcaaagtcccagatttgggtgcacctgattctaatgctgatgataagcttggcaaaagaaggaaacatggtgaagatgaaagcgaggaggaaacaaagcggacaagagatgaggcagcatgccacacaagcaacggcagagggcgtgggaggggacgcgggagaggtcgccgtgccgggcgtggagctgagagggagattgaacaccatgaattagctcgcactgaatttagcaacccaggccacctaaaggtagagactggagatggttttgacacaactgaaaccaagaagcatacccctttgagtaatgccagggccctccttagggacattgacttggactaaaatcttgctgactatgagaaggatacggggcaccacaagccgaaccttgtcccggggtgaatcggggcgtgcaagtccaaaattaagggcctcgttttactgtttagagagggggaaccagggtcc

SEQ ID NO: 8038 - DNA, 1158 bp, Hordeum vulgare
  misc_feature (418)..(418): n is a, c, g, or t
  misc_feature (702)..(703): n is a, c, g, or t
  misc_feature (731)..(731): n is a, c, g, or t
  misc_feature (752)..(752): n is a, c, g, or t
  misc_feature (774)..(774): n is a, c, g, or t
  misc_feature (962)..(963): n is a, c, g, or t
  misc_feature (989)..(990): n is a, c, g, or t
  misc_feature (1070)..(1072): n is a, c, g, or t
  misc_feature (1074)..(1078): n is a, c, g, or t
  misc_feature (1080)..(1084): n is a, c, g, or t
  misc_feature (1088)..(1090): n is a, c, g, or t
  misc_feature (1092)..(1092): n is a, c, g, or t
  misc_feature (1099)..(1099): n is a, c, g, or t
  Predicted polypeptide sequence is orthologous to G3074
caaagatgaggaagaagttgggcacccggttccccgcggcacggatcaaaaagataatgcaagcagatgaggatgttggcaaaattgcattggctgtgcctgttttagtgtcgagagcccttgaattgtttctgcaagatttgatcgaccgctcatacaaaattactcttcaaagcggtgcaaagacactgaattccttccacctaaagcaatgtgtgaagaggtacagctcttttgacttcctaactgagattgtcaacaaggtgccagatctcggtggcggtgaatcttgtggagatgaaagaggattacccagaagaaggaaattttcaaatggaagtgacccagagaatgaggagccccgatctagcaaaatgcccataagaaacttgaacactagtcccagaggacgaggcanaggtcgaggaagagggcgagggcggcctccaaccaagagaaaggaaattggttatgtacagtttgaggatgagagcagcatgtatgctgaacaaagtgaacccttgccaggagatgagatagttccagagaccaatcgtggcaatgagagtattccccaaagctcacatcctgtagcggaggctccatcagctgcgacgccagctgtgacttcaaaggttgaagaagctagcaccaaccatcagccggattggcctatgccagatccattggaggcattgtgtnngaccatcagtttggaatctgacggtgcnggtgatgaggaaaggactacnataatgaggataggcaggcttnctctattcattatatcctctaacagaccagtctcctgtggtgacattgtaaaattgttccagagtacccgccgcatatgataaccaactttctttcaccaaatagttgtactaaacgcctccgggtgccctcaccgcggcggggggaaacacccctttgtgggagagagataatttattctctctcgnnaaaacaaacatacctttaacccagtnntcgataaaggaggcgggcggcccccactcttctgcttattatcttctccctctccacccctagacacacccagaatatannnannnnntnnnnntttnnncnacatccnttcccaacaagcaccacctctctcttcatcgctggtgcatttatatcttctatatctcc

SEQ ID NO: 8039 - DNA, 802 bp, Hordeum vulgare
  Predicted polypeptide sequence is orthologous to G3091
ccatgttgcatgccattcctctcctttcgccggccgaagatggcaatagaccacgcatcccctctcgcgctcaagagcggcggcgccacggtaattgatttcttgatgcttgtgtccctcctgctatgtgttcttggttctcgtttgttcatcctagactagtggcggcgccgggttgaagctgaaatgttgggtgtgcagggaggagcggagtgcgacgaggaggcggggaaccagcggtggccgccgtggctgaagccgctgctggcgacgagcttcttcgtgcaatgccgggtgcacgccgacgcgcacaagagcgagtgcaacatgtactgcctcgactgcatcagcggcgcgctctgctcgctctgcctcgcccaccaccgggaccaccacgccatccaaatacggaggtcgtcgtaccacgacgtgatccgggtgtcggagatacagagggtgctggacatcaccggcgtgcagacgtacatgatcaacaacgcgcgcgtggtgaagctcaacgagcacccacaagcaaggccgggcaggggagtgaccagcacctacggacgggtacgagcgcgagctgcggagctggggccggtggtagtgcctggggtggtagggtgggtgcccgtgcggggtagctcctaccaatggagatctcctggagggtcccgggggcggggctatgaggacgaaggcggggtgaggggccctcgaggtggctcgcgtgacggatgggcggctctctgtttgagagcccgtggtacgcgcgttgcggccgcgggtagtcctcccaaac

SEQ ID NO: 8040 - DNA, 914 bp, Hordeum vulgare
  Predicted polypeptide sequence is orthologous to G3091
ctccccccctccctctctcctctttccctcccaagcaaatcctctgccgcctcccccttcttgctctctgctgcgtcccgcgtttggtccggcgcaccgaaatggcattccaccacgacgcgccgctgctgctcaggatcaacaccaacagagccggccgcatgggaggaggcgagtgcgacgaggccgataaccagcgctggccgccgtggctcaagccgctgctggccaccagcttcttcgggcaatgcaagatgcacgccgacgcgcacaagtgcgagtgcaacatgtactgcctcgactgcatcaacggcgccctctgctcccagtgcctcgcctgccaccacggccaccacgccatccagatacggaggtcctcgtaccacgacgtgatccgcgtgtcggagatccagaaggtgctggacatcaccggcgtgcagacctacatcatcaacagcgcgcgcgtcgtgttccttaacgagcgcccttcacccatgcccggcaagggcgttaccaacacctgcgaggtctgctagcgcagcctcctctacaccttccgcttctgctcccttggatgcaagatcgtcggcaccttcggcgagtttcgcggcccgaaaaggcacgctggcggctagaagatgaatcttaacctgaagaacgctggtgcatcggactcggacgaatcgtccaaccatcaacagctggcggctgagacaatagcatcggtggtgcagagcttcaacctagtctaaccctccaggcaatcgtccacagtctatcggttatagtcaatgcgagcgaggtcctatcttcactggtagcccttgggatcggtgattttggagttattagaacacacaaatcggtcgtcgtcgcgtcctaagggacggtaccaactgtgaatacaccggtcg

SEQ ID NO: 8041 - DNA, 679 bp, Hordeum vulgare
  Predicted polypeptide sequence is orthologous to G3091
tttttttttttttttttcggcaaatttcttatctttttcctgtcaataacaatataactgtatatacaaattatagtgcccctgcaagtcgtaaaacattgaattaactacacaccgcaacgctaataaacacattgggtgaggtaaagacactaggcagccaaattaaccactacaaaccgagacatatacatgattatttttgcttttcacatatcaatctcggccttagccaagctaaaaaccctagctatgtttctattagctgtgtttcttaccatcctttcttccttcttcgccttattttctgcatggagcagggcaccgcgccatgcccttgtgcgatttgacaacctttgccaatatatcatatttacacacactccacctacattattgggggtatgtatatgtatatatatacaagtatatataccatgcttgctatagctaatacggagtacctatctagtgatctactaactggatcacttcactactcagtcccaaccgacacacattgcattgcaataccggtagtagcattgtcacttttggtgcagagtggtttccactggaagtctaaccgtagaacggggcgcggtgggggatgcccttcctcctggacggccggcaccggttgatcggcggcgtgctcggcgtcatcggcccctcgtgc

SEQ ID NO: 8042 - DNA, 706 bp, Hordeum vulgare
  misc_feature (634)..(634): n is a, c, g, or t
  misc_feature (672)..(672): n is a, c, g, or t
  Predicted polypeptide sequence is orthologous to G3095
tcgaggtgtttttgcaatgaaggggggtacggtgcctagatggctagagctactgcttgcaacacagttctttgcaatatgcaccaaccatctctcctctactcgcaatgagtgtaacctgttctgcatagattgtgaggaatcaaaggccgccttctgctattattgccgttcacgccatcattccacccatcgggtaatccagataaggcggtcctcataccatgatgtggtcagggtttctgagttaaaagatgtacttgatatcagtgatgtacaaacgtacgtgatcaatagtgcaacagttgtatttcttaatgagcgcccacaacaacgtggttgtggtgtttctgcgatcaaggcatcatcatcatcatacaattgcgagagttgcaatcgtgctcttcttgacccattccgcttctgctccctgggttgtaacctcaaaggaatcaaagaggatatgaggacaagctttccgactagagatattattgactatagcagaaaggatgacgatacagattgcagtaacacaagtggaaatagtggaaacaatgaagagagttgcagcgatgcagattattgcaaggaaaaaccatctccaccaagggttattcgtcaccgcccgaanagggattccctcggcgtgcacctttttattgagagaanagtgttatgaataatttgctggcaccatagcaaa

SEQ ID NO: 8043 - DNA, 2900 bp, Hordeum vulgare
  Predicted polypeptide sequence is orthologous to G3967
ccatacgctcgcttgtttcatagatactatgcaattgccacaccaagtgctacacaaagattgctttttggtcttcttgaagcaccaccatcatgggctccagatgcacttgatgcagcagttcagcttgttgaactccttcgggcagctgaagattatgctactggcatgcggcttccaaaaaattggttgcatcttcatttcttgcgtgcgattggaactgcaatgtctatgagggctggtattgctgccgatacagctgctgcgttgctttttcgcatactatcccaaccaacgttgctttttcctccactaaggcatgctgaaggagttgaagtgcaacatgaaccactgggtggctatgtatcatcatacaaaagacagctggaagttcctgcatctgaaaccacaattgatgccactgcacaaggcattgcttccttgctgtgtgctcatggtcctgatgttgagtggagaatatgtaccatctgggaagctgcctatggtttgttacctctgaattcatcagcagttgatttgcccgaaatcgttgtagctgctccgcttcagccacctactttgtcatggagcctatacttgccactgttgaaagtattcgagtatctacctcgtggaagtccatctgaagcatgccttatgagaatatttgtggcaacagttgaagctatactcagaagaactttcccttcggaaacctctgaatcatctaaaagaccaagaagtcaatccaagaaccttgctgttgctgaactccgtacaatgatacattcactctttgttgaatcatgtgcttcaatgaaccttgcttcccggttgttgtttgttgtattaactgtttgcgtcagtcatcaagctttgccagggggcagcaaaagaccaacgggtagtgaaaaccattcttctgaggaggccactgaggacccaagattaaccaatggaagaaataaggtcaagaagaaacaagggcctgttggtacatttgactcgtatgtgctggctgctgtttgtgccttatcttgtgagcttcagctgttccctatcctttgcaagagtgcaacaaactcaaaagtaaaagactctataaagatcctgaagcctggaaaaaacaatgggatcagtaatgagctacagaatagcattagctcagcaattctccatactcgtagaattcttggcatcctggaagctcttttctccttgaagccatcatcagttggtacctcctggaactatagttcaaatgagatagttgcagcggctatggttgccgctcatgtttctgagttatttcgccggtcgaggccatgcctaaatgcactatcttcactgaagcgatgtaagtgggatgctgagatttctaccagggcatcatccctttaccatttgatcgatttgcatggtaaaactgtgtcctccatcgtgaacaaagctgagcctctagaagctcacctgacttttacatcagtaaagagagatggtcaacaacacattgaggaaaacagcaccagctcatcgggtaatggcaacttggaaaagaagaatgcttcagcctcacacatgaaaaatggtttttcaagaccactcttgaaatgctcagaagaggctaggcgaaatggtaatgttgcaagtacatccgggaaagttcctgcaactttacaggctgaagcatctgatttggctaacttccttaccatggatagaaatgggggttatcgaggctctcagactctcctaagttctgttatctcagaaaaacaggaattatgcttctctgttgtctcattgctctggcataagcttattgcatctcctgaaacgcagatgtctgcagaaagtacatcagctcatcaaggttggagaaaggttgtagatgccctttgtgatgttgtttcagcctcaccagccaaggcttcaactgctattgttctgcaggctgagaaggacctacagccctggattgctcgagatgacgaggaaggtcaaaagatgtggagagtcaaccagcgaatagttaaactgatagctgagcttatgaggaaccatgatagcccagaagcattgataattcttgctagtgcttcagaccttctgcttcgtgctacagatgggatgcttgttgatggtgaagcttgtaccttgcctcagttagagctcctggaagtaactgctagagctattcatctcatcgttgaatggggagacccaggtgtagcagttgctgatggcctctcaaatctgttaaagtgccgtctatcgcctaccatccgctgcctctcccacgctagcgcacacgtacgagcgctcagcatgtccgtcctccgtgacatcttgaacagtggaccactaggttccagtaagaccattcaaggcgagcaacggaacggcatccaaagcccaaactaccaatgcgcggcagcaaacacggtgaactggcaagcggatgtcgagagatgtatagactgggaagcccgcagccgccgtgccaccgggatgaccctcgccttcctcaccgctgctgctaacgagctcggctgcccccttccttgctgacaaggccatatttgaagctgacaatcagcaacacttgacagttggtgcgagcagttgctgcatggtcagcgagcaggatggctaattaatcccttgctcaaggatggctttccattcccagtctgccccccatgatgtgatgtatattagctgatgttcccaatcatacggagctttgctcccgcggtgtgattttaacttgcaatctgacgttagatgttcaagcatattgaactgcttgtgctgtaacttgtattcatgatgtaacagtaagatgtccgctatgttaaatgaagacgtgtcaaaaaaaaaaaaaaaaaaaaaaaaaa

SEQ ID NO: 8044 - DNA, 3480 bp, Hordeum vulgare
  Predicted polypeptide sequence is orthologous to G3967
atgtcagcgtcaaatgggaagtggattgatggactccagttctcatcactgttctggcccccgccacacgatgcgcagcagaaacaggcacaaattttagcctatgttgagtactttggtcagttcacatctgacagcgagcaattcccggaggatgtagctcagctaattcaaacttgctatccatcaaaagaaaagcggttggtagatgaagtattagcaacttttgttctccatcaccccgagcatggtcatgcagttgtacatccaattctttcacgcatcatagacgggacactgagttatgatagtcatggttccccattcaattccttcatctccttatttacccaaagttctgagaaagagtactcagagcagtgggccttggcctgtggagagattcttagagttctaactcactacaacaggccaatctttaaagttgcagactgtaacaacacctctgaccaggctacaacaagttgttctgcacaggagaaagctaattactctccaggaaatgaacctgaacggaagccattgaggccattatctccttggatcacagatattttgctaactgcacctttaggcattagaagcgactattttagatggtgtggtggagttatgggaaaatacgcagctggtggagaattgaagcctccaacaactgcttacagccgaggagctggtaagcacccacaactcatgccatccaccccaagatgggctgttgccaatggagctggagttattttaagtgtctgtgatgaggaagtagctcgttatgagacagcaaacttaaccgcggcagctgttcccgcccttctgctacctccaccgacaacacccttggatgagcatttggtggcagggctaccccctcttgagccatacgctcgcttgtttcatagatactatgcaattgccacaccaagtgctacacaaagattgctttttggtcttcttgaagcaccaccatcatgggctccagatgcacttgatgcagcagttcagcttgttgaactccttcgggcagctgaagattatgctactggcatgcggcttccaaaaaattggttgcatcttcatttcttgcgtgcgattggaactgcaatgtctatgagggctggtattgctgccgatacagctgctgcgttgctttttcgcatactatcccaaccaacgttgctttttcctccactaaggcatgctgaaggagttgaagtgcaacatgaaccactgggtggctatgtatcatcatacaaaagacagctggaagttcctgcatctgaaaccacaattgatgccactgcacaaggcattgcttccttgctgtgtgctcatggtcctgatgttgagtggagaatatgtaccatctgggaagctgcctatggtttgttacctctgaattcatcagcagttgatttgcccgaaatcgttgtagctgctccgcttcagccacctactttgtcatggagcctatacttgccactgttgaaagtattcgagtatctacctcgtggaagtccatctgaagcatgccttatgagaatatttgtggcaacagttgaagctatactcagaagaactttcccttcggaaacctctgaatcatctaaaagaccaagaagtcaatccaagaaccttgctgttgctgaactccgtacaatgatacattcactctttgttgaatcatgtgcttcaatgaaccttgcttcccggttgttgtttgttgtattaactgtttgcgtcagtcatcaagctttgccagggggcagcaaaagaccaacgggtagtgaaaaccattcttctgaggaggccactgaggacccaagattaaccaatggaagaaataaggtcaagaagaaacaagggcctgttggtacatttgactcgtatgtgctggctgctgtttgtgccttatcttgtgagcttcagctgttccctatcctttgcaagagtgcaacaaactcaaaagtaaaagactctataaagatcctgaagcctggaaaaaacaatgggatcagtaatgagctacagaatagcattagctcagcaattctccatactcgtagaattcttggcatcctggaagctcttttctccttgaagccatcatcagttggtacctcctggaactatagttcaaatgagatagttgcagcggctatggttgccgctcatgtttctgagttatttcgccggtcgaggccatgcctaaatgcactatcttcactgaagcgatgtaagtgggatgctgagatttctaccagggcatcatccctttaccatttgatcgatttgcatggtaaaactgtgtcctccatcgtgaacaaagctgagcctctagaagctcacctgacttttacatcagtaaagagagatggtcaacaacacattgaggaaaacagcaccagctcatcgggtaatggcaacttggaaaagaagaatgcttcagcctcacacatgaaaaatggtttttcaagaccactcttgaaatgctcagaagaggctaggcgaaatggtaatgttgcaagtacatccgggaaagttcctgcaactttacaggctgaagcatctgatttggctaacttccttaccatggatagaaatgggggttatcgaggctctcagactctcctaagttctgttatctcagaaaaacaggaattatgcttctctgttgtctcattgctctggcataagcttattgcatctcctgaaacgcagatgtctgcagaaagtacatcagctcatcaaggttggagaaaggttgtagatgccctttgtgatgttgtttcagcctcaccagccaaggcttcaactgctattgttctgcaggctgagaaggacctacagccctggattgctcgagatgacgaggaaggtcaaaagatgtggagagtcaaccagcgaatagttaaactgatagctgagcttatgaggaaccatgatagcccagaagcattgataattcttgctagtgcttcagaccttctgcttcgtgctacagatgggatgcttgttgatggtgaagcttgtaccttgcctcagttagagctcctggaagtaactgctagagctattcatctcatcgttgaatggggagacccaggtgtagcagttgctgatggcctctcaaatctgttaaagtgccgtctatcgcctaccatccgctgcctctcccacgctagcgcacacgtacgagcgctcagcatgtccgtcctccgtgacatcttgaacagtggaccactaggttccagtaagaccattcaaggcgagcaacggaacggcatccaaagcccaaactaccaatgcgcggcagcaaacacggtgaactggcaagcggatgtcgagagatgtatagactgggaagcccgcagccgccgtgccaccgggatgaccctcgccttcctcaccgctgctgctaacgagctcggctgcccccttccttgctgacaaggccatatt

SEQ ID NO: 8045 - DNA, 576 bp, Zea mays
  misc_feature (76)..(76): n is a, c, g, or t
  Predicted polypeptide sequence is orthologous to G28, G22, G1006
gcgcgtgtggctgggcacctacgacacgcccgtcgatgcggcatggcatacgaccgcgccgccgtcgcgctgcgcngggccaaggccaggaccaacttcgccgccgggcgcggctcccgcgccactccccccgtccaggctcgcccgctcccgtaccccgcgctggcgccgggccacttcggcgtgctcgacggcgcccgctcgtcgccctggcacgtcgtctacctcccaccgcctaggctgcaccacgccgtggcgccgccgatgcctctcgtggcagtggcaggggacgccgcctcgtcgctgccgtccacggcgctggagctccggacagggcccaaggccctcccgttcgacctcaacgagccgccgtcgctgctgttgggctcgcggtctccataatggacgtggagacggaggtgatggtaggtcagtagtatcgagtagggatcatcgaccattgaactaggtggtaggattgactagtgagggtaatcaactggtgggagtggagaccatcgctccggttgtatatatctaccagaacctattttaggaaaaaaaaaaaaaaaaaaa

SEQ ID NO: 8046 - DNA, 974 bp, Zea mays
  Predicted polypeptide sequence is orthologous to G28, G22, G1006
cacacccgtctcagctcactccctcctcctccagtttcgtcagctcatcatcatcataaaccgaacacagagctctcgattccattccaggatgctgctgaacccggcgtcagaggcgtcggtgctagacaccatccggcagcacctcctcgaggagccagccgacgagagcttcgggagcctggtggcggaccagtggagcggctcgctcccgttccgcaccgacgacgccgacgacatggtggtgttcggggcgctgcaggacgccttcgcctacggctggctgcccgacggctcattcgtgcacgtgaagcccgagccggtgcggtcccccgactcgtcctcctacccctgctcctacgacggctcaccctgcttcggcctcctggacccggagccgccgctgacgcccggcaccaccacgcccagtagtagggggcaggaggaggccgcggcggccatggcccggggcaagcactacaggggggtgaggcagcgcccgtggggcaagttcgcggcggagatcagggaccccgccaggaacggcgcgcgcgtctggctcggcacgtacgacaccgccgaggacgccgcgctcgcctacgaccgcgccgcctaccgcatgcgcggctcgcgcgcgctcctcaacttcccgctccgcatcggctccggggacaagcgcccgtcgccggcgccgcccgagcccgccacctcctcggactcctcctcgtcttcggccagcggctcgcacaagaggcggaagcgaggcgaggccgcggctgccaacatggccatggcgctggtgcccccgccctcccagcttaacccggcggcccagccgtggttccctgccgcgccggtcgagcaggcggcgatggctccgcgcgtggagcagatcgtcgtctagtctagtcatgcgccggcgaaagcgggggcagggcctgcgctgcacttgcgtgacagctccaccggatgga

SEQ ID NO: 8047 - DNA, 1002 bp, Zea mays
  Predicted polypeptide sequence is orthologous to G481, G482, G485, G1364, G2345
gcacgacgctaaaataaactccccgctctcccccgcccgtccagctcttgctccgcctccgctgctctgtcctcttccctcctctgcgtttctcctcagagctgtttgacttgaccggacagtgctgttcggtggctcggccgcgatgccggactccgacaacgagtccggcgggccgagcaacgcggagttctcgtcgccgcgggagcaggaccggttcctgccgatcgcgaacgtgagccggatcatgaagaaggcgctcccggccaacgccaagatctccaaggacgccaaggagacggtgcaggagtgcgtgtccgagttcatctccttcatcaccggcgaggcctccgacaagtgccagcgcgagaagcgcaagaccatcaacggcgacgacctgctctgggccatgaccacgctcggcttcgaggactacgtcgagccgctcaagctctacctgcacaagttccgcgagctcgagggcgagaaggcggccacgacgagcgcctcctccggcccgcagccgccgctgcacagggagacgacgccgtcgtcgtcaacgcacaatggcgcgggcgggcccgtcgggggatacggcatgtacggcggcgcgggcgggggaagcggtatgatcatgatgatggggcagcccatgtacggcggctccccgccggccgcgtcgtccgggtcgtacccgcaccaccagatggccatgggcggaaaaggtggcgcctatggctacggcggaggctcgtcgtcgtcgccgtcagggctcggcaggtaggacaggttgtgaccgtcgccgtccatgcttgcatggccatggcatggctcagtcccgccgccggcttcttgcttggtgtcggtaattagcgctggttaagttaaccttcggtttttccccccttttcttttcgtggtaagtaatgttgtgctgaatggagccagtgatatggttaagatagctccataacctctcggtaaaaaaaaaaaaaaaaaaaa

SEQ ID NO: 8048 - DNA, 630 bp, Zea mays
  Predicted polypeptide sequence is orthologous to G481, G482, G485, G1364, G2345
atgccggactccgacacgactccggcgggccgagcaacgccgggggcgagctgtcgtcgccgcgggagcaggaccggttcctgcccatcgccaacgtgagccggatcatgaagaaggcgctcccggccaacgccaagatcagcaaggacgccaaggagacggtgcaggagtgcgtgtccgagttcatctccttcatcaccggcgaggcctccgacaagtgccagcgcgagaagcgcaagaccatcaacggcgacgacctgctgtgggccatgaccacgctcggcttcgaggactacgtcgagccgctcaagcactacctgcacaagttccgcgagatcgagggcgagagggccgccgcgtccgccggcgcctcgggctcgcagcagcagggcgagctgcccagaggcgccgccaatgccgccgggtacgccgggtacggcgcgcctggctccggcggcatgatgatgatgatgatggggcagcccatgtacggcggctcgcagccgcagcaacagccgccgcagcctcagccgccacagcagcagcagcagcaacatcaacagcatcacatggcaatgggaggcagaggaggattcggccaacaaggcggcggcggtggctcctcgtcgt

SEQ ID NO: 8049 - DNA, 860 bp, Zea mays
  Predicted polypeptide sequence is orthologous to G481, G482, G485, G1364, G2345
gaccggttcctgcccatcgccaacatcagccggatcatgaagaaggccgtcccggccaacggcaagatcgccaaggacgctaaggagaccctgcaggagtgcgtctccgagttcatatcattcgtgaccagcgagtccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacaggtaatctatcgtactgtcatttgttagtaaaacaatactgcagctattttccgtctcactaaacatggcagaaaatttcgatcattacattattccactaataattttctctctgtacgcactcagtaccacaatggggaaacctaataaagggctaatacagcagcaatttatggtaatattattgctccctgaattttgttaactaaagattctgtatcatgctatatgtatgttcccttttttcttcttcttgttttgacattgcttctttctctacgggtttatcctcagctagggagtctctgcattgcttacatgtgttttggcagaaaacaggaggcccttcaaaaggtgttaatctctgcgaggctgcctctcaggggtaatgggttcggttagcgctcttttgccggttttcaggagattgactgtggtcctttggc

SEQ ID NO: 8050 - DNA, 1115 bp, Zea mays
  Predicted polypeptide sequence is orthologous to G867, G9, G993, G1930
gcacgagggcccaacgggcggtggggcgcgcagatctacgagcgccaccagcgcgtgtggctcggcaccttcgcgggcgaggccgacgcggcgcgcgcctacgacgtcgcggcgcagcggttccgcggccgcgacgcggtcaccaacttccgcccgctcgcggacgccgacccggacgcggccgccgagctccggttcctggcgtcccgctccaaggccgaggtcgtcgacatgctccgcaagcacacctacttcgacgagctcgcgcagaacaagcgcgccttcgccgccgcgtccgcggccaccgcctcgtcgctggccaacaacccttcttcctacgcgtcgctctcccccgcgaccgcgacggccgccgccgccgccgccgcgcgggagcacctcttcgacaagacggtcacccccagcgacgtgggcaagctgaaccggctggtgatcccgaagcagcacgccgagaagcacttcccgctgcagctcccgtccgccggcggcgagagcaagggcgtgctcctcaacctggaggacgccgcgggcaaggtgtggcggttccgctactcgtactggaacagcagccagagctacgtgctcaccaagggctggagccgcttcgtcaaggagaagggcctccaagccggcgacgtcgtcggcttctaccgctccgctgcaggcgccgacaccaagctcttcatcgactgcaagctgcggcccaacagcgtcgtcgccgcctcgaccgcaggcccgtcgcctccggcgccggtggcgaaggccgtgcgtctcttcggcgtcgacctgctgacggcaccggccgccgccgcggcgccggcggaggccgtggccgggtgcaagagagccagggacttgggttcgcccccgcaggcggcgttcaagaaccagctcgtggagctggcactagtgtagatttaatgctacggagcgatcgatctttccctagctagctagtcttttttatttttttgctcgatcgctcaactcagatggtagcatcaccgagctgaatttagttccctctcggcatctcacttagttggttcgtttgttaatttccagtttcaaaaaaaaaaaaaaaaaaactcgagact

SEQ ID NO: 8051 - DNA, 675 bp, Zea mays
  Predicted polypeptide sequence is orthologous to G1073
ttttttttttttttaaacgactaatattatgagactagtattttataacggagggagttaatagaatagaagtgaaaggcaaatgtcatgacaacttgacaaacatcgttccaaagcaaaagaggacaagaagtcgacaggatggtctctaaacagttaacactggacctaatgaccttccttggattttgttggaccaatagaccacccaaaaaatagacatgcatcgtcggtagtactcacttttccatagccatagatggtaatggtatacatcgatctggattgtttccaagtcgaagtcgaacaccatggcaacatgcattatcaccaaatcaccacatggcctggtgccctcgtcaaagtgtagccttcaaccaaaatgcaggattaaggagcttctccgtcatggatcgcgatctcttggagattcttgccgtgatacaaatgcagctgccaagagaaagagatcggtatgccatatcaaaacggtggccttataccaccgctccaggtgccgaagttctctccgggcaactcgtagccagccgcgttccctccaagatcatacagtgacatgccatgaccaatgccgccgacatcgccacccgtcactccagaagactgcgacgcctcctgttgctgtccttcggccggctccactgctgcgccttg

SEQ ID NO: 8052 - DNA, 736 bp, Zea mays
  Predicted polypeptide sequence is orthologous to G1274, G1275
tttttttttttttttttgagtgctctctgcttcccttaaaattattacttgcactgtgtaagtgtaaaactatacaagtaggtcagaatttaatccggctacagcgatagcttctagagtattttatctctataaattgcatctccaacactaatttgaatagctgcagcagttgagactgtttagccagccgctgaacattcttcttatccgacgactggagtgtaaaggtaactatgggtcaaggcccggaaaagtcagaaggctagggagcccgagtaggaggtggccgacggggagccgctgtgcggcgggctgtagaagccgctattgccgccgccgctgccgtacgggacgatgatagcagcggctccggggctggcgtggttgtggacgccgtcgtaggtggtgatgacgtagcgggggtcgtcgcggtccctctccacccgcttcttcacgccgcagccctccgacgagcagcggtagtagttccttggatttgggctgttcttgacggccttcttcccgtacttcctccacttgaatccgtcgtccaagatctccacctctgacctcgttctgaacccgatccttccgttgcttctgagtcttctctcgtcaccaccaccctcacaccacatcatcttctcgttgcgatcgccgcccccagccccggctccggcagcagtgacgatcggcgccggtgagtagtcgaagtggtgaatgtcgtcgagct

SEQ ID NO: 8053 - DNA, 467 bp, Zea mays
  misc_feature (332)..(332): n is a, c, g, or t
  Predicted polypeptide sequence is orthologous to G1274, G1275
taattccgctacaacgacagcttctagagtattttgtctctatattgcagctgcagtaattcgaatagctgcagcagttgagactgtttagccggccgctgaagattcttctcatccgacgactggggtgtaaaggtaactatgggtcaaggcccggaaaagtcagaagactagggagcccgagtaggaggtggccgacggggagccgctgtgcggcgggctgtagaagccgctattgccgccgccgctgccgcacgggacgatgatagcagcggctgcggggctggcgtggttgtggacgccgtcgtaggtggtgatgacgtagcgggggntcgtcgcggtccttctccacccgcttcttcacgccgcagccctccgacgagcagcggtagtagttccttggatttgggctgttcttgacggccttcttcccgtacttcctccacttgaatccgtcgtccaagatc

SEQ ID NO: 8054 - DNA, 866 bp, Zea mays
  Predicted polypeptide sequence is orthologous to G1274, G1275
gtcactggtcacaccgcgcagcgcaacggcagcagcagctcatcgctagctccacggtcgtcggtgttccctgtgcctgtgcgtgcctactactctactctacatggcggcctcgctaggactcgcccacgaggcggccccgttctacgccgccgcctacccgccggccggcgctgcttacgcttacctcgcaccaccacccggcgacctcgtcgtcgagttcccgccgcgcgccgccaccatggctgacgactgctgctaccagttcggccaggagatgggcggcgcctactgctcgccgccggtgttcgacaatggcatgacgagcctgctgtaagttcgcgtacatacgtgctgttactagcagctagcttgcgtgctaataatgtgcgctgtcgccgtcgttgcgtcgcgtcacacgtaacgtacgccgtggcagcggctatactcaatgctcatcccatcagttgcgtacctgtggtttggctggggcttcaggaactatggcgtcgaaggcgacgggaggaggccggtgggcggaccagctggcggtactgggaacggcggcggccggccccggccggcgtcacggatcgggttccggaccaggtcggaggtggacgtgcttgacgacggcttcaagtggcgcaagtacggcaagaaggcggtcaagagcagccccaacccgaggtacagtagcagaatacaacactagctagcttggcgcacatggcgccaccgactccgacgaccacttcaattcccgttcattgtcacgctcatgcatgcaagcttgacgacgacgtgctgatccgcgcgccgcgccgtgcgtgcgtgcaggaactactaccggtgctcggcggagg

SEQ ID NO: 8055 - DNA, 724 bp, Zea mays
  Predicted polypeptide sequence is orthologous to G1274, G1275
ggcgcattgactgatacacatatatacaacaagcaaggcggctagctacagcggctagtgcgcgcgtggtgcaggcgcatctagctactacctggtgcttgttgtgcatacaatggcgacttcgctgggactgaaccctgaagatctcttcacttcgtactcgtcttcctactactcctcgccgccgttcatgtccgactacgcggcgagcttcacgccggcggccggggactccacggccttctcctcggagctcgacgaccttcaccacttcgactactcaccggcgccgatcgtcactgctgccggagccggggctgggggcggcgatcgcaacgagaagatgatgtatgtatatatgcaacgcacgcagcaaaatattattactgtgtctgtgtgtgtgctagttattgttggttggtgtcggcgcccctgctagctgcttactacagtttgcttcggtgatttcgctcatcatcaggtggtgtgagggtggtggtgacgagagaagactcagaagcaacggaaggatcgggttcagaacgaggtcagaggtggagatcttggacgacggattcaagtggaggaagtacgggaagaaggccgtcaagaacagcccaaatccaaggtactactatactacacaaatacacatgcaaattaatagagcagctagctaaattcccccaacatgaaagtcaagacaagagcaaagagatgaatt

SEQ ID NO: 8056 - DNA, 636 bp, Zea mays
  Predicted polypeptide sequence is orthologous to G1760, G152, G153, G860
ttttttttttttttttgactgactaattgttaataataaggatctgtccctatttttttggcaaaaaatgtggcccctagattttgttaatctgctatacatctagctactagagatagcaagttaattaattatacgcaaagcaaattacagatctgttaaagttgaaccaagtctgatcatcggtaagaaattacatacagatatatgtctagctagctagggagagtcacgacgtagatgaatcgtacttggtgttggagaaatcgtagagcctgccggtgctggagaagatgatgaggccaacctccgcgtcgcagaggatagagagctccttcgccttcttcagcagcccgctccgcctcttggagaaggtcacctgcctgctcgtggagttgtctatcctccttatcactatcttccccctccccatccctccttctatctctcagatctagtctaggccggaccggatgggaaggaaggatcacacgggaagacgaagagctcgccggcggccggggggacgagcgatgactggtctgatgggggaattaaaggcggaagctatagcctagctactagaggccggttccattcctagccaccttccaaagagcggaacgggaagtgccg

SEQ ID NO: 8057 - DNA, 571 bp, Zea mays
  Predicted polypeptide sequence is orthologous to G1760, G152, G153, G860
ttttttttttttttttcttgatagtaaacgaagatgagaatacagtaacaaactcataacttatttgtcttagaaaatctccagcatggcaaaaaaaaaaaagacacaagctagcaggactgtactcaggttcccaaaagttacatatatgggcggtttaacaaactcaaagtaactttaccagcttcctttgaagcgaaaggttttgttcttttcgttgtagttgtagtccctactctaaagtagagatcatatggttgtccagtcactctcatttatgttaattaattgaaagcttttccaatcttactagctctggcaaagggaggcagaaagcttgaggcagcaactgcataacttaaaagagcaccatcggtatgaccctcaactaaccggaaagtgaactcttcgcgttcgcttagttccctgggtcggggcgctctcgaagggtggcctagtcggttttcgctcccttcgattttctcttgacccttcttcgaagttctcatgacacgaaggttctatttctaggaggtcgagctcctacccttcttccggagctagggtttct

SEQ ID NO: 8058 - DNA, 1539 bp, Zea mays
  misc_feature (74)..(125): n is a, c, g, or t
  misc_feature (169)..(194): n is a, c, g, or t
  misc_feature (230)..(246): n is a, c, g, or t
  misc_feature (896)..(900): n is a, c, g, or t
  misc_feature (1374)..(1403): n is a, c, g, or t
  Predicted polypeptide sequence is orthologous to G1760, G152, G153, G860
ccgccctgcgccaagaaaagccatcgttcttcccacaaacgcacacatagaagcatcattcccctctcggctannnnnnnnnnnnnnnnnnnnnnnnnnnnnnnnnnnnnnnnnnnnnnnnnnnnaaacctgctgcctttgagctttcttcttcgagtgctcccaccannnnnnnnnnnnnnnnnnnnnnnnnncacgttcggcggcgcgcgcggagaaagatagatccnnnnnnnnnnnnnnnnngtccttgcttccgatcggagggccacaaccacaacctctcgctccttagcgtgcgcgcgcgagccagggtcaagaagagagctagctagctataggccggagatcgatggggaggggaaagatcgtgatccgcaggatcgataactccacgagccggcaggtgaccttctccaagcgccggaacgggatcttcaagaaggccaaggagctcgccatcctctgcgatgcggaggtcggcctcgtcatcttctccagcaccggccgcctctacgagtactctagcaccagcatgaaatcagttatagatcggtacggcaaggccaaggaagagcagcaagtcgtcgcaaatcccaactcggagcttaagttttggcaaagggaggcagcaagcttgagacaacaactgcacaacttgcaagaaaattatcggcagttgacgggagatgatctttctgggctgaatgtcaaagaactgcagtccctggagaatcaattggaaacaagcctgcgtggtgtccgcgcaaagaaggaccatctcttgatagatgagattcacgatttgaatcgaaaggcaagtttatttcaccaagaaaatacagacttgtacaataagatcaacctgattcgccaagaaaatgatgagttacatnnnnngatctatgagactgaaggaccaagtggagttaatcgggagtcaccgactccattcaactttgcagtagtagaaaccagagatgttccagtgcaacttgaactcagcacactgccacaacaaaataacattgagccatctactgctcctaagctaggattgcaattaattccatgaagaagagtaaaactgccgtcttatgatgctgaaggaaactatttattgtgaagagatgatactcagagaaagacatatttgtggcagggagatttgagatatgaacttataaatgtaatgcaaataattttcagactggaatggggtcgtggaattcagaggatgattgctttctagttgcatttgatgtttgatgagacttttctcatgtgaaacgtttattaaaacttcaaaatggtgcagatgttgctactacccttgttaggcttgtataaatatttgactttgtgtactagcannnnnnnnnnnnnnnnnnnnnnnnnnnnnngtgataggggacaatgatgcgatctaggagtacaaacagagtctagtttccactcagttgagttttatattgctctcaagcgttatcaagggtttagtaggatacagatataattaagatacagtggttaaatcgc

SEQ ID NO: 8059 - DNA, 695 bp, Zea mays
  misc_feature (671)..(672): n is a, c, g, or t
  misc_feature (677)..(677): n is a, c, g, or t
  misc_feature (680)..(681): n is a, c, g, or t
  misc_feature (685)..(685): n is a, c, g, or t
  misc_feature (690)..(690): n is a, c, g, or t
  Predicted polypeptide sequence is orthologous to G1760, G152, G153, G860
tacgcgggggcgtgcataataaaacctaatcatcggcacttcccgttccgctctttggaaggtggctaggaatggaaccggcctctagtagctaggctatagcttccgcctttaattcccccatcagaccagtcatcgctcgtccccccggccgccggcgagctcttcgtcttcccgtgtgatccttccttcccatccggtccggcctagactagatctgagagacagaaggagggatggggagggggaagatagtgataaggaggatagacaactccacgagcaggcaggtgaccttctccaagaggcggagcgggctgctgaagaaggcgaaggagctctctatcctctgcgacgcggaggttggcctcatcatcttctccagcaccggcaggctctacgatttctccaacaccaacatgaaagctgtgatagaccgatatgggaaggcaaaagacgagcagcttggcaagaacgatgcaacttcagaactcatggtacggtgaggaaaatgtacctatttctagctaactagcagttattggtcgtagtacacacgtgccatatgatgtatgttggtcggaccaagatcagaagtttagtccttcattactcacaaataaatgacattcgttgtgtttagctaatcagcttttcaaaatttttgcgannaaaanaannaaanaaaanaaggt

SEQ ID NO: 8060 - DNA, 854 bp, Zea mays
  Predicted polypeptide sequence is orthologous to G1760, G152, G153, G860
gcatcacatcgagccgggagattggaatccagttgagatttcgctcctctcctcccctcccccgccctggtgagcccctccgggcgacgtgtgtcccgttgcctttccttcgctcgacggccacctgttgccctcgcatggctctgcctgctcctgccaagcgtccaagctcccgctcgcccggcggctgcacgccgcagcgtctatccacccagatccgcacgatccccgctaatcgccgcaccccctacctcccatgcaacttctctagctcacccgcatcccggctcggcactgccttctccttgcacttcacttctgtatctagaccacctcatcacaattcgtcgtcagcgtcgcgccgtcgtctcagattgatgcaaggcgtgatgagaagctagaggcagcaactgcatatattgcaagaaaattgggtttcaaaccataccgataattttcttgcaagttgtgcagttgttgtctcaagcttgctgcctccctttgccaaaactacgaggaaaagcacatgttatattatcagtgaacacatcaggataaatcttaactgatatgtgttggtaatacacacatttaattggaattttgcagcatgatatatacagcagctattaggtaggcgttttgggtttttaggtcccgtttggttccattagtcctaagactaaagtttagtccagaaactaaacttaagttctatcctgtttggttttagagactaaatagattctaaacacattaaatgaagtacacaaagcctaaaatgcccctctccttattgcttgcgtgcggtgcagattctctatgcaagggtaattagtgtaaatgatgtcatt

SEQ ID NO: 8061 - DNA, 725 bp, Zea mays
  Predicted polypeptide sequence is orthologous to G1760, G152, G153, G860
tttttttttttttacctagaaaaccaagaggacttataattcagagtacaatttacaatagcatacatggcaagcttatatgaaaagcaaaattaaaatcaacattcttcttaatacataaacaatcgcatctagcagcttaaagtttagctgttaggtcttgcaattcaaccaacgatatccatttcttatcactcggtttagttatcctcactgtatttaaagtcttatggcactttcagtgttctttattaaatcatctggtttactgactctgagttatcctgaagtttggacaaaaatctcaccctacacttggtgtttctgatttgtccctttgcacacttagctcaagattgatcggaagattctctgtattccgagtactgtgtctaacagtagtacttgtttgctcattatttactccttgtccatacacctttctccgtaattcagtgttatgttgatgaagaaggttaactttgttgtatagttccatgctttcctggtgcatgaggcttcccttcctgtttaattcttgaatctgataaaaaataagttggtcctttttcagacgaatatttcttaggctcgtctccagcttattctctaaattctgcaaatctcccacgttcaggccagaaagctgctgacccaacaactgccgatggtgctcttttaagttatgcagttgctgcctcaagctttctgcctcgctttgcctg

SEQ ID NO: 8062 - DNA, 487 bp, Zea mays
  Predicted polypeptide sequence is orthologous to G1945
ctacttcacttgccggtcatcaaacttggacttcttggacgagcagggtggctcggttgaggagcttgagatgatgagagctggcagtttagatgcatttaggtgatgaagaagattggtttatttctcacgtgtgtatctgttcatagcatcataggagaataagtgagatggccatttgtcaagagccgcacagattgacaagtccgtattggtggttacaagccatggtggcatatgtgtatgcttgggttgattagctgaagttggtgttgaaaggaacattttttgcacccatttggtatgccatgcttagtcaatagcggatttggatgggaaggctagagggagatctgtcatgtggtttgttctggatcagatccatgttttggcagcgattgaagagctggtgatatgtgtagcattctttcaaaacggtgtaactagtatatcaatttaatcgttgtggaaaaaaaaaaaaaaaaaa

SEQ ID NO: 8063 - DNA, 1967 bp, Zea mays
  Predicted polypeptide sequence is orthologous to G2
ggcacgagctcccactgcactgctgctccgctgccgctaccctttccctctcccttctcgtcctcggtcctccccaacccatggccacggccaccaccacccactgccccttctcccaccacgctatttatcgcggctgcacgactcctgcccatcaggcgccatagagacgcgtgggaccgaagccgccgatcaagcgctgctcggggcggagcagcggccggcggtggtgagtgctggcagacaggccggcaggtcaggcagagtgaccagctggtgagtcgaagcttgagcggggagctggactttgggggttccggcgggctccggagcggagatggtgctggatctcaatgtagcgtcgccggcggactcgggcacgtcgagctcgtccgtcctcaactccgcggacggcggcttccggttcggcctgctcgggagccccgtcgacgacgacgactgctccggtgagatggcgcctggcgcgtccacggggttcatgacgcggcagctcttcccgtccccgaccccgccggccgagccggagccggagccggtggcggcgccggtgccggtgtggcagccgcagcgcgccgaggatctcggcatggcccagaagccggtggcgccagcgaagaataccaggcgcgggcctaggtcgcggagctcgcagtacaggggcgtcaccttctacaggaggacgggccgctgggaatcgcacatctgggattgcgggaagcaagtctacctaggtggttttgacactgcgcacgcagccgcgagggcatacgatcgagctgcgatcaagttccgcggcctcgacgctgacatcaacttcagtctgagcgactacgaggatgatttgaagcagatgaggaattggaccaaggaggagttcgtgcacatactccggcgccagagcacggggttcgcgaggggaagctccaagtaccgtggcgtgacgctgcacaagtgcggccgctgggaagctaggatggggcaacttcttggcaagaagtacatctatcttgggctctttgacagcgaagttgaggcggcaagggcttatgacagggctgcccttcgcttcaatgggagggaagctgttactaactttgagcctagctcctacaatgcaggagataataacctgcgtgacaccgaaaccgaggcaattgatgatggtgatgccattgatttggatttgcggatttcacagcctaatgtgcaagaccccaaaagggacaataccttagctggcctccagccaacatgtgattcccctgaatcttcaaatacgatggcttctcagccaatgagctcatcatccccttggcccgggtatcaccaaaacccagcagtgtcatttcaccatcagcgcttgtactcgtcagcttgtcatggcttctttccgaaccaccaggtccaggaaaggccggtggagcgaaggcctgagctgggcgcccagccattcccctcatgggcatggcaagcgcagggctcccctcacgtgccgttgcaccactctgcagcatcatcaggattctctaccgccgccggggccaacggcggcatgcccctgccgtctcacccgccggcgcagttcccgactactacaaacccgttcttcttcccctagaccgcttttgacatgacagcttgctgttccggctcagctctcggcgtctgggatggcagctggtcttgcgtgtggcgtctagcagctctggtgatggaagaaagtgattgtgttttgtgtgtgtgtgtgtgagagagagagagagccataataagaagcgacatggctggtctccctctggtatgcgcctgttaggatatgggatatctccatgcatggattgtttccgagacagtagtagtattttgttgtagtcgaccatgcgtgtacatcagtataactggatctttgaagagctgagattttatgactcaacaagcattgacat

SEQ ID NO: 8064 - DNA, 2284 bp, Zea mays
  Predicted polypeptide sequence is orthologous to G2
ggatctttcgctttccttaccccgttagcgttcctgcttgatacactacgactgcagattctttggcagaccgctaccaagtgcaagtgtgcaacgcacacacatcactcacagtctcacggtgtctctgtgcgcgcgcgtgggacacaggagggagagagacacagagaagggggcgggacgatcagctctagctcagctggtatcgtctaaactgcataaaaggggagggaaaaaaagttgcaatgatgcatcccggcgcatagatagagagagagagagaagagagagccccgactcgagagccaagaacgccgtgtgttgtgtttgtgtgcatctatctccgtacacgcacgctcgtacgcaccagctagcacgaccgccatggccgccaccaggagagccttcttccacagcgccgtcgacggcattgcgcgcgccgggccgggggaggccgagcggctgccggcgccgccgcaggtcgggcgaccggtggaaggcgccagcagcatggtcttgggcttccccgtgccgcggcccacgatgccggaccgccggccggccgccgtcacccagcagttctttccgcccactactacggccgcgcagcaggcgacgatggaggagcaatgccacgtgcccgccggtagcgcggcggagcagtgggtccggtcgtcggcgtccaggaagagccggcgcggcccgcggtcacggagctcgcagtaccgcggcgtcaccttctaccgccgcaccggccgctgggagtcccacatctgggactgtgggaaacaggtgtacttgggtggattcgacacggcgcaggccgctgcgagggcctacgaccaagccgcgatcaagttccgcggcctgaacgcggacatcaacttcaccctggacgactacaaggacgagatgaagaagatgaaggacttgagcaaggaggagttcgtgttggtgctccggcggcagggcgccggcttcgtcaggggcagctccaggttccggggagtcacccagcacaagtgcggcaagtgggaggccaggatcggccagctcatgggcaagaagtatgtgtacctgggcctgtatgacacagagacggaggctgcccaggcatatgacaaggctgccatcaagtgctacggcaaggaggcggtgaccaacttcgatgcccagagctacgacaaggagctccagtcgcagccctgggacggcgagctggatctcgagctcagtctgggctgcgccagcagcgatccgtccacggtcgccgtcgaggcgttcagccccgcgacgagcagcagtagccgcaagcagaggacgatgacgctgacgctcggtctgccggaggaggaggagacgggcgccggctaccctcaccctgctgccggcatgttcgggcgcccggctgatggccacgtccacgtagcaccgccgccacaccggcaatggcagcagcagcagcagggacagcacgcagctccagatgcggcgcctgagcgacgagcggcagagccagcagatcggcagcggtggggccggggcgcgcgctggcccatcgccagcgccagcggcattaactgggcctgggcgccgccgtacgccaccgcccgcgccggcaccgacgacgacgacgccagcagcgccgccgctgcagcatcatcaggattcccactgtggcagctgggtgcggcgtcgtccaggtccagctggcccagctgctgagcctttcctgtcgtcccgcgccaccaacagtgacgctgctgggccacgtactgacggcgactggtgacctgctggaaccgccgccggcctgtttcccttttctaggtaaaagcagtggcagaggggcgagctagcgacagcgtgcctcgtcatccatcgtccctgcgccgtggctggcggggtgggaaaaagtctgagcagttttgagcgtccggaggagctcgagatttcctccctcgaatagtcacttggggtggccactagttattatttctttccttccccctcgttgattctgctacccattatagcctctgtatctagctacatgcatgatgctgctctagcgctgttggacgttgatggcacggtgtacggatatggacagggttcgtgtgaccccatgtccactgctaggcctgtttccaaatggagtatttctgcagtaccatggcttatagaaatgccgagtattttaaaccattaggtgcttggttactttcccaaaaactaggttttcaaagctatggtataatgaataccacggtatatatttttc

SEQ ID NO: 8065 - DNA, 684 bp, Zea mays
  Predicted polypeptide sequence is orthologous to G2
ccacgcgtccgaacgcttcttttctttttcttttttttatagcatgcagtgatgattcaaccttagttgtgcctttcctcctaatcctatatatgtaggatttagtactggttgactatataagtatatatgtattgttcagtaaaagtatacataggttagctgcatgtttatgtatgtagctggttgtttcaatcagaagataaaaaaaaagggaagtagtggctagggaattcctccggtgggaacgccgtgcttgggtgcaggtacatataccttgggctattcgacagcgaagtagaggctgcaagagcctacgacaaggccgccatcaaatgcaatggcagagaggccgtgacgaacttcgagccgagcacgtatcacggggagctgccgactgaagttgctgatgtcgatctgaacctgagcatatctcagccgagcccccaaagagacaagaacagctgcctaggtctgcagctccaccacggaccattcgagggctccgaactgaagaaaaccaagatcgacgatgctccctctgagctaccgggccgccctcgtcagctgtctcctctcgtggctgagcatccgccggcctggcctgcgcagccgcctcaccccttcttcgtcttcacaaaccatgagatgagtgcatcaggagatctccacaggaggcctgca

SEQ ID NO: 8066 - DNA, 1889 bp, Zea mays
  Predicted polypeptide sequence is orthologous to G4
gcacgagccgcctcccaactcccaagtcccacccccactccctcgctcaccagaggaactagcggccaggcaaagccgagccgcaaccgcgaagatcttgcgtggcctccttttcccagctcgtcactgtgccgctcgtgtccttcactcccggtccgcccaaccaataatccatcgatccatccaccaccaccaccccgctgcggcgatgtgcggcggcgccatcctctcgggtttcatcccgccgtccggggtggcggcggcggcggcggcggccaagaagcagcagcagcagcagcagcggtgccgtgtgactgcggacctgctatggccggggcccggcagtaagggagctccccaggacaaggaggaggacttcgaggccgacttccgcgagttcgagcgcggcctcggcgaggatgacgtggacagcgccggcgaaggcggcgaccccgaggtccaggagcttcctccgccggagccgacgaggtttgccttcgccaccgcggccaaggcagcagttgatggcgtgatgacgacgactccaaaggatgtgcaaggagatagagcagtaaaaaagcgcggccggaagaaccagtacaggggaatcaggcagcggccttggggcaaatgggcagctgagatcagggaccccaacaagggcgtccgcgtctggctcggaacctacaacaccgccgaggaggcagctagggcatacgacgccgaagctcgcaagatccgcggcaagaaagcgaaggtgaatttccccgatgacgacgcgacaggcactcgtcacaggccaacgaacgccgcgaacgcagcgaggctagtagctccacccccacccccgaaggcctgcgccgatgagatgtttaacaacctgaagaacgacgacggcgacaacaacaacaacgatgatctgtttgcgatgtttgcgttcggtgacaataagaagaaggttcctgcagcgaagccagccgccgacgaggttggcagtggcagtggcagcttcctcgtccctgcgcctgcggtggcggcggtgcccggtaacaagaggaggtcgtccgcgaccaacattatgctctccgtctccgacgaccagagcagcaactcctacggctccggctcctccgccgacttggtggggtcgtggtcgtgggacgacgacgacgccgccgccgccgccgccgccgccgccatgacctcggtcttcgctcccgataacgccgtgctgccggcggcgtcttactcttacatgcaaggcggagcgccgaagagaatgaggaggagctacggcggcgcgccgcccagcctcgcacatgacgcggccatgcctggctttggccttgataaagtgagctaccactaccaggcgttgcctccttattacgtcgggagcagcaacgcgtcggtgggcaacctcggtcttctgcagcaggctgatgatgctccagctccacaggatggggcgagcgccggggatatctggagcctcgacgagctgctcatgctggcagcagctggtgcttattgagaaccgcaagaaaaaaaaaatgtgttggcgctgctagctggagacgagacgagagggcgagaggcagttgcatccgccatccgctatcgttttgtctctcctatatctagtatatatatgcttctggcagtcgaactctatggcaatgcgtgtgtatagtgtgttgctgccgtctatgattggaagcgagctcgagactggttcaataattcacctttgcctaccgtcgtaccgccggcctgctggactgtagtgtgcgtactgcatatatatgccatagttatgtatgcactcctcctatatatactatatattattatgaaaaaaaaaaaaaaaaaaactcgagacctcgtgc

SEQ ID NO: 8067 - DNA, 2052 bp, Zea mays
  Predicted polypeptide sequence is orthologous to G4
gcacgaggccgcaattccgcatcacgcagaggcagagcgaccaacccagaaccccaccccaccgcccgcaaccgcaagctcagattccctccccaccccaccccaccccaccgtcccgctcactccagcccagcccgcgtccccacagcccagcgacagcgggcaccggcggcatccagccatgtgcggcggcgccatcctgtcggacatcatcccgccgccgccaccgcggcgggtcacggctggccacctctggcccgagagcaagaagccgaggagggctgcatccggcaggaggggagcccccgtggagcagcatgagcaggaggaggatttcgaggccgacttcgaggagttcgaggtggagtccggcgagtcggagctcgagtccgaggacgagcccaagcccttcgccgcccccaggagcgcgctcgccagaggtggactaaacactggtgcagctggtgtcgatggccctgctgcaaattcagttaaaaggaagaggaagaaccagttcaggggtatccgccggcgcccgtggggcaaatgggctgctgagatcagagatcctcgcaagggcgtgcgcgtctggctcggtactttcaactcccccgaagaagctgccagagcttacgacgccgaggcacgcaggatccgcggcaagaaggctaaagtcaacttcccggatgaggttcctacggcggtttctcagaagcgccgtgctgctgggcctgcctctctgaaagcgcctaagatggacgttgaggaggagaagccgatcatcaagctcgcagtgaacaatatgaccaactcaaacgcatatcactaccctgccgtcgtcggccacaacatcatacccgagccattcatgcagactcagaacatgccattcgctcctctggtgaattatgctgccctagtgaacctgtcttcagaccaaggcagcaactcgttcggttgctcggacttcagcctcgagaacgactccaggacccctgacataacttcggtgcctgcgcccgttgccaccttggccgccgttggcgagtctgtgttcgtccagaacaccgccggccatgctgtggcgtctcctgcgacggggaacactggtgttgatctcgccgagttggagccgtatatgaatttcctgatggacggtggttcagacgactcgatcagcactctcttgagctgtgatggatcccaggacgtggtcagcaacatggacctttggagcttcgaggacatgcccatgtctgctggtttctactgaggctgaggcccagcgactggtgcttgtgtacatagggggggacaaagggtaagagcctgcagtaacagagattggctctttctggtacttgcaatttctatcccttcaactctttcttccgcccccgtgtttcaggaataatgttctggagatgaagaaacgcttgcgtgggcgtgcctgcaggcacgcgtgtagtagctgcggtattagtatatatgcttagatgttcagtcacttcctttaagtacaatttggcgctggacatgtaccttattttactatgtatccgtgacaacagctatgtgtctgcgtccgcggggtctgggtactacgaccacacggcacttatgtatcacgcgatcccgctgtcccagcagctggagtacttcagggagtaccagacgaagctggcggcggtggccggcgccgggcaggcgcgctccatcctcagcggcgcgctgtacatcgtcagtgccggcgccagcgacttcgtgcagaactactacataaacccgctgctgttcaagacgcagacggccgaccagttctccgaccgcctcgtggccatcttcggccgcaccgtgcaggagctctacggcatgggggcgcgccgcgtcggcgtcacgtcgctgccgccgctgggctgcctgccggcgtccatcacgctgttcgggcacggcgccgccgggtgcgtgtccaggctcaacagcgacgcgcagagcttcaaccggaagatgaacggcaccgtggacgcgctggcgcggcggtacccggacctc

SEQ ID NO: 8068 - DNA, 828 bp, Zea mays
  Predicted polypeptide sequence is orthologous to G4
gcgggcacgccgtcaagcaccgatttgtttactgctctctccgacgcgcggcggcggagctccctacgacgactgaaccatgtgcggcggcgcgatccttgccaaccttcgcgagccggcgccgcgccggctcacagagcgggacatctggcagcagaagaagaagctcaagaggggcggcggcggcgggaggcgctcgttcgcggcggaggacgatgaggatttcgaggccgactttgagggcttcgaggccgactccagtgattcagatttggagctcagggagggtactgacgacgacgtcgtcgagatcaagcccttcgctgccaagagaactttctccagcgatggcttaagcgccatgactagtgctgtagcaaggtcagtcaagaggaagagaaagaatctatacaggggtatccgccagcggccttggggcaagtgggctgctgagatcagagatcctcagaagggtgttcgtgtttggcttggtactttcaatagtcccgaggaagctgcaagagcttatgatgctgaagcgcgcaggattcgtggcaagaaggccaaggttaactttcctgatgcaccagcagttggtcagaagcgccgttctggcttagcttctgctaaagcatccaagtcaagttttggacagaagcctatcgtcaaagtagctatgagcaaccttgccaacacaaatgaatccttcttccaatctgctagctacccctccaatttatttgttcagcatggcaatatgccatttgttccagcaatgaactctactgcttctgttgatgatcttatcatgaatctgcagtctgacca

SEQ ID NO: 8069 - DNA, 1426 bp, Zea mays
  Predicted polypeptide sequence is orthologous to G4
gcacgcgttccagttgtagggaagggccaagggaaacttcaagatagtatggcgaagaactatcgagagcgccgcttaaagagggcgatgaagatagatgagggagaggacgactttgaagctgattaccaagcattctctaagaagtacgatgagaaggatgagtgccactataagttcatggctttattaccattcaagaatggtcttcctaatgtctcaccgccaacaaaagagaaagttggacttcattttgccatgaaagatgttgtgattagtcaaaaaccaaccaccaccaatgaaggtatcattgtaaggccgaagtgcaagcgaaagaccccatataggggcatccgccgacgcccttggggaaaatgggctgctgaaatccgcgatcctacaaagggtgttcgtgtttggttaggcacgtataaaacaccagaagatgcagctagagcatatgacgctgaggcccgcaagattaggggcaataaagcaaaggtgaatttccctaatgaaccaccaaacatggtgagcaatgcaccaaaactaattgttactgcaatgactacaatggctatcccagcagacaagttgaatgccaatgaattgatgtgccataaaaactactcaaatgaggattttttctcaatggtgaactttagtggaaacaatggtaactttatttctactgcggcctttggcttacaatgtatcaaaaagcctcgtgttccttatgacatcccaaggatgggtgagtgttcaaatcaaaacagaatgacatatggtttaagtaatggattgggcaatgaagctagtaggaacctgaatggatgctctttcttaccacaagctggcatgccaattttcattcaacctacttttgatggtccttcaaggatgataggaagaaatgatggcgtgattgttcctactttgactaatgcaacacccatggctggtgttgatgctgcgaaaaagatgaatcaacaacctattttccaagagatggaaagtgaagatattccttctattttgcaaggtgatgtcagtgaggacgtggcagctgagattagtatgtgggagttttatgacaccctattagataataaggaaaattgatggatcttgacatcatgcatggtccatatggcttctgtcttgatgatactagcaagtggttcgaagcatgcatgatggggatgtagtcgcaaatgacatattcgttttataatgtcaagtaaaatgcagccatttgttatccatgtgtatcagtttggactgtttatttatgctttgttgtaagcttacaggcaacggaacctgattgacattgtgggtgttattgtaatgtattgataattttcaatccaaaaaaaaaaaaaaaaaaaaaaaaaaaaaaaactagagggggggcccggtaccc

SEQ ID NO: 8070 - DNA, 885 bp, Zea mays
  misc_feature (8)..(8): n is a, c, g, or t
  misc_feature (13)..(13): n is a, c, g, or t
  misc_feature (766)..(766): n is a, c, g, or t
  misc_feature (825)..(825): n is a, c, g, or t
  misc_feature (856)..(856): n is a, c, g, or t
  misc_feature (864)..(864): n is a, c, g, or t
  Predicted polypeptide sequence is orthologous to G4
tacctgtnccggnattcccgggccgacccagcgtccggtctctacccccatctgtagtgcggtctgcggccaagcagagcccggggaaacgatcgagacgatatgtgcgggggagcgatccttgccgaactcatcccagcacgggtgcaccggccgctgaccgccgccacgctctgggcggcggccctgagtgggaccactaccgtcggcaagtggaaggccgatgcagccgccgctaccgacgacgacgacgacgaagagttcgaggccgagttccagcttttcgacgacgatgacgagtgcgaggccgagttccagcttctcgacgaccaccaaccatctcccgcagcttcgcctgaggccagcggctgcaagcggaagcctgcccttgctcctcctgctggtgcccccgcttccacggatccggcgaccccgtgctccaggaagtacaggggcgtccggtaccgccggtcaggcaggtgggccgcggagatcagggacccgcggcaggggcgccgcgcctggctcggcacgtaccgcaccgccgaggaggccgccctggcgtacgaccgcgaggcccgccggatccgcgggaagagcgcgcggctcaacttcccgctgctcatcccgcacgaaggtcccggccgtcacgcgcgcacgccggtggccatcgacctcaacttgccgcccgtctccgacggtctcggcgtcccggctccggctggcgtcggcgacgacggcacggcgaatgccgacggagatgcanatatggccagtactaagactcagagcacgctagcgcgggtcaaggaactgatcgcgcangacctcacaacatcggctggcggcaagatcntgcctganctgatgatgcacgggagcagg

SEQ ID NO: 8071 - DNA, 889 bp, Zea mays
  misc_feature (654)..(654): n is a, c, g, or t
  misc_feature (741)..(741): n is a, c, g, or t
  Predicted polypeptide sequence is orthologous to G4
agccatagttaactttcctgatgcaccagcagttggtcagaagtgccgttctagttcagcttctgctaaagcactcaagtcatgtgttgaacagaagccaattgtcaaaacagatatgaacatccttgccaacacaaatgcacccttctaccaatctgttaactacgcatccaacaatccatttgttccagcaatgaactctactgtttcttttgaggatcctatcatgaatctgcactctgaccagggaagtaactcccttggctgctcagacttgggctgggagaatgatactaagacaccagacatcacatccattgctcccattcccactattgctgaaggcgatgagtctgtatttgtcaactccaattcaaacagctcgatggtgcctcctgtcctggagaacaatgctgttgatctcactgatgggctgacagatttggaatcctatatgaggtttcttatggatggcggtgcaagtgattcaattgatagccttctgaaccttgatggatcacaggatcttggtagcaatatggacctctggaccttcgatgacatgcccatcgctggcgatttcttctgaggaatttgaagcttggccataggactatgtacatagggactagggaataaagactgggagattgngaagcacctgcttggcaccttggggtagcatatgctcgtgtctagctcagatgcagaagtcgcattctgaaactctttggttatcgnacctgtccctatttaactatctctgtatgagagccatttatgagactgaacccatttaccattttgttttcccccttcttttcgtgtacagtatatggttaacattatgaattatggatatgtgccaaacatgcctttaatatgcgcc

SEQ ID NO: 8072 - DNA, 866 bp, Zea mays
  Predicted polypeptide sequence is orthologous to G4
aaaacttgtcgaaaaatacacagggcacaatgtgcggaggcgccatcctcgcggagctgatcccgccgacgcggcgcgtggcgtcgaagccggtgacagaaggccacctctggtcggcgagctccaagaaagccggcagcggcagggacaagaggcaccagcacgaatacgccgacgatgacttcgaggccgccttcgaggacttcgacgacgactttgacgtgcatgaagacgacgaggacggccacttcgtattctcgtccaaatccgccttgtccccagccctgcacgacgggcgcgcggcgagccagaagaagcagcgcgggcgccagttccgcggcatccggcagcggccctggggcaagtgggcggcggagatccgcgacccgcacaagggcacccgcgtctggctcggcaccttcagcaccgccgaggacgccgcccgggcctacgacgtggaggcgcgccgcctccgcggcagcaaggccaaggtcaacttccccgcagccagcggtcgcgctcgcggtcgcgcgcgcccacgccgcggcgacgacggcaacccacgaaccgcgccggaaacgcagcacccagcacagcccgctctgctgcctcgaggagagagagagacgcagaggaaggaagggatcgccgccgtgaagccagaagctacggagtcgttcgacgtgggcggcggtctcttcttcgacatggccttccccaccttcccagcctcgccgccgccgcaggccgtggatacgtccttcgccggcagcaccgccacgtcggagaccgggagccccgcgaagaggccgagatgcgacgaagactcgtccgagggcggcagcggctcggcgctggagctcgct

SEQ ID NO: 8073 - DNA, 880 bp, Zea mays
  Predicted polypeptide sequence is orthologous to G4
cagccaaacacacgcgaagaaaaggagatagagtacaggttacagacaggcagagagcaaagatgtgtggtggtgcgatcctcgccgagctcatcccgaccacgccggcgcgccgcggcggcgcggcgtggcccgccggcaagtgcaagcggcggaaggcgaacgacttcgaggccgcgttccgggagttcgacgaggactccgaggaggaggaggaggacgacgagggggtggtggagagcaagcccgctttcgtcgtccgcgcctcgtccgcggcgacgcagcccagggcgcgccaggagcagcggagccggcgccgggcgcccgaccagcagtacaggggcgtccggcgccgcccgtggggcaagtgggccgccgagatccgcgaccccgtcaagggcgtccgcgtctggctcggcaccttcccttccgccgaggccgccgcgcgcgcctacgaccacgccgcgcgccacatccgcgggcccagggccaagctcaacttcccctcctcctcctccgcctccgctgccggggcccccgccagccgcaagcgcgcccgcgccgccgacgccgacgccgacgccgtcatcgacctcgaggaacaagagcagcgcccggccgcggcggccctgaagcacgaggccgccgagtgctccggatccggcgcgctcccggacttctcgtggcagggcgtgtcggcagcgtacgacgaggcctcggcgccgcgcccggccttcgacttcgaggcgcggccggagagcgccgcggacgaggcgtcgcccctggcctccgactccgagtcggacgcgctgttcgactcgctcctcttcggcgaccagttcgccttcttcgacgccggcgcgtaccagtcgctggacag

SEQ ID NO: 8074 - DNA, 918 bp, Zea mays
  misc_feature (392)..(392): n is a, c, g, or t
  Predicted polypeptide sequence is orthologous to G5, G974
ccacgcgtccggcggcagcgccactggggcaagtgggagccggagatccggctcccgaagaaccgcacgcggctgtggctcggcaccttcgacaccgcggaggacgcggcgctcgcctacgacaaggcggccttccgcctccgcggcgacacggcgcgcctcaacttcccggccctccggcgcggcggcgcgcacctcgccggcccgctgcacgcctccgtggacgccaagctgaccgccatctgccagtccctgtcggagtccaagtccaagagcggctcgtccggcgacgagtcggccgcgtccccgccggactcccccaagtgctcggcgtcgacgacggagggagagggggaggaggagtcgggctccgccggctcccctcctcctcnggctcctcccccgacgctggcgccgcccgtgccggagatggcgaagctggacttcacggaggcgccgtgggacgagacggaggccttccacctgcgcaagtacccgtcctgggagatcgactgggattccatcctgtcatgagcaataatagctccgtgtaatttaattttctactgtctgggttttgcggctgcggtggcccgatggcattttagacgtcggccatggcggctgcaagtagcaatgagtaactagctagctagtacatcgtcgtcgactcgtcgtcgtccagtgttgtgaagcagcgtcaagtacatgcgtgctagtctctcctggttgagctgccggttgtttttttttctcacggcacggccagtcgagaagagtcagtagtgtaatctcgtggtgttatgatcatcggttgcagcttatgtatggaactttgtctatctagtactatttattggtctaaaaaaaaaaaaaaaaaaaaaaaaaaaaaaaaaaaaaaaaaaaaaaaaaaaaaaa

SEQ ID NO: 8075 - DNA, 1550 bp, Zea mays
  Predicted polypeptide sequence is orthologous to G5, G974
gcacgcggtaatccccttcaacaaacgcaccgcactccacggcagcctgaaaacacaatccacagagtctccgtgaggtctgagcgaggtaggactagctctgagcgagttcttccgtcttccaggtataatcctagcaactctcactatcctcttcgcatcgctcgtctctttttgagaccagttggatttctcttatttttccttggatcctactacctaatagaacagagctccggagccttttagtttctggtctctgatctactcattttcttttcttccccttttggtgacataggtaggtctagttaagatctgtcgtgcctgttctttgattttagctaagaaccaggcgatttagtcttcttcttccttacaaaaaaaatccccagaaaaaaaaagttgtgagtagtatattcttgtaccatttgatggccgctgctataaatctccccgggcccagcgaggatctgatgcgagcgatggagtccttcatgcaagacgacgccccatcccctctggccatgccgccggcgccgtctttcccagcggccgcagcccacggggcccagtacccggcgacccacctgagcccggcgcagatgcagttcatccaggcccagctccacctgcagcggaacccggggctgggcccgcgggcgcagcccatgaagcccgccgtcccagtgccgccggcgccggcgccgcagcggcctgtgaagctgtaccgcggcgtgcggcagcgtcactggggcaagtgggtggccgagatccggctcccccggaaccgcacccgcctgtggctcgggaccttcgacaccgccgagcaggcggcgctggcctacgacccagcggcgtaccgcctccgcggggacgcggcgcggctcaacttccccgacaccctggagtccagggcgccgctcgaccccgccgtggacgcccatctgcaggccatctgcgccaccatcgccgccgcgtcgtcgtcatccaagaattccaaggccaagagcaaggcgatgccaatcaacgcgtccgttctggaagcggcagcggcgtctccgagcaacagctcctccgacgaaggttccggctccgggttcgggtcggacgacgagatgtcctcgtcctccccgacgccggtggtggcgccgccggtggcggacatgggacagctggatttcagcgaggttccgtgggacgaggacgagagcttcgtgctccgcaagtacccgtcctacgagatcgactgggacgcgctgctctccaactagtcgcccttcgccgacagatgtgctgttgtagttcagtagtggcagtatctctggccgccgcagatgaggttttaggcaatctgcaggccgccggcccatgtgtattaagtaggttttgctcagttgttggccctggacttcgccggcgtttttgtgaccggcgtccccgagtgcactgcattggtgtactggtctgtctgtaaaaaaaatggatctgtacttctatagtgtgtattcaaccattgttcttagttgtaaaaaaaaaaaaaaaaaaaa

SEQ ID NO: 8076 - DNA, 926 bp, Zea mays
  Predicted polypeptide sequence is orthologous to G5, G974
aggagctcgcgaaagcactcgagccttttataacgagtgcttcctccccctaccatcgctactcgttggccccagattcttacatgcctacaccctcctcctacaccacctcgcctcttcccacccccacctcctcgcctttctcgcagcttccgccactctactcgtcgccttacgcggcttcgacggcgtcgggcgtggctgggccgatgggcctgaaccagctcggcccggcccagatccagcagatccaggcccagctcatgttccagcaccagcagcagaggggcctgcacgcggcgttcctgggcccgcgggcgcagccgatgaagcagtccgggtcgccgccggcgcagtcgaagctgtaccgcggcgtgcgccagcgccactggggcaagtgggtggcggagatccgcctccccaagaaccgcacgcggctgtggctcggcaccttcgacaccgccgagggcgcggcgctggcctacgacgaggcggccttccgcctccgcggcgacacggcgcgcctcaacttcccgtccctccgccgcggcggcggcgcgcgcctcgccggcccgctccacgcctccgtggacgccaagctcaccgccatctgccagtccctggcggggtccaagaacagctcgtccagcgacgagtcggccgcgtccctgccggactcccccaagtgctcagcgtcgacggagggggatgaggactcggcctccgccggctcccctccttccccgacgcaggcgccgcccgtgccggagatggcgaagctggacttcaccgaggcgccgtgggacgaaacggaggccttcccactgcgcaagtacccgtcctgggagatcgactgggattccatcctcccatgaacgatcaactacaactagtattttagtagtagcagcagcagcagcagcaag

SEQ ID NO: 8077 - DNA, 693 bp, Zea mays
  Predicted polypeptide sequence is orthologous to G5, G974
gagaaaaaacaaccggcagctcaaccaggagattagcacgcatgtacttaactctgcttcacaacactggacgacgacgatgtactagctagctagttactcacttgctacttgcagccgccatggccgacgtctaaaatgccatcgggccaacgcagccgcaaaaaccaaacagtagaaaattacacggagctgttattgctcatgacaggatggaatcccagtcgatctcccaggacgggtacttgcgcaggtggaaggcctccgtctcgtcccacggcgcctccgtgaagtccagcttcgccatctccggcacgggcggcgccagcgtcgggggaggaggaggagagaagaggggagccggcggagcccgactcctcctccccctctccctccgtcgtcgacgccgagcacttgggggagtccggcggggacgcggccgactcgtcgccggacgagccgctcttggacttggactccgacagggactggcagatggcggtcagcttggcgtccacggaggcgtgcagcgggccggcgaggtgcgcgccgccgcgccggagggccgggaagttgaggcgcgccgtgtcgccgcggaggcggaagggcgccttgtcgtaggcgagcgccgcgtcctccgcggtgtcgaaggtgccgagccacagccgcgtgcggttcttcgggagccggatc

SEQ ID NO: 8078 - DNA, 835 bp, Zea mays
  Predicted polypeptide sequence is orthologous to G5, G974
cattcctcaatctccgcggtgcgcccccgcgaattgctgacgtcgacgccctcgaaatctcgctctctccgtttctagaccttctcggcttccctcctctgtttcgtgcaagaatccatggcggctacgacgatagattggcacggccgcaacgccgccttgtatggcgtgccggacagcaaggagctggtgcgcgcgctggctccgcccatgcagcaggccccgaccatctcgttcgcgtacccctgcccaggcgtggagcagcagagccagtgcgcggcggcgggctcgtttctgggcgccggcggcctgaccccggcgcagcttctccaggtgcagtcgcggctccggttcctgcgccggccggcggcagcgggcggcgccgcgcagccgatgaagcggcagggcgtgccgcagcaggctccgcttcccgcgcggccggcggtgtccaagctgtaccgcggcgtccggcagcggcattggggcaagtgggtggcggagatccgcctgccgcgcaaccgcacccgcctctggctcggcaccttcgacaccgccgaggaggccgcgctcgcctacgacggcgccgcgttccgcctccgcggggactccgccaggctcaacttccccgagctcaggcgcggcgggcagcacctcggcccgccgctccacgccgcggtcgacgccaagctccacgccatctgcagcggcgcggacgtcggcgcgccgctgccgcagggccagagccagagccacgccacggcggcggcgactacagccaccccgagccccttctcctcggtgagcccacacgtcaagagtgagccgggctgctccg

SEQ ID NO: 8079 - DNA, 1494 bp, Zea mays
  Predicted polypeptide sequence is orthologous to G5, G974
gcacgaggagcgcgcgagccttttatccgggatgcctctgctcacggagccagtccgctctctccaaccccaacagccaattagcccctcgtcaccgttctccttccacccaagcagccgcagtcggccgccaccgccgcctcctcctacggaggaaactacccgttcgccgcggccgacgaggcgggccagctgagcccttcccagatgcagtacatccaggccccgcctccacctgcagcgtcgccaggcgcagacctccgtgctgggcccgcgtgctcagcccatgaaggcgtccgcgtccgcggcccccgccccggcgcggccgcagaagctgtaccgcggcgtgcggcagcggcactggggcaagtgggtggcggagatccggctcccgcgcaaccgcacccggctctggctcggcaccttcgacaccgccgaggaggcggcgctggcctacgaccaggccgcctaccgcctccgcggcgacgcggcgcgcctcaacttccccgacaacgccgcctcccgcggcccgctccacgcctccgtcgacgccaagctccagagcctgtgccagagcatcgccgcgtccaagaagggcgccaagaagccagcctccgccgcagctgccgcgtcgtcgtccgcccccaccagcaactgctgctcctcgccgtcgtccgacgacgcgacctcgtcctgcctcgagtccgccaccgagtcctcgtgcccgtccccgtccacgtcgccgtccgcctcgcccgggccgacggtgccggagatgcagcagctggacttcagcgaggcgccgtgggacgaggccgccggcttcgcgctcaccaagtacccgtcgtacgagatcgactgggactccctcctcgccaattaatcgtcgccccctgttggctggctggctggctcccttcctacccacactgccgtcgtgcagctggaggagggttaaagaaggttaacggccgtcgcgcagatgggattttagacatcctgcgcgggcactagttggatcattagtgctaatccccgtccgtccgttcgttcgttcgttctgtgtagatgtccgtccgattcgtttggtccttgtcactggtgagtcagttgtagatctcgggttatttagggtttggttctccggaggaggagagacccccaaccgacgggaacccggcgtttttgtgtccggcgttttccggcggtggccggtacgtgtcacactggtcagtgacccccccccccccgcccgttcaggtgtccgttgctctggtagctgtttcttgtgctagatggtgtgctgtgctctccagggttgtaaaaaccacgccccggtgtgatgtgaagggagatcgcttgtcaaccaggtagtactccggtatgtatgttgtaaaatcagctagctagctgtgtccaggagttgtaatttgatgccctgctactgttggtgctactattgtatggttaaaaaaaaaaaaaaaaaaaaaaaaa

SEQ ID NO: 8080 - DNA, 646 bp, Zea mays
  Predicted polypeptide sequence is orthologous to G8
agggttgattctgtagagcgtatgatagggcagccattcgcttcaatggaccggatgctgttaggaactttgattctgtttcctatgatggagatgtcccacttccacctgcaattgagaaagatgtggttgatggagacatccttgatctgaatttgaggatttcacaacctaacgtgcatgatctcagaagtgatggtaccctgactggttttggattaagttgtaattctcctgaagcttcaagctccattgtttctcagccaatgggcccccagtggcctgtccatcctcacagcagatcgatgcggccccagcatccacatctgtatgcatctccttgtccaggcttctttgtgaacctcagggaggcgcctatgcaggaagaggagaaccggtccgagccggcgtgtccccagccgttcccctcctgggcatggcaaacgcagggctcccgtgccccagttctccctgccaccactgcagcatcatcaggattctctaccgccgctgccaccggcgtggacgcggccacagccggccacagcgtgccgccgccgtctggtagcctccggcagttctcgggctaccaccagctccgcttccccccaaccgcctgacggagacagaccacctcctgttgagt

SEQ ID NO: 8081 - DNA, 883 bp, Zea mays
  Predicted polypeptide sequence is orthologous to G8
acttgtgcagggtgacgcctctgtacctggagctgcctctcgagaagccggtgctctgacggcgcaggacgtgcacgaactcctccttggacaggctccccatctgcttcatgtcgtcctcgtagtcgctgaggttgaagttgatgtcggcgtcgacgccgcggaacttgatcgccgcccggtcgtacgcccttgcagcggcgtgagcggtgtcgaatccacctgcgtatatcggccagcagccggaccaccactaggtacacctgcttgccgcaatcccagatgtgggactcccagcggcctgtgcggcggtagaaggtgacgccgcggtactgcgagctgcgggagcgcgggccgcggcggctcttcttggccggcggcggcgcggcgtgtgggtgcggcacgatcctggggcccggcgcctgttgctgctgcaggtcggcgcggaagaagccgagctcggcccaatgccgcggcgtcggggccggcggaccggcgccggccgggaacagctcgcgggtcacgagctgctgctggtgctggtggcggtggcgaggaggaggcgatggcgtggcgtcctcgtcctcgtccgcgccggccgcgtcgctatcgctccggatgaggatgctgaactccagcacggccggcgttgagctagatccctcctccgccggcgcgggcgcgccgcccgccgacgccgcttccgacgcgttcagcaccgacgaccccgagtcgctcgcctccatctccaccggcggcggcgcctcggccacgttcagatccaactgcatctcctgctcctgctcccctcccctccaaagctacaactcgcaagcggcagcccgccaccgatccccagtcgcaactgggctgctaactacct

SEQ ID NO: 8082 - DNA, 880 bp, Zea mays
  Predicted polypeptide sequence is orthologous to G15
gtctcactcaacctgcgcccatgggattggcttaacttctgggacgtactccatccactacggcaactcccccctgcactgcagtttatctcggcgggtatgacgtggaggagaaggccgcgagggcatatgacctggcggcgctcaagtactgggggacgtccacgcacgtgaatttcccggtggaggactacagggaagagctggaggagatgaagaacatgaccagacaggagtacgtcgctcacctgagaaggaaaagcagcggcttctcgcgcggcgcttcgatctaccggggagtcaccaggcatcaccagcacgggcggtggcaggcgcgcatcggccgcgtctcgggcaacaaggacctctacctcggaacgttcagcacccaggaggaggcggcggaggcgtacgacgtggccgcgatcaagttccgcggcctcagcgcggtcaccaacttcgacatcacgcggtacgacgtggacaagatcatggagagcagcacgctgctcccgggcgagcaggtccggcgcaggaaggaaggcgccgacgccgcggtctcggaggccgccgccgcgctggtgcaggccggcaactgcatgacggacacctggaagatccaggcggcgctgccggctgccgcgcgggccgacgagcgcggcgccggccagcagcagcgtcaggacttgctgtcgagcgaggccttctcgctgctccacgacatcgtgtccgtcgacgccgctgctggtacagggacagggggcatgtcgaacgcgtcctcgtcgctggccttcagcgtgagcaactcccgggagcagagcccggaccggggcgggcgcagcctcgccatgctcttcgccaagcccgccgcggcgcccaa

SEQ ID NO: 8083 - DNA, 820 bp, Zea mays
  Predicted polypeptide sequence is orthologous to G20
cccgttctacgcttggcttggctgcgctgcgctgcgcacaccgaacccctcgccgtcgcggctcgcctcggctccgccccgaccgaccgatcgatccggccggcggtgggcgccatggcctcccccaaccccgaggccgcggggctgcaggccgtggctgtggcgggggcaggggagggcggctcgtcctcgtcgctcagcgccgttgcgggagcggctgcgttgtccggggagctggtgcccaggagggcgttggcgctgcgcaaggagcgcgtgtgcacggccaaggagcgcatcagccgcatgcctccctgtgcggcggggaagcggagctccatctaccgcggggtcacccggcataggtggacaggtcgatatgaggctcacctttgggacaaaagcacgtggaatcagaatcagaacaaaaagggcaaacaggtatatctaggtgcatatgatgatgaagaggctgcagcaagggcctatgaccttgctgcattaaaatactggggagctggaacacaaataaatttcccagtatctgactatgcaagagaccttgaagagatgcagatgatatccaaggaggattatctcgtgtctcttaggagaaagagcagtgccttctacagggggttaccaaaatatcgtgggcttcttaggcaacttcataattccagatgggatacatctttgggactcggcaatgactacatgagccttagttgtggcaaggatatcatgttggatgggaaatttgcaggaagctttggtctagagaggaaaattgatcttacaaaatacatccggtggtggctac

SEQ ID NO: 8084 - DNA, 1388 bp, Zea mays
  Predicted polypeptide sequence is orthologous to G21
ccagagtaccagacaccactgcgcatcagtgcaaagaggtagctaccctatctgccatggctcaagagctccacgaaacgtcctcttgctctgccaccaccacctcgtcgtgcaccacatcctgctgctcgtccactgtcacagactcgtcctcttcgcccccgtcaccggcggcggccaatgccgcgcccgcgacacggaagcggcaggcgttggaggccgaggccgaggccgaggcgggcggtgaggaggaggaggaggaggaggaaggctgtgctggtaataaggcggcgccggccaagaagcgaccgcggggcagcgaggggaagcacccgacgttccgcggcgtgcggatgcgggcgtggggcaagtgggtgtcggagatccgcgagccgcgcaagaagtcgcgcatatggctcggcacgttccccaccgccgagatggccgcgcgcgcccacgacgtcgcggcgctcgccatcaagggccgcgccgcgcacctcaacttcccggacctcgccggcgcgctcccgcgcgccgcgtccgcggcgcccaaggacgtccaggcagccgccgcattggccgctgcgttcacgtcgccgtcatcggagcccggcgccggcgcgcacgaggagcccgctgccaaggacggcgccgcgcccgaggaggcagccgccgacgcacaggcaccagtaccagtagcactaccaccgccggcggcctctcggccagggacgccgtcgagcggcgtggaggacgagcggcagctgttcgacctgccggacctgctcctcgacatccgggacgggttcgggcgcttcccgccgatgtgggccccgctcactgacgtggaggaggtggtcaatgcggagctgcgcctcgaggagccgctgctttgggagtagcggtcagagatgctcgttgcctgcattgcaaacgaggtctaaacaatagtagcagtggtatcccatttcttctcgttttgcttctcgccctctcctttttttctctctttcttgcttactttggggggaaaacagctagttctttttttcttcttcttcttcttcttttattaaattgagttttaataagtataaacatatataaacgagagagagatataagctgtgtacttaaaagtgtaagacgagtacctatcagttcattattacgtatctactagtggtaccagtagtgatcatgttgtcccggccgtgtgtgaattccagcggtagttgttgaccttgctagatttttatagttgcttgtgttgtgtgctgtaccaaaattccccagggaaaaagggcaggaagcaaacgaatgtaacgggaacacaagcagcatctaatctctattactgctgacaacgaaaaaaaaaaaaaaaaaaa

SEQ ID NO: 8085 - DNA, 470 bp, Zea mays
  misc_feature (280)..(284): n is a, c, g, or t
  misc_feature (325)..(329): n is a, c, g, or t
  misc_feature (375)..(375): n is a, c, g, or t
  misc_feature (395)..(395): n is a, c, g, or t
  Predicted polypeptide sequence is orthologous to G21
ccagtctgaactcaacatgaccattattcataaaaccatgatctgaattgaacatggtccatccaaataaatatttcaagttacattcacaactaaatggcagaaaatactacagcctatccaaataaatattacaagtgtcatttcacaactaaatatcagtagtatcagctattcgtcatcactgtcaacatcatttgtagcaccttcttcggcttcgctgcaatactccaaaattgtatcgtcatcatcttcttcttcactatcactcccatacacnnnnnggccattttcttgtaccaattgagcaatttcagcagcttcnnnnntaagaccttgttcatcatctctcgttcaaaggcttctcatatatanttatcggaaactgcttgtcngactagcattctcttcacaacactcattttcttgatatgcaggagcattatgttgggcaacatcattttcactca

SEQ ID NO: 8086 - DNA, 558 bp, Zea mays
  misc_feature (473)..(473): n is a, c, g, or t
  misc_feature (516)..(516): n is a, c, g, or t
  Predicted polypeptide sequence is orthologous to G25
agccacagatacaaaagagataacaacacaggcacggcaaaccgcgttcattattcagtgaagagcgacagtgacggcgggtagtagtagtcctcgaagctccacagcccggctggcgctggcgccggcacctgcgcttcttcggggacggcggcagcggcagcggcagcggtggtggcacttacagctgcattcccgccctccatgtacgggacgccgagaaagctcatgtagttctcgtaggccattagctcctcggacagctccttgacctcgtcggacacctgcgtgcgcgcctccaccttgggcgccgggagaacggccggggcctgtgcagcagcagcagccccagatgccgccgtcggcgcggtgacgctggaggaggaggtctcgttggggaagttgaccttagctttggcgcccctgatgcgcctggcagcgcggtcgtacgcgcgcgcggcggcctcggcggnggggtaggtgccgagccagacgcgcacgcccttcaggggtcgnggtattcggcggccattgccccaaggcgttgcggtagccggg

SEQ ID NO: 8087 - DNA, 1121 bp, Zea mays
  Predicted polypeptide sequence is orthologous to G25
gcacgagaccaaatccaacgtccgcagaaaccacactcccgtcgaggaggaggcgtcgacttcccatagtttccattccacttcgatcctatcctatcgtccccaaacactccaccaagaacctttccccctccaatagtccgagttactcggaggaatccatgtgcggcggtgcaatcatcttggactacatcccggcgcggcgccgggtgtccgccgccgacttctggcctgactccgaagccgacgccgaggactccgactcgcacgcccctgaccctgagagagcgccgcgcccgcgcgggaaggcgaagcgtgggcgcaagaaccagtaccgcggcatccggcagcggccgtggggcaagtgggcggcggagatccgcgaccccgtgaagggcgtgcgcgtctggctcggcacctaccccaccgccgaggccgccgcgcgcgcgtacgaccgcgctgccaggcgcatcaggggcgccaaagccaaggtcaacttccccaacgacgcctcctcctccagcgtcaccgcgccgacggcggcatctggggtggcggcacaggccccggccgtttttctcccggcgcccaaggtagaggcgcgcgcacaggtgtccgacgaggtcaaggagctgtccgaggagctaatggcctacgagaactacatgaacttcctcggcgtcccgtacatggagggcgggaatgcagctgtaagtgccaccaccgctgccgctgccgctgccgccgtccccgaagaagcgcaggtgccggcgccagcgccagccgggctgtggagcttcgaggactactactacccgccgtcactgtcgctcttcactgaataatgaacgcggtttgccgtgcctgtgttgttatctcttttgtatctgtggctcgcgagttgaggcatgtaaacaagctttgcagttttttttttaactccggtctgtgcttctcagcagctcgctgcggtgcagaggaatctgtttcattctgttcgtgattgaaactagttttacggttacaacgcgcagatggaggatcgtcggacactcggaccattgtaacaaggcttgcataccatttggaagattttaccatactgaaaaaaaaaaaaaaaa

SEQ ID NO: 8088 - DNA, 1023 bp, Zea mays
  Predicted polypeptide sequence is orthologous to G25
ggggataccgccgaaccaaatccaacgtctacagaaaagaaaacacattcccgtcgactcccctagtttccatcctattcatttctccccccaaacactccagctactagttactcgaggaatccatgtgcggcggcgcaatcatcttcgactacatcccggcgcggcgccgggtgtcgacagccgacttctggcctggttctgaagcagacgccgaggacattcatgcctcgcactcctctgacccacagagagcgccgcgcgcgaaggcgaagcctgggcgccgcaagaaccagtaccgcggcatccggcagcggccgtggggcaagtgggcggcggagatccgcgaccccgtgaagggcgtccgcgtctggctcggcacctaccccaccgccgaggccgccgcgcgcgcgtacgaccgcgccgcgaggcgcatcaggggagccaaagccaaggtgaacttccccagcgacacctcctccagcgtcaccgtgccgacggcggcgtcgaggtctgctgctgctgctgccgccgcacaggccccggccgttctcccgccgcccaaggtggaggcacagactcaggtgtccgacgaggtcaaggagttgtccgaggagctgatggcctacgagaactacatgaacttcctcggcatcccttacatggaaggagggactacagctgcaagtgccaccacagctgccgcctccgccgccgctgccgtcgccgaagaatcgcaggtcccggctccggccggactgtggagcttcgaagattactactacccgccgtctctgtcgctctttactgaatgatgaacgtgctttgaccgtgcctgttttggtaacacctttgtgaacagatttcctgctcgtcctagtcggtgtgatgtgatggcatcaatcgagctcctgtcctgtaattttgttgaacccatccattgtttcgtgactactgtgtgtccctgtaactcgcaagttgatgaggaatcaagatttccagtttaactccaaaaaaaaaaaa

SEQ ID NO: 8089 - DNA, 653 bp, Zea mays
  Predicted polypeptide sequence is orthologous to G27
ctgcattttttcttcttctctaagatcaacaataatactatcattgttgatgcgaaatgcacccatctgctactagtagaaaacaatagcgatttgcagatgcatcagactgctgctatcagtcgacgcctctagcacagtctagtgctcactcgatcacaacctggtacggaaagaacacacggggtagctgctccatgcccaatcctaaatcaggcacaggcaataccgatacgccaatactagtactgatttaagaatagcaagcatactagtatgtccgttccctctattttcttcgaaaaggcccgtatgcttcacaactcggcccacaagagcggctcgtgcatcccgacgacggcgtcgcagccgtcgtaatgctcagcggccattgccgccggccaccacagcccgtcccgcaggtcgaggaggaggtcgggcaggtcgaacagcgtgctctcctcctcccgtccctgtcctccgtcgccatacgccgccgccgtctcggggcagcaggcggcagcttccggcgagggcgacggagcccgcgcgtcgcactgcacgtccacgtccacgtccacggccgccgccgccgccgcggctaggaccgccgcggcctggatgtccgcgggggaggcggacgccggccgggg

SEQ ID NO: 8090 - DNA, 627 bp, Zea mays
  Predicted polypeptide sequence is orthologous to G27
gatcctctatatttaggggaaaaaaccctttaggggaccttgttggagcccgccttacacataccagctagggctacagggagaggtaacaaacatcatactagcttaactagaactaacatgctatggttctaaggttactaaactttctaacacgggcatgatgggcccacgaacaccaaaaaaacaaacgcggcgatcaccaacccccccactgatgtacaaaatcctcctccaaaagtggccggagtggtctagctaaaatccacagaaggacagggaaagctccaggctaacaacaccccccggcccgacaaaaaaacagcctgagtggccggagcagtcgctggagctcctcctcgccggggaggccgtgaggatgcagctgctctccccgcttcgcgaggaggccgctgccgccatgccacgcccgcattttgcgtccagattaccgagggacagcgagagcgagcactgctcaaatgcctcgtcctccttcgtcgctgcattggtggactggggccgtccgtcgtttccgtcctctttgctggagtcctcgccgtcctgctgcttcagcgcaaaaccaagacggtgtgcttctggtcggcgtacctgcttaaaggggcc

SEQ ID NO: 8091 - DNA, 1086 bp, Zea mays
  Predicted polypeptide sequence is orthologous to G38
gtcgacccacgcgtccggaggaggcaaagcgaccaagaaaagcacctgcaaagggttcgaagaagggctgtatgaagggaaaaggggggcctgacaatactcaatgtggataccgtggagtgaggcagcgtacttgggggaagtgggttgctgaaataagagagccaaatcgtgtcgacagactctggctgggtaccttcccaaccgcggaggatgcagctagggcctatgatgaggcagccagagcgatgtatggagacttggcacggactaacttccccggacaggatgcaacaacctctgcccaagctgctctagcatcgacctctgcccaggctgatccaacagctgtcgaagctcttcagactggcacgtcatgcgagtcgacaacgacatcaaattactcggacatcgcatccacctcacacaagcctgagcctgaagcctctgacatctcgagctccctaaaggcaaaatgtccagctggatcatgtggtatccaagacggtacacccagtgtagctgacaaggaggtctttgggccgttggagcctatcacaaatcttccagatggtggtgatggttttgatatcggtgagatgctgaggatgatggaaagcgatccacataatgcaggtggagctgacgctggcatggggcagccctggtatcttgatgagctggattcgagtgtcttggagagcatgctccagccagagccagagccagagccagagccattcctgatgtctgaagaaccggacatgtttcttgctggcttcgaaagcgctggtttcgtcgagggtctggagcggctaaactgaatttctgatgtttgaccgttgatcctcatcccacttcatgtctgagcttgtgaattcggaggcaaacattggcagaacttataagctctagcaattctaggctttatattcctctgtaatagttctctaggcatgggaactgggtttgcttcacattttttgtaagaccagaagtgatgtaaatagttcccaccttgtggaaggacaagaaaaaaaaaataaaaagagtgcttgcttttaaaaaaaaaaaaaaaaaaaaaaa

SEQ ID NO: 8092 - DNA, 627 bp, Zea mays
  Predicted polypeptide sequence is orthologous to G38
ttttttttttttttttttttaacagccaagagagctcattaaacacgaactcatccctactatagtacaggaactcaacacacaggacaacttgttgtaccggttggctcatagtataaagctatgtctcatcagcatcatctagaatgaagctattcctactactccccccacccccatgatcgtgctttctaatatgcaaaaaggctaaacccatcatctccatcaaggtattcttcgtgtgcctcaaattttttatcagcattcagttctacaattatcatctcgacgacgtcttcaacgttgaagtaatcataactcacgtccccttccttgtgtagcacagtctcctccgcggactgaatgacgcaggtgaccttgacgcttcccaagtcaccattcttcgcttctgtcttcacctcatgtacctctacctcagtctccacggattccacctcagtctccactttctcatcagaccgttgttgcaacgcggcagccggcacactagacgccagcagcgaaagcgccgacgtgcagccggagttggcatcagcagagctctccgagaagttgacgcgtgccttggggccgtacatcgccttcgccgcctcgtcgtacgcatgg

SEQ ID NO: 8093 - DNA, 782 bp, Zea mays
  Predicted polypeptide sequence is orthologous to G43, G46, G1419
actatataaattatcttttatttattatatattatatttaaaaattgtccattatagtattctcatgcagtcatgctacgccaggacacgtttgcttgcttgcgactgaacgaataaataaagaacgaaagaatatttggagctatactcctctagcatatcaaagaactcagaagactatcatcaggtaagagtaagaccaccgtccctgtcttgctacgacatcaagtcaggcagtcagctgacgtagagctgcggcacggccaggtgcgggtgcggcgacaacggtgagagcggcggcaggctgcagatcgcccccttcagcgactcatcctcccagaagtagtccgcccctccgcttgcgggctcctgaatccgctccttcttcacctccctaaccatgcacctagcgtcctgctcctgcggcgacctcgccctcttgttaccggccacggtcgcgctgggctgaggaggaggagcaggcgtcgcccaccatgcagcggtgcttaacgcgacctcgttggggaagttgaggatggccttggacccgcgcaggcggaacgcggcgcggtcgtaggcacgagcggcctccacggcggtgtcataggtgcccagccacacgcgcgcgcccttccgcgacgggtcccgaatctcggccgcgtacttgccccacggccgctgccgcacgccgcggtaccgccggaaatcgtcctcctcgggttcagggcagcagtgctgctcctgctgaggaatctgcaacggcggcaatggggatggcgatg

SEQ ID NO: 8094 - DNA, 740 bp, Zea mays
  Predicted polypeptide sequence is orthologous to G43, G46, G1419
aaaaaaatattctatcgcctcctttttcttatcgttctggacacacacatgcagctccaaaagctacgtcaaatcctctaaacgagttcaaagccaggtccgtccgtccataactagaaaccgctaacaattattaacgtctttacacctattgatgcttactgaccgatgtccccttagttaacggtgacctccgggaagccgagctgcgggtgtggcgagagcggcgacaggatcccgaacacgccctccagctgctcccacgtccagctcgacggggtcacgggaaacatctcggggccggctccagcgtccgaagaaggaaagcacgtcgtcaccgtcgaggccggggtggtcgttgtcgcgggaaacagcgacgacgccggcgacccggacgcctcggccttgacggacttggctggctcggctccggctccggccccggccggggccgtggcctcggcgtcgtgcatcagcttccgtttgttctgggacgttgccgcggcttgcggcggcggcggcggcggcgcgaggaaatccgcgccgcgggtgcctacctcgttagggaagttgaggatggccttggcgccgcgcatgcggaacgcggcgcggtcgtaggcgcgcgcggcctcgatggcggtgtcgtaggtgccgagccacacgcgggagccccgcttcttggggtcgcggatctccgccgcgaacttgccccacggccgctgccgcacgccgcggtactt

SEQ ID NO: 8095 - DNA, 902 bp, Zea mays
  misc_feature (871)..(871): n is a, c, g, or t
  Predicted polypeptide sequence is orthologous to G44
actggacgcctgcggtaccggtccggaatcttcaaaaagggggcgtccggcccctgtcccaaagaatcgttgtttcgacaatgtgcggcggagccatcatcgccgacttcttccccgccggcgcccggcgcccggcaacagacgacaccatgtccgcctccatcctctccggtagcgaggaccatccggagctgccgctgccgctgccggcgccggcgccggggcgctagacggcggaccgccggatccggcgccgcccgtggggccggcgggcagcggagattcgcgacccgcggaataggcgcccgcgtgtggctctggacctacgccaccctggaggatgcagcacgcgcctacaacatggcggcacacgaaatacactgcctaacagccatgatccacttacccatggtgagccctgccgcctacttgcgagagcagctgcttgcatccgacccacttgcgtctcgcaaacgtacttgcgacgcagaaaatcaaccccacatccttctctgccgacgcttcagcaactaagcatggagaaccctgcgccctactgtatacaagcgacactgctttcatctagcccgctcgctgcggccaatgcgcctacgtacatggcacaacaattgttgcaacatattgtaacggcatctcgactcgacttagctgtggaaaaccctgctgcccactatgaacaccttgtttcatctgagcaagtgactccgttctgattttgctgcgtgcctaacacgctgaccacgttacgtgatcccatggggatggatacccataggttgccgtcttcctattaacacaacattcgttccgaacaacaaggtcccttagagaagaccgacatgactagggncacacccccgctggaggtgccaccttttaat

SEQ ID NO: 8096 - DNA, 1351 bp, Zea mays
  Predicted polypeptide sequence is orthologous to G129, G136, G140, G146
cccagagctaccacccctcttatccccacccctcctcctcctaccttttctccttcagacctcaaaatctgtgtgataggaacaagagcatgcacatccgagaagaggaggctacaccatccacagtaacaggcatcatgtcgaccctgacttcggcggggcagcagaagctgaaggagcccatatcccctggtggcggctccgcgtcggtcgctgggtccgctgcggagaggaacaacggcggcaggggcaagggcaagactgagatcaagcgcatcgagaacacgaccaacaggcaggtcaccttctgcaagcgccgcaacggcctcctcaagaaggcgtacgagctctccgtgctctgcgacgccgaggtcgcgctcatcgtcttctccagccgcggccgcctctacgagtacgccaacaacagcgtgaagggcaccattgagaggtacaagaaggcaaccagtgacaactccagcgcagctggtacgattgcagaggtcaccattcagcattacaagcaggaatctgctaggctgaggcagcagatcgttaacttgcagaactccaacagggccctgataggtgattctatcacaaccatgagccacaaggaacttaagcacttggagactaggttagacaaagctctcggaaagattagagcaaaaaagaacgatgtgctgtgttctgaagtcgagtacatgcagagaagggaaatggagttgcagaatgacaacttgtacttaaggagccgggttgatgagaatgaaagggcacaacagacagcgaacatgatgggggcaccatcgacaagtgagtatcagcagcacggttttactccttatgatccaataaggagcttcctgcagttcaacatcgtgcagcagcctcagttctattctcagcaggaggaccggaaagacttcaacgaccaaggtggaagataaatattggacctctcaagcttcagtacttatccgtgatgatgcatgacgtactgccagtgagaaactgagctacattactgtggaattatatgtaaagactagtactactgcttcatatgtgcatggcacacgcgcacgtagtatgcacaatttcatcccactattatggcttggcaccaactatgtctccttaattatcataggagaaaaataagtcacgcacaaaaaaattctaaagatgaggcgcagtgttggatgactgaaactgaaagataggattctcgtggatggcggtggtcatatacggcctgttttggttgatgtacccgagcgcacccgcggaatcttaaagcaagttgtgtttaattgactgcactttatatacgggttgaacagatgta

SEQ ID NO: 8097 - DNA, 1083 bp, Zea mays
  Predicted polypeptide sequence is orthologous to G129, G136, G140, G146
cttgcttgcttattgcaagtctctgcaagaacctgctagagaggaacaagctggtatcgtcgccagcatgggtagaggaaggattgagatcaagaggatcgagaacaacacgagccggcaggtcaccttctgcaagcgccgcaatgggctcctcaagaaggcgtacgagctctccgtcctctgcgacgctgaggtggccctcatcgtcttctctagccgtggtcgcctctacgagtatgccaacaacagtgtcaaggctactgttgagaggtacaagaaggcacacaccgttggctcttcctctgggcccccgctcctagagcacaatgcccagcaattctaccagcaagaatcagcaaaactgcgcaaccagatccagatgctgcaaaacactaacaggcacttggttggtgactccgtgggaaacctgtcactcaaggagctgaagcagctggagagccgccttgagaaaggcatctctaagatcagggccaggaagagtgagctgctggctgcggagatcagttacatggccaaaagggagactgagcttcagaatgaccacatgaccctcaggaccaagattgaggagggagagcaacagctgcagcaggtgaccgtggcacggtcagttgcagcagcagcagctgccaccaacttggagctgaacccattcttggagatggataccaaatgcttcttcactggcggccccttcgcgacgctggacatgaagtgctttctccccggcagcttgcagcagatgctggaggcacagcagcgccagatgctcgccaccgagctgaacctcggctaccaactggcgccgcctggttctgacgctgccaacaataaccctcatcatcagttctaaactggatgcatgtacgagaagcttttcaagcgaactgtgaacggtggaagctggctgttgcctctagatgttcttggcttccatgacctagcttattacggtgtgtattgttgttgccttttgtgtgtgattctccttgtgctactctacctgatggagaactaaacctaatcgattggacataatgatcaaatgctacagatcctgtg

SEQ ID NO: 8098 - DNA, 1166 bp, Zea mays
  Predicted polypeptide sequence is orthologous to G129, G136, G140, G146
gcacgagctcttccctgcagatcgagaggcactgcacaccaccaccaccaccaccaccaccaccacaccatgctcaacatgatgactgatctgagctgcgggccgtcgtccaaggtcaaggagcaggtggcggcggcgccgacgggctccggcgacaggcaggggcaggggagaggcaagatcgagatcaagcgcatcgagaacacgacgaaccggcaggtgaccttctgcaagcgccgcaacggcctgctcaagaaggcgtacgagctctcggtgctctgcgacgccgaggtcgcgctcgtcgtcttctccagccgcggccgcctctacgagtacgccaacaacagtgtgaagtccaccattgagaggtacaagaaggccaacagtgactcctccaactctggcacagttgcagaagtcaatgcccagtactaccagcaggagtcctccaagctgcgacagatgatccacagcttgcaaaacgcaaacactaggaacatagtgggagattccatccacaccatgggcctcagggatcttaaacaaatggagggcaagctggagaaagccataatcaagattagagctagaaagaatgagctgctatacgctgaagttgactatatgcaaaaaagggagatggatctgcagactgacaacatgtacctgaggagcaagatcgctgagagtaatgaaacggggcagccggcgatgcacatgacgatgggagcgccgccgacgagcgagtacgaccacatggcccctttcgactcgagaaactttctgcaagtgagcatgcctcagcactactcccatcagctgcaacctacaaccctccagctcggatgatgaaatcagcgctatacctggcggcgcccggcccccaatcgagatagatcacgcatgcagttatatcatgtgccaaatcgagatctcaagtaactctacgtacgtttgcttaattattaataattgtgattagtgcaactgttagggtatatatatttgtgagtgccaccactgtgtgcgtgcatttgtacgtgtgaatttagctgttgcatctactactattgtaccctccggccaggccatatcatcagaaacgcgggtttatttacgcatacttatatatatatatgatttgtgtgctttatatagattgaaaa

SEQ ID NO: 8099 - DNA, 965 bp, Zea mays
  Predicted polypeptide sequence is orthologous to G129, G136, G140, G146
caggaatgggctgctgaagaaggcctacgagctctccatcctctgcgacgctgagatcgctttgatcgtcttctctacccgaggccgcctatatgaatattccagtaacagcgtaaggtcgacgatcgagaggtacaagaaagcctctgccagcacttctggaacagctccagtgacagatgtcaactctcttcaatactttcagcaagaagcggcaaaactgcgccagcagatacaaaccttgcagaattcaaacaggcacctgatgggtgaatctactggcaatatgactgcaaaggagctaaagggccttgaaagcaggcttgaaagaggcattgggaggatccggtccaaaaagcatgagctgctgctcgcggagatcgaatatatgcagaagagggaagcagatctgcacaatgaaaacatgttcctgcgggccaaggttgcggaggctgagcgagctctggagcaggaggcggcagaagaccagacgatgatggtgccggcggcggtccgcggggctacgacggagctgaaagcgttgccggcgtcgttcgacgcgagtggctactaccagtaccagcagcatcagcatgtggtggccgccgcctccgctgcctcctcgtcgcagtacgcggagcagccccagggtcagcaggagtaccaccaccagactgccctccacctcggctaccacgttaagatcgattccgccgccgacaaaggcttcctctaggcgctcgcgcgcatgcatgcgtgaagcgtctcatctcataatctgacgtacggacgatgggtgccggacagctaaggtaaggcacattgtcatcgcctgaccatggagtggagtggttgttgctatatgtgcttctatatagagagaaaataaggggtagatccgcgagtacctatgtacgcaagctgtatcaaacaatattgtcatgagatatatagattgactatat

SEQ ID NO: 8100 - DNA, 1231 bp, Zea mays
  Predicted polypeptide sequence is orthologous to G129, G136, G140, G146
ctcacatcctctttcagttccctctctggatctcttcctgaagagaggcactactgccacaccaccacgccacccatgctcaacatgatgaccgatctgagctgcgggccgtcgtccaaggcggcgaaaggagggcagccggcagcgacgacgggctccggcggcgacaggcaggggaggggcaagatcgagatcaagcgcatcgagaacacgacgaaccggcaggtcaccttctgcaagcgccgcaacggcctgctcaagaaggcgtacgagctctcggtgctctgcgacgccgaggtcgcgctcgtcgtcttctccagccgcggccgcctctacgagtacgccaacaacagtgtgaagtccaccattgagaggtacaagaaggccaacagtgacacctccaactctggcacagttgcagaagtcaatgctcagcactaccagcaggagtcctccaagctgcgccaggcgatcgatagcttgcaaaacgcaaacaggaccatagtgggagattcaatccacaccatgggcctcagggagcttaagcagatggagggcaagctggagaaggccataaacaagattagagctagaaagaatgagctcttgtatgctgaagttgaatatatgcaaaaaagggagatggatctgcagactgacaacatgtacctgaggagcaagatcgccgagaataatgaaacggggcagccaccgatgaacatgattggattgccgtcgacgagcgagtacgatcacatggccccgtttgttgactcgagaaactttcttcaggtgaacatgcagcagcagcctcagcactactcccatctatcagctgcaaccaacgaccctccaactcggatgatgaaattaagaatcttcggccaacaatccatgcacgcaagcacgcagtaaatcatgtgtccaattcagataaaaaaatctactctagcgtttgtataattattaataatcgtgactagtaaactgttatatatatagccatgtgtgtgtggcgcctacatatatgtcatgtggctgtacggcgagtttttctttttcacaagcgtttgcagcagcatttggtgttgctcatcgatcaattaatcgcaagaaattaaacttgtcaccactgtgtgtgcattatttgtacgtgttaatgcagttgttgtatctgttaattgtaccctccatcagataaacgcgggtgcgcgtatgcatatttatgtgt

SEQ ID NO: 8101 - DNA, 1117 bp, Zea mays
  Predicted polypeptide sequence is orthologous to G129, G136, G140, G146
gcactagggcagcttcagcctggccggccggcctgctattaaaccactttgcttgcaagtccaagaaactgctagagaggaacaagctgagatctccagcatggggaggggaaggattgagatcaagaggatcgagaacaacacgagccggcaggtcaccttctgcaagcgccggaatgggctcctcaagaaggcgtacgagctctccgtcctctgcgacgccgaggtggcgctcgtcgtcttctccagccgcggacgcctctacgagtacgccaacaacagtgtgaaggctacgatcgagaggtacaagaaggcacacgccgttggctcttcctctggccccccactcttagagcacaatgcccagcaattctaccagcaagaatccgtaaaactgcgcaaccagatccagatgctgcaaaacactaacaggcacttggttggtgactctgtgggaaacttgtcactcaaagagctgaagcagctggagagccgccttgagaaaggcatctctaagatcagggccaggaagagtgagctgctggctgcccagatcaattacatgggcaaaagggagactgagcttcagaatgaccacatgaacctcaggaccaagatcgatgagggagagcaacagctgcagcaggtgactgtggcccagtctgtcgcagcagcagctgccaccgacgtggagctgaatccgttcttggagatggataccaaatgcttcttccctggcggccccttcgcgacactggacatgaagtgcttcttccccggcagcttgcagatgctggaggcacagcagcgccagatgcttgccaccgagctgaacctcggctaccaactggcgccgcctgacactgacgttgccaacaataaccctcagcagttctacccctggatcaatgagaaagccaactgtgaccgatggaagctggctgttgcctctagatgatattggcttccataacctagcttattatggtgtgtattgttgccttttgtgtgtgattctccttgctactgatggagaataaacctaatcgattgggcataatgatcaaatgctacagcacccgtgaggctgtgatcaggaaaaaaaaaaaaaaaaaaa

SEQ ID NO: 8102 - DNA, 1250 bp, Zea mays
  Predicted polypeptide sequence is orthologous to G131, G135, G155
gaacctcgccggcggccgcagccgcatagaccggaagagaaaggaagcagagatcggaggcaggcgaagatggggcgcggcaaggtgcagctgaagcggatagagaacaagataaaccggcaggtgaccttctccaagcgccggaacgggctgctgaagaaggcgcacgagatctccgtcctctgcgacgccgaggtcgccgtcatcgtcttctcccccaagggcaagctctacgagtacgcctccgactcccgcatggacaaaattctagaacgttatgagcgatattcctatgctgaaaaggctcttatttcagctgaatctgaaagtgagggaaattggtgccacgaatacaggaaactgaaggccaaaattgagaccatacaaagatgccacaagcacctgatgggagaggatctagagtctttgaatccaaaagagctccaacaactagagcagcagctggagagctcactgaagcacatcagatcaagaaagagccaccttatggccgagtcaatttctgagctacagaagaaggagaggtcactgcaggaggagaacaagattctacagaaggaactttcagagaggcagaaggcggtcgctagccggcagcagcagcagcagcaggtgcagtgggaccagcagacacaggtccaggtccagacaagctcatcgtcttcttccttcatgatgaggcaggatcagcagggactgccacctccacaaaacatctgcttcccgccgttgagcatcggagagagaggcgaagaggtggctgcggcggcgcagcagcagctgcctcctccggggcaggcgcaaccacagctccgcatcgcaggtctgccgccatggatgctgagccacctcaatgcataaggagggcgagcaaatggcgtgcgaagtgattgattgctcaccgttgattgaacgctagcctaagttcatggcggcagcaaactaagctaaaactattgttatgtttgcaaggaagggtaacccgctgtgtaatctttgtccagctagcatgtaccaactgagatgcatgcatgcttattattgtccaattacccgtgaatctagcggtgcttttggtgagaggccggccggacgggtgcagtttacttcaaatatggtttgtgattttgtgtaaatagtattaactaggagtcctatggtaagtaaattaattaatgggaggatgcatgaataaaacctctcttgtgctgcaaaaaaaaaaaaaaaaa

SEQ ID NO: 8103 - DNA, 1488 bp, Zea mays
  misc_feature (7)..(52): n is a, c, g, or t
  misc_feature (104)..(126): n is a, c, g, or t
  misc_feature (294)..(298): n is a, c, g, or t
  misc_feature (465)..(469): n is a, c, g, or t
  misc_feature (519)..(567): n is a, c, g, or t
  misc_feature (606)..(733): n is a, c, g, or t
  misc_feature (858)..(865): n is a, c, g, or t
  misc_feature (994)..(1014): n is a, c, g, or t
  misc_feature (1060)..(1064): n is a, c, g, or t
  misc_feature (1351)..(1385): n is a, c, g, or t
  misc_feature (1387)..(1409): n is a, c, g, or t
  misc_feature (1428)..(1463): n is a, c, g, or t
  misc_feature (1487)..(1487): n is a, c, g, or t
  Predicted polypeptide sequence is orthologous to G131, G135, G155
gcacgannnnnnnnnnnnnnnnnnnnnnnnnnnnnnnnnnnnnnnnnnnnnngctacctgcctacccggcggttgcgcgccgcaatcgatcgaccggaagagannnnnnnnnnnnnnnnnnnnnnnatcggagcacggcaacaaggcgatggggcgcggcaaggtacagctgaagcggatagagaacaagataaaccggcaggtgaccttctccaagcgccggaacggcctgctcaagaaggcgcacgagatctccgtcctctgcgatgccgaggtcgccgtcatcgtcttctnnnnnaagggcaagctctacgagtacgccaccgactcccgcatggacaaaattcttgaacgctatgagcgatattcctatgctgaaaaggctcttatttcagctgaatctgaaagtgagggaaattggtgccacgaatacaggaaactgaaggccaaaattgagaccatacnnnnntgccacaagcacctgatgggagaggatctagagtctttgaatcccaaagnnnnnnnnnnnnnnnnnnnnnnnnnnnnnnnnnnnnnnnnnnnnnnnnnatcaaggaagagccaccttatggccgagtctatttctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacatgcccaggcccagacaagctcatcatcgtcctccttcatgatgaggcaggatcagcagggactgccgcctccacacaacatctgcttcccgccgttgacaatgggagatagaggtgaagnnnnnnnntaaaactgctcgcgcgcgggcacgcagccactgccggggcaggcgcaaccgcagctccgcatcgcaggtctgccaccatggatgctgagccacctcaatgcataaggagagggtcgatgaacacatcgnnnnnnnnnnnnnnnnnnnnngcatgtggatcatgacgtacgcgtaccatatggttgctgtgcctgnnnnnatcgatcgcgagcaatggcacgctcatgcaagtgatcattgctccccgttggttaaaccctagcctatgttcatggcgtcagcaactaagctaaactattgttatgtttgcaagaaagggtaaacccgctagctgtgtaatcttgtccagctatcatgtatgcttgttactgcccagttacccttgaatctagcggcgcttttggtgagagggtgcagtttactttaaacatggttcgtgacttgctgtaaatagtagtattaatcgatttgggcatctagtaactnnnnnnnnnnnnnnnnnnnnnnnnnnnnnnnnnnntnnnnnnnnnnnnnnnnnnnnnnnagctggatccataaaatannnnnnnnnnnnnnnnnnnnnnnnnnnnnnnnnnnncttctagacagaccgcgggccctng

SEQ ID NO: 8104 - DNA, 991 bp, Zea mays
  misc_feature (186)..(209): n is a, c, g, or t
  misc_feature (375)..(393): n is a, c, g, or t
  misc_feature (723)..(759): n is a, c, g, or t
  misc_feature (947)..(951): n is a, c, g, or t
  Predicted polypeptide sequence is orthologous to G131, G135, G155
aacgaaatttgaactattttagacaatctatcctaacgtgcatggattgcgatggatacatgagcacgtaaacaagagccggataaggctaataatacattagatccctcagctcattaacatcaagctgagccttgtttgatccaggacaactttggtcaacaaccattttaaaccataaccaannnnnnnnnnnnnnnnnnnnnnnntgacagagtgatagggtacaatgaagcagcgcatagtcttcgatccatcctccagcttccaagccagtcagcgtcagttgaatcccagtttgagttccaggccgccgccgcttggtggggtcgaccctccaccttccccgccgttgttccaggcctgagaatgagnnnnnnnnnnnnnnnnnnncaagaagttcttgtcgcacaacccgtagcgctcctcgtggcgtcctctgataatgttctggaggcagtcgatctcgccgccgatcttgcggtccttctcggagcgcaccctgtgcacggccgcctccaggctgtgctccagctgctccagcgacggcaccgtgtactgctccccgtcgtccaccgtcatgaaccgcagctccttctccatgagctcgcacatccgctccgccttctccagctccgcgcgccgctcctggcgaacgtcggcccagaccttgctgtgcgtcgcggcctcgtacctctcgaccaggtccttgacagtgggcannnnnnnnnnnnnnnnnnnnnnnnnnnnnnnnnnnnnggagaagagcagcagcagcaggtcgacgtcgcacaggacggcgagctcccttgccttcttgaagagcccgtccctgcgcttgtagaaggtggactgccgctgcgtcgggttctcgatccgctttatctcgctgcggcccctccccatgtcgtcgtcccggactcgcaaacgcgcggcgctgcagcagnnnnngccgagctgctctttgcccgtcgttgctgctttaaattgg

SEQ ID NO: 8105 - DNA, 1282 bp, Zea mays
  Predicted polypeptide sequence is orthologous to G131, G135, G155
gcacgagctcgagtcgagactcgagaggcacctgatctttccttcccgtcttcctcccacacgtccccatcaccattgctgcgacgagagtgagcgggagagggtaggtggcgaggcggcggagatggggcgggggccggtgcagctgcgccggatcgagaacaagatcaaccgccaggtgaccttctccaagcgccggaacgggctgctgaagaaggcccacgagatctccgtgctctgcgacgcagaggtcgcgctcatcgtcttctccactaaggggaagctctacgagtactctagccattccagcatggaaggcattcttgagcgttaccagcgttactcatttgaagaaagggcagtacttaacccaagtattgaagaccaggcaaattggggagatgaatatgtccggttaaaatccaaacttgatgcacttcagaagagtcaaaggcagctgttaggagaacaattgagttcactgaccataaaagaactccagcaactggagcaacaactggacagttctttgaagcatattaggtcaagaaagaatcagctcatgttcgattcaatttccgcgcttcagaaaaaggagaaagcacttacagatcaaaacggtgtcctgcaaaagttcatggaggcagagaaggagaaaaacaaggctttgatgaacgcgcagctccgggagcagcaaaatggagcatcaacaagctccccatcactttcaccaccaatagttccagattccatgccaactctaaatatagggccatgtcaacatagaggggcagcagaatctgagtctgaaccgtctcctgctcctgcacaagcaaacaggggcaacctgccaccatggatgctccgcactgtcaagtaacaggtgaggtcttcccagtgtagttttgcagctgatctcgacagcaacacacctgtcaccgaaatgcttcggtgaccctagatatcaaccgatgcacgatccatctcgatcctgtgatcgaataccggcgtaggtactaccaataaagtcaggccccgtcaaatgctttacatggtgattgaagtctggagcttctcagcaccaccatatattgtgttcagttcctgtgtttattgccatagctaccctttttttctctgatctacgagctagacgtagctttgtgcttggagattccactactatgtttcctctgtcctgtgtatgctttaacggagatgcacgttgtacccgtggtaatatatataaatttgcgttgtaaaaaaaaaaaaaaaaaaaaaa

SEQ ID NO: 8106 - DNA, 1280 bp, Zea mays
  Predicted polypeptide sequence is orthologous to G131, G135, G155
gctttaaatccgcctcctcccagcgtctccctcctcccggcctgtcccctcacctccctccccctatctctccaccgccgcagctagctgcgacgtcatgcactcgccggcgccaccgccaccgcatactatctacaattagccagccgtaggcttacctatcctgtgtcaagcaagcctctcgcaagcaacaaggaaggaagctagctagttttatagctgctgtcggcggcggcggctgaagcgacgtgcctgagctaggatttaggttgagatcaggagagggagaaggcggcggcgatggggcgcgggaaggtgcagctgaagcggatcgagaacaagatcaaccgccaggtgacattctccaagcgccgctcggggctactcaagaaggcgcacgagatctccgtgctctgcgacgccgaggtcgcgctcatcatcttctccaccaagggcaagctctacgagtactctaccgattcatgtatggacaaaattcttgaacggtatgagcgctactcctatgcagaaaaggttctcatttccgcagaatatgaaactcagggcaattggtgccatgaatatagaaaactaaaggcgaaggtcgagacaatacagaaatgtcaaaagcacctcatgggagaggatcttgaaactttgaatctcaaagagcttcagcaactagagcagcagctggagagttcactgaaacatatcagaacaaggaagagccagcttatggtcgagtcaatttcagcgctccaacggaaggagaagtcactgcaggaggagaacaaggttctgcagaaggagctcgcggagaagcagaaagaccagcggcagcaagtgcaacgggaccaaactcaacagcagaccagttcgtcttccacgtccttcatgttaagggaagctgccccaacaacaaatgtcagcatcttccctgtggcagcaggcgggagggtggtggaaggggcagcagcgcagccgcaggctcgcgttggactgccaccatggatgcttagccatctgagctgctgaaggtttgccctcaccgtcgcgatgtgatagcccaaaatccagcaagtcttccccggaccccggactgtccccgcttctccgcctggtgcagtatcgtcgtgatcgcgagaagcagcagcagcggtttgccgtattttttaccactgtgtataagtagcatatctgcaatgtgtatattttgttcaccgttcctgctggggcggccgcacggtactttacgcatgtaatatatgtgcttcatc

SEQ ID NO: 8107 - DNA, 1216 bp, Zea mays
  Predicted polypeptide sequence is orthologous to G131, G135, G155
ggcacgtttgagtcctctctctccgccgccgcagctagctgtgacgttatgctctcgccggcgccatagcgccagcgcctaccgtctacaactatccagccttaggcttacctatcccgtcaatcaagcctctcgtaaggaacaaggaaggtagctagctagttctatagctgctgtcgtcgtcgtcatcggcggcggcggcgcctgttcttagaggataaggttgtcctagcggagagggagctagccaggatttcggttgagatcaagagggggagcaggcggcggcggcggcgatggggcgcgggaaggtgcagctgaagcggatcgagaacaagatcaaccgccaggtgaccttctccaagcgccgctcggggctgctcaagaaggcgcacgagatctccgtgctctgcgacgccgaggtcgcgctcatcatcttctccaccaaagggaagctctacgagtattccaccgattcatgtatggacaaaattcttgaccggtacgagcgctactcctatgcagaaaaggttcttatttcagcagaatctgaaactcagggcaattggtgccacgagtatagaaaactaaaggcgaaggtcgagacaatacaaaaatgtcaaaagcacctcatgggagaggatcttgaaacgttgaatctcaaagagcttcagcaactagagcagcagctggagagttcactgaaacatatcagaaccaggaagaaccaacttatgctcgagtcaatttcggagctccaacggaaggagaagtcgctgcaggaggagaacaaggttctgcagaaggagctcgcggagaagcagaaagcccagcggaagcaagtgcaatggggccaaacccaacagcagaccagttcgtcttcctcgtgcttcgtgataagggaagctgccccaacaacaaatatcagcatttttcctgtggcagcaggcgggaggttggtggaaggtgcagcagcgcagccacaggctcgcgttggactaccaccatggatgcttagccacctgagcagctgaaggtttcagcaactcttcccgtttatccgcctggtgcagtatagtatcatcgtgatcgcgagagcagcagcagtgggtttgccgtatctttttttaccaatgtatgtctatatatgtaagtatcaaatctgcaatgtgttaatcaccatttccgctggggcggccgcacgagtactttacgc

SEQ ID NO: 8108 - DNA, 766 bp, Zea mays
  Predicted polypeptide sequence is orthologous to G131, G135, G155
ccctgcgtgtgcgtgctgcgtgctgctactatatataaattgcaagcaagctaggcaggcaggctagcccagcgctcggccctcggctccttaaggcttcatcttctcaagttccggccgtccatcgccgccgccggcctcggccggctcagttcctgcctgccagccaaaaattccacaccacccacccagagactgaggcgcgcggtggtgaagacgtgatcgaaagtcgaaaccaaaacgatatatagatggggcgcgggcgcggcaaggtggaggtgcgtcgcatcgagaacagcgtgagccggcaggtgaccttctcgaagcggcggcgcgggctggcgaagaaggcgcgggagctggccgtgctctgcgacgccgacgtcgcgctgctcgtcttctccgacaagggcaggctccacgacttcgccgcgcacggcagcatggagcgaatccttggccgatacgagaggtacttgctatgtgaagatagggacgatgtaacccaagactaccctgaagaatcgcaggggaacatgagctatgaccacatcaagttgaggtccaaactcgaagctataaagaagagccaaaggaatctcatgggggagcagctcgagtccctgacgttcagagaggtacagcagcttgagcaccggatagacagcgctctgaggaacgtcagatccaggaaggaaacttttctgatggaacaaaatggcattctagagaaggagaaggctgcagtgggggcatcatcatccct

SEQ ID NO: 8109 - DNA, 1273 bp, Zea mays
  Predicted polypeptide sequence is orthologous to G133
gcacgaggttgtgctgctcgctcagacagctctgctagctgcatcctcctaactctccaggtctctctctcctctcccaactcccaagtcccatccggatcgagacgctggaggcggagcgcccccccgggacggcggcggcgacgatggggcgcggcaagatcgagatcaagcggatcgagaacgccaccaaccgccaggtgacctactccaagcgccggacggggatcatgaagaaggcgcgcgagctcaccgtgctctgcgacgcccaggtcgccatcatcatgttctcctccaccggcaagtaccacgagttctgcagccccggaaccgacatcaagaccatctttgaccggtaccagcaggccatcgggaccagcctatggatcgagcagtatgagaatatgcagcgcacgctgagccatctcaaggacatcaatcgtggtctgcgcacagagattaggcaaaggatgggcgaggatctggacagtctggacttcgacgagctgcgcggcctcgagcaaaacgtcgacgcggctctcaaggaggttcgccataggaagtaccatgtgatcagcacgcagactgatacctacaagaaaaaggtgaagcactcgcacgaggcgtacaagaacctgcagcaggagctaggcatgcgggaggacccggcgttcgggtacgtggacaacacgggcgccggcgtcgcctgggacggcgcggcggcggcgctgggcggcgccccgccggacatgtacgccttccgcgtggtgcccagccagcccaacctgcacggcatggcctacggcttccacgacctccgcctgggctagcgcatccatcaccatgctgggtggtgctgctcgatcctactgcatggcaatgcaagctggttggttagttcgctcatgcatcgtccgtcaacaaagcaagtaagcaatgcaatgcaaccgaggtactgtaatagccaataaaatctactgcatactgcaaacccaattactggtagcttagctaccgcgtgtgtacgaatcaaccgattaattaccgcgcccttagcttgcatgtcgtcgtcgtctgtgcttttggcgttcgtagacatgtgtgtattgtatgcatgggtcctgttcatctgcatccatgcatgttgtttatgattgtaattgttgtgtgaaatggctgtactttgttatgatcacgtgaaattatatctacattcgtgggaaaaaaaaaaaaaaaaaaaaaaaaaaaaaaaaaaaaaaaaaaaaaaaaaaaa

SEQ ID NO: 8110 - DNA, 1069 bp, Zea mays
  misc_feature (11)..(37): n is a, c, g, or t
  misc_feature (56)..(80): n is a, c, g, or t
  misc_feature (93)..(121): n is a, c, g, or t
  misc_feature (236)..(273): n is a, c, g, or t
  misc_feature (314)..(318): n is a, c, g, or t
  misc_feature (438)..(466): n is a, c, g, or t
  misc_feature (804)..(811): n is a, c, g, or t
  Predicted polypeptide sequence is orthologous to G134
ccacgcgtccnnnnnnnnnnnnnnnnnnnnnnnnnnngcggctccaggctcctgcnnnnnnnnnnnnnnnnnnnnnnnnnttccttgggaagnnnnnnnnnnnnnnnnnnnnnnnnnnnnnggggcgcggcaagatcgagatcaagcggatcgagaactccaccaaccgccaggtgaccttctccaagcgccgcaacgggatcctcaagaaggcgcgggagatcagcgtgctctgnnnnnnnnnnnnnnnnnnnnnnnnnnnnnnnnnnnnnngcaagctttacgactactgctccccgaagacatcgctatcnnnnntcctggacaggtaccagaccaactctggaaagatactgtggggtgagaagcacaagagccttagtgcagagattgaccgtataaagaaagagaacgacaccatgcagatcgagctcaggnnnnnnnnnnnnnnnnnnnnnnnnnnnnngcaacccaaagacctgatcatgatcgaggaggcacttgataatggactgacgaacctgaatgagaaactgatggagcactgggaaaggcgtgtgacaaacactaagatgatggaagacgagaacaaattgctggccttcaaactccaccagcaagatatcgcgctgagcggcagcatgagagagcttgagctgggttaccatcctgaccgggacctggcggcccagatgccaatcaccttccgcgtgcagcccagccatcccaacttgcaggagaacaattagactgctggatgccctcgttccacttgccgaggatttcacccagccaccaccgctnnnnnnnnggcttgtatgtcctcgtgcgctgccaactgtatctttatctttccggtatgtttggatgaacgtataatgtgtgtcagtgtcggtcgcatgacgtgccgatgtcgtgcatctctctctctctctgccagagcagcggaactctgcaccgtgagtaacttaattggtaccgtatgatctgccggacagtgaatagtttatgtgagtgggtcaaaccataatgtgtagtatttgtgtcgaactgtcaatggcacgtattt

SEQ ID NO: 8111 - DNA, 623 bp, Zea mays
  Predicted polypeptide sequence is orthologous to G135
tttttttttaagtgtaattgtaacatcgtcattccaaaatgctaaacaccttcaaaataaccagagcaagttttggtttccagctattgtaatcgtaacacctcttattcttctgtcactgccatgcgactcgatcttcgtcgttgtcatatatattcctacagttttgcaaagctaatgctcccgacagccagtataatcagaaattacaactgggtaaataaagtgagcaacctatcaagtaatgtaaagaatcggaacatagagctgttggcctagaagcctgaaaacggtacgaggccaatttggagcaatcatgcggaacaagcttcacgacaggtagggaggccgcccgatcgtactgcaatcatgttagttaggtaaacaaaacatctactggcttccagcaaaacagaacacaacattgtcatcatactcaacagagagatttgaaacgctagactccagctctgcctcagttaacgcatgattggttgtaggggcgtctcgcaccagcatcgtgccagcctgggccgctggaaacgagggggagacggggagttgagtttccgcgcatgcaggctacccagtgggggaaaaaaatcaacgctgcatgcatggga

SEQ ID NO: 8112 - DNA, 1036 bp, Zea mays
  Predicted polypeptide sequence is orthologous to G137, G145
gcctgcgctcgcctcagctcytttctyccccgccccttggcttttgcttggttgcatcgggccggtcgagccggagaggaaaagctagctagcagctaccagctctcgsccggcggtggtagtctscctgcagctggggttagctgcaagggttgggagctagccatggggaggggtcgggtggagctgaagcggatcgagaacaagatcaaccgccaggtcaccttcgccaagcgccgcaacggcctgctcaagaaggcgtacgagctctccgtgctctgcgacgccgaagtcgcgctcatcatcttctccaaccgcggcaagctctacgagttctgcagcggacagagcattaccaaaacacttgagaggtatgaaaaaaacagttatggaggaccagatactgctgtacagaacaaggagaacgagttagtccagagcagtcgtaatgagtacctcaagctgaaagcgagggtggataatttacagaggactcagaggaatttgcttggtgaagatctggggtcacttggtgtcaaagagcttgagcagcttgagaagcaacttgattcatccttaaggcacataagatccacaaggacacaacatatgcttgatcagctcactgatcttcagaggagggagcaaatgctgtgtgaagcaaataagtgccttagaagaaagctggaggagaccagcaaccaggtgcatggccaagtgtgggagcacggtgccaacttactcggctacgagaggcactctcctcaacagcaggccccatcacatgttggcaatggtttgttctttcatcccctggaagctgcagcagagccaaccctgcagatcgggttcgctcctgagcatatgaataacttcatgccaacatggctaccctgaagatggatcttgaggcaaaggaaataaataaagatgcggtggcagcatcatactctatgcaagctaagagtgacagctgtgtttcagtcacatatatgatctagtctgtgtgtcaatgtgtcgaaaaacatgtctgtga

SEQ ID NO: 8113 - DNA, 867 bp, Zea mays
  Predicted polypeptide sequence is orthologous to G137, G145
aagatcagccggcaggtgacgttcgccaagcgccggaacgggctgctcaagaaggcgtacgagctgtcggtgctctgcgacgccgaggtcgcccttatcatcttctccagccgcggccgcctcttcgagttctccacctcctcatgcatctacaagacgctggagcgataccgcagctgcagctttgcatccgaagcatcagctccactagaggctgaattaaataattatcaggagtacttgaagttaaagacaagagttgagttcttacaaacaactcagagaaatctacttggtgaggacttgggtccacttagcgtgaaggagttagagcaacttgagaaccaaattgagatatctctcaagcaaatccgatcatcaaagaaccagcagatgctcgaccagctctttgatctcaagcgcaaggaacaacaactgcaagatgctaacaaagatttaagaatgaagatagaagaaactagtgaagaaaatgtgctgcgactgtctagccaggatattgggtgtagtggatctagtgggcatggtgatgaagccaaccaagaacaccttcaacttgctcttgatccttcgctgcatatagggtatcaagcttacatggaccacctgaacaatgattaagttgcttctttgtgcgctgtgtgctctagtggccatggatcttctatatatgttggacgtaatgcttttgataaatcctctatatataaccatatcggtcctagctttatgcatgctactgtatgtactaaactaagaagccctacgacttctgttgaggaagaatgttctgacgatcatgactttttcttgctaaataataactactgtatctcattttgaattaaa

SEQ ID NO: 8114 - DNA, 921 bp, Zea mays
  Predicted polypeptide sequence is orthologous to G137, G145
aagatcaaccgccaggtcaccttcgccaagcgccgcaacggcctgctcaagaaggcgtacgagctctccgtgctctgcgacgccgaagtcgcgctcatcatcttctccaaccgcggcaagctctacgagttctgcagcggacagagcattaccaaaacacttgagaggtatgaaaaaaacagttatggaggaccagatactgctgtacagaacaaggagaacgagttagtccagagcagtcgtaatgagtacctcaagctgaaagcgagggtggataatttacagaggactcagaggaatttgcttggtgaagatctgggttcacttggtgtcaaagagcttgatcagcttgagaagcaaattgattcatccttaagtcacataagatccacaaggacacagcatatgcttgatcagctcactgatcttcagaggagggagcaaatgatgtgtgaagcaaataagtgccttagaagaaagctggaggagaccagcaaccaggtgcatggccaagtgtgggagcacggtgccaacttattactcggctacgagcggcactcctcgccacagcaagccccatcacatgttggcaatggattattctttcatcccctggaagctgcagcagagccaaccctgcagatcgggttcgctcccgagcatatgaataacttcatgccggcatggctaccctgaagatggatctttgaggcaaagggaataaataaagatgcgatggcagaatcatattgtactgcaagagtgacaattgtgtgttccactcacatatatgacctagttttgtgtgtctatatgtcgaaacccatatgtctgtgattttattatatgttatgtaagcacaaatgaaacatgccggactagttgcttttgcttgtctatgtatttgtatctgttctgtgt

SEQ ID NO: 8115 - DNA, 1210 bp, Zea mays
  Predicted polypeptide sequence is orthologous to G137, G145
ccacgcgtccgggcgcgcgcgaggaagaagttaggttagaaggactctccaaaagcgccgcttgagtaaaaaagatctcgccccaaggggtacgacgactacgatcacacaatataagcatctctctgctgctcaaagcaacccaggccggactcccgagggagcttttttagagcaagagaggacggagaggtagagagagaagggggacggaacaagcagctagctagcagggaagatgggtcgcggcaaggtggagctgaagcggatcgagaacaagatcagccggcaggtgacgttcgccaagcgcaggaacgggctgctcaagaaggcgtacgagctgtcgctgctgtgcgacgccgaggtcgcgctcatcatattctccggccgcggccgcctcttcgagttctccagctcctcatgcatgtacaaaacactcgagagataccgcagctccaactacagcacacaggaagtaaaagctccactggagagtgaaattaactaccaggactacttgaagttgaggaccagagttgattttctccagactacacaaagaaacatccttggcgaagatctgggcccactcagcatgaaggagctcgagcagctggagaaccagatagaggtatccctgaagcatatcaggtcaagaaagaatcagatgctactcgaccagctctttgatctcaaaagcaaggaacaagagttgcaggatctcaacaaagacctaaggaaaaagctgcaagaaacaagtccgcagaatgtgatccacgacgtctcctgggaggaaggcgggcacagtgggagtagtgttcttggtccgttccagggactccttcagcaccatggcaatgatccttccctgcagacacggtaccatcagcaggcctacatggaccagctgaacgaggacatggcggaccctgacgagcacggtcggtctggatggatatgagatgctccggtccgatgccccccaaataatgtcgatgcatgcatatagtttcctgcggtatgcggaactatatatgtgttgaaactgcaccaacgattagctgcctgattgtaatggttaccttaagaactccagtgtattgtattgttgtgtgctgtgctgtgttgtcagaagcttgcaactttgtatatgtacatgtatggtattctgttagtttcttggagctgcgcaaaaaaaaaaaaaaaaaaa

SEQ ID NO: 8116 - DNA, 1056 bp, Zea mays
  Predicted polypeptide sequence is orthologous to G137, G145
agagagagagagagagagagctccggctgcgctctgccttgctttcctgctacctgctctagcgcgagcgaagagaggtacggcggccgatctggcggcgcaggcggagggctcggccggggccggcaagtcggcgccgaacatggggaggggccgggtcgagctcaagcggatcgagaacaagatcaaccgccaggtcaccttcgccaagcgccgcaacggcctgctcaagaaggcgtacgagctctcggtgctctgcgacgccgaggtcgcgctcatcatcttctccaaccgcggcaagctctacgagttctccagcacgcagagcatgccaaaaacacttgaaaagtaccaaaaatgcagttttgcagggcctgaaacagcactccagaatagagagaatgagcaactgaaaagtagccgcaatgagtacctcaaactgaaggcacgtgttgataatttacagcggactcaaaggaacttgcttggtgaagatcttgagtcattaggcataaaagagctggagcacctggagaagcagctcgattcgtccttgaagcacataagatctacaaggacacaacacatggttgatcaactgacagaacttcagaaaaaagaacaaatgttttgtgaagcaaataagtgtcttcgaagaagactggaggagagcaaccaggttatatggcagcatgcgtgggagcaaagcgagcggcattctgaagtgcagccgcagcagctcaatggcaataacttcttccatcccctcgatggtgctggtgaacccacccttcagatagggtatccttcagaggcactgactagctcatgcatgaccaccttcctgcccccgtggttgccatgagatcgaactactgcgcaattccgaattaataagcatggccgcatgcagctgcctgtgctatacgttgtgcttggagtgtactttaaggttcttgcatggcaagtatgtgtgtaacatttgtgatgaacatggaaactatccacttaattctcgaataatcaatgaactgggtaaaaaaaaaaaaaaaaaaa

SEQ ID NO: 8117 - DNA, 1303 bp, Zea mays
  Predicted polypeptide sequence is orthologous to G137, G145
ctcagccagcagcaagcatatagcccagcaccaccacatgcccaagggccctccctctccctcgtcgtcgggccaattgagtgtgagagctcgaaaaaacccaggggatcggccggacgagcagcgcgcgagcgcgagcgcgagctctgtgtgcgtgcgtgtgtctgctctagattagatcacctccatcgtcaataattgcaggcagatccatagtctgctggtggcgagacaaagcaacggatcgtcgtcgatccggagagcggaaagcgcgcagatcgcgacggccatggggcgcggcaaggtggtgctgcagcggatcgagaacaagatcagccgccaggtcaccttcgccaagcgccggaacggcctgctcaagaaggcgtacgagctctccatcctctgcgacgccgaggtcgcgctcgtcctcttctcccacgccggccgcctctaccagttctcatcctcctccgatctgcttaagactctagagcggtaccagaggcacatctatgcttcagctgatgctgcagtgccatctagcgatgagatgcagaataactatcaagaatatgtgaagctgaaagcacgagttgaggttttacaacactcgcaaaggaatcttcttggtgaagaactggctccacttagcccaagtgaacttgaccagcttgagagtcaagtagacaagaccttgaagcaaataagatcaagaaagactcaggtgttacttgatgaactttgcgacttaaagagaaaggaacaaatgctgcaagacgctaacagggttctgaaaaggaagctgcacgagtttgaggcagaggctgcttctcccccacaattggcgtggcaaggcggaggcggcatgttgtcccatgaccctccacagccagaacacttcttcgtggctctggagagcaacgcgcctctgcaacctacataccatactatggacatgaaccagcagccagagccagcgccgggcggctgctaccctcctgcgtggatggcttagccagcgctttggttccattgccttgacaagtgccgtgtccttcagagatcgctacgagtcctgctgctgcttttgcgaaccccccctttgctgcctgccatgcttaccgaactgttcaaataagaaataaccacatggtcctatataggttgctgttgtctttatcttctgttgatcacgtcctgctcagatgctttaaacgctatgcaaaatggcttagcgatgcatgctggaatgggctgaactgcttgtgttttgggagtataaatcgcttgggcgcttggcaat

SEQ ID NO: 8118 - DNA, 1299 bp, Zea mays
  Predicted polypeptide sequence is orthologous to G137, G145
ccaccacccacatgccgcagggccctcacccgtcgagccaattgagtggcagccagaaaaacccagagcgcgagcagcgagcgcgagcgactcggcagcgagcgcgggctcctgtgtgcagtgtgtctgcgctagagggcgaagggcacggaccgccttcgtcaataattgcggtacgaacggggcaaatccgtcgtttaaagaggtcgctgatagcgcctgctggtggcgagagagaaagcagcagaatcgctgagggatcgtcgatccggagaggcaaaaaagccgagagatcaggcagggcaccatggggcgcgggaaggtggtgctgcagcggatcgagaacaagatcagccggcaggtgaccttcgccaagcgccggaacggcctgctcaagaaggcgtacgagctctccgtcctctgcgacgccgaggtcgcgctcgtcctcttctcccacgccggccgcctctaccagttctcatcctcctccaatctgcttaagactctagagcggtaccagaggtacatctatgcttcagccgatgctgcagtgccatctagcgatcagatgcagaataactatcaagaatatgtgaagctgaaggcacgagttgaggttttacagcactcacaaaggaatcttcttggtgaagatctggccctacttagcccaagtgaacttgaccagcttgagaatcaagtagacaagaccttgaagcaaataagatcaagaaagactcaagtgttacttgatgaactttgtgacttaaagagaaaggaacaaatgctgcaagatgcaaacagggttctgaaaaggaagctgggcgagtttgaggcagaggcggcttctcccccgcagttagcgtggcaaggcgaaggcggcatgttgtcccatgaccctccacagccagaacacttcttccaggctctggagagcaacccatgtctgcaacctacataccatacgatggacatgaaccagcagccagtgccagcgccgggcggctgctatcctgcatggatgtcttagccagtgcttcattccattgccttgagaagtgtcctgaccttcacagatccctacgagctttattactgcttttgcctgcccctttgctgcttgcggtgcttactgaactgtccaaatgaccacatggtcatatataggttattgctgtctttatcttatgttgatcacggcctgctcagctgctttagcgccatgcaaaatggcttgggcgatgcacgcttgaatgggtcgaactgcttatgttttgggagtataaatcacttagcaat

SEQ ID NO: 8119 - DNA, 962 bp, Zea mays
  Predicted polypeptide sequence is orthologous to G137, G145
gcacgagggacgaagctagagggacgcaaaacaagctagctaagctaggaggaagatgggtcgcggcaaggtggagctgaagcggatcgagaacaagatcagccgccaggtgacgttcgccaagcgccgcaacggactgctcaagaaggcgtacgagctgtcgctgttgtgcgacgcggaggtcgcgctcatcatcttctccggccgcggccgcctctttgagttctccagctcctcatgcatgtacaaaacactcgagagataccgcagctccaactactcacaagaagtaaaaactccactggacactgaaattaaataccaggattatctcaagttgaggacaagggttgaattcctccaaactacacaaagaaatattcttggggaggatctgggtccacttagcatgaaggagctcgagcagctggaggaccaaatagagatatctctgaagcatatcagctcaagaaagaatcaaatgctacttgatcagctctttgacctcaaaagcaaggaacaagaattgctggatctcaataaagacctaaggaagcagctgcaagaaacaaggccagagaacgcgctccgtgtctcctgggaggaaggtgggcacagtggcgcaagtgggaatgttcttgatccttatcaggggctccttcagcacctggacaacgatccttccctgcagttcgggtaccatcatcaagcctacatggatcagctgaacaacgaggacctggtggacccgaatgagcatggtcgatctggatggatatgaaatgctctgatgacccaaaataaagttgatgcacagcagggattcaccctgcaggacgcgagactatgtattgaagctaagacctcgtgtgtgttgtgttgtgtgcgaagcttggaactttataaatcgttgtcatgcccatggcgttctatttaaaaaaaaagggggggccgggtaccca

SEQ ID NO: 8120 - DNA, 1262 bp, Zea mays
  Predicted polypeptide sequence is orthologous to G142, G148
cccgagccggctcattatatcgtccgtcgcgcagacaacgcaagtttgctagcggccggatcagcagccacagcgcgaagagagcaaccacgctgcacacagaggcgccgtgtgtgagatagagcaagctcgatcgaaggaaggagggaagctagagatcgtacgttcgccatggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccggcataacaaaaactttagaaaggtaccaacattgctgctacaatgctcaagattccaatggcgcactctctgaaactcagagctggtaccaggaaatgtcaaaactgagggcaaaattcgaggccttgcagcgcactcagaggcacttgcttggggaggaacttggcccactgagtgtgaaggagttgcagcagctagagaaacagctcgaatgtgctttgtcacaggcaagacagagaaagacacaacttatgatggagcaagtggaagagctccgcagaaaggagcgacacctgggagaaatgaacaggcaactcaaacacaagcttgaagctgaaggttgtagcaactacagaaccctgcagcatgcagcctggccagctcccggcagcaccatggtggagcatgacggcgccacctatcatgtgcatccaacaactgctcaatcggttgcaatggactgtgaacccactctgcaaatcgggtaccctcctcatcaccagtttctgccttccgaggcagccaataatatcccaaggagcccccctggaggcgagaacaacttcatgctgggatgggttctttgagttgctctgttaatcatccatccatcagatggatgtccaaactaataaaaggcactcagtgctaccatatgcatatccatgcttaagtgcttgatttgccacgacgtggatatcttttaaatttatcgttctggtgtgtaataactaattaagaacggcaccttcattctatggttgtggtgtggcacttctatctatggtttttgtatttggaccacgaatgttgtaatttgtaaaaaaatttaaagatttatctatgctgccggtgctgcggtgcatagcccggtgcatagaatccaaaattatctgcaccggtgcttatt

SEQ ID NO: 8121 - DNA, 1262 bp, Zea mays
  Predicted polypeptide sequence is orthologous to G142, G148
ctcgtgcgctgatattccgctcctgtccctgtgtcctccccggatggagctagagccggctctgctcatcattatatcgtcgcgcacaaatgcagcacttgtgttcgtgggggtgtgtggcatattagctagcggataagcggccggccgggcagctagcagaagagagcaagctcggacctcggatcggaggaggtcggcatggggaggggacgcgtcgagctgaagcggatcgagaacaagatcaaccgccaggtcaccttctccaagcgccgcaacggcctgctcaagaaggcctacgagctctccgtgctctgcgacgccgaggtcgcgctcatcatcttctccggccgcggcaagctctacgagttcggcagcgccggcgtaactaaaactttagaaaggtatcaacattgctgctacaatgctcaagattccaacaatagtgcactctctgaatctcagagctggtaccaggaaatgtcaaaactgagggcaaaattcgaggccttgcagcgcactcagaggcacttgcttggcgaggaccttgggccactgagtgtgaaggaattgcagcagctagagaaacagctagaatgtgctttgtcacaggcaagacagagaaagacgcaagttatgatggagcaagtggaagagcttcgcagaacggagcgtcacctgggagaaatgaacaggcaactcaaacacaagctcgaagctgaaggctgtagcaactacacaaccttgcagcatgccgcctgctggccagctcccggcggcaccatcgtggagcatgacggcgccacctatcaagtgcatccgcctgcccactcagttgctatggactgtgaacccactctgcaaatcgggtaccctcatcaccagtttccgccccctgaggcagtcaataatatcccaaggagcgccgccacaggcgagaacaacttcatgctgggatgggttctttgagttcttctgttaatccatccatcagatggatccatgttgaaaccaataaaaggcattcagtgctatatatatcatatgcatatccgtgctcaagtgcttgatttgccacgacgttggattgtatcgttctgtgtgtaatagctaatttagaacggcacatctattctatgtggttgtggtgtggcacttatactgtttattcatttggaccatgaatcggggtagtttgtaaaaacacatctatatatgctgccggtgcatagaattaaagttatctgcaccgtaattattat

SEQ ID NO: 8122 - DNA, 868 bp, Zea mays
  Predicted polypeptide sequence is orthologous to G147
gggaaggataccctcgccaacctcgaagctagtccaaactagtgggaggttgagtgcagggatcgatcggggaagacgagacaagcttcttctgctgctgctgccgcccccgccagctctagttcaccagagttactacttactagccaatctgacaccgatccaccgccggcaccgaccgtccatggcgcggggcaaggtgcagcttcggcgcgtcgagaacccggtgcaccggcaggtgacattctgcaagcgccgcgcggggctgctcaagaaggcccgggagctctccgtcctctgcgacgccagcgtcggcatcatcgtcttctctgcgcacggcaagctctacgacctcgccaccaccgggaccatggaggagctgatcgagaggtacaaagctgccagcgccggagaagcgacgaccgacggctgcggcaggcacaacaggatggaccccaaacatgaaaccacggtgctgcaacaggaaatcaacctgcttcagaagggactgaggtacatctacgggaacagggcgaacgagcacatgaatgttgacgaactgaacgccctagagaggtacttggagatatggatgtacaacacccgctctgcaaagatgcagataatggctcaagagatccaagcactgaaaagcaaggaaggcatgttgaaagctgccaacgagattctccaggaaaagatagtagagcagagtagtttgcttgacgtaggcatggtggtagcggaccagcagaatgggcgttttagcacagtcccactggtagaagaggtgatcagtagtaacccactgactgtactgagtggctattctagctgtagggggtcagagatgggctactcctttctg

SEQ ID NO: 8123 - DNA, 510 bp, Zea mays
  Predicted polypeptide sequence is orthologous to G147
aaaaacaacccacccattacaaactttattggcgggatgtattaccccctaaaaaaaatcaacaaaagggcccccccggctgtttgttattacgggcaaaaggagtaccccctccccgaacccccacagcaaaaaaacccccccaaaacaggcggggggttactactgatccccccttccaccagggggactgggcaaaaacccccattctggggggcccctacccccatgcccacgtcaagaaaactaccctgccctactatctgcatcaggttcaaagcgcccgaacaaaacctgaacaaagttcaaaacccaaaaggaactgacaaaaatctgacagttgcttatcatgatgtaaaaaaaagaaacctgaagtttgtaccccaaaaggagctgacagttggaaaaaaccttttcctggaaaaacccgttgggagctttcaacatgccttccttgcttttcaggggttggatcccctgagccattatctgcatctttgcaaagggggg

SEQ ID NO: 8124 - DNA, 548 bp, Zea mays
  Predicted polypeptide sequence is orthologous to G154, G627, G1011, G1797, G1798
cccagcagcgtgaagtgaggccagctagccttatcagcctatggcggctcggattggagcggacgggaaggcgatggcacgccgcggccgcgtggagctgcggcggatcgaggaccgggtgagccggcaggtgcgcttctccaagcgccgctcggggctcttcaagaaggccttcgagctctccctgctctgcgacgccgaggtcgccctcatcgtcttctcccccgccggcaagctctacgagtacgcctccaccaggcaaaaggcgtggtgcgtcacttatccattcaaacacaggaatttgttgcaatcacgggattgtagaagaaaactacaagatgtgatgatgctgatgctacataagtcatgctaaaatgtctcgtttattgaagtattgtatctcaaatatattattttttaatttctttatcttgtagtttatatttgagattttattattatatttagtcactgcacactctcgttaaaagagtaacgacctttttggtgaccaaaaaaaaaaaaaaaaaaaaaaagtcgacgcggcc

SEQ ID NO: 8125 - DNA, 585 bp, Zea mays
  Predicted polypeptide sequence is orthologous to G154, G627, G1011, G1797, G1798
gcacgagctgggcactggtgaatgaacgagagtgacctgacccccgtgcggccgtccgccgtcaccgaccgagcgccgggtcccaccactccccgtccccaacccctcgcgctcgctccagcctccagcaaccgcgctccctgttcctttccttcccaggcggccaggcccagcagcgtgaagtgaggccagctagcctattatcagcctatggcggctcggattggagcggacgggaaggcgatggcacgccgcggccgcgtggagctgcggcggatcgaggaccgggtgagccggcaggtgcgcttctccaagcgccgctcggggctcttcaagaaggccttcgagctctccctgctctgcgacgccgaggtcgccctcatcgtcttctcccccgccggcaagctctacgagtacgcctccaccagcatagaggatacatataaccgctatcagcaattttctggagaaggaaggaatataaatgacgatcgaaatagaaacgataacaaggataaagcttcttcagatttgcagttgatgctgagcaagattgccacctggtctccccagagcaatgctgac

SEQ ID NO: 8126 - DNA, 1341 bp, Zea mays
  Predicted polypeptide sequence is orthologous to G154, G627, G1011, G1797, G1798
ccacgcgtccggccaaaacccttacgcgcgacgcggccccctcctcttcttctctctcccaccaccgccctccccttgccatttttggtgagtgccccctttcccttccctagaccagatcctcgccccgttttccacttttgcctccaccgcgccggcccaattcggataacaagctccctccgcctcgccgcgtctcctcccagccgcaggagccgccgccatccgatccggaagagggaggaggggggagggaggaggatctgtgtcccgattcgattgcagctctcgtccccggcggtccaggatggtgcggggcaagacgcagatgaagcggatagagaacccggccagtcgccaggtcaccttctccaagcgccgcaacggcctgctcaagaaggcgttcgagctctccgtcctctgcgacgccgaggtcgcgctcgtcgtcttctccccgcgcggcaagctctacgaattcgccagcggaagtgcccagaaaacgattgaacgttatagaacatacacaaaggataatgtcagcaacaagacagcacatcaggacattgagcaagtaaaagctgatgctgagggcctggcaaagaaactggaagcacttgaagcttacaaaagaaaacttttgggtgagaggttggaagaatgctcctttgaagagctgcacagtttggaagtgaaactcgaaaagagcctgcattgcatcaggggaagaaagactgagctgctggaggagcaactccataagctgaaggagaaggagatgaatctgcgcaagagcaacgaagatttacgtgaaaagtgcaagaagcagccgccgccgccgccgcctatgctgatggctcctccgccgcctccagcgccggcagccatcgatcacacggggccgaaggatgtcgggatggacgtggagacggagctgtacataggattgcccggcagagattaccgctcaaacaacaaagacatgactgcacagtagctgtcaggtcaggtcaggtcaggctagccagcagtgcagagaataatcttagatctgtggtgcggagaactggagatgcaagccaagcccaagccaatcaacatgataaggatcatgagtgtcgcgtcgtgttttacaaacctgtccaccgtccgtcaaaggcacatgcgccagaacgtccgtcagagaacacttaccccctcatctccctctattagctagctgctccggcctgctcatgtcgaaaccttctgttcaagtatgttctcctcctgatgaattccctgcccggcatgcattggtgagcttcttctcgagaagaagtgggtggggtggggacactgtcg

SEQ ID NO: 8127 - DNA, 1154 bp, Zea mays
  Predicted polypeptide sequence is orthologous to G154, G627, G1011, G1797, G1798
gcgccctttcccttcctccccagatccccgtccccgttttccacttttgcctccgccccaattcggataacaaacccctccgcctcgtcgcgtctcctcccagccgagccgatccggtagagagagggagagggagggactgagggaggaggagctgggttccggtcccggccgcccggccggctgcgcgattcgattgcagctctcgtccccgggcggcgtccaggatggtgcggggcaagacgcagatgaagcggatagagaacccgaccagccgccaggtcaccttctccaagcgccgcaacggcctgctcaagaaggcgttcgagctctccgtcctctgcgacgccgaggtcgccctcgtcgtcttctccccgcgcggcaagctctacgaattcgccagcggaagtgcgcagaaaacgattgaacgttatagaacatacacaaaggataatgtcagcaacaagacagtgcagcaggatattgagcgagtaaaagctgatgcggatggcctgtcaaagagactcgaagcacttgaagcttacaaaaggaaacttttgggtgagaggttggaagactgctccattgaagagctgcacagtttggaagtcaagcttgagaagagcctgcattgcatcaggggaagaaagactgagctgctggaggagcaagtccgtaagctgaagcagaaggagatgagtctgcgcaagagcaacgaagatttgcgtgaaaagtgcaagaagcagccgcctgtgccgatggcttcggcgccgcctcgtgcgccggcagtcgacaacgtggaggacggtcaccgggagccgaaggacgacgggatggacgtggagacggagctgtacataggattgcccggcagagactaccgctcaagcaaagacaaggctgcagtggcggtcaggtcaggctagcagctacctcagccacgcacaggcccaatcaacgcaagctagctagctgagaataatcttttagatctctggtagtgtggagatcgagatgcaagccaagcaatgtgatatcgcgttgtgtgttaccaacctgtcagtctgtgtatcatcccgtcccgtccgtcagagtctcagagaacgaacacttcttctccttctccctgtagctagctgctcctgcttgtgtcc

SEQ ID NO: 8128 - DNA, 895 bp, Zea mays
  Predicted polypeptide sequence is orthologous to G154, G627, G1011, G1797, G1798
cgacgagcgacgagctaaaccccgaccgagtcgctgcttgggtgcccaagatagccctaccgcctcgcctctctcgttccccctcatcgccacgccagtcgcctccactcccagtcatctcccatcaccgacgacgtgtcgaggcgagagaagagggcgagtccaagtctagggttcccgccgcatcgacacgggcatcgcaccgcaccgcgaggggcgggcacggaggaagatggcaccgcgcgggcgcgtggagctgcggcggatcgaggacaaggcgagccggcaggtgcgcttctccaagcgccgcgcggggctgttcaagaaggccttcgagctggccctgctctgcgacgccgaggtcgcgctcctcgtcttttcccccggcggcaagctctatgagtactcctcctccagcatagaagatacatatgaccgctatcatcaatttgcgggagcaggaagaaaagtgaacggacataacaacgataaccgggatgtagctgcttcagatttacagtcgagacttaaggagatcgcaacatggtctaaacaaaacaacgctgaggagtcggatgccaatgaacttgagaaacttgaggaactcctgacaaatgctttgaggaatacgaaagccaaaaagatgttggcaaaagaaaacaatggtggtgccggtgcaagtacaagcagccagatgttgctttactcggcagagcgtgcaaccgacaaatgaaacggggcgtgcatctgttgctaacggggcggtgccggtgccgcatactattgttgtgtagctgaagtttgtcaaggtggctgctggcaaggtagccgaggaagtggagttcataacaggatgcggaaactgtgccgctccttgccgaacttagccccgtta

SEQ ID NO: 8129 - DNA, 904 bp, Zea mays
  Predicted polypeptide sequence is orthologous to G154, G627, G1011, G1797, G1798
gacgaaacggcaagcgtcgccctctccaccgccaccagtccacctcctcgtcctcctccggtcacgcacgcagctagcttacccgccccgccactataaaaatccacctccaccccaccgcgcgtctacagttccacacacgcgtgcacgggcgggcaagcaccagaaaggaaaggcggaggccgcgcggcgggcgccagctgcagccaagagcccactagtagtagtagtagctagttcaccaccgcctgcttgcctcctttactttgccatatttgctagcgtttcctggattggggacgcttccgtttcgggaagccgtgaagggatcggccacgacgatggtgcgggggaagacggagctgaagcggatagagaacgcgacgagccggcaggtgaccttctcgaagcgccgcaacgggctgctcaagaaggccttcgagctctccgtgctctgcgatgctgaggtcgggctcgtcgtcttctccccgcgcggcaagctctacgagttcgccagcgccgccagcctccagaaaacaattgaccgctacaggacatacacaagggaaaatgtcaataacaagactgttcaacaagatatacagcaagtcaaagcagatgccgtaagcttggcaagtagactcgaagccctagaaaagaccaaacgaatgtttctgggtgaaaatttagaagaatgctccattgaagaactgcataatctggaggttaaactggcgaagagccttcacgtcatcagagggaagaagacacaactgctggagcagcagatatccaagctgaaggagaaggagaggaccctgctccagacaacaaagagttgcgggataagcagcgcaacctccagtctccaccggaggcgccacgggacctgaccgctgtgtcc

SEQ ID NO: 8130 - DNA, 1039 bp, Zea mays
  Predicted polypeptide sequence is orthologous to G156
cttggatcgaccgaccggccggggtggtcgccatgggacgcgggaagatcgagatcaagcggatcgagaactcgacgaaccggcaggtcaccttctccaagcgccggggcgggctgctcaagaaggccaacgagctcgccgtgctgtgcgacgcgcgcgtcggcgtcgtcatcttctccagcaccggcaagatgttcgagtactgcagccctgcctgcagcttgagggagcttattgagcagtatcagcatgctaccaacagccacttcgaggagataaaccatgatcagcaaatactgctggagatgacaaggatgaagaacgagatggagaagctggagacgggcatcaggaggtacaccggcgacgacctctcctccctcaccctcgacgacgtcagcgacctcgagcagcaactcgagtactccgtctccaaagtccgtgcaaggaagcatcagctcctgaaccaacagcttgacaacctgcgtcgcaaggaacaaatcttggaagaccagaacaccttcctgtaccgcatgatcaacgagaaccagcaggccgcgttgaccggcgaggtgaagctgggggagatggcgccgctggcgatgctgcagccaccgccggcgttcgcgcactccgccaccgcctactacggcggggagtcgtcgtcgtcgggcacggcgctgcagctgatgtcggcggcgccgcagctgcacgccgacgacctcgggttccggctacagccgacgcagcccaacctgcaggacccggcggcgccgtgcggcggcctccatggccacggcctgcagctgtgattaactgcgatcaattgggaggactgtcacatgctgcatggaagagggactattattggagcacgcagtttcaaggtcgcaaagctcgtcatgcataatttcgatcatatgttagtttgtcatctgaatagttttatatatgcatgcaatgcaatcaattctctggataataattcaactattgttatgtatctaattaagataggttcgtagactaaaaaaaaaaa

SEQ ID NO: 8131 - DNA, 923 bp, Zea mays
  Predicted polypeptide sequence is orthologous to G156
tgttcttgtaggttgaatagaagagtggaagcaccaagctgtaccaatggggcgtggaaaagtagagctgaagaagattgagaatccaacaaaccgccaagttaccttctccaagaggcggatggggttgttcaagaaggcaaatgagctagccattctttgtgatgcgcaaatcggagtcatcatattctctggcagtggcaggatgtacgagtactccagccctccatggagaatagcaagcgtctttgacaggtacctgaaagcccctagcacccgtttcgaggagatggacatccagcaggagatgactaggatgaaggatgagaggaacagactgaggatgatcatggcgcagtacatggcggaggacctggcatcgttctccgcgcaggatctgagcaaccttgagcagcaaatcgagttctcgctgtacaaagttcgcctcaggaagcaagagctactcgaccagcagctgctcgagatccaccaaagggagatgcatatgccagcagagcagggcggctacctgtgcctcatgaacccggctgcggctattgctagcgggcagcaccagcaggctggcgagatggtgggaattaacccgaggccgttcccgtggtgggacgtgggagccagtggcagtggcagtggcagccagagccagcagcagctgctgcacggccgggacgccgcggagtcgtcgatgacggcgctcgggctgtcgccgcagctgcatgggtacaggctccagccgcggcagcccaacctgcagcaggacgccgacatccatggctggctgtgatttgctttggtcgtgggtgtgcgtcctcaacgagacgagacgacgctgaacgtgcagctcctctgcttgcgacctgttcattctagagtctttgatcatgacctgccccccgtatgaa

SEQ ID NO: 8132 - DNA, 716 bp, Zea mays
  Predicted polypeptide sequence is orthologous to G175, G877
gtccggaattcccgggtcgacccacgcgtccgcgcaagtatggacagaaagtggtaaaagggaatccctacccgaggagctactatagatgcacgtaccaaggatgcgatgtgaagaagcatatcgaaagatcatcccaagacccaaaggccgtcataacgacttacgaagggaagcacagccatgatgttccagcagtcaggaacggtagccatgctgctgccaacgccaatgggtcatcttccaccagcttaccagtaccacacagggtccacagttcagcatccagtagtcgcagagcggcagaattacaaagcgcatcctcagcttcttctatgctactaaaagaggaaaacgaaataacataggagttttggagtgtgtagccagggtaaattatatctgttctctgatccatttcctcctaggtgtgctgcttcacgctctgcgccgcagcaaaaattgggcactgcaagcccccaccattggttttagtcaagagcgagctctttcgtttgtgcccttccaaaagctgcacaccctgtttggctgcgcggtgtatgttatgttgtcattaccatttacgcccattggttgtaaatgccatcagtcgttcccccggagaactatatggatgacagcattcatcggcccaagtgtatatactcgatttaaaaaccttttttttaactgagatatggtttgttgtaaaaaaa

SEQ ID NO: 8133 - DNA, 1026 bp, Zea mays
  Predicted polypeptide sequence is orthologous to G175, G877
ggtccggaattcccgggtcgacccacgcgtccggtaaccatttaagacttgatgcagacattgtactgaattcgctggtactctttttcaggaagttggaattagatgctttaggagctattgctattgctactacctccaccaccagtaccattgacatgggccctgcatcctcaagagctgtccgggagcctagggttgttgttcagaccacaagtgaggtagacattcttgatgacggttatcggtggcgtaagtatggacagaaggttgttaagggcaatccaaatccaaggtcacactttcactaccatttcttacactaaatgactaaactgtatccctccatcccctgaagctagtaacattgattcacttgcatgcaggagctactacaagtgtacacaccctggctgttcagtgcgcaagcatgtggaaagagcatcacatgatctgaaatcagtcatcacaacatatgagggaaagcacaaccatgaagttccagcagccagaagtagtgggcaaggcagttctggttctggcagcggtccatctgcaccacaagctggtggttctcaccgtaggcaagaacctgcacaagccagcttcgctcactttggtacatctcctttcagctccttcggtctcgcaccgagcggacagttgggaccaacaactggtaatttccgcttcggcatggttccgccaggcgcgacgatcccaatgccctctctaggatcacttgcccctacaaaaatgattggaaatccatcagctatgcaggggtacccagggcttatgatgccaggagagccaaaggtagagcctttctcgcgaccacacttcccaacgtcaattgcacctccgccagcttaccaacagatactgagcaggcctccttttggtcatcagatgtaaataataggaaggggatagatttgcttcggcttgtatacatgatagctacgctgcaacatggctttgttctagttttgttgatggatcgtccgatttttaaaaaaaaaa

SEQ ID NO: 8134 - DNA, 796 bp, Zea mays
  Predicted polypeptide sequence is orthologous to G175, G877
tcatcctcctccagtcacagcacaggttaggttgaataatccaagcttgagatggaaggtcatgtagcaatggagtggaatgatcctaatccaggcccagaatccttgacgagcttccaaaccgaagctgttcgaccagacaccgcagggggccacagcaacgacgacgttgaagctggatttgagaagcatggcttggcagtcaccgtaaggccgcctgaggaggaagctcggtcagtgccactaaccccacagcttggccagaagtccagtcctggcagcagcctcgcggagaggatgcaggcaagagctggattcatggtgtcgaagctcaacatgcccttcagcacagcagctggagctgacaattcagtacccgaagttccatcgccctacctcacgattccgcctggcctgagcccagcaacgctgctggagtcaccagtcttcgtttctaattccatgggccaggcctcgccaaccacggggacgctattcatgtttggtagcacaaatgacaatgatcctattagatttggaggtggtcctccttcagttggagatggccctaatgcttttcctttcaagcccttagatctgaaatcctcacactacactgctgaagcaatgaaggaacaaaatacgaagtcttctgtcaagactgaaaccaagattctgacagtacaagaggctagtttgctcagccaactgaaccagctgaatcacaattcgcagaccattattaatagtggcggtcctcatgaccccaagctcagccgtcctgcatctggcgccg

SEQ ID NO: 8135 - DNA, 639 bp, Zea mays
  Predicted polypeptide sequence is orthologous to G175
cagccaaggtgacacaaagttgaaccacttccgagggttcctcgtcatgatattgtgcaggcagtggagcttggcagcagggaaagactcatagcattctgtgaagtagtgcaacaaacttgtccagtaggatctttcatcaaaccaactgctggggaaacgtctggctatgcttcagaggtcattttcgccgacgggacattcatagatggaagcacaagcgaactgtcatgtgatgggcccttgagagatccatatgccgtcttttgccagggaggaacacattggacacagtgggcacttgtccttggtgatgttctgaaggtcatataaacgtgcggtgtgataatgttgtcacatttctgtgaagaggcaggcgtcactaatatgcgagcgcttgcacttcagtggatacggacaacgacaagctgtcgttagtgttacccgactactacctcccctgctgttcatgtggacaaatcaccagcgacctcaccaccagtgaccccacttttaacctccctatttactcaccaccagatattttttagggactcaaacatgatgtatgatttagcatatgatctgtgagcacaaagaatatgcaaattgctgtattgtgtatatagaggtttgttt

SEQ ID NO: 8136 - DNA, 869 bp, Zea mays
  Predicted polypeptide sequence is orthologous to G175, G877
ctcggttggtggaagggcgaggcacagaagaacatcgataaagggtgtgtctattttttagctcttcgtgttcttgtaggaggaattcccgttcacatgatccgtgcctgtacctgacgggccttgtcgcgctctgctgcttcgctttcggggagaggaggactcgactcaaatcacttggtagcggagacgtcgccctttctagttcagtcgagagatatttctggcatggccggcgcaagcaaccatggatccctcaccgacgaatggttgccgccccctacaccaagcccaagaagtctcgtgtcaagctttctgaatgaagaattcagccccgggccattctctggtcttttcagtaaacatggcgccaatagaccccatgatcaatccgaaaagggcagaggagctctgaattcgagcgaggagttccctactcatgctgtcaaagacccatttcaaaagggtttctccctggagccaaatttgttcagtgctaatcatatatcaaactccaatggtggtttggcagagcgcagggctgcaagagcaggtttcagtgtcccgaaaattgatacttctcgagttggttcatcagcagttattcgatctcctgtgtcaattccacctggtctaagtccaactacactactggagtctcctgtttttctttacaataaaatggcacagccttctccaaccactggcacgttgccatttttgacggctacgaatgataagtcgacaataccaccagctaccaagataactgaagattctgcagtttataatgatgtgttttctttccaaccccacttaggttctaaagaaacagggttctctactgcagaaaaggactatggcgccta

SEQ ID NO: 8137 - DNA, 775 bp, Zea mays
  Predicted polypeptide sequence is orthologous to G175, G877
cgtggagcgagcctcgccaccactgggctcctccggcgacctcctccctccagtcacaggttgagcaatccaagctgagatggaaggccatgtagcaatggggtggaaggatcctaatccaggccaagaatcttccatggtcttccaatccagagctgttcggccagacaccgtagaggggcacagcaacgaggacgttgaagccggatttgagaagcatggcttgtcagccgccttaaactcgcctcagcacgaaggccgatcactgccactgaccccacagtttggccagaactccagtcctggaagcagcctcgccgagaggatgcaggcaagagccggattcaaggtgccgaagctgaacatgcctttcagcacggtagctggagatgatagttcagtgccaggagctccatcgccctacctcacgatcccgcctggcttgagcccagcaacgctgctggagtcacctgtcttcatttcgaatgccctgggacaagcctcaccaaccacggggaagctattcttgtttggtagcacaaatgacaacgatcctattcgacctggaggccctccagttggagatggcactgatgctttttctttcaagcccttagatctgaaatcctcacactacactgctgaagtaatgaaggaacaaaatacgcagtcttctgtgaagactgaagctaagactcaggcagtccaagaggctaatttgctgggccaactgaaacagcagaatcacgatgggcagacaaacatgaatagtgac

SEQ ID NO: 8138 - DNA, 690 bp, Zea mays
  Predicted polypeptide sequence is orthologous to G175, G877
gggcagaaaaataaaatagaaataaaaaattggacgatccatgaacactaaagccatgttgcagcgtagctatcatgtatacaagctgaagcaaatctattatcccctttctctttcctattatttacatctgatgaccgaaaggaggcctgctcaatatctgttggtaagctggtggagatgcatttgccatttggataagtggttgcgagacaggctctgcctttggttctcccggcaccataagccctgggtagccctgcatagttgatgaatttccaaccatctttacaggggcaagtgatcctagagagggcactgggatcgtcatgcctggcggaaccatcccgaagccgaaattgccagttgttggtcccaactgaccactcggtgggagaccgaacgagctgaaagaggccgtaccaaagtgagcaaagctggcctgtgcaggttcttgcctacgatgagaaccaacagcttgtgatgcagatggagcgctggaactgccttgcccactatttctggctgctggaacttcatggttgtgctttccctcatacgttgtgatgactgatttcagatcgtgtgatgctctttccacatgcttgcgcactgaacagcccgggtttgtacatttgtagtagctccttggatttggattgcccttaacaaccttctgcccatacttgc

SEQ ID NO: 8139 - DNA, 851 bp, Zea mays
  Predicted polypeptide sequence is orthologous to G180
catcatcgtcgtcaacctcaaccttatcatgcacagttgacaccgaaaggagagagagacccattctatcctgctgcgaattctgtgccccgcccgcccaaccaagaaccgcacttgcatcgtccagatcgatcatcgctagcgcatatatgcaggcatatatggagggaggccagttgttgggggcttgctgccttcctggcttccttgtgccggatcactacgccgccttccctcttcctctcccgctacaacttcctagccagccaaacgataataggcttttccagatgccgtttgaccaggaagaagccgagaaccatggcgggatgctctactccgaccaatgtggactatacccgctgccggccttcggcagctgctctgctgccgccggcgcaacagcgaagcctactgctggtttcatgcccagtactattggcgctgagacgaaggtctgcacctcgctgactactaaaggttgcaacgagagtaatagcacatggtggaaggggtcagcagctacgatagcggagagagggaagatgaaggtgaggaggaagatgagggaaccgaggttttgcttccagaccagaagcgatgtggatgtactggatgatggctacaagtggaggaagtacgggcagaaggttgtcaagaacagcctccatccaaggagctatttccggtgcacccacagcaactgccgcgtgaagaaacgggtggagcggctgtcgacggactgccgcatggtgatgaccacgtacgaggggcgccacacgcactctccctgcagcgacgacgctttctcccgcgaccacaccgattgcttcagctccttttgatgaacc

SEQ ID NO: 8140 - DNA, 892 bp, Zea mays
  Predicted polypeptide sequence is orthologous to G180
ctcaatcctcaagcggccatcgtcgtcaaccttatcatgcacagttgacaccaaaagcagagagagatagagagagagcgcgatccactccatcctgcaagttttctgtcccgcccacccaacaccaagaacaattaaacgctttgatcgatggatcaatatcagtcgctagcgcgcgcatacgcagacgacgcgaaggcatatatggagggaggccagctggggacttgccttcctagcttcctcgtgccggatcactacgccttccctcttccgctcccgccgctacaacttcctagtagccaaccgaacaacaagcctttccagatgccgtttgacgacgtccaggaagaggccgggaaccacgccgggatgctctcctcctccgaccactgtggactatacccgctgcagtcactgcccttcggcagtagcgcctccggcggcgccggcgcggcagcgtgcggtgggaagcctacggccgtcggtttcatgcccagctgtagtgctgtcggcgctgaggaggtctgcacctcggtggcgcctactactaatggttgcaacgagagtaatagcgcatggtggaaggcctcagcagcggagagagggaagatgaaggtgaggaggaagatgagggaaccgaggttttgcttccagaccagaagcgacgtggatgtactggatgatggctacaagtggaggaagtacggccagaaggttgtcaagaacagcctccatccaaggagctatttccggtgcactcacagcaactgccgcgtgaagaaacgggtggagcggctgtcgacggactgccgcatggtgatgaccacgtacgagggccgccacacgcactctccctgcagcgacgacgcttcctccggcgacacaccga

SEQ ID NO: 8141 - DNA, 555 bp, Zea mays
  Predicted polypeptide sequence is orthologous to G181
ttttttttttttttttagcaaacaaacagcccttaaattgtgcaaactaaattacggcttcattacaaaggacgctgatccgcggacatacatttctgttgaatcatctgtgtatatgcatgaatcacgtacatatctgttgaatcatctgtataagaccagctacacgctgtagtaatttagagagacagtcgttccttgtgtcgttaccactgccgatcgatcgatcaacagtttgttttgtacacttagcagtaaatttgcattagctcatcacgtacgctgatggtggccagctaggctaataggctgccagctgtgtcgtcagaccaggtggatattcagaggagttgattagtgcaggactggagctgcgagaggagctggagctgcttgaggatggggctgagcgcctccatgagcttctcgcacgggtggttgtgcacgccctcgtacgtggtcaccacgatgctcgtgtccttggccagccgctgcacctgcttcttcacctcgcacgtgtggtgcgtgcaccggtagtagctccttggaaacgcg

SEQ ID NO: 8142 - DNA, 434 bp, Zea mays
  Predicted polypeptide sequence is orthologous to G184, G186, G916
ttttttttttttttttttgaaaaaaaagctaacaagaatatattctggggcgcacggagtattatttagcatacatactagtaggtgtaatgtatctagctagcagaaacgaaataaagtaaaaaaaaagttagggaacaatgaatcaacaatacagcttaattttgaacatcactgggtctcactgttgctggtggcagtgttgttgctgctgctcgtgaccaccgcattgttgttgttggcgttgctgttactcgtcggggtcaggccctgctgctgtcgtccttgcccctgcccgccatgatgaattggaatcggaactggatggcctccgccgcctatgatggaggtgatggccgccgccagcgccaccgtgaagttggggtccgaggcgatggccgccgccgccgcagcggtgacggtgttcatgtgcg

SEQ ID NO: 8143 - DNA, 867 bp, Zea mays
  Predicted polypeptide sequence is orthologous to G184, G186, G916
ccgctcggctggctctacacctgcagctaggcagccgacgtcggacttgggatcttgcatggacaaggcccacctcggaggaggcctgttagctctcgacgcgtcgccgcggcctctcggcttcctcaacctgctatcgccgccgacgtcgtccccgccgtttcacaggacaagaacgatggaggccgacgacgtccccgccgttccaggcaacaagggccgtaggtccatcgaggtggacttcttctccgacgacaaggacaagaagagcgctgccgctgcagctaacgacaagaaggaagacctgacgaccattaaccttcttcccggcagcaacgccaacgacgacgacgacgacgaggcggcgacccggctccggctgccgaacgaccaagacaggcagaacaggaacaccaacgagctttcggccatgcaatcagagcttgcgcgcatgaacgacgagaaccagcggctgcgcgggatgctcacccaggtcaccaccagctaccaggcgctccagatgcatctcgtggcgctcatgcaggcgcgggccgacggccagccgatgatgcctcctgcagtggcccagacactgccggtgaccgacgccgctgctgtcatgccatcgccgagacagttcctcggcctaggaccagcggcggctgccgaggagacgtcaaactcgtccacggaggtgggcagcccgcggccgtcgtcgtccgcaggcaggcggcaggaccaacagcaacaggcggcggagcgcggcgacagcccggaccccgtcggatccgtcgactacagcaaggcagctagcgcagcagcaggagggcagcatgaggaaggcgcgcgtctcggtgcgcgcgcgat

SEQ ID NO: 8144 - DNA, 724 bp, Zea mays
  Predicted polypeptide sequence is orthologous to G185
ttttttttttttttttccactgggattccatggtttgcaactctgcatggacagggcggaacagtacaccgagctgttgatagtagttgaagactatactctagtctagtccgaagctaattctgttgccggacacgtgtacatacatgtatggttgcatagatagcatacatagcccattccatctatctaattggcggcatagaggtcccattggaagggctccgtagcattggtgaacagctcctcgaacagggtctcgaactccacgccgatgccggccccgtggctgcttctcagctgcccgtccaagcccgtcggcgagaagagcgggaagtcggcgcctgaggcgaacgagtagggcgtcatgggctctagcagcccggtggccagcgcgagcggggagcaggctccctggtccttgtcctgggcgctgtgcccgtgctgcagctgtagctcctgccgcagctggttggcgccggggtgcgcggcctggacgcaggtgtgcgcgccgtggtacaccacgacgtgcagcagcgggtccccgtcggcgcgctgcacgtgcttggtggcgaggcagccctgcgagtggcggtgcgtgcaccggaagtaggccctggggtacttggcgcccaggatgtccttctgcccgtacttcctccagctgagcccgtcgtccagcgccgccgcgtcctgcagcgacgccgcccgcagctgcctcctc

SEQ ID NO: 8145 - DNA, 648 bp, Zea mays
  Predicted polypeptide sequence is orthologous to G187
ttttttttttttttttgaatataactgttcccctctccttagaccgagccacgcacaagcacgaggtcatcaggtgatcacatttggcgcgcagtattccgacgacagcatctctcatgtcgatctaggctagctagctgttcgtagcagttagttattacgggttattgggcattgtggaagggaagagatcttgcaagagggcgtagtcagtgaagtggtgctgctgaagaggaggatcaggagcaggagatggcgttgacatatgaggaggaggaggcatacttggcaggaacatgttagggttcgcgcccaccatggcggggtgcatcatgctcatcaggttcaggtccgggcgaaagctggacgacggcatggtcaggtgcggcggcagcgcgtgcgcgctggacatgaagaggtgcgcgccgccggcgcgcatgctggcggggctgtggtgcgtgtgctgcccctcgtacgtcgtgatcaccgtcgacgggtcctggtacgaccgctccacgcgcttcttcacgccgcacttgggcgtagtgcaccggtagtagctccttgggtaaggactgttcttgaccgccttctggccgtatttgcgccaccgatagccgtcctcaaggtgatccacctcgctcttgg

SEQ ID NO: 8146 - DNA, 807 bp, Zea mays
  Predicted polypeptide sequence is orthologous to G188
aaactagcaaaagtcagcgcctcccccttatctcctccgccactttcctccatttccaagaactcaaccactccacgtcgtcgtcgtttgctgccgctgcgcaatggaggaggagcgctgcttcaacaactgggatctggacgccgtcgtccgcctgggctgccgccgccgcctctccccgccacggcagcccgacccgtttgcttcgcttctccctccgaccctgccgtcgccgtcgccgtcgccgccgcagaaggagaagcccgtggtgccagcgctggctaaaggaccagagccagagccatacgccgggtggcgctttcctaacctcggtgctggcggcgggcaagacggcgacgagctcatgagggccatgttagcagtccagccttccctgcctcagcctctgccaacgacaacgccaacgccaacgccaacgcttcccccggcagcaggagagcatcgacagtcgactgttacagccgtggacgtgccgctaccccaggtgcgccccgctccggccgccagagcgcagccgagcgggcggcaggtgcccggtgccgtgccaagatccaagagaaggaagaaccaggtgaagaaggtggtctgccacgttccggcggacggctcgtcgtcggacatgtgggcgtggcgcaagtacggacagaagcccatcaagggctccccctacccaaggggatactaccggtgcagcagctccaaggggtgtgcggcgcggaagcaggtcgagcgcagccgcgcggaccccaacaccttcatcctcacctacaccggcgagcacaacca

SEQ ID NO: 8147 - DNA, 820 bp, Zea mays
  Predicted polypeptide sequence is orthologous to G188
aaactagcagaagtcagcgcctccctcctccgcccgtttcctcaagcgacaagaacccaaccactccgcgtcgtcgtctgctgccaatggaggaggagcgctgcttcaacaactgggatctggacgccgtcgtgcgcttgggctgccgccgcctcctctccccgtcgccgcagcccgacccgttcgcttcgtttctcccgccgccgccgcagaaggagaagcccgtggcgccagcgccggctaaagagccagagccacataccgcgtggcgcttccctgaccttggtgctggcggcgggcaagacggcgaagagctcctcagggccctgttagccgaccagcctcccctgcatcagcctctgccaacgccagcggcaacgccaacgccaacgccaacggcaacgcctcccccaccatcacaacagcagcatctacagccgactgtgacagccgtggacgtggctccaccccaggtgcgccccgctccggctagggcgcagccgagcgggcggcaggtgcccggtggcgtgccaagatccaagagaaggaagaaccaggtgaagaaggtggtctgccacgttccggcggacggctcgtcgccggacgtgtgggcgtggcgcaagtacggccagaagcccatcaagggctccccctacccaaggggatactaccgatgcagcagctccaaggggtgcgcggcgcggaagcaggtggagcgcagccgcgcggaccccaacactttcatcctcaccttcaccggggagcacaaccacgcggcgtcgacccaccgcaactcgctcgccggcaccacccgccacag

SEQ ID NO: 8148 - DNA, 868 bp, Zea mays
  Predicted polypeptide sequence is orthologous to G190
ccccactccatccatccaaatcagctttgcctagcttattattccttaccgacaaacaaaactgacacggatccgcacagagcaacgaactcgcccagtccggctgctgctgctgcacaacggactcgatctcacggccccgccggctcgcagccatgcagacgcagtcccgcctggccatgagcggcggcggcggcagcggcggcagcagcagcagctcggcctcggaggacgagcacgaggcggtgatccgcgagctgacgcgggggcacgagctgacggcgcagctgcgggccgaggccctacgcgcgctgcgcgggcagggccaggccgaggccaccgcggcattcatcctgcaggaggtgtcccgcgccttcaccgtctgcctctccatcatgagctcgcccgcccgcgccccgccgccgacgatggaaatgcccgcgcctgccctggccccgcgacggggccgggacgacagcatcccaagagagcaacggaggacgtcctcgccgcacagcgacgggtaccagtggaggaagtacggccagaagaggatcactaagtcgccgtttccgaggtgctactacaagtgcagcttccaccgcgagcgcagctgccgggccaccaagcaggtgcagcagtgcagcgacggcgacggccacccgccccagtacgtcgtcatgtacttcaacgagcacacgtgcgacacggcggcctgggagccccgcggcggcggcggcggcttcctcgggggtgcggctggacgacctgtccaggtccaggctgcaggcggtactaggccagggccagcagggcgctcgcgcgctgctgctggacgaacgcggcgtccaggaggagcacgagcgcc

SEQ ID NO: 8149 - DNA, 504 bp, Zea mays
  Predicted polypeptide sequence is orthologous to G197, G255, G664
ggggcggtcgccctgctgcgagaaggcgcacaccaacaggggcgcgtggaccaaggaggaggacgagcgcctggtggcctacatccgcgcgcacggcgaagggtgctggcggtcgctgcccaaggcggcgggcctgctgcggtgcggcaagagctgccggctgcggtggatcaactacctccggcccgacctgaagcgcggcaacttcaccgccgacgaggacgacctcatcgtcaagctgcacagcctcctcgggaacaagtggtcgctcatcgccgcgcggctcccggggcggacggacaacgagatcaagaactactggaacacgcacgtccggcggaagctgctgggcaggggcatcgaccccgtcacgcaccgccccatcgccgccgacgccgtgaccgtgaccaccgtctcgttccagcccagccccagcgccgccgccgcagcagcagcagaagccgaggcgacggccgccaaggcgcccagatgccccgacctcaa

SEQ ID NO: 8150 - DNA, 961 bp, Zea mays
  Predicted polypeptide sequence is orthologous to G197, G255, G664
ctgctgctagctagctggacaccgagagagaaagagagagagagcgagagatgggcaggagggcgtgctgcgccaaggaaggggtgaagagaggggcgtggacggccaaggaagacgataccttggccgcctacgtcaaggcccacggcgaaggcaaatggagggaggtgccccagaaagccggtttgcgtcggtgcggcaagagctgccggctgcggtggctgaactacctccggcccaacatcaagcgcggcaacatctcctacgacgaggaggatctcatcgtccggctccacaagctcctcggcaacaggtggtcgctgattgcaggcaggctgccgggccgaacagacaatgaaatcaagaactactggaacagcacgctgggccggagggccggcgccggcgccggcggcagcagggtcgtcttcgcgccggacaccggctcgcacgccactccggcggcggcggggagccacgagatgaccggcggccagaagggcgccgctcctcgcgcggacctcggctcgcccggctccgcagcagtagtgtgggcgcccaaggcggcgcggtgcacgggcgggctcttcttccaccgggacacgccgcacgcgggcgagacggagacgccgacgccaatgatgatggccggtggtggaggaggagaagcacggtcgtcggacgactgcagctcggcggcgtcggtatctcccctcgtaggaagcagccagcacgacccgtgcttctccggcgacggcgacggcgactggatggacgacgtgagggccctggcgtcgtttctcgagtccgacgaggagtggctccgctgtcacacggccgagcagcttgtgtagacaacaagtacacgtacggagtacaattatatatagccatgcgtatgtatacttttttcccttctccaatccaaacagaaatacgtatgcgtatgaaatagtatcgg

SEQ ID NO: 8151 - DNA, 927 bp, Zea mays
  misc_feature (430)..(434): n is a, c, g, or t
  misc_feature (651)..(692): n is a, c, g, or t
  misc_feature (821)..(870): n is a, c, g, or t
  Predicted polypeptide sequence is orthologous to G197, G255, G664
ccacgcgtccggtgccctataaaatccagccccgcttggcttcacccacccttgggctcgcagtcgcagcaacgatggggaggtcgccgtgctgcgagaaggcgcacacgaacaagggcgcgtggaccaaggaggaggacgaccgtctggtggcgtacatcaaggcgcacggcgaggggtgctggcgctcccttcccaaggccgccggacttgtgcgctgcggcaagagctgccgcctccggtggatcaactacctgcgccccgacctcaagcgcggcaacttcacggaggaggaggacgagctcatcatcaagctccacagcctcctcggcaacaagtggtccctgatcgccggaaggctgccgggcaggacggacaacgagatcaagaactactggaacacgcacatccggcggaagctgctgagcannnnnatcgacccggtgacacaccgccccatcaacgagcacacgtccaacataaccatatcgttcgaggactggggccaggggaaggcgctcaagtgccccgacctgaacctggacctctgcatcagcccgccgtgccaggaggaggaggaggccatgctgctgaggccggtgaagcgggaggaggccgggctctgcttcagctgcagcctggggctccccnnnnnnnnnnnnnnnnnnnnnnnnnnnnnnnnnnnnnnnnnnaccgccatgctcgacttcagaagactcgagatgaaatgagagcttccatccatctctgtctgtctctctctgtaacttcacccctgataacacgcagtagtagtagtcaccaactgatttgtcgcaacnnnnnnnnnnnnnnnnnnnnnnnnnnnnnnnnnnnnnnnnnnnnnnnnnntgtaaattagcatcaccatgggcaattaataatacttgttgctgctgcaaattgccc

SEQ ID NO: 8152 - DNA, 1372 bp, Zea mays; identical to SEQ ID NO: 1997
  Predicted polypeptide sequence is orthologous to G197, G255, G664

SEQ ID NO: 8153 - DNA, 129 bp, Zea mays
  Predicted polypeptide sequence is orthologous to G197, G255, G664
atcaactacctgcgccccgacctcaagcgcggcaacttcacccaggaggaggacgacgtcatcatcaagctccaccaggtcctcggaaacaagtggtcgctgatcgccgcccagctgccggggcggacg

SEQ ID NO: 8154 - DNA, 914 bp, Zea mays
  misc_feature (4)..(6): n is a, c, g, or t
  misc_feature (28)..(28): n is a, c, g, or t
  misc_feature (50)..(50): n is a, c, g, or t
  misc_feature (53)..(55): n is a, c, g, or t
  misc_feature (59)..(61): n is a, c, g, or t
  misc_feature (80)..(80): n is a, c, g, or t
  misc_feature (89)..(89): n is a, c, g, or t
  Predicted polypeptide sequence is orthologous to G197, G255, G664
ggtnnnggatggtagcctgcagtacggnccggaaatcttcctcagccgcncgnnngagnnngatatcccacaaaaacggngggagaggnagggagccatggggaggtcgccgtgctgcgattttgccacaccaacaagggcgcgtggaccaaggaggaggacgagcggctggtggcgtacatccggtcgcacggggaagggtgctgtcggtcgctgcccagcgcggcgggtctgctgcgctgcggcaagagctgcaggctgcggtggatgaactacctccggccggacctcaagcgcgggaacttcaccgacgacgaggacgagctcatcatccgcctgcacgccctcctcggcaacaagtggtctctgatcgccgggcagctgccgggccggacggacaacgagatcaagaactactggaacacgcacatcaaacgcaagctcctggcccgaggcatcgacccgcacgagcaccaccgcccggatgcgctgcaacacggggcagcaacaagcactcgacgcggaccccgccgcgaaaccgaacccaaaaccggaggagtcgtccaaagacggcgggagcgacaactgcaagtggaagaggaagcggcagcatcgtgggtggaaccgcggggccccaacactgaaccccacctggccgttaggcagaagggaagcgccatctgtggggagcccgacgtgcctggggcgccagaactggaaagcgggactgctagtaggaatgctgatggatagagcgagagagaagtcgcagaaagttctactaggcagagccaaacagggttcgggcgcagagagagggacacagtacgtcgagaacaggcgctgagaaaagggagggaagaagaacgcccgcagaactgtccaaggagaacaggaaaaaaagaggagctcgc

SEQ ID NO: 8155 - DNA, 737 bp, Zea mays
  Predicted polypeptide sequence is orthologous to G197, G255, G664
tggcgggcccacggacaggtcgaggttgaggtcggggcaccgcggctcctccacgctggcgccgccgccgctgctggcgctggcgctgctccggccgccgtcgtcggatgactccgccggcgccggcttcacggcgagctcgacgggggctgcgcctgcgcggtgcagcagcgcccggtgcgcgaccacgccgggtggcgcggcggcgtcggcgccggcgccgagcgggcggtgcgtcttcgggtcgatgccgcgggcgaggagcttgcgcttgatgtgcgtgttccagtagttcttgatctcgttgtccgtccggccaggcagctgcccggcgatgagggaccacctgcggggggtaagagaagagagcaggttcgttgtggcgttaggcgatcatcgaagcgcccggccgggagcattattgttgtattaaccgtatcgactaggaataggaacagcgacgacgagagctaatagagtaatagctagacagaaggacgccggcagcccggcacacgctcactgacttgttgcccaggaggctgtgcaggcggatgatgagctcgtcctcgtcgtcggtgaagttgccgcgcttgaggtccgggcggaggtagttcatccagcgcagcctgcagctcttgccgcagcgcagcagccccgccgccttgggcagcgagcgccagcacccctcctcgtgcgcccggacgtacgccaccagccgctcgtcctcctccttg

SEQ ID NO: 8156 - DNA, 849 bp, Zea mays
  Predicted polypeptide sequence is orthologous to G197, G255, G664
ctgttgtccacgaaaggctcgcactcgcgccggtcgttcgctgcagcacacaacgcaatcgccactgtcgtcgctcgtcagtccaccgactccaccgccaccggcagaaccagaacacatcgagcggcatcggagcgcgaatctgtgcggcggcgtcgcctctgccgggcgggtgggcggcatggggaggtccccgtgctgcgagcaggcgcacaccaacaagggcgcgtggaccaaggaggaggaccagcgcctcatcgcctacatcaaggcccacggcgagggctgctggaggtcgctaccaaaagccgcagggctgctgcggtgcgggaagagctgccggctgcggtggatcaactacctgcgcccggacctcaagcgcggcaacttcagcgaggaggaggacgagctgatcatcaagttccacgagctgttcggcaacaagtggtcgctcatcgccgggaggctgccgggcaggacggacaacgagataaaaaactactggaacacgcacatcaagcggaagctgctcgcccgcggcatggacccgcagacccaccgcccgctggccgcagcgccagcaggagggccgcagcagcagcattgccattaccagatggagccacagaagcgggcggcggcggcggaccattccgaggccgccgttgccaccaactcgccggaggccagcagccgcagcagcgacgacgacgaggcgccggcgctggcgccaccgccgcggcggcggcagcgccacctcgacatcgacctgaacctgtccatcagcctcgcggcctaccagccgccgggagggaaccggcagcgccatcgagccactgacggcgacga

SEQ ID NO: 8157 - DNA, 836 bp, Zea mays
  Predicted polypeptide sequence is orthologous to G197
cgggggcgtgcccgtcagagtgcgacggcgagctcgtgccagcgacgagctccgaccgccaagttaacgtcaccggccacggcacgcacgtcgtattgttcccattcgaaacagcgcaagcgtccgtcgggctagttagacgcgtgacgccgcgatctatgcgttagagtattcgcgaatcgcgacgacggcacagtttggcgagtgcggtgggttcttggcctccactggagtctgaagattcctccgataaggtcagatggcccagcggacgggattagtctaatccgatgcccgacggtactagttttcgcacatgcataattacaaggggaagggggcggctcaaagtcgcctctgcatgtcaccatgtgtgctattctttccaactttcaaagcagaactgtcgaaaagaaaacttggcagattcaaagttgcagaatgcaggctcgtctagatgttctagcttcctctcgtggccattttctatgagggaacttcaattattgcaacaagatggtcgtgcagccaattagaaaaatacagttgatattctttattccagctctgctcgttggttaggtttttacgctggaacctactatccaccaggttcgtttttggacgggtgaaaatgttctcgagaggtttgttgtcttcgactaactaacctatccagctcatcttctcttctcttgtcttcgagatgtgttcggagtgtgaatggacggtgtgttcaaagtggcgaaaaatgtggcgtaagcgtgcaagtgcaatttgtaatgtgtttcaagcaaaaataaaagaaaaaaatgtaactgagtttgattacattg

SEQ ID NO: 8158 - DNA, 129 bp, Zea mays
  Predicted polypeptide sequence is orthologous to G198, G1328
actaactatctgaggccggacatcaagcgcggccgcttctccttcgacgaggaggagacaatcatccagctccacagcatcctcggcaacaagtggtcagcgatcgcggcgcggctgcccgggcggacg

SEQ ID NO: 8159 - DNA, 129 bp, Zea mays
  Predicted polypeptide sequence is orthologous to G200
accaactacctccgccccggcatccggcgcggcaacttcaccccgcacgaggaagccatcatcgtccacctccagtccttgctcggcaacaggtgggccgccattgcttcttacctcccgcagagaacc

SEQ ID NO: 8160 - DNA, 129 bp, Zea mays
  Predicted polypeptide sequence is orthologous to G200
accaactacctccgccccggcatccggcgcggcaacttcacaccccacgaggaaggcatcatcgtccacctccaggccttgctaggcaacagatgggcggccattgcttcttacctcccacagagaacc

SEQ ID NO: 8161 - DNA, 759 bp, Zea mays
  Predicted polypeptide sequence is orthologous to G200
gtaggcagcagccagccacacagacacagcttcgttcccatctcttctcgttcttcatcacctacttgcctactatatctactagccacgctagctagactagccttagacgtggctagctcactagctgcttgctaggtgtgtaccgatcgtccgaggtaggagacacagcacgcagcaggggtatggggaggccaccgtgctgcgacaacggcgtcggcgtcaagaaagggccgtggacgcccgaggaggacatcgtcctcgtctcctacatccagcagcacggccccgggaactggcggtccgtgccagagaacacagggttgatgaggtgcagcaagagctgcaggctgcggtggaccaactacctgaggcctgggatcaagcgtggaaacttcactcctcatgaggaagggatcatcatccacctccaggcgttgcttggcaacaagtgggcagccatagcctcctacctccctcaaaggactgacaacgacatcaagaactactggaacacacacctcaagaagaaggtgaagaggctgcaacagccggcagccgactccttccagacaactgcctccaatgcagtcacctgcagcccaaactactacagccccagcagcagtcaccacagcctccaaggaatgcagccgatgagcagctacccccacaccacctgcagcggcggagccccaagcaacaatgaggcgatgactgatactactaccgccgtcgtcttccacctcttccaggcat

SEQ ID NO: 8162 - DNA, 878 bp, Zea mays
  misc_feature (736)..(736): n is a, c, g, or t
  misc_feature (811)..(812): n is a, c, g, or t
  Predicted polypeptide sequence is orthologous to G207, G227, G230, G242
gtcatagaagcggcgtccggatgatgaattacaccctgggcctgctagcagcagtagtgttgctgtagaggtgaagaaggggtcttggacccccgaggaggacgccctgctgaccaggctggtggagcagcacgggccccaccgctggagcctcatcagcgccccaatccctggccgctccggcaagtcctgccgactccgctggtgcaaccagctcagccccgacgtgcaccaccgccctttcacgccgcacgaggacgcgctcatcctcgccgctcacgcccgctacggcaacaagtgggccaccatcgcgcgcctccttcccggccgcaccgacaactccatcaagaaccactggaactccaacctccggaggtgcaggcgccgagcggcggcggcggcggtggcctcccgaccgcaggtgcaggacagcgacgacgctcctgctgctgctgctgctcatgatgatcagccggcggctgtggttgctgctggtggtttaggtggtggcaacagcagcagcggtctgccgcctgcagcagcaggggccgcaactgccgaggccgagccgtctctgtccctcagccttggcctcccgctgccagcagcagaaccagctgaagccgcggctgacgacgagagccgcaacagccagggccaggcatcgccgttactggaggaaggagaaggaaacgcgcagctgttggcagtggtgcgccggatggtcagggaggangtgcaacgccagacgggacagctcgcctactcgctcatgggcgcagcagcagccagaagcaagggacaccaccgnntatctgtgtgtgatccattgtgcatgctgctgctgctgctgctttctggatttccctcctttctcc

SEQ ID NO: 8163 - DNA, 877 bp, Zea mays
  Predicted polypeptide sequence is orthologous to G207, G227, G230, G242
ctcgtcgtctcgtcttctctaccaccaccaccactgctcgttttacagaaaccggaaggaaccaaacgcctttccgccccgggccgccgctacccaagcccagcaaccaccactcgttgtcgtcgactactaggcggcaagcaggcgtcctttttttttggtcctcgtcgtcgtccggactccggacaggacaggacatgggcgcggaggcggcggagcgcgacagaatcaggggcccgtggagccccgaggaggacgaggcgctgcggcggctggtggagcggcacggcgcgcgcaactggacggcgatcgggcgcggcgtgccgggccggtcgggcaagtcgtgccgcctgcggtggtgcaaccagctgtcgccaagggtggcgcgccgccccttcacggccgacgaggacgcggccatcgcccgcgcccacgcccgcctcggcaaccgctgggccgccatcgcgcgcctgctccccggccgcaccgacaacgccgtcaagaaccactggaactgctccctcaagcgcaagctcgccggcggcgccgtcgcgtccggttcggcggtttccgctgaagacgccgccgaggccgaggcgcgccggggcaagatgatgatgagcatctcgccgcccgacagcccctcggggtcggggtcggggtccgaccgtagcgacctcagcagccacggcgccgggtccgggtccgggtccgggtccggccagatttaccgccccgtggccgcgcgctccggcgggttcgagccggcggactgcgccatgagccgtccgcaggaggaggacccgctcaccgccctcagcctctcgctttccggcacggaacagcggtttcacaccacagcggcgccgccgacagc

SEQ ID NO: 8164 - DNA, 811 bp, Zea mays
  Predicted polypeptide sequence is orthologous to G207, G227, G230, G242
cccgactccacctctctccgatcgtctcatcttcttccttctcttccaccacatccttggcatctcatccggatcgaccagtacacgccccagtagtactaaagaaccagtttctgagtaaaacatggcggcgtcgccttccccgtccggcagcggcggcggcaaggccggcgtggaccggatcaagggcccctggagccccgaggaggacgaggccctgcagcgcctcgtgcgccgccacggcgcgcgcaactggtccctcatcagccgctccgtcccgggccggtccggcaagtcgtgccgcctccggtggtgcaaccagctgtcgccgcgggtggagcaccgccccttcacgcccgacgaggacgacgccatcctccgcgcgcacgccaggttcggcaacaagtgggccaccatcgcgcgcctcctctccggacgcacggacaacgccatcaagaaccactggaactccacgctcaagcgcgagcgcgagcgcaagcgcgagtactacgccgatgcgcgccccggccccggcgaccagcgctcgctcaagcgcaccagcagcgacgggccccccggaagcccgtccgggtccgacctcagcgactccagccaccagagccttcccaccgtgatgccgtcagccgcttctaccgccgtcacctcccagcagcagctacaacacgtgtactaccgccccgtgccgcgcgcgggcggcgtggtcctgctcccggtggcgccgccttctccgcaggctcctccagcaacctccttgtcgttgtccctctccctgccagggctggaccagcag

SEQ ID NO: 8165 - DNA, 826 bp, Zea mays
  Predicted polypeptide sequence is orthologous to G207, G227, G230, G242
ctgcagctggaacggcaagctcggttgggcttgtggtggcggcatctgaggtggagcaggctgctgctgctgtatctgaagaggaggttgaggcggtgccggtgccggcgtcagaaccgcttgggatgcttcgggcttctggccgtccagcccgggcagggagagggacagtgataaggaggtcgccggaggctgtggcggcggcggcggcgcaagaggcgccaccggtagcatgaccacgccgcccgcgcgcggcacggggcggtacacgtgctgctgctgctggtgggaggtgacggcggcagcagaagcggctgacggcatgacggagggaaggctgtggttgctagagtcgctgaggtcggacccggatgggcttccggggctgaagcagagccctgggtggccgtcgctgcttgtgcgcttcagcgggcgctcgtcgtcagcgtcagcaacaacagcgtcgctggcggcgtagtacttgcgctttagcgtggagttccagtggttcttgatggcgttgtcggtgcggccggagaggaggcgcgcgatggtggcccacttgttgccgaacctggcgtgcgcgcggaggatggtgtcgtcctcctcggccgtgaagggccggtgctccacctgcggcgacagctggttgcaccaccggaggcggcacgacttgccggagcggcccgggatggaccggctgatgagggaccagttgcgggcgccgtggcgggccaccaggcgctgcagggcctcgtcctcctcggggctccaggggcccttgatccggtccacgtccgacttgccgccgcttgcacggcaggac

SEQ ID NO: 8166 - DNA, 912 bp, Zea mays
  Predicted polypeptide sequence is orthologous to G207, G227, G230, G242
ctcctccactacccacccgcctgcccgcccgccttctcctccaccactgccccgccgctaaccaaccactcgtgcgccacaagtctcccgtcgtggaatagggcaaaggccaggcatctcgcttctgtcctctgtcgaggggatcggacccgatcggagaaagaatgggctcggaggcggactgcgacaggatcaggggcccgtggagccccgaggaggacgacgcgctgcggcggctcgtggagcggcacggcgcgcgcaactggacggcgatcgggcgcgagatcccggggcggtcgggcaagtcgtgccgcctgcggtggtgcaaccagctgtcgccgcaggtggagcgccggcccttcacggcggaggaggacgcggccatcgtccgcgcccacgcccgcctcggcaaccgctgggccgccatcgcgcgcctcctccccggccgcaccgacaacgccgtcaagaaccactggaactgctcgctcaagcgcaagctcgccgccgcgtccgccccggcgggttcctccgacgtcgaggcgcgcccgaccaagcgcgtcagcctctcgcccgacagcccgtcggggtcggggtcggggtcagggtcagggtccgggtccgggtccgggtccgaccgtagcgacctgagccacggcgccggccaggtttaccgcccagtggcgcggtccggcgggttcgagccggcggactgcgcgatgagccgtccgctggaggaagaggaggaggaaaaggaggacccgctcacctccctcagcctctcgcttccaggcacggaccagcggttccaccacgaccgcgcccacagccagttccaggagctcccggcgtcgccgccctcgccctccccgcctccgccgccggttctctcggcgtacccgttcagccccgtgt

SEQ ID NO: 8167 - DNA, 129 bp, Zea mays
  Predicted polypeptide sequence is orthologous to G208
atgaactacctccgcccggacctcaagcgcggcaacttcacggacgacgacgacgaggtcatcatcaagctccacgccctgctcggcaacaagtggtcgctcatcgcggggcagctgccggggcgcacg

SEQ ID NO: 8168 - DNA, 689 bp, Zea mays
  Predicted polypeptide sequence is orthologous to G208
gaattccattgtgttgggcggaaacaagtggtcgctgatcgccgcccagctgccggggcggacggacaacgagatcaagaactactggaacacgcacatcaagcgcaagctcatcgcccggggcatcgacccacggacgcaccagccggcgagtgccgccgcagttgcccccgccgccgccgccgccgccgccgcgcaaagcagctttcgccaccatggcgacgacgaggcggtggcgcggcgcagctgctcgcgagacagcggctgcatcgcggcgcacagcagcgacgacgacgacagcacgtccgggtccctgccacaccaacatgctgtcggcggcatcgacctcaacctctcgctaagcccaccgacgagccaaccgtcatcgccggccgccgccaagggagttgtagctagcggatatggccaagggagtgagagctagctgtacctcctctgcactgccacgatgatggttgtcaattgttgttagctcctcctcctcgtcttatgttcttccatgcaggccggaagatcctaaagagaacgtgtgcgtgcgtgtgagaattaaactcgtgtctgttgttcgatcgggcgctctaagatttggccatgccccatgcatgaggaaccctgcagggccctcctactttttgagactcaaaaaaaaaaaaaaaaaatcggagcgg

SEQ ID NO: 8169 - DNA, 1466 bp, Zea mays
  misc_feature (1392)..(1392): n is a, c, g, or t
  misc_feature (1406)..(1406): n is a, c, g, or t
  misc_feature (1418)..(1418): n is a, c, g, or t
  misc_feature (1425)..(1425): n is a, c, g, or t
  misc_feature (1444)..(1444): n is a, c, g, or t
  Predicted polypeptide sequence is orthologous to G214, G680
ccacgcgtccgctgcctgctcacttccgttccgtagtccagctagatccccgggcaaccgatccaccgagaagcttgtggttgtggcggcggcggagagggaagcggggagcgggaggtcggaggcctccgtgcgtcggaggtggacgagggagcgaggcggcgccagaccgaggttgcgtcgggctcgatttctactgggctgctgtctgctgagtttacggaagtgtttggccctagaagagttgaagataaggagtggagctaggtttaaactctggtgacttggttgttgtgtgcaacgaatcaactatgctgagtttttctgtagagtaacagaaattggatcaattcaagtagaggtctaggaggagatatgaggtactacttgcgtcaggtccagcgtttggttggagatatggaaggaggagctctcttgtttatagacgacctcaactccaagtgacaaagcgaacagctgttgaacgtttcccttctatttctgtttctttttgccggatttggagatggaggtgaattcctctggcgaggaaactgtggtaaaggtaagaaagccgtacacaataacgaagcagcgggagcggtggacagaggctgaacacaaacggttccttgaagccttgaaactttatggcagagcatggcagcgcatagaagagcatgttgggacaaagacagccgtgcagatcagaagtcacgctcaaaagttcttcactaagttggaaaaggaagctatgaacaatggtacttctccggggcaagcccatgacattgacatacctccaccacggcctaaaagaaagccaaacagtccatatcctcgaaaaagttgtctcagctccgagacacaaaccaaagaacttccaaatgacaagtcaacaaaaccaaatatgcccttgagcaatgggcatgtaaaaatggtaggcgatgcatctcttcagaattttcaaaggaaggagttgtctgaaaaaggaagtcgctcggaagttcttaatctcttccgtgatgccccatctgcatcattttcttcagttaacaaaagctcttcaaatcatggggcacccaggaggaccgaggcaagtaaaacagaaagccgagatatgtccatcatggaaaataattcttttaaccccaacacccaagaggatgtaaaggtgatcagtgatcaggaaatggaaaggcttaatggtatccagatcagatctaaatgtgaacattctcatgaggggtatttggacatctcaacgcaacaaatgaagctaatgccaaagtctgtggagacaacatatgtggatgaacaaactgcaagagcttcacacaccctagcagagagcaacggggacagctagcgttccagtgactgtacctgaanggactccatcctgntcaaacaagtgntccagtngggatccatgggagcatgnacccatggatccatcccatggt

SEQ ID NO: 8170 - DNA, 804 bp, Zea mays
  Predicted polypeptide sequence is orthologous to G214, G680
gatttctcgcggcgctcgccgcgagagcgacccccacaggtcgccgcccctccgcggcccgcgcagcgcacagcatacagtcagcacacgcagcagctgccaccacagcgaacagcaaagcacctccgactcggagtcgcggcgagagccgagaaccttctcattcatcttcctcttctatccatcctgcctgcctgcttgcctccgtattccagctagatctccgggcagccgattgaccgagaagtttgtggttgtggcggcggcggagagggaaacggggagcgggagggcggcgcggatgccactgctgcgccggcgccggcggggccggtgatgcccgccgtggcggtcgcttgaggccgccgtgcgtgggaggtggacgggggagcgaggcggtgcggaccgaggttgcgttgggttggattcgattgggctgcgtctgctgagagtaaggacaattggatcaatttaagtaggtctgggcacacaaatttgaactattaacgcattgggagtgcttgtgtgttagaggtctaggaggagctatgaggtactacttccgtcaggtccagcgtttggttggagatatggaaggaggagctctcttgtttatagatgacctcaactccaagtgacaaagtgaacagctgttgaacttcccgtctatttctgtttctttttgctggatttggagatggaggtgaattcctctggtgaggaaacggtgataaaggtaaggaagccatacacaataaccaagcagcgggagcggtgaacagaggctgagcacaaacggttcct

SEQ ID NO: 8171 - DNA, 3188 bp, Zea mays
  Predicted polypeptide sequence is orthologous to G217
gcggagtccgccgctccgttggacttagggtcgccggaccccctccagggctagcggcggaggaagtcggaaaccgattacccctcccctccccttaccgggggagggagaaactagcggaggaggcgaatcaggtcagagtggggcacgatgaggatcatgatcaagggaggcgtgtggaagaacacggaggacgagattctgaaggcggccgtgatgaagtacggcaagaaccagtgggcgcgcatctcgtcgctgctcgtccgcaagtccgccaagcagtgcaaggcccgctggtacgagtggctcgatccgtccatcaagaagaccgagtggacaagggaggaggatgagaaattacttcatcttgctaaactcatgcctactcagtggaggacaattgcacctattgtaggtcgaacaccatctcagtgtcttgaacgttatgaaaagctgcttgacgccgcatgtgcaaaggatgaaaattatgaggctaatgatgatcctaggaagctgcggcctggcgagattgacccaaaccctgagtcaaagcccgcacgtcctgatcctgttgatatggatgaagatgaaaaagaaatgctttctgaggctagggcccgcttagctaacactaggggtaaaaaggccaaacggaaggcaagggagaaacaacttgaagaagcaagaaggcttgcttcactacaaaaaaggagagaattgaaggcagctggtattgatacacgccacagaaaaagaaagagaaaggggattgactacaatgctgagattccatttgaaaagagaccaccttcaggtttttatgatactgttggtgaggacagaccacctgaacatgtacagtttccaacaaccattgaggggcttgaagggaagagaagagcagatatagaggcacaattaagaaaacaggatattgccaggaacaagatcctgcagcgacaggatgcccctgctgctataatgcaagcgaataaactaaatgatccagaagctgtcacaaagaggtcaaagctaatgctgccgcctcctcaaatttctgaccacgagctagaggagatagcaaagatgggcagtgctggtgatcctgctttagctgatgagcttggtgaaggaagcactgccacaagaaccttgcttgccagctattctcagactccaaggcttggtatgacaccattgcgaactccgcagcgaactccagctgggaagggtgatgcaatcatgatggaggcagaaaatcttgcacgtctcagagaatcacaaacgcctctattaggaggtgataacccagagcttcatccatcagatttctctggtgttacaccacgcaagaaggagatacagactccaaatccaatggcaacacctttagcaagccctggccctggtatcactccaaggattagtatgacaccatccagagaggggcacagctttggtttaacaccgaaagcaactcctcttcgtgatgaacttaacataaatgaagtggaaatgcaggacaacactaaacttgagcttcgtaggcaagccgaactgaggaaaagcctgcgatctggttttgcttctattccacaaccaaagaatgagtaccagatagtcatgccacctattacggaagatgagaaagaagaagctgaagagaaaattgaagaggacatgtcagacagactggcacgagaaagggctgaggaacaagctaggcatgaggcattgctcagaaagagatccaaagtgttgcagaggagtctgcctaggccaccggctgtttcagtagagattatccggcaatctcttattagaagtggagaaagcagaagcagaagcacctttatgcctcctacatcacttgaacaagctgatgaactaataaatgaggaactccttaggcttcttgagcatgataatgcaaaatatcctcttgatgaaaaaactcaaaaagagaaaaagaaaggaagcaagcgtcagcaaaatggaggacctcttgtccctgaaattgatgattttgatgaagatgaactaaaagaggctagctctatggttgaagaggagattcaataccttcgagtggccatgggtcatgaaaatgaatcttttgaggacttcgtgaaagcacatgatgcatgccaagacgaccttatgttttttcctaccagcaatagctatggtttagctagtgtggctggaaatgctgataagatttctgctttgcaaaatgagtttgaaactgtgaagaagcgaatggatgatgaagctaagaaggcttctcggcttgagctgaagattaagcttctgacacaaggatatcagatacgggctggaaaactgtggtcacaggtccaagatacattcaagcagatggacactgccgcaacagagctcgaatgcttccaagagctgcagaaacaggaacatctcgctgcttcatatcgaatccaaaatttgtctgaagaagtgagtaaacagaaggcactagaaaggaccctccagagccgctacggcgagctggtttctggtttccagaggatccaagaacaggtcgaggagcacaagaggcaactcaaggtacaagaggcggtagaagccgaaagtcacgctcaggaagaggaagctgcggcatcaaatcatgctgctgctgaggaagaggatgaaaggaaggaagatgatgaaaggaaggaagaggatggaagcaagtctctcagctctgaagagaaaccacagcagacaagtacggctaccgatgaagaacctgcaggaagcaaaggaaccaccgaggatcagatggacgtggacagcgggaatggagagggtggagttgtaggccctgtcccaccagcaccagacactgaagggggtaatgacgaagtatcggttcaagagatcagtgaagcccagcccttgccttgaagacggcgctcctttcccttaaagctccgctttcttctcccgcacctggcgatcttcacgatgttgttgttgcacagcaggtccggactgagtatttcctatttagttctatttttagtgcactataatatcacaagcgaagctacaattggttgtgagctatattggcatatccttccctttgttgtattcccttgaacaatgaatcataacaactgtttaccatttttctaaaggatcgactgcttatgtactcatgc

SEQ ID NO: 8172 - DNA, 298 bp, Zea mays
  Predicted polypeptide sequence is orthologous to G222
acccgacgccgatcggcgccttcgccgcaggcacccagttcttcccttataaccctagaacctagctcactactactagtatctacatattagctagctttgctgcttccattattatggctatcgatcgatcctagtagtagcttaattccttgatggttccatttacttcctccaagttccaaattaaagatgatgatgatgagcatgaactaagttgtcgtcattgtcgtcgtcctcgggattagcaaacaaattcgagacaaacgcgaagataattttattgttactagttctt

SEQ ID NO: 8173 - DNA, 841 bp, Zea mays
  Predicted polypeptide sequence is orthologous to G222
gcggcgccggcggctctgcatgcgcgcgccctgcggaaactgatccatgatctgatcccacggcaccagcagcaacggccgaccgccgggccggccggccggcgcgcacgcacggtgggcgcgcgcgcggtgccaaataaagagcttagagccgccggccgggatctatggggcgcgaggcggcagccacgaggccgcccaagctgcggaggggcctgtggtcgccggaggaggacgagaagctgtacaatcacatcatccgatatggcgtcggctgctggagctcagtcccaaagctcgctggcttggagagatgcggcaagagctgcaggctgagatggatcaactacctgcggcctgacctcaagaggggcagcttctcccagcaggaggaggatctcatcgtcagcctccacaagatactaggcaacaggtggtcccagatcgcgtcgcagctgccggggaggacggacaacgagatcaaaaacttctggaactcgtgcatcaagaagaagctccggcagcagggcatcgaccccgccacccacaagccgctcaacgacgacgacaacgctgctgctgctgctgctgcggacaacgacgccgccgtggcgccgcaccaccatcgtcgtcatcaggacgaccactgcggcgccgccaatattgataataataataataacaacaacaacaacaacaatcggcagctcccctcagccgacgaccactgcttcgccatgagcagcgacgaccctctcgcgccacactccccgaccgtcagcttcgacccactgtccgtcaccaacgtccccacgggcatgcaacagggctcctacggctc

SEQ ID NO: 8174 - DNA, 1802 bp, Zea mays
  Predicted polypeptide sequence is orthologous to G229
agccagcacagcacacacactggaaagtgcaagctgtagtgagacctgcgcgactgccagcgtgtatccgcgcggcaaggagcgtagcgccggtcgtcggcccgcacggccaccaactcccttggacgcacgcgcgaccagctgctaaccgtgcgcaagtagtagtgcgacttcgccgccggccgggatcgctagctcgatcgatcggcgggaccacatacgactccggtgtggccagcggcggccgggccggggaacgcacgtgctgcgagcgagcgagggcagacgctagctgttgccgggagctagccggcgcgcgatggggaggacgccgtgctgcgagaaggtggggctcaagcgagggaggtggacggcggaagaggaccagttacttgccaactacattgcggagcacggcgaggggtcctggaggtcgctgcccaagaatgcaggcctgctccggtgcggcaagagctgccggctccggtggatcaactaccttcgggcggacgtcaagagggggaacatctccaaggaggaagaagacatcatcatcaagctccacgccaccctcggcaacaggtggtccctgatcgccagccacctccccggccgaacagacaacgagatcaagaactactggaactcgcacctcagccggcagatccacacgtaccgccggaaatacaccgccgggcctgacgacaccgccatcgccatcgacatgagcaagctgcagagcgccgacaggcggcgcggcggcaggaccccgggccggccgccgaaggctagcgccagcaggaccaagcaggcggacgccgatcagcccggcggcgaggcgaaaggcccggccgcggcggcgtcgagcccgcggcacagcgacgtggtgaacccgggcccgaaccagcccaacagcagcagcggcagcacgggcacggccgaggaggaggggcccagcagcgaggacgcgagcgggccgtgggtgctggagccgatagagctcggggacctagtctggggggaggccgacagcgagatggacgccctgatgcctatcgggcccggcggcacgactcggctgccctcgaagggcttggcgcggtcggctgcgaggcccaggtggacgacctgttcgacatggactgggatggcttcgcggcccatctgtggggcgggccggagcaggacgagcacagcgcgcagctgcggcaggccgccgagccgctggaagttgctgctgctgctgctgctgcgacggcggcccgcaccccggacgatcgcgagctggaggcgttcgagacttggctcctgtccgactcgttctgacggctccggtcaccggaccgatcagacagaccaaataattgggtcacgtgtgctcgctcgctcgctgccgtcgcgtgggtcttggttcagatggccaaataattgggaaaaaaattctacggccagggccgtaaagccaccaccgtgcgctcctgatgtcgatgcctgccgcgtggagctcttgcgtatctaacgctcccacgacaatcacccttccagacggctcgaattacatacgacaggatcggctccgctctactccgttctgttcgcttctgctttaggtgcgtgcctagcagatggtgaggcggcgtcgcgcggccctcccgacggctcgccggccgcgctacggggcctgctgcagcagcccctcctccacgcctgtaaaagagctttgtatttacctgtttgtttgtgcttttgtgcaatggaataaacaatgatattatactgaataaacatgaatgttctgagac

SEQ ID NO: 8175 - DNA, 240 bp, Zea mays
  Predicted polypeptide sequence is orthologous to G229
cgttgctgtcgcgccgcgttagcaaccagccgcgtctgccacaggtcgtggctcgcttctcccctgcttttccgcgtccccgcagcgccgacgacgactgggtgcgcagcgcggcgccgccgttctacgccgggcgcccaagtcctcgacgggaccttctctggcgacgagcgccccaccaggccctaagctcatatgagcacggagcatcaatgcaagctaataaacccgacagcaacg

SEQ ID NO: 8176 - DNA, 1038 bp, Zea mays
  Predicted polypeptide sequence is orthologous to G229
atggggagggcgccgtgctgcgagaaggtggggctgaagaaggggaggtggaccaaggaggaggacgaggtcctggcgaggtacatcaaggagcacggggaaggatcgtggaggtcactgcccaagaatgccgggctgctgcggtgcgggaagagctgcaggctgcggtggatcaactacctgcgggcgggtctcaagagggggaacatctcggaggaggaggaggacatgatcatcaagctccacgccacgcttggcaacaggtggtccctgatcgccggtcacttgcccggtcgaacagacaacgagatcaaaaactactggaactcgcacctgagcaggcgggcggccgacttccgcgacggcgtcgtcgtcgacatcgacctcagcaagctgcccggcggcgggaaacggcgcggcggccgggccagccggggcgccgtcgtggccgcggccaaggagaagaaggccaaggagaaggacgacaggggcaatagcaaggtcgcagaagcggagcagcagctcagggacacggaggacgacgacggcggcagcgtctccacgccgaggcctcagtctgatgactgcggcaccgcccagagcgaagaggagcaagcgcaggccagcgccagcggcctgacatccgatgggcatgggcccgaggaggaggaggaggaggacccgctggctctgagcgaggagatggtgagtgcgcttctggccccggaaagcccaaagctggaggtgggccccgatggctcgtgcatggacagctacagtggccctccgtcaggggaaagcggctgtgggtccagtgggccttctggcgacgtggcccaggacctggacctagacgacgacaaggccatcatggactgggacttgatggggctggacatctcgaccgccggtgacatgtgggaccagctggtgtgggactacgacgaaacgttggtcacggaaccggaaggaggggaggaagggcaccagcagcaggacgatgtcatgtcagacctcttcttcctggacaatctctag

SEQ ID NO: 8177 - DNA, 129 bp, Zea mays
  Predicted polypeptide sequence is orthologous to G231, G2007
actaactaccttcgccctgacctcaagcgtggcctactcagcactgccgaggagcagctcgtcattgacctccatgccatgctcggaaacagatggtccaagatcgctgccaagttacctgggagaaca

SEQ ID NO: 8178 - DNA, 1417 bp, Zea mays
  Predicted polypeptide sequence is orthologous to G231, G2007
gatagccgcaaccgtgagaggctggtagcccgtagccggcatccctcgccctcgacccatttgaacagggcctcgagctttgcctctgctgctgctcgcttgatccgtctcttgccgtggtacgcgtgctcgatcggcggatcgtcggcggcggcggcgggaagctctccgacccgcggccgggatgggtcggcagccgtgctgcgacaagttgggggtgaagcgggggccgtggacggcggaggaggaccgcaagctcatcaacttcatcctcaccaacggccattgctgctggcgcgcggtgcccaagctcgccggcctgctgcgctgcggcaagagctgccgcctgcgctggaccaactacctccgcccggacctcaagcgcgggctcctcacggacgccgaggagcaggtcgtcatcgacctccacgccaagctcggcaacagatggtcgaagattgctgccaagctaccgggcaggactgacaacgagatcaagaaccactggaacacgcacattaagaagaagctgatcaagatgggcatcgatccagtcacgcacgaacccctcgaccggaagacaaccagcagcggcccggctacaacctctcagtcaaccaagtctgacgaggcgaccaaggagcagagcccgcagaacgacgacgccgtgataagggacgtgccggccgatggttgcagcccgacggaatcgagcacgaacaccgtgagcaccggcggaagcagcagcagtggtggcggcggccatgaccaagacccgctggtgaagtggcttttggaagaggagcctgccaccggcgacgaggcgtggctgaacttcactggcagtgtcgacgtggacgagttcagcagcattgccgccggtccggagttgttgccgtgggatggcgcgaccgactggctgctcgactaccaagattttggattgggggactcgagcttggtcgatggctacatggtcaacaacaacagctcaaacggagcaaagttctagctagctagccgaagatgtcatctcatctgcttgtgttgctttgctgccagtgaacgtagatacgtaagtaataaaagcattggtatcgaggttgtcaaaggtggatgaccacatcgcaggaagatcatgaagagtccttgcacgcactcctgtatctcgaaccaactaacggctgggatgcaattgagaaggggaggagcacaggccaatcaatctcaaagagataaaactggttcttgaagatctcgaagaaagatgtgtttcttcacaatcacaaagagaggttgtagaagttcttgctgttgtatacatggttgcgtatatattgctaaattgtaccttgttaggccattttgttcgcaaattgcacgagtcactaattagtcagcaaaaaaaaaaaaaaaa

SEQ ID NO: 8179 - DNA, 879 bp, Zea mays
  Predicted polypeptide sequence is orthologous to G231, G2007
cgctgccatgggacccacggaatccaacctcacccgccggctgccgctcggctgccctccggcctccgggcatcgccatcggagtgtgcaggaaccaggaggaggccggtagagtccgtgcacccgggtcccactcccctgaggccgtccgtggctccgtgcaagatggggattgcgcaagggtgcgaggtcaccatccccgcgcctggtcatcagtagtttggtggctcacagcatatataaaatgcaatataagcataccgatagccttgttaactcagtggttaatctagtacaagttgccagctgatagtaaattgatcaatggggagacagccgtgctgtgacaaggagggggtgaagcgagggccatggacagcggaggaggacaagaagctcattagcttcatcctgacacatggccggtgctgctggcgggcagtgcctaaacttgcagggctgcttcgttgtggcaagagctgccgtctgcggtggactaactatcttcgccctgacctcaagcgtggcctcctcagcactgccgaggagcagcttgtcattgacctccatgccaagctcggaaatagatggtcccagatcgctgccaagttacctggaagaacagacaatgagatcaagaaccactggaacacgcacatcaagaagaagcttatcaagatgggcatcaacccggccacgcactagcctctagccaactccaaggcagctccctcacactccacaggtacagacgaatccgctaaatccagcgacaccagagaggagctgagccctggaagatgacaccatcatagggaggttccgctgtccaccgattcatcggagcagtccagctggccagagccaggcagcaacgtc

SEQ ID NO: 8180 - DNA, 775 bp, Zea mays
  misc_feature (24)..(24): n is a, c, g, or t
  misc_feature (618)..(618): n is a, c, g, or t
  misc_feature (636)..(636): n is a, c, g, or t
  misc_feature (657)..(657): n is a, c, g, or t
  misc_feature (735)..(735): n is a, c, g, or t
  misc_feature (745)..(745): n is a, c, g, or t
  Predicted polypeptide sequence is orthologous to G233, G241
gcgagctcgggaacaggtggtcangcgatcgccgcgcagctgccggggcgcaccgacaacgagatcaagaacgtgtggcacacccacatcaagaagcgcctggggggcgacgacggcggcggcaccggcggacggcaggagaagaaggcgcgcaaaagcaggaccaggaccgccggcgccaccaagagaccagccgccgacgtggacagcagcgagcggcagccggcgtcgccggggcagtcgagcagcgtgagcagcggcgtcacgttctccgccgcggccgtgtcgtcgtcgcccgacaacgcggccgccaccagccgccaggaggagcagctgcaggtcggcggcgccggcaaggcggagatggagatggagatggagatggagagcttcagctccgccgagttcccggccatcgacgacagcttctggtcgtcggcggacgtcacggacctgggcctttgcgccatggacggggatgagctgggcatcgccggcccgccctcgtcgtccaccagggaccaggacatggagttctggctcaagatgctgctggaggccggcgacatgagggacttgagcgtcttgtaactagaatgcagaaatcaaacttattangggcctggttacatgcangcaggattagactagacatcnattttctttttctttattttctcctgcatcttgttccccattttccgtgaccagaaatcttggcaacgtactcatcgncggtgaatcnccttcaaaaaaaaaaaaaaaaaaaaaaaaa

SEQ ID NO: 8181 - DNA, 129 bp, Zea mays
  Predicted polypeptide sequence is orthologous to G233, G241
atcaactacctgcgccccgacatcaagcgcggcaacttcagccgggaggaggaggacgccatcatacagctccaccaaatgctcggcaacagatggtcgacaatcgctgccaggctgccggggaggacg

SEQ ID NO: 8182 - DNA, 129 bp, Zea mays
  Predicted polypeptide sequence is orthologous to G233, G241
atcaactacctgcgccccgacatcaagcgcggcaacttcacccgcgaggaggaggacgcagtcatccaactccaccaaatgctcggcaacagatggtcggcaatcgctgccaggctgccggggaggaca

SEQ ID NO: 8183 - DNA, 784 bp, Zea mays
  Predicted polypeptide sequence is orthologous to G233, G241
gcacgaccaggacactgctcccgtccccgaaagacaaacaggcaagcagcaaagacacgcctccctgcctgcactccccacacgcccacacctccaacagacaaagacaatctagcaagcacacacagcatcaggaggaggagatcgagtacgggtttgaagcagagaatggggagggctccgtgctgcgagaagatggggctcaagagggggccatggacgccggaggaggacaagatcctggtcgcgcacatccagagcttcggccacagcaactggcgcgcgctgcccaagcaagccgggctgctgcggtgcggcaagagctgccggctccggtggatcaactacctgcgcccggacatcaagcgcggcaacttcagcaaggaggaggaggacgccatcatcaccctccacgagcagctcggcaacaggtggtccgccatcgccgccaggctgcccgggcggacggacaacgagatcaagaacgtctggcacacgcacctcaagaagcggctggagcccaccaccaagcagctggagcaggagcagcacggggcgcatgcaggtggtggcgccgccaggaagcgcagcaggcccaagcgcgcgggtgccaggaagacgacgacggccgccgtcgccccggccaccaccgcgccggcgtcgcctgaacggtcggcggcctcgtcgtcggtgaccgagtcgacggagcaggagcagggaaacacggggacgagctcgcccgggtcccccaaggaggagagcttcacctcgtcctcggaggccg

SEQ ID NO: 8184 - DNA, 806 bp, Zea mays
  Predicted polypeptide sequence is orthologous to G233, G241
tgcaaatctgccccggcggcgacggcgaccctccctcccactcgctttccccgctccctcctggcctgcccataaatagccccccgccgaggacacgggacacagcccgtccccgtcgtgcttcaattcgccactctcctggcccctgctgccgtcgccggcttctacagctactagcagctcggaggaccgggagcagctcccaacacccgcggagccagccagccgcttgcgcttggacccccgatcgatcgtctcgtcgccgcctgcccgggcggccgatggggagggcgccgtgctgcgagaaggaggggctgcggcggggcgcgtggagcgccgaggaggaccagcgcctggtggcctacgtccggcagaacggccaccccaactggcgcgcgctgccacgccaggccggcctgctccgctgcggcaagagctgccgcctccgctggatcaactacctccgccccgacatcaagcgcggcaacttcacccccgacgaggaggccctcatcgtccgcctccaccgcgagctcggcaacaggtggtcagcgatcgcggcgcagctgccggggcgcaccgacaacgagatcaagaacgtgtggcacacccacatcaagaagcgcctggaggacggccacggggaggagaagaaggcgcgcaaaggcaagcccgccgccaagaaggccgccgacgccgtgggccgcagcagcgagcacgggccgttcctgaccgcgtcgccggggctgtcgagcagcggcgtcacgttctccgccgcggcggactccgccgcggccgtgtcgtcg

SEQ ID NO: 8185 - DNA, 606 bp, Zea mays
  Predicted polypeptide sequence is orthologous to G234
tttcggggcataaacacaccgcccgcccagcagaccgtcatcgtcgtgactaaccaagtctagctaggccctaatcagcacttgttcgatccaccgctcgctcacaagtgaagagagagccgccgccccagccccagagcagctcagagacctcaagagtcaagaggggagaaataaaggaagacgacgacgacgtacgtacgccatcgccatggggagagctccgtgctgcgacaaggctactgtgaagaagggcccgtggtcaccggaggaggacgccaagctcaagtcctacatcgagcagaacggcaccggcggtaactggatagccctgccgcagaagataggtttgaagaggtgcggcaagagctgccgcctccggtggctcaactacctccggccaaacatcaagcacggcgggttctcggatgaggaggacatgataatccttagcctctacatcagcataggcagcaggtggtcgataatagcggcgcagctgccgggaaggacggacaacgacataaagaactactggaacacgaggctcaagaagaagctcttcggcaagccgtttaaaaaaggtattcggcagggttccttttt

SEQ ID NO: 8186 - DNA, 129 bp, Zea mays
  Predicted polypeptide sequence is orthologous to G237, G1309
atcaactacctgcgccctggactgaagcgtggaatgttctcccaggaggaggaggacgtcgtcatcgatctccaagccaagctgggcaacaagtggtctcagattgcgatgcatctgccggggaggacc

SEQ ID NO: 8187 - DNA, 637 bp, Zea mays
  misc_feature (579)..(579): n is a, c, g, or t
  Predicted polypeptide sequence is orthologous to G247
ggggacgacgccggagaccgacggccgtgcgtcctcgctccttgtgcgctgcgttcgcctccacagcttctgcaggttcatccaacaccttatgaccattttttcttcctcagtagcgcaaaccagtatctacgattttccagtctatcgatcttcgcggccgtcaatgtcgccctcgtcctcgctcttctccctaacccagatgatagggagtcagcccgtgcctgaagctggttcatccaacaccttattattgccttttcttcttcctcagtagtgtgtaccggtatctgtggttttccaaagtctcgaatatttgccgccgtgaatgtcgccttcgccctcgctcttctccttaacccggacgagaggaagtcagtccatgtcggatctgaatgatggagctgcgacaaggcgaagggcggaaagctcacatgtctcctactgctattggaagcgagctgttgctggtgtgcaccatgcgcgcaaaatgtccgatcaaatgcctaaaataaatatttgggaaaaaaaaattttagaaaaaaaaactcccaatttccagaaaaaggggctggaaanggaaaattttttttaaaaaaaaagcccccttttccccatcccaaaaaaaaaaaaaaaa

SEQ ID NO: 8188 - DNA, 129 bp, Zea mays
  Predicted polypeptide sequence is orthologous to G249, G1322
ctcaactacctgaggccgggggtgcggcgcggcagcatcacggcgggggaggacacggtcatccgggagctccacgcgaggtgggggaacaagtggtccaagatctccaagcacctccccggccgaacc

SEQ ID NO: 8189 - DNA, 129 bp, Zea mays
  Predicted polypeptide sequence is orthologous to G249, G1322
ctcaactacctccgccccggcgtgcgccgcgggggcttcaccccgcgggagcagctgctcatcctcgacctccactcgcgctggggcaaccgctggtccaagatcgcggcgcacctgccgggccgcacg

SEQ ID NO: 8190 - DNA, 1246 bp, Zea mays
  Predicted polypeptide sequence is orthologous to G254
gcacccgtgtacgtgcctgaaccgtgattaggcctttttccttttacttgctctcaaaagcttttcccctcccctttctctctctttatccttttggtgacatcttgttgggtttcaactctagcctactccaacttgcttgggactaaaaggctatgttgatgttagatccatcttctgtttgcatatcataaccataatgggtccttcaaattttaaatgtggtcttaatgctttgattggtaagggtctacaggctcttatttccttgctacgtcacagtggaaatgggatccttaccctgatactttgtattttcgtttggaggtagcattgatattgtcaactgtagctgtgtcacgtgtgcccccttagaccttgttcggttattttcaatccatatggattggaggggattgatacggattgagagggattttgacttaatagggattgaaaccccctaatccctctcaatccatatgaattggggtagaaccgaacaagcccttattcttcagattcatactgacaactttctcccctccctattctggtgaaacatgcagccatgccagactttgctcgtgtatacaacttcctgggaagcatatttgatccaaagacaaatgggcatttgcagaagttgaaggaaatggatcccattgatgctgaaacggtactgttgctgatgaaaaatctgtcaatcaacctaactagtccaaactttgaggagcataggaggttgcttttttcggaagcctcaaaaagcatggatcaaaagtcgggcttttcccgggttcatctcccgttcatgataacgaccaagtgaaaaaagcagctggctgccctgaacccaaaaaggtcgtttggagtcgtccccctcaggagcaaggcgatgggtatgtacatatattttaataataagcagctttaggatagcttggtttgctcgccccccaagttgcaagtttatgcccctttttttttattatttccccccccagttttccccattgtagtagggaacttataacatgcgtgttttatcccccattttacatttttttgtcccatcccaaggatgaacggggggggcaggggggggtgtttttttcccgggggtatgtatacaccatgcggctgtatgggtagatcaaatcaggctatatatataacagactgtgctgtttttttaaaaaaaaaaaaaaaaaaaaaaaaaaaaaaaaaaaaaaaaaaaaaaaaa

SEQ ID NO: 8191 - DNA, 1369 bp, Zea mays
  Predicted polypeptide sequence is orthologous to G256, G666, G668, G932
gcaccagacggaatcgatcgatcggtgctttgatctctgagcctgagcaagcggtcgagctcaccaaccgccacgctcaagacaggtcgagtagctagctagctgccggagcggaaaaggaggcggtgcagtggcatggggaggccgccgtgctgcgacaagatgggggtgaagaaaggcccgtggacccccgaggaggacctcatgctcgtctcctatgtccaggagcacggccccgggaactggcgcgccgtgccgaccaacaccgggctgatgcggtgcagcaagagctgcaggttgcggtggacaaactacctccggccgggaatcaagcgcggcaactttaccgagcaggaggagaagctcatcgtccacctccaggctctccttggcaacaggtgggcggccatagcatcctacttgccgaagaggacggacaacgatatcaagaactactggaacacgcatcttaagaagaagctgaagaacatgcagggcggcgaagggggcgcgggagggaagcgcccggccgttcccaaggggcagtgggagcggcggctgcagactgacatccacacggcgcggcaggctctgcgcgacgcgctctcactggagccttcggcgacgccgctggccaaggtggagcctctgccgacggctccggggtgcgcgacgtacgcgtctagcgccgacaacatcgcgcggctgctggaggggtggctgcgcccgggcagcggcaaggggccggaggcgtcgggttcgacgtcgacgacggccacgacgcgccagcggccgcagtgctccggtgagggcacggcgtctgcgtcggcgagccacagtggcggggcggccgcgaacacggcggcgcagacccccgagtgctcgacggagaccagtaagatggccggcagctcggtcggcgcgggctccgcgccggcgttctcgatgctggagagatggctgctggacgacggcatggggcacgctgaggtggggctcatgaccgacgtggtgccattaggggaccccagtgagttcttttaattaaggcacaagtaccaccaaaagcaaactgatcaagtagagatgcaagaacaaaaagaagaaattaatcgccgggttaggtaactagttaagcagaaatccaacaaaactaaatgtatttgaattctcggtgaatttgatcgagttggatgtcgatatagtttttgttttagtcccttcttttatttttttctctgttgtttctctgatgttagggtttgtaactgatcatgtaagcttatactaatgacaggttcctaaatggaccctgcatgaaaatacatcttataaattaaaagatctatacaaaaaaaaaaaaaaaaaa

SEQ ID NO: 8192 - DNA, 129 bp, Zea mays
  Predicted polypeptide sequence is orthologous to G256, G666, G668, G932
accaactacctccgcccgggcatccggcgcggcaacttcacgccgcgcgaggagcgcgtcatcgtccacctccactccctgctgggcaaccggtgggcggccatcgcgtcgcatctcccgcagcgcacc

SEQ ID NO: 8193 - DNA, 129 bp, Zea mays
  Predicted polypeptide sequence is orthologous to G256, G666, G668, G932
accaactacctccgcccgggcatccgccgcggcggcttctccgaccaggaggacaggctcatcgtccacctccaggcgctcctcggcaaccgctgggccgccatcgcctcctacctccccgaccgcacc

SEQ ID NO: 8194 - DNA, 879 bp, Zea mays
  misc_feature (853)..(853): n is a, c, g, or t
  Predicted polypeptide sequence is orthologous to G256, G666, G668, G932
cccgattcacctcctgggaaagtggaagggagggagaagcaaggcaaagcggagccgagggtcaaaggccctcgtcctgcttggccaagcaagcgtcgcgcacgtacgtagaggccgaccggccggccaggttgaagaaggcatggggaggccgccgtgctgtgagaaggccgggttgaagaaggggccctggtcgccggaggaggacctcttgctcgtctcctacgtgcaggagcacggtcctgggaattggcgcgccgtgccatgcagcaccggtctgatgcgctgcagcaagagctgccggctccggtggaccaactacctccgcccgggcatcaagcgcggcagcttcagcgaccaggaggagaagctcatcatccacctccaggagctgctcgggaacaagtggtccgcgattgcgtcgtacctgccggagcggacggacaatgacatcaagaactactggaacacgcacctcaagaagaagctcgccaagacgggcgccagggaaagcggtgccagcgccaagacgacgaagaagagcgatagggccgcggcgcccaaggggcagtgggagcggcggctgcagacgaacatccacaccgcacgccaggcgctccgggaggcgctgtccatggacgacactgcgccgccggcaatcaagccggagccgctgccgctgccgctggggcagctgccggcgccagccagccaggcgatgtacgcttccagcatcgataacatagcgcgtctgctggagggctggatgcgtcccagcgtcagtgggaatgcgtcggctgagtccatgtcctctttctcggcgttctccggtggtggcgacggcgcgtcggcnagccacatcggcacggcgcacacgcc

SEQ ID NO: 8195 - DNA, 821 bp, Zea mays
  Predicted polypeptide sequence is orthologous to G256, G666, G668, G932
ctgtcctcaacctcaagccgccacgctccaccaacacgcgcgcgctggcttcttcaacctcggttgcttgctcgcaacaagacacggatcgtcagagcaagagctctggtgacctgacgattctgctcttgttctcgtacggcgccggtgcctagcgtctgtagcctttttgtgtgtgttttttcgcccatatctccccaccaccaccaccaccaacctcagccgcagttcacccgcgtcaccgcacgagtacacgagcaatccgcaagcgataacctgcaagctgaggggaaaggaaggtgaaggccagctgttttgctcacggagaaagaggttcgtcgttgatcaacacggacacaccatggtgaggccgccgtgctgcgacaaggagggcgtcaagaaggggccatggacgccggaggaggacctcgtcctcgtctcctacatccaggagcacggccccggcaactggcgcgccgtcccggccagaaccgggctgatgcggtgcagcaagagctgccgtctgcggtggaccaactacctccggccgggcatcaagcgcggcaacttcaccgagcaggaggagaagctcatcgtgcacctccaggccctcctcggcaacaggtgggcggccatcgcgtcgtacctgccggagcggacggacaacgacatcaagaactactggaacacgcacctcaagcgcaagctgcagagcggcggcgacggggcggccaagccgccggcgcacaggccgccgtcgtcgtcccaggccagtgggagaggagggtgcagacggacatcaacttggcgcgccgcgcgct

SEQ ID NO: 8196 - DNA, 623 bp, Zea mays
  Predicted polypeptide sequence is orthologous to G258
cactgctgcagcaagaagaaggtgaagcgtgggctgtggtcgccggaggaggacaagaagcttgtcaagtacatcaccgcccacggccacagctgctggagcgccgttcccaagcatgccgggctgcagcgctgcggcaagagctgccgcctccgggggatcaactacctccggccggacctgaagcgcgaaaccttctccgaccacgaggagcgcaccatcatcgacgtccaccgcatcctcggaaaccgatgggcgcatatcgccaagcacctgcccgggcgcacggataacgaggtcaagaacttctggaactcgtgcatcaagaaaaagctcatcgcgcagggcctcgaccccaagacccacaacctcctgccggcctccaagactctcctccacggcaacggggcaaaccctagcagcaacaatcctgcccacttcaactcaaacggctgcgctgctgtcgtctccgtcgccacgacgcccttcaccatcatctccccgaccaaggccgccgcctacggcaccgtcaccgccacgccgccgccggagacgatggcgccggcaacgtacgacgtccctaataattaccctgacggcatgctcatgaggcatgatcaggc

SEQ ID NO: 8197 - DNA, 2364 bp, Zea mays
  misc_feature (69)..(106): n is a, c, g, or t
  misc_feature (140)..(163): n is a, c, g, or t
  misc_feature (386)..(390): n is a, c, g, or t
  misc_feature (509)..(515): n is a, c, g, or t
  misc_feature (534)..(539): n is a, c, g, or t
  misc_feature (708)..(712): n is a, c, g, or t
  misc_feature (999)..(1003): n is a, c, g, or t
  misc_feature (1209)..(1213): n is a, c, g, or t
  misc_feature (1895)..(1929): n is a, c, g, or t
  misc_feature (1945)..(1949): n is a, c, g, or t
  misc_feature (1953)..(1957): n is a, c, g, or t
  misc_feature (2040)..(2049): n is a, c, g, or t
  misc_feature (2085)..(2100): n is a, c, g, or t
  misc_feature (2136)..(2144): n is a, c, g, or t
  misc_feature (2208)..(2245): n is a, c, g, or t
  Predicted polypeptide sequence is orthologous to G261
gcccacgcagcaatctggtcttctggaaatctccatcaatccgattccgaacggcagaaaattttcccnnnnnnnnnnnnnnnnnnnnnnnnnnnnnnnnnnnnnncctgagccacctcccatgcgccgcgccgcagccnnnnnnnnnnnnnnnnnnnnnnnnggtctggagagggatggagggcgcgtcctcgctgccgcccttcctgagcaagacgtacgagatggtggacgacccggccacggacgccgtggtggcgtggacgccgctggggaccagcttcgtcgtcgcgaaccaggccgagttctggagggatctgctccccaagtacttcaagcacaacaacttctccagcttcgtgcggcaactgaacacctacgtaagnnnnnaccgcacagcacgatcattcattttcttcgccccatctccctctctgtccacctgtggttttgatcaatcggggtgcgtggcggcgtgctactgtcagctatgctgttgcccctttgcnnnnnnnctccacaagttggcatttnnnnnncgaatcttgttagccttgtagtagaacaattgtttagggtatcgtcttcggtcgaatgaactgtttccttgttatagcatagcgtgttgacaacttggtggcgataactttaaattacatgtgtccactatatatctagtatatatgctcaattatcttgttgagatgnnnnnccttttctaaatccaactagagttagtgtaccttttgacaaatgaagtgctgctaacggtaaacactgttgaattggcatctttgttgacacccaaattaaatccaatagaaaccataatgatttcggatggttacttttgatttatgagccttgatgggtcaaatttctgtgatgttgtgttaatcgttttcctgcttcttcttatgtagggctttaagaaaattgatcctgaacaatgggagtttgcaaatgatgatttcattaggggacaacagcaccgactgnnnnntatacacaggcgtaagcctatattcagccattcatcgcatactcagggttctggaccattaccagataccgaaaggagggattatgaggaggaaatcgaaaggcttaagtgtgacaatgcagctctgacctcagagcttgaaaagaatgcacagaagaaacttgttacagagaaacgaatgcaggatctagaagataagttgatcnnnnnggaggatcggcagaagaatctgatggcgtatgtcagggatattgtacaggcaccaggatctttctctagctttgtgcagcaacctgatcatcacggaaagaaaaggagactaccagtacctatctctctctaccaagattctaatgctaaggggaaccaggttgtgcatgggagcttcatcaccaacccaccagcttgcagggaatcatttgacaagacggaatcttcattgaactcgttggagaatttccttcgggaagcgagtgaagcgttcaatatttcatatgatgatggcctccctggccttcatctgctgtcgttatcacagagctccattcgtccggagaaagtgatccccatgtgccatcacctgtctcaagaatgcatacatcttcggctggtgcgggagattcgctctcttcccgcgatttaacagagtcaactagctgcgctgagagccctcgcctccctcagatccaaccctgtacagattcacgaactaaggtgtctgagatcgatgtcaatcgggagcctgctgtcacagaaactggtccgacaagggaccaacctgccgaggagcctccccacgtagcagctggggtgaacgatggcttctggcagcagttcctcaccgagcagcccggtcctgatgtacaccaggaggcccaatcagaaaggagannnnnnnnnnnnnnnnnnnnnnnnnnnnnnnnnnnaggggaccgagaaaannnnnggtnnnnnaagaagaatgttgagcagatgagagagaagctggggcgtctcacctcggtggagaaaacctgactgtatttcttgtagctggnnnnnnnnnngttagcacagaaacacatataggacgctggtgcctnnnnnnnnnnnnnnnnttgcagtgtatcatatatcttcgccaccagatatgnnnnnnnnnatcgacctcgtagtcgtacttcttccacctgtacttttgccgtgtttacagtgagacttagttnnnnnnnnnnnnnnnnnnnnnnnnnnnnnnnnnnnnnnactagtcgctatacttctgttaggagttctgcattcgtacttggttagtagacacttcctggtactgttgtccaacgacgtggttatatatgtagatgatgataatattcacttcgttg

SEQ ID NO: 8198 - DNA, 748 bp, Zea mays
  Predicted polypeptide sequence is orthologous to G261
gcaaataactgaatctgtgctctagctcaacagcacgaggacatacgtaatgtacatgggtcagcatatgattttactttttacagtaggaaatgctagaaaagacttagctagcctaaactataatgtacagcggcaacaccgatggtgtggtatcagtaattctcgggtgcataagaagctgaatcaagctgccccatctgctcagtgatctgatcaacattgtcctggagacgaggacagcagcggtctacggcagtcttcacatcctcttttgcttctattgcctcgcttttaccctcggcggcgtctgtgagaaaccgctcccagaatacatcgttcactttggccggcacatgggaacctccagtttcactggtggtatcatcttgcgaggtgtcgccggttgtggtgtcagagttcatatcgactccagcagctgtcctatgggcatgttcatggagctgtgccatcggcagcatcgggctctgggcgtagtagctcgggggttctgccaacggagaagacgactggtcttgccctgaggtcgaagcgaaggggttctggcaagctgatggctgcagatcgatctcggtatccattggtgccgagagcatctcgcctagagccagagcagggctgggttcagcaacaccagcggcgtacaacatgccttgagcagcagacgtatgcgctgttgccctctgcaagaaactctccagcgacaccagggccagctccatcttct

SEQ ID NO: 8199 - DNA, 779 bp, Zea mays
  Predicted polypeptide sequence is orthologous to G263
gacaagcggcgacacgccagggcggagagcacacaccgaagcgggccgcggcggcggcgcaggcgcaggcgcttacatgggagtagaggcgggcgggtgcgggcggagggcggtcgtgaccgggttctacgtctggggctgggagttcctcaccgccctcctgctcttctcggccgccgccgccgccgcagactcttactagctagctagccacctcttcttcctcctccttgtaggtagtagtaggctacacaacaaccacatatatacatactaggtactagcaggcgagcgagattcgtgcaataatcaaggcagccagttattaatagttaatcgtcggcgccgagcgagagatggtggaggaaggcgccaccgcggcggcgtcgaggggcgggccggcgccgttcctgagcaagacgcaccagatggtggaggagcggggcacggacgaggtgatctcgtgggcggagcaaggccgctccttcgtggtgtggaagcccgtggagctggcgcgcgacctcctcccgctccacttcaagcactgcaacttctcctcctttgtccgccagctcaacacctacggtttccggaaggtggtgccggaccggtgggagttcgcgaacgggaatttccggcgaggcgagcaaggcctcctgtccggcatccgtcgccgcaagtcaacgacgccgcagccatccaagtacggcggcggcagcgtcgtgaacacccgcgttcctccgccgttgccccttccgcctcccgcgtcggtcaccacg

SEQ ID NO: 8200 - DNA, 837 bp, Zea mays
  Predicted polypeptide sequence is orthologous to G263
aaaaacgataatattccattccaaacatatgggcttgtctttctagaccgtctactcatccggtcatccctagttccctactttcaatcttgctacctccaaatcatcccataattaacttttaacatgcgttacggttatctcctgtgccctgtgttctgccttcacagttttaccacagcactggaattatccttgccatcaacctcaccttggatgacaaatacaaacacgcacaaaaagcatccacgactcgaacatgcgctcgctgtaataaagctgtcacacggccggccgtggcgcatcagttccaaccataccttaccttaattcccgccgccgcaccgccccgggcccgacgacgggacgccgatccacggctcgccgattctgatcatcttaatgggccgctcgctggccgccgcctcctcgcaccgggccctcttccttgcggcatccgtgaggagtacgccgaacagcttcacgctcttcccctcctcgccgccgcgctctagctggctgaccattgcgcggcgcggcgcggcgtcgtcaccggcacccgctcgcacgtcttcctgcatgagcagcccaaggtcgagctgccggacgtcgaggaagcgcgagaggaagcccaggagctcctcgcagtgccgacgcgcctgcgccagctcggtggacagcgtgcggttgtccttcttgagctgctcgttctcgctggtcaggtcgtctgtccgtggcggcgacgatgccgacgaggagctgcgctcgttgccagcgccacccgcaccgccaccgccagacgtggtgaccgacgcgggaggcggaaggggcaacggc

SEQ ID NO: 8201 - DNA, 851 bp, Zea mays
  Predicted polypeptide sequence is orthologous to G264
gggatccaccaaccttcacccactcgcagcaggcagcaggcggcagcagcagcacgcgctgccgcagcaccagtcatggaggtcgccggcgcccgcgagcccggtagcggaggaggaggaggtggcggcggtggcggaccagccccgttcctgctgaagacgtacgagatggtggacgacccgtcgagcgacgcggtggtgtcatggagcgacgcatccgacgggagcttcgtcgtctggaaccagcccgagttcgccgcgcggatgctgcctacctacttcaagcacaacaacttctccagcttcatccgccagctcaacacatacggtcttcgcaaaatagacccagagcgctgggaatttgctaatgagtactttgtcaagggacagaagcacctgctgaagaatatccacaggaggaaacccatccacagccatagccatcagccaggtgccctgcctgacaatgagcgtgcgttatttgaggatgagattgacaggctttcacgagagaaagctgccctccaggctgacctctggaaattcaatcagcagcagtcaggtgctgtgaaccagttagaagatcttgagcggcgagtgcttgacatggagcagcgacagacgaagatgctcagcttcttgcagcaggctaggaagaatcctcagtttgtcaggaagctcgttaagatggcagaggaatccccaatctttgcggacgcgtttcacaagaagcgaaggctacctgggcttgaatgcatcacggatgctaccgaaactgccactagctttttcgatgaccatagcagtagttccaggcaagaaatgggtaaccttctgaatcagcacttctc

SEQ ID NO: 8202 - DNA, 812 bp, Zea mays
  Predicted polypeptide sequence is orthologous to G264
aaccacaacagaacagcaattccgtagtcgcattgctctgtctccggtatgtatactgggataatatgtacagggcattcttgcgatgctgtttacacacaatcctagacagaccttcgtgccattccaatttccagcaaaaactcaaggtcatgctaaaaaaactcaaggtcagagtttcagctgccccatatctctcgtgtcacttccagtgccctcgtcgtacgcatgcgtgtggtctggatccctcctcagggtgaagcttgcttcctcggcttcggggcagcccggcctctcggtaaggaactgctcccagaacttgtcgttcaccaccacctggggacctgtatgttcttcagggggagcttggctgccccgatgcggcctacccgttgcatctgctgcggccccagcgtgacctgaagcctccttctggttctgggtagcatcatggcatctgtcaggcatgccgtcgtccttctccatggtgggtgtggtcacctccggtgggccatccttctcatccacagtgttcacgtttgcatcggggatttggcttctgaccacatccattggacatgatgcaaggctgaggttgaggtggcatggcaagaacccgtcgtcatttgcagctgttgtaaagctcacactcttcgagggacagatggatgttccagtgtcagagagctccatcatctgtggcaccagtggaaggcactccatgcctgttctctcgtaatctggatgcttcccaagagggctcccgttatcttcatgtgagctttgggtgctcaaggtgatgaggttgcttt

SEQ ID NO: 8203 - DNA, 760 bp, Zea mays
  Predicted polypeptide sequence is orthologous to G268
aaaacggtctcttcgtatttcccccacttttgtagggtttccatgacaatgtttcaacaaaagaaattggcacatgtcagaaactacacagatcatcattttacaaatggatgatcaatcaaatagttacaaattagtccttgacctaccctatctacagcacaaatgtcagtcccgacagcagctcttttcagttgcaaaagtacctaaaattacccctgcttgtcttcacctgatcgcctaacgcgccataggcttgtcgcacatcaaaaccttcctactggcgtacgcgccttcggcagtgtcacgtatagtaccacgccaccccatggcattcgttatttctttgatctcctgtataacttctttccggtcacgaatatatgctttaccacctggtctgagtatccggtccatctccagcaagatgctagagatattacacctgttctgctcctttgagaaaagaccagatgcatgaagtagatcgtacgtcctagggtatgtatcaaagggttcacaccagtcatgagctactccaagaagcccccgatcaaaaattacaggtagtgtatttggctcactaataggaacaacattcatcacccaccaatccagtttctggcggatcaaagcagctgcaaaccctccaaatccagccctcatgtccattacattccggactttgaacttcctccacttaaagatacggatataaccgtcaattatgtcgtcccaaaattttgtttctgctttgaaa

SEQ ID NO: 8204 - DNA, 858 bp, Zea mays
  Predicted polypeptide sequence is orthologous to G268
tccccttccgatcccatcccttccgcatcgtccccgaacgacgcagacggacgcaaggcacggcgccgacatctccccgtggcccgagggcccagacatgaaggccctgggcgcgcacgccgccgacctgctccgaggcccgcacctactccgcgccgccgtcttcgctttcgccgttgcgctcgccttcctcgttggctaccactggcccaacgcctccccgcgccttgtcttcttctcgtccgatgcctcctcgtcgtcgcccaggtcgtcctcccgctctccttccgtcgtgctctcccctaactctaacgtctccttcgacccatccctgatccctacccccagcaccccgcctgcttcttctactcccaatgcctggtccccgcccgcactaccaccgccgacatcggcgccgccgcctcccctcccccctcctccaccaccagcgcgcctcggcatcgtcggcgaggacggcgctatgcaggacgacttcgacatcggcaacgtcggcgccaacgacactgatctggccaccgacgagaccgcgccgcaggagcctagcgacgtgggcgccagcggtggaccacctagggtgcggattgagaggttcccggtctgccccgagagcatgagggagtacataccctgcctcgacaacgaggatgatatcaagcggctgccctcgacggagcgcggggagcggtttgagcggcactgccctgccaaggacaagggtctcagctgcctcgtgccggcgcccaacgggtacaaggcgcccatcccctggcctcggagcagagacgaggtctggtttagcaacgtgcctcacacaagattgattgatgacaaaggagg

SEQ ID NO: 8205 - DNA, 885 bp, Zea mays
  Predicted polypeptide sequence is orthologous to G270
ctcctctcaagcctcgacgcagcacggcgcgccggcgcgggacgacggcatgacgccgccgtccatcttccaccaccatcgctgcctcgtctccctcccctccgcttccccgacctggacctcgtcccgtcgtctcatccatcaactcgcaaaacccacagtcctgtccctacatctgcgtccagtcttatcctcttccttcgcggttgccgccgtcggcgacgacgaggatgtcgtagtcggggattgcctcgtgttcgacgacgacgctttcgaggaaccggacctggacctcccctcgtccccgtggccgtcggctagcgcctcacgccacggccggaggtcggaggcaggcgagagcgacagcctggtgccggagaggtggaggcatgccgaggaggagatcaacctgacgaagaaggataagcgccgcatcgcgcacgggctgcggttcgggagccgcctcgagcggcgggcgcccccagctgttgctgctcctgatgaattccgcgcgtaccgcaaggggatgctgagcgctgagcgtgagcatgtttctcatgtataccgggggccgctggagaggactcctccgccggaagtgaaggaacatccaccgccggagccggagcctgggacgcgtgtggccccgaggaatccgaggatggggatgggcgttggcacccttgacgacattgatgagtttttcagaagtagggaatatgttcaggatgagatggaggacagcaagagtcctaagggccgtcagaagttgttctcaaatgaggagaagattcttctgaacaagcgagtgcctgatctgggaacagctacttctagtaaatggcttccacttcacacccttgctgcatctggtgatttctatct

SEQ ID NO: 8206 - DNA, 652 bp, Zea mays
  Predicted polypeptide sequence is orthologous to G274
gtaccaaaacaaatgtcagtttgaagatatactcctggaaatggacagaatcttacacccggagggtgcagtcataattcgtgacaaggttgatgttcttgtaaaagtggagaaaatagccaatgccatgaggtggaagacaagattggctgatcatgagggtggccctcttgtacctgagaagatactcttcgcggtcaagcaatactggaccgttgcaaaaacaagcagctaacattattcgtattttatttttttctccagtcacaggtaacttggtccctggatgtgtttattggggggaaaatctgccggtttgaaaatcatcatcccatgtttgttactgaaaatagaaaacaagcttacaatcaccctggaggatggtaagttatgcgggacctagttgtgaacttgtggtttgcttattccactgttgcagagatgcagaagacatgccaaaaggatcaattgaccttgcactagtgactcatatctgatcggacagatgcagctgcttataattggaaccctgcagcagtccagggaagttatgaactagcagtggacttacagttttgtataggatactcatttacctctacacgccccctcttttttttttggtggatccccagaatcccatcaaatggat

SEQ ID NO: 8207 - DNA, 838 bp, Zea mays
  Predicted polypeptide sequence is orthologous to G274
cagcagtgtgaacaagtatctgcttactggtagatacaggaacattatggacatgaatgcacagtacgggggattcgctgcagcaatagagtccccgaaatcttgggtgatgaatgttgtgccgaccatcgcgaagatgcccaccctgggggctgtgtatgagcgaggatgatcggcatatatcatgactggtgtgaggctttctctacttatccaaggacgtatgatcttatccacgctagcggtcttttcaccttgtataaaaacaagtgcagcatggaagatgttctcctggagatggaccgcatcttgaggcccgaaggcgccgtcataatacgggacgacgtagacgtcctgaccaaggtgaacagcctcgctctgggtatgaggtgggacacgaagatggttgatcacgaggatggccccctcgtgcgcgagaagatcttgtatgccgtgaagcaatactgggttggtggtaagcagacggctgtagcttgaagcaagcacgtttcatgaggctctaacatgaggaattctgcaaccaaaccttacccgacgaacaagaattagcttaaatgatcaacccttgtagggggtagcactgaagcagccagaatgccgtgctcgctgggtgatcactgcaaccacatcatcttctttggtcgtgtactcttttcaaaagcttgtatcttggaaaattctttacggtcctcgtatagattccggtgtaacgttttagtagactagctttatgtagcgagaatacatgttttcttttggacacctcaggtctttttttgtactcccgatgatccctgagaaaaggctcctacgggtc

SEQ ID NO: 8208 - DNA, 896 bp, Zea mays
  Predicted polypeptide sequence is orthologous to G274
tttctgtcggcggcgactgggcggccgtcgctgccgtcctacgccagctgcccaggtcttcctcgcgcccttcgccggcggcaaccaccgccagggtaagccagccatcagccatggctttgaaggcgagctccagcgacaaccggaccaggagcacggtatccctgtgcatagtgattggcatgtgctgcttcttctacatcctcggggcgtggcagaagagcgggttcggcaagggggacagcatcgcgctggaggtcaccaagcgcaccgactgcaccgtcgtgccgaaccttagcttcgacacccaccattctaaagccagtggcaactctagcagcctggtttctccgtcgaagaagttcaagccgtgccctgatctctacacggactacaccccctgccaagaccagaacagggcgatgaagttccctagggagaacatgaattacagagagcggcattgcccggcgcagaaggagaagctgcactgtttggttccacccccaaaaggctatgtggctccgttcccgtggccgaagagccgggactatgtccctttcgcgaattgcccatataagagcttgacagtcgagaaagccatccagaactgggtccaatatgagggtaatgtattcagattccctggtggagggacgcaattcccgcagggagcagacaagtatattgatcagcttgcatcagtcgttccgatcgccaatggaactgtcaggactgcacttgacactgggtgcggggtggctagctggggagcttatttgttgaagaggaatgtcttggccatgtcgtttgccccgagagattcacacgaggcacaagtgcagtttgctctggagagaggtgtccctgctgttattgccgtcttggtacaataa

SEQ ID NO: 8209 - DNA, 650 bp, Zea mays
  Predicted polypeptide sequence is orthologous to G274
gctggtctcggtagctttgctgctgcactagaatctccaaaagtatgggtcatgaatgtcattccaacaattgcaaatacttccactttaggtgtaatctacgagcgtggattaataggaatgtatcatgactggtgtgaaggattttctacttatccaaggacatatgacctcatacattctaatgatatcttcagcttgtaccaaaacaagtgccaatttgaagatatactcctggaaatggacagaatcttacgcccagagggtgcaatcataattcgtgacaaggttgatgttcttgtaaaagtggagaagatagccaatgccatgaggtggaagacaagattggctgatcatgagggtggccctcatgtacctgagaagatactcttcgcggtcaagcaatactggactgctgaaaaaacaagcagctaacgttgttcattttcatttttttctccagtcacagctaacttgccccctggctgtgtttattggaaaaatttctgtcgattatacagccccatgtttgttactgaaaatataaaacaacccccttgagggggagtaaattatgtgggatttagctgtgaacttgggatttgattattccactggtgccgagacccagaagacatgccaaaaggatc

SEQ ID NO: 8210 - DNA, 732 bp, Zea mays
  Predicted polypeptide sequence is orthologous to G274
gccttggcaaatcgccaacagttcacttaacgctctgattactatatatgcacagcaaaaatccaggtatgtcccgatcatctaagggtctttagtactgtacgtatgcagtatgaacaaaatctattaaccgacaaaacagcatcaggggatcgcatcagggaaagaggctggcatccagcatcaacatggttctgtacctatcagctgttctgttcctcgctgccaacccaatattctttcactgaaatcagaatcttctcgggaacgtgcgggccatcctcatgatctagtaacttggacttccaccgcattcctgccaccatacttctaaccttgttcagtacatcggcattgtcccgcagtatgactgcaccctctggccgtaaaatcctatccatctccagaagaatgtcttctgcatcacacttgttctgatataaactgaagatgtcattgccatgtatcaggtcgtatgtcctagggtatgttgagaaggcttcgcaccaatcatggtatataccaatcagacctcgctcatatatgataccaagagtgttcctttctgatatagagggcacaacgttcattacccaggaactggaagaatgaagagttgcagcaaaacttccaaggcctgcattcatgtccataatattcctgtaccttgaagaacctatcagcttgttcaccctcttataagtattaacatgcttcttccacaacttatta

SEQ ID NO: 8211 - DNA, 2194 bp, Zea mays
  misc_feature (4)..(4): n is a, c, g, or t
  Predicted polypeptide sequence is orthologous to G275, G837
cgcnctaaagatgatgaaatcacaaatgagagtggtgatgaaaaaactgatggtgagagtaaggacggtcaagaagagaagcctgatggcgatgccacccaggaggagcaacctaaaatagaggagaatgtgggagaaaatggagagaaggatcagagctcaaactccaacgaggtatttcctgatggggcccaatcagagcttctgaaggagtcaaatacccagaacggttcattccccacacaggctgcagagtcaaagaatgaaaaggaagtccaagcgttaccgaagtcttcaggcgatgcaaccagctatacctggaaattatgtaatagtagtgcctcaacagattacataccttgccttgacaacgagaaggctatcaagaagcttcgaactaccaaacattatgaacatcgtgagaggcattgccctgaggagcctcctacctgccttgttccactcccagaaggatataaacggccaattgagtggccaaagagcagggacaaggtatggtacagcaatgttcctcacactaggcttgcagagtacaaggggcatcaaaattgggttaaggtctcaggtgactatctcttgttccctgggggtgggactcagttcaagaatggtgccctccactatattgatactattcagcaggcactacctgatattgcatggggcaaacgaagccgtgtcattttggatgttggttgtggagttgccagctttggaggctacatgtttgatagagatgcgcttaccatgtcttttgctccaaaagatgagcatgaagctcaagtacaatttgcattagaaagaggaattccagcaatatcagctgtgatgggcaccaagagacttccgtaccccagcagagtctttgatgtcattcattgcgctcgctgcagggtcccttggcacatcgaaggtggcatgcttttgctggaattgaaccgcttgttacgccctggtggttactttgtctggtctgccactcctgtttaccaaaagctcccagaggatgttgagatttggaatgccatgtctactttgacaaagtccatgtgctggaagatggtcaacaagactaaggataagttaaaccaagttggtatggtcatatatcagaaaccaatggacaatatttgctatgagaaaagatctgaaaacagcccgccattgtgcaaggaatctgatgatgcagatgctgcttggaatgtaccgttggaagcatgcatgcacaaactgcctggtggctcaaaagtccgaggatcaaaatggccagagttatggccgcaaaggcttgagaagacccctttctggattgatggttccaaggttggtgtctatggaaagcctgcaaatgaagattttgaggcagataatgcccactggaaacgggttgtaagtaaatcgtatgtgaatggcatgggaattgactggtccaaagtgagaaatgtcatggacatgagagctgtctatggaggttttgctgcagctctgagggaccaaaaggtctgggtcatgaatatcgtgccgatcgattcaccagacacgctgcccatcatctacgagcgcggtttgtttggcatgtaccatgactggtgcgagtctttcagcacttacccaagaacgtatgaccttctgcacgcggaccatctgttctcaaagctcagaaagagatgcaaactggctgcagttttcgccgaggtcgaccgtgtactgaggccacagggcaagctgatcgtgagggacaccgcggacacgataaatgagctggagagcatggccaagtccgtgcagtgggaggtgcggatgacctacaccaagggcagcgagggcctgctctgcgtcgagaagtcgatgtggcggcccaaagaactcgacgctagcacgtgaactgtgttgaggaggaactgctaccacgtaggggtgaaattagaggaattttgtcttctagatatgcgtatggctcttgttggtgctgaaaggaccagaaaatatttggtgtaactgtagaacaatacatctgttttttctgccgtttgttttcgtttttgttttttcacaacgttgctgtaagttagtgctggaaatcacaggtacattcagttctactgggcacgttgttggcttgtcggatagcagtcgaacgatcttgtgctgcaaaaaaaaaaaaaaaaaactc

SEQ ID NO: 8212 - DNA, 622 bp, Zea mays
  Predicted polypeptide sequence is orthologous to G275
aaaggaacccgttgtacactaacatttatcgaataatttatttgccgtcgcaacgcacggccacatacctagtatatacatatatttttaggagtacatgagacttcatacatatatagtaggatgcatcaacaaaagttgtctggacattgttttccaagtaaggtaaaagctatatacatgtgctgctgcgtaaaagttccaactttgaagccagacttgtttcatttttattcatcgggtagatttttgtcacagtcaaacttcaaggatttacgcctagccctttttgggggggattcaaaagccagtatgttctggtcttcattttgaagattgtcttcagtttgaggactattctgttgctctggagaaatggcagtcgatagtttggacagggctgaaaaaggggaaacttgctgttttgctgcacctagtagttgcgttgaagttgacggttgcactgaaatctttagtttgggtgacggaaaagttaggtctcttccatgtgaagctatgactgacttgatgaagagctctttttctgcgaaggtagatgcgcagtcgtccaacaacgctgtgatcctggaaaaagcggggaccgggacacccgcactgagcc

SEQ ID NO: 8213 - DNA, 744 bp, Zea mays
  Predicted polypeptide sequence is orthologous to G275, G837
ttttttttttttttttttttttaaaaaaaaaaagggaatcagataaccagttccacttccacagatgaatatggatatgctggaaaccaccagattcctccacatctaccaatcatatagctctacaaattctacataaataaaagatgcctcacaaaagtagaggaccttgcaaacactagatcttcctttcctccttccaaggggcaagggctctgcatcatagcttagcttcagtttcatttggccgccatgtcgtcttctgcaccaacagcaagccttctttctcctggaagtaagacatgcggacctcccagtggagagatttcagaatgttctccacctcacttgttgtttcaatgttgtctctgacaattagccggccttgtggcctcaacacccggtccacctccacgataacaggtaatagctcgcacctcttcttaaccttggagaacagatggttggcgtgcacaagatcataagttctcggataggtgctaaacgactcacaccagtcatggtacagtccaaacagcccgcgctcatatataattggaagcgtgtcaggtgaatcaattggaaccacattcatgacccacaccttgagatcgcgcaaagctgctgcgaaccctgcatatacggctttcatatccataacatttctaacagtagaccagtcaatacccaaaccattcatgtatgaattgctcacgactcgcttccagtgttcatagtctgctt

SEQ ID NO: 8214 - DNA, 857 bp, Zea mays
  Predicted polypeptide sequence is orthologous to G278, G1290
gtggacaacctcccattggtcttatctgttgccaacttatgtagcaaatcttgtgtgaaactgcttgagaggtgccttgatgtagtagttcgttcaaatcttgatatgattgctcttgaaaaaaagttgcctccagatgttgtcaaagaaattgttgatgcaagggtaagccttggattagtttcaccggaagacaagggcttccctaacatacatgtaagaagaatacacagagcactggattctgatgacgtggagctagtccggatgctactcaaggaaggaaaaactaatcttgatgatgcatatgcattacactatgccgtcgaacattgcgactcaaagatcacaacagaacttctggatctcgcgcttgcagatgtcaatcataggaacccaagaggttatacggtccttcacattgctgctatgagaagggaacctaaaatcattgtctctcttttgaccaagggagctcggccatcagacctcacatttgatgacagaaaagcagtgcagatctctaaacgacttacaaagcatggggattactttgggcctactgaggacggaaagccttctcctaaagatagattatgtattgaggtactagagcaagctgaaagaagggacccgcaacttggagaagcatcagtttctcttgcgatagaaggagactctgcgcgtgggaggctactctaccttgaaaaccgagttgctctagcaagaatactgtttcctatggaggcaagggtagcaatggacattgctcaagtcgatggaacactggaattcacccttgtttctagtgtggatctgcctgccgagatacaacggacagttgacctgaacgatac

SEQ ID NO: 8215 - DNA, 1112 bp, Zea mays
  misc_feature (303)..(308): n is a, c, g, or t
  misc_feature (387)..(442): n is a, c, g, or t
  misc_feature (451)..(480): n is a, c, g, or t
  misc_feature (489)..(520): n is a, c, g, or t
  misc_feature (568)..(598): n is a, c, g, or t
  misc_feature (610)..(655): n is a, c, g, or t
  misc_feature (663)..(700): n is a, c, g, or t
  misc_feature (874)..(900): n is a, c, g, or t
  misc_feature (943)..(963): n is a, c, g, or t
  Predicted polypeptide sequence is orthologous to G280
ggagcgaggctcctcctcgtttcctatctatcctgatccaaatccgccctactcgcttcatatatcctggcacgagggaaaacaattcattccgcgccgcatctgggaaggtctcgtcttgctcgcctccgtccgtcgccgcaccctgcgtcgtcgccatggccaccgacgaagccaccaagccgtccccgatcccaccctatcccgagatgatcctggcggcgatcgagggtctagacgacaagagcgggtcgaacaagtccgccatctccaagtacatcgagggcaagtacggctcgctgnnnnnngcgcacgcatcgctgctgaccgcgcacctggcgcgcatgaaggagtccggagagctcgtcttcctcaagaacaactacnnnnnnnnnnnnnnnnnnnnnnnnnnnnnnnnnnnnnnnnnnnnnnnnnnnnnnnnggcgcgggnnnnnnnnnnnnnnnnnnnnnnnnnnnnnncgccgtcgnnnnnnnnnnnnnnnnnnnnnnnnnnnnnnnnggccaagagcccgctggaagccgccgtgaagcaggccaccgcggggannnnnnnnnnnnnnnnnnnnnnnnnnnnnnnggccaagaccgnnnnnnnnnnnnnnnnnnnnnnnnnnnnnnnnnnnnnnnnnnnnnncgacgggnnnnnnnnnnnnnnnnnnnnnnnnnnnnnnnnnnnnnnggtacgccccgccgtgcccagcgagacggccgcggcttgaccccgcttcttggggataatagttcgtcccgccgcgagatgggatggttagggcgtagcaattcgtcccgctgcagctgcggctgcagctgccgtgttaatgttggtaggcttggtctccatgcttcatctaannnnnnnnnnnnnnnnnnnnnnnnnnnctcaattaattaatggagtaattaggaggattcgatgtgctgnnnnnnnnnnnnnnnnnnnnncagttcagtttcaccgtgtgtctctggtgttatgtgctggatctgttgtaagctaagctagggagcttgagtgctgtgttggtcgattaattattataagctgctaatgtggatgtgtacaattaattagaggatggtgatgatgttcg

SEQ ID NO: 8216 - DNA, 524 bp, Zea mays
  Predicted polypeptide sequence is orthologous to G280
cacacacacactctctctcttcgcagacacaaccaaaagaccaaggtggaaaaatagtaaagaaacggagcgaggctcctccgcatttcttatctatcctgatccaaaccctccgagggggaaacaattcattccgcacggcatccgggaaggtctgcgtcgtcgccatggccaccgaggaagtcgccaagccgtccccgatcccgccctaccccgagatgatcctggcggcgatcgaggacttaggcgacaagagcgggtcgaacaagtcggccatctccaggtacatcgagggcaagtacgacggcgacctgccgcccgcgcacgcgtcgctgctggccgcgcacctggcgcgcatgaaggagtcgggtgagctggtcttcgtcaagaacaactacttccgcgccgacgcgcccgacgcgccgccgaagcgcgggcgcgggcggcccccgaaggcgcgggaccccggcgcgccggtgtcgccgccatcggggcgcgggcgcgggcgcccgcccaagcccaag

SEQ ID NO: 8217 - DNA, 887 bp, Zea mays
  misc_feature (14)..(14): n is a, c, g, or t
  misc_feature (807)..(807): n is a, c, g, or t
  Predicted polypeptide sequence is orthologous to G280
ccagttccgtccgnattcccggctcgaccccgcgtccggttgcacatatgactgagggtcggcatgaagctctgcctgcacaagctgtagaccaaactgggcctgtgcaaaatgaagttgaagctatgattttgcaatcccttgctactactcctttgatggagaagaggagtcgtgggcgacctagaaagaggccattggaaactgaaactgcagaaacccaagttgctgcatcggtggagaagcgagggcgtgggaggccaagaaagaagaatccatcggcagggtggtctgcaggaaccagggatactgcattaaaggggattaagagagggcctgggaggccaaggaaggccaggccttttgaaactgagtctgtgaaaactgcacttgaggtgtctagggatttgacagaagatgggcctcaaaaggatggggatcttgtgtcagggaagaaagcagatactcatggtgtggtttggtagtgtcaactgaggaggtagccattgctcccatggatgctgggtgcgcagacgccaagggttgatctgatggatgtgggcaccaagagtcactagtgctctgatggtgcgaacaagaacaaaaaagaaataatgatagtacctgaaaggctaaacagaacatgcagctaataagtgtgttcatggatataattaatagccatactgcaagtattgctatatgtttgcaccagtttgattactcgtatgtttttgagcagttccattggaaactgcgtttgatgggtttcacttttggggggtggatttaatatctaaccacatnctcttctttgtcaaggactatacattttgtattttgtgcttgactggaactagccatcataggtcatttgtttccagttc

SEQ ID NO: 8218 - DNA, 873 bp, Zea mays
  Predicted polypeptide sequence is orthologous to G280
cgtggccttaactttacggcttcaccgaccgaaaacccccatttcctcttctccaaaccccactcaccgcaacgagccgccggatccatggccggcaaagacggctccgtcccttccccgcctcctccccggctcccatcctaccctgagatgatcgtggaggcaatccgggcgctgggactcgagaacggctgcaacagactgcgatctcggactacatcaagggcagctacggctccaacctccctgcccagcacaacgccgtcctcacgggccacctcgcccgcatgaaggctaccggtgagctcgccttcctcaggaacaactatctcctccccaacgaggacgaagcctccccgctgagcaccggtgggcacaagggccccgccgccgccgaggagtctactggcgtgttggacgttggtgacgatgtgttgcttgcttcccctctcgtcatcgacgctgacgccgtcgacattgacgtgcctgctccagctcccgttgtcaccgctgatgtcgacgacattgacgtgcttgctccagctcccgttgtcagcgctgatgtcaaccctgttcataccaagcggggacgcggacggcccccgaagcccaaggaccccgttgctgagggctacggtggtaagcccgctacagctcccgtcgccgccgctgccgtgcctgtcaagcgcgggcgcggacgtccgccgaaacccaagaaccccgtcgccgaggactcagctcccactgcgtcttccgtcgtcaccactgatggcaatgccgtgcctgtgaagcgtgggcgcggacgccccccaaagctcaaggaccccatcaatgtggccactgaccaagccaccagcggcatgctcagcccca

SEQ ID NO: 8219 - DNA, 1034 bp, Zea mays
  Predicted polypeptide sequence is orthologous to G291
gcacgagagaatgtggttggctggtatcactcgcaccctggctatggatgctggctgtcaggaatcgacgtgtcaactcagatgctcaatcaacaattcacagaaccattcttggcagttgtgatagaccccacaaggacagtttctgctggtaaagtggagattggagcctttagaacatacccaaaagattacaagccaccagatgagcctgtatctgagtatcagactattccactcaacaagatagaagattttggtgtccattgcaaatcgtactatgctttggatataacttatttcaagtcatccctggattctcacctccttgatctgctctggaacaaatattgggtcaacacgctatcttcatcatcgcttctgggcaacagagattatgttgctgggcagatctttgatttagctgataaactagagcaagctgaaggccagctggcacacagtcgatttggtggtatgattatgccatcgcaacgaaagaaagagcaagaagagtctccactggctaaggtaacacgagatagctccaaaatcacagctgagcaggttcacggcctcatgtcacaggtcataaaagacatccttttcaactctgttcacccgtcaagcaaggcaagcacaagtgctccaccagattcatccggtcctgagcctatggttgaagcctgagttccagcggaaggggacaatggatatttgtgttatgttatctgattcagaaggtgcaaaacaagttatcttttgagtacagaatcatcatgtaattatgagttgccatcttgggctgccactgagagggtgtgatttgggtccggttagcaatctcatgtattggatttcggatcagtattcgaagctttcataacgaggagccatcatcttattttagctgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 8220 - DNA, 2490 bp, Zea mays
  Predicted polypeptide sequence is orthologous to G307, G308, G309
ttcggcacgagccgctgctactactagttgccttcctcgcttccccgtctcgccccagccgcttcccccctcccctaccctttccttccccactcgcacttcccaaccctggatccaaatcccaagctatcccagaaccgaaaccgaggcgcgcaagccattattagctggctagctaggcctgtagctccgaaatcatgaagcgcgagtaccaagacgccggcgggagtggcggcgacatgggctcctccaaggacaagatgatggcggcggcggcgggagcaggggaacaggaggaggaggacgtggatgagctgctggccgcgctcgggtacaaggtgcgttcgtcggatatggcggacgtcgcgcagaagctggagcagctcgagatggccatggggatgggcggcgtgggcggcgccggcgctaccgctgatgacgggttcgtgtcgcacctcgccacggacaccgtgcactacaatccctccgacctgtcgtcctgggtcgagagcatgctgtccgagctcaacgcgccctcagcgccgctcccgaccgcgacgccggccccaaggctcgcgtccacatcgtccaccgtcacaagtggcgccgccgccggtgctggctacttcgatctcccgccccgccgtggactcgtccagcagtacctacgctctgaagccgatcccctccgccggtggcggcgccgtcggccgacccgtccacggactcggcgcgggagcccaagcggatgaggactggcggcggcagcacgtcgtcctcctcttcctcgtcgtcatccatggatggcggtcgcactaggagctccgtggtcgaagctgcgccgccggcgacgcaagcatccgcggcggccaacgggcccgcggtgccagtggtggtggtggacacgcaggaggccgggatccggctcgtgcacgcgctgctggcgtgcgcggaggccgtgcagcaggagaacttctctgcggcggaggcgctggtcaagcagatccccatgctggcctcgtcgcagggcggtgccatgcgcaaggtcgccgcctacttcggcgaggcgcttgcccgccgcgtgtatcgcttccgcccgccaccggacagctccctcctcgacgccgccttcgccgacctcttgcacgcgcacttctacgagtcctgcccctacctgaagttcgcccacttcaccgcgaaccaggccatcctcgaggccttcgccggctgccgccgcgtccacgtcgtcgacttcggcatcaagcaggggatgcagtggccggctcttctccaggccctcgccctccgccctggcggccccccgtcgttccggctcaccggcgtcgggccgccgcagcccgacgagaccgacgccttgcagcaggtgggctggaaacttgcccagttcgcgcacactatccgcgtggacttccagtaccgtggcctcgtcgcggccacgctcgccgacctggagccgttcatgctgcaaccggagggcgatgacacggatgacgagcccgaggtgatcgccgtgaactccgtgttcgagctgcaccggcttcttgcgcagcccggtgccctcgagaaggtcctgggcacggtgcgcgcggtgcggccgaggatcgtgaccgtggtcgagcaggaggccaaccacaactccggcacgttcctcgaccgcttcaccgagtcgctgcactactactccaccatgttcgattctctcgagggcgccggcgccggctccggccagtccaccgacgcctccccggccgcggccggcggcacggaccaggtcatgtcggaggtgtacctcggccggcagatctgcaacgtggtggcgtgcgagggcgcggagcgcacggagcgccacgagacgttgggccagtggcgcagccgcttcggcggctccgggttcgcgcccgtgcacctgggctccaatgcctacaagcaggcgagcacgctgctggcgctcttcgccggcggcgacgggtacaggttggaggagaaggacgggtgcctgaccctggggtggcatacgcgcccgctcatcgccacctcggcgtggcgcgtcgccgccgccgccgctccgtgatcagggaggggtggttggggcttctggacgccgatcaaggcacacgtacgtcccctggcatggcgcaccctccctcgagctcgccggcacgggtgaagctagacgtcattgagcgctgaatcgcagttagcgaccgggccaaggttctcgccggcgtgatgagatggaacactttgactcccgcggccggatcggcctgtgttcgttcttgtttccgatctcccttctctttcccgttgcttcgatcccgtcaagtatggtagaccgtagcctattgttatgtttaaatgtcaattattatgtgtaattcctccaagcgccgatatccaataaggacgaaccggattttcgttagctcgacctcgaatgagaattttgtatacaatgcatcctcgtgc

SEQ ID NO: 8221 - DNA, 1484 bp, Zea mays
  Predicted polypeptide sequence is orthologous to G307, G308, G309
ccctctcaccccttttctctaccacatctaccaatgataccatgtacaaccttaacccagcgttgtatgcatccctcgtgccaccaataaggaaacctgcaaccccgaccacactagaggtagggaggcaatgcaaggaggacgaggatgcatccattcgtccggtgcacctgcttatcacttgcaccagtgccattgagactggtgactactcgatcgcacaaggaaacttgtctgaggcacgcaagattcttggggaaatcccaacttcgaccgggattggccgtgttgggaaacacttcatcgacgcactagttcaacgcctcttcccggcatatccgcacgcagcaccaccttctccatctccttctacatcgatcgatctgcacaacaatttttatgatgcaggtccctacctaaagttcgcctactccactgccaaccaagcaatcctcaaagcaatcaaaggatacaaccatgtacacataattgacttttccctgatgcaaggtctccagtggccggcactcatggatgtcttctccgcccgtgagggtgggccaccaaagctccgaatcacaggcattggcccgaacccaataggtggccgtgacgagctccatgaagtgggaattcgcctcgccaagtatgcacactcggtgggtatcgacttcactttccagggagtctgtgtcgatcaacttgataggttgtgcgactggatgcttctcaaaccaatcaaaggagaggcagttgccataaactccatcctacaactccatcgcctcctcgttgacccagatgcaaacccagtggtgcccgcaccaatagatatcctcctcaaattggtcatcaagataaaccccatgatcttcacggtggttgagcatgaggcagatcacaacagaccaccactactagagaggttcactaatgccctcttccactatgcgaccatgtttgactctttggaggccatgcatcgttgtaccagtggtagagacatcaccgactcactcacagaggtgtaccttcgaggtgagatttttgacattgtctgcggcgagggcagtgcacgcaccgaacgtcatgagttgtttggtcactggagggagaggctcacccatgctgggctaactcaagtgtggttcgaccccgatgaggttgacacgctaaaagaccagttgatccatgtgacatccttatctggctctgggttcaacatcctagtgtgtgatggcagccttgcactagcgtggcataatcgcccgttatatgtggcaacagcttggtgtgtgacaggaggaaatgctgccagttccatgggtggcaacatctggaagggtacaaatgatagtagaagaaaggaaaaccgtaatggacccatggagtagcaaaaagaataaccatgtcatgagcaaatcgatcaactaataaaatgcactgatgacatgcatggtgatctaaaaaaaaaaaaaaaaaaa

SEQ ID NO: 8222 - DNA, 915 bp, Zea mays
  Predicted polypeptide sequence is orthologous to G307, G308, G309
ccgtgccagcccagtgtcaggcacccctcggcctcctccacgcagtgtccttccccggagaagagcccaaccagcatcctcgcctgccgcagcgcgttggcccccagcggcacggcggccagccccgtgcgacccagcctgtcacgccaccgccacagcggctcgtgccgctccctgcgccccgcgccctcgccgcacacgatgtcgcagatctcgcgctccaggtaggcctccgccgccgcgtcgcccgcgccgccgctcgccgcgtccagggagtcgaacaccgccgagtagtagaagagcgcctccgtgaaccggtccaggaaccccggcttgttgtggtccgcctcctgctccaccaccgtgaacaccctggggcgcacggacgcgacgcactccagcacggcgtcgatgggcgcccgggcgtcgcccgacgagggagcgtcggcgaggaggcggtgcagctggagcacggagttcacggccacggcctcgccctgcgagacctgcagcatccagggccgcacctcgtcgaggcggttggcggccacgccgcggaaggagaagtggacgcgcacggagcgcgccaggtcggcgaggcggaccccgacgtcgcggaggtcgtcgcgccctggcggggacggcggcccaatgcccgtgaggcggagcgacggcggcccgccggggcggagcgcgagggcctggatcagcgctggccactggaggccctgcatgatgctgaagtcgatgatgtgcacgtgcttgcagccctggacggcctccaggatgggctggttgggcgtgaagtgcgcgaacttgaggtagggacccgcctcgtagaagcggtggtagaggaaagctcggtcggcgtcggcggcgtgccgggccgggggcgggagccaaagcgaaggcgaa

SEQ ID NO: 8223 - DNA, 764 bp, Zea mays
  Predicted polypeptide sequence is orthologous to G312
cggagcgcgtggcgttctacttcggggacgcgctggcgcgccgcctggcctgcggcggcggggcgcaagcgcaacccttgacggcggtggacgcgcgcttcgccaccgacgagctcacgctctgctacaagacactcaatgacgcctgcccctactccaagttcgcgcacctgaccgccaaccaggccatcctggaggctacgggcacggcgaccaagatccatatcgttgacttcgggatcgtgcagggtatccaatgggcggcgctgctccaggcgctcgccactcgcccaggggagaagccgtcccgagtgcgtatctccggtttaccctcgccgtacttggggccaaagccagcgacgtccctcgccgcaaccagtgcccgtctccgcgacttcgcaaagcttctcggggtggagttcgagtttgtcccattgctgcggtcagtgcacgagctggatcggtcggatttcttggttgagcctgacgagactgtagccgtcaatttcatgctccagttgtaccaccttcttggcgactccgatgagcccgtgcggcgagtcctccggctggttaagtcactcgatccatcagtcgtcacccttggcgagtatgaggtcagtctgaaccgagctgggttcgtcgaccggttttccaatgcactgttgtattacaagccagtgttcgagtcacttgatgtggcgatgccacgggactcaccggagagggtgagggtggagcgatgcatgtttggggagcgcatt

SEQ ID NO: 8224 - DNA, 789 bp, Zea mays
  Predicted polypeptide sequence is orthologous to G324
gcacgaggagagagtgaaggcggaagttgctgctgctgttcaggcatcagctatgcgatttgagtatacaaattcctctcaaagtcacaacgatgtcatgttctctctggatgactttgaagccctgggaaacaacgctgggccgtccaccagtccaccagcgagtgaaaggaagcttttctctgatgtaacacgcttgggttttgcatctgctcaagactcacctcccttaagactcggaactggggatgcaaatggccaaagtgaaacctcgagagaccaagggccgttagcgacacccgcattatcatttgccagcatcatatcttccagtagagccgtgactgcagctgacaactcggagatgcagaaagcaaatggcgctgggaagaagggtaagaaagcaactagagtgcttttgtcgactggtggtggccgtcgatactgaaggactatagatgcattggaacgaacagtttggttgtttccatataatgccgtagctcaatgcaatgtgcatagtacataacctggctgggatacgcttgtaagttgtaacactgagcggcagtcgtgtgtgttttgcctttcttgtgggtgtgcttgcgttgtgcccacatcctgtcccttgcatgatctggaaacgagcgcagagaagcgtgtaccataactaataaaggtggcgcaacactttagttgtggaacgccgctagtctgcccggagtgtcaaaatctccaaaaatgtgtacttttgatcattgaacatagttcatcagggttcaaaaaaaa

SEQ ID NO: 8225 - DNA, 873 bp, Zea mays
  misc_feature (827)..(827): n is a, c, g, or t
  Predicted polypeptide sequence is orthologous to G324
ccgtcgccgccgttcgaccgagcgccgctcacccaccccacgagctcccgcgcgggttcatgtccatctctccacacgaacgcaccggaggagcctattacccgcgcccgcacaaccctagccctagtccccaacatggcagcgacagacgccgccacggccgccgctcccctccggcatccgtctcgccacccggcgccgctgcggaagctagcgacggcggggtcggctcgagctccaacccagtggttccagctattggagaatctattaatgctcccgaaaaggtagttggatttataatatctggggaagagaatgatacatgtacacaagaggttggcaatgtttcagaatgccactcttcagaacagggggattccggtttgcctgtagataattttggctcagttgggtcatatcctgagagacctaaaatggtgggatcccttcaggctgaccatttggcttcaggttctactggactgggtaatgggactcagatagctgccaggaagaatcagaccgtgaatgctaatcacctactgaatttccagtatgatcctatttctcggccacagcccagaggccctagaacatatcttccgagaagacaaaggaagataaaaccttacaacaaggatctgttcatccaagcaaactataagtttgttgtattggatactgggaattaccagattgattcaatggatcctgataagatgcttcagtgggaagatattatctgtgtaagatactatagcccttctgaggtacaatgccctatttgcttggaaagaccattgtgcccacagatcacatcatgncgacacatatattgcttttcatgcattttacgttatctaatgatgg

SEQ ID NO: 8226 - DNA, 559 bp, Zea mays
  Predicted polypeptide sequence is orthologous to G326, G1337
ttttttttttttttttttttttttacaacaagcagtaccgtgcaatctctggagttgactgcccaacaattggccctgatcgctatagcttccacgcaaaacttgggccgcgtgcgtagcgattcctgccgcgccatacatacgtacgtagcaatccgtaccatctccaggtagcattgcctagctctccgttgctaacgcaggcgtgcagcagacacgcgggcttcacaggccatgcatatatatatggctgcctcatccgccgtacctggcggcgttgagtgcttcggtggacttgacgaaccgccctttcacccgcttcctcgtgtccgcccgcagcttcctcgactcgtaccggatgtgcttctcgtacctgcggttcttcttcttctccctgtaccgctgcatggcgctgtccctgttctgcgcaagcgtctcgctgtcgatcctcacggcggcaggcctctcggtctcggccgcgggggcggacaccgtctgatccccgaaggagatctccctggtgagcgctgctcctggacctggacctgaagcgggtacg

SEQ ID NO: 8227 - DNA, 1057 bp, Zea mays
  Predicted polypeptide sequence is orthologous to G326, G1337
gcacgagcttcaatttaggacggtcaaggcatcacgatgagaaatctgctcttgaagttggatacggttctaaccatggcggctttatgattaagagttacagtgacatgcttaaggacatttcttcggggacaacgaaagatctggaagatatttatgactcaagatactgctcaaccgccgaagatatcatgtcctctaatatctgtcagttgtcatcgaaaaatgtgagcaccgggagcaacaaacggaaggtgaggtcatgtgctgcgtcgacgatggatggaccaacgacctccgggaaccacaaccacgtacccgcttcagcttcaggtccaggagcagcgctcaccagggagatctccttcggggatcagacggtgtccgcccccgcggccgagaccgagaggcctgccgccgtgaggatcgacagcgagacgcttgcgcagaacagggacagcgccatgcagcggtacagggagaagaagaagaaccgcaggcacggatccatgagctgatcttgatgacccttacctacctagcttgcctgctgcgacttgtgcggtattaagaataggctgttacatgttgtgtcccatcatatcgttcgtgtccgcagtacgagaagcacatccggtacgagtcgaggaagctgcgggcggacacgaggaagcgggtgaaagggcggttcgtcaagtcgaccgaagcactcaacgccgccagatacaacggatgaggcagccatatatatatatatatatgcatggcctgcgggcggatgagtttgctgcgcgcctgcgttattacgtgcggtagttacctcacggagaggtaggtactgctacctggaggtgctacgtatgtatggcgcggccggaatcgctacgcacgcggcccaagtttaattttgcgttgaagctatagcgatcgtggccattgttgggcagtcaactccagagattgcacggtactgcttgtttgtaacagacgaccctccctttccccttttttctctgttgttgccgtcatccccaccagaacagaaagtatgtagctt

SEQ ID NO: 8228 - DNA, 655 bp, Zea mays
  misc_feature (567)..(567): n is a, c, g, or t
  Predicted polypeptide sequence is orthologous to G326, G1337
gctggtccggccccagcgattcggtttggtgcgcctcgtggtccacgtgcgcgggctttgtgctctctcttccctctgtgtgtgtgtcagttcgtcgggtaggttggtggcggcgtgagagatgaagagctgcggcgggggaggagcggacgggcagcagtgcccgtgcgactactgcggggaggcggcggcggctctgcactgccgcgcggacgccgcgcgcctctgcgtcgcgtgcgaccgccacgtgcacgccgccaacgcgctttcgcggaagcacgtgcgggcgccgctctgcgcagggtgcgccgcgcgcccggccgccgcgcgcgtctccctcggcgccgacccggcgttcctctgcgcggactgctgcgagggctgcgccgccgcttccgcggcgcgcgtgtcggttgagggcttctcggggtgcccctcggcggccgagctcgccgcgtcatgggggctcgacctccgccgcgcggccgtggccgtgggcgacgacggcgacggcggcgacgacgacgaccccttcctctcggtgctcgactactccgtgctgggggntgggggtggccgacacggacctgcgcgacctctacgtgccgtgcgacccaccgcgggtgcccgtccccgacgccggcgcgcgcccgct

SEQ ID NO: 8229 - DNA, 750 bp, Zea mays
  Predicted polypeptide sequence is orthologous to G326, G1337
accgggcaatctctggagttgactgcccaacaatggccacgatcgctatagcttcaacgcaaaattaaacttgggccgcgggcgtagcgattccggccgcgccatacatacgtagcacctccaggtagcagtacctacctctccgtgaggtaactaccgcacgtaataacgcaggcgcgcagcaaactcatccgcccgcaggccatgcatatatatatatatatatggctgcctcatccgttgtatctggcggcgttgagtgcttcggtcgacttgacaaaccgccctttcacccgcttcctcgtgtccgcccgcagcttcctcgactcgtaccggatgtgcttctcgtacctgcggttcttcttcttctccctgtaccgctgcatggcgctgtccctgttctgcgcaagcgtctcgctgtcgatcctcacggcggcaggcctctcggtctcggccgcgggggcggacaccgtctgatccccgaaggagatctccctggtgagcgctgctcctggacctgaagctgaagcgggtacgtggttgtggttcccggaggtcgttggtccatccatcgtcgacgcagcacatgacctcaccttccgtttgttgctcccggtgctcacatttttcgatgacaactgacagatattagaggacatgatatcttcggcggttgagcagtatcttgagtcaaaatatcttccagatctttcgttgtccccgaaaaaatgtccttaagcatgtcactgt

SEQ ID NO: 8230 - DNA, 891 bp, Zea mays
  misc_feature (1)..(1): n is a, c, g, or t
  misc_feature (6)..(6): n is a, c, g, or t
  misc_feature (687)..(690): n is a, c, g, or t
  misc_feature (694)..(694): n is a, c, g, or t
  misc_feature (710)..(710): n is a, c, g, or t
  misc_feature (712)..(717): n is a, c, g, or t
  misc_feature (722)..(723): n is a, c, g, or t
  misc_feature (741)..(741): n is a, c, g, or t
  misc_feature (745)..(748): n is a, c, g, or t
  misc_feature (771)..(771): n is a, c, g, or t
  misc_feature (775)..(775): n is a, c, g, or t
  Predicted polypeptide sequence is orthologous to G328, G2436, G2443
nccggnattaccgcgtcgaccccgcgtccgcaggttttaaaccggcttttggaattgtacacatggatcaatttgtgggagtggaaattagagcagatttctgtgctttttttttttccagcacatctgccagactagtatcatcagcaattgtccatcgcagcatagtaccagacaacatggcaacgacagacatgccaagctccggcatcctgctgacgcctgctggggccatcagcctgttctcgtcgggtcctccgctccagatgccgcttcacttggcctccatggacagggaggccagggtgctgaggtacagggagaagaagaagagcaggaagtttgagaagaccatacggtatgcaacgaggaagacgtacgcagaagcacggccgaggatcaagggacgcttcgcgaaaagatcgtctgatatggatgtcgaagtggatcagatgttctcagctgcggctctgtcgtctgatggtagctatggtaccgttccatggttctgaaggaactttagtgagacattatatgtatcatacagtataataattgtaacatgcgttgaccatatatagtggtaaggtcaagtacaagtagttctaggaaaccgatggtaatgagtgatattgtgtttgttttgaaagataaatgaacaaatatcttagcattaaaaaaaaaaannnnaaanaaaaaaaaaaaaaaanannnnnnggggnnaaaaaatataaaggcggnaaannnnaggggggggggccgtgcaaaggnatcntggtttgggcgggcgccttactaaaatacgactgccaaattcatccacctgggcgaatggaacaccctggggataacgaaataatgggggagacccccctttcccccttcgagagc

SEQ ID NO: 8231 - DNA, 678 bp, Zea mays
  Predicted polypeptide sequence is orthologous to G343
cgtcgtccaacaggccagcgcgcggcaggaagagcccggggcccggcggggacgcggtggcgggctcggacggcggcgtgcggcggtgcacgcactgcgcgtcggagaagacgccgcagtggaggacggggccgctgggccccaagaccctgtgcaacgcgtgcggcgtgcgcttcaagtccgggcggctcgtgcccgagtaccgccctgcggccagccccaccttcgtgctcacgcagcactccaactcgcaccgcaaggtcatggagctgcgccgccagaaggagctcatcctcatccgcggaagccaccgcgacgccgccgcggctgcaggagcaggatccgccgggccgaggccggagctcatgttccgcgactacggcgtgtgttagttagctgcggcactgaggaagctcgatcgcgtcgtgcttgtgcattgcatgcgtgggagcttctttagatccgcctcttgcgaaattctgccgcgtttcttttcctcctttctttcccttccgatccctgcgtattccagacattttcgttttttcttttgttaattattacattgttggtacgacctacctcctccctgcttcttctaagttctaatgagagagcaatgaattctgttggtacaaattgtggtcgttttgtgagtaatcatgctcctaaacccat

SEQ ID NO: 8232 - DNA, 440 bp, Zea mays
  Predicted polypeptide sequence is orthologous to G343
agaacacgcgccctggtatcaacttatgaaactacaatttgcatctttcatgttccctttctttcatcccctgcattagcggtcaatcaacaatgtgcatgcccgacatagcaagttctcctctctcacgcatttcatcaagcagcctcccagcaccctccaaatgtaaaacttcacataaccatcaaccgtcagcacccgtccacgcattcaaaatacattttacttgtgttgagttgacttgtttttccctaagaacaagaacaagcagacttctctagtggatgcgatgcggatgcggatgctagacaatttgccgtgggacctgaactcctactgcatgccggactttactgtgtaatagcagcaggaacacaacagctgccagcagaaagcaaaagggactcccgttccagcagtgagaccaggagccctcggtc

SEQ ID NO: 8233 - DNA, 467 bp, Zea mays
  Predicted polypeptide sequence is orthologous to G343
cccatttgaaaccttgaatttttaatggacctaaaacccttaccacaattcaggacaacatccagattgaattgaatccgacgacaaaaaacaccaaccaaaacaaactgaactagaaggccgctagagctaacgacaattgcctattactactataaccaaagtctctgttctcatcctctctgaacaacaaaaaaactaaaaggtaaaaaaacccctaacgcgcttccaaggatagattccgggagaagtcgggctccctgctgaagcgggggggcttgccgcatcggcctgaccttatggggggagttggagtgcaagcaaataacgaagggggggctgttggcgggccgggactccgtcaccaacctgccggacttgaacctgacccagaaagctttgcacagggtcttgggcccaaaaggccccgccctccactgcggggtcttggaggacagggagggggg

SEQ ID NO: 8234 - DNA, 825 bp, Zea mays
  Predicted polypeptide sequence is orthologous to G343
ctctccccaggagacggtggcaatggcctccgacgagccacagtcgcagctgactggcctaggcgatccaaaagccagccgatctgatgcggcgaccatggtgacgaccggcggtgctggcgacggggaggaggtgatgggggcggagagccccctcgacttcgtcctcgtcggcacgccttgggggctgctcctcgctcccacaccgctggcgagcatgaagcaggacgaggaggaggtgagtgctcctccctgtccagagaagacacctgctgcagcgaatggggcgaagcagtgcgtgcagtgcggcgcgaccgagacgccacagtggaggatccagccgacggggcagggcgcgctctgcaacgcctgcaggatccggctcaggccggccgaggcgctgcgggagaaggtgcacgtgcacgcgcaccgcccatcggcgccggcgctagggccggcgacgtcgacggccatctccgagcctccagcggacggctggatctcgggggcctggatggatttcgacgcgcacctgctgaaggtgacgcctccccctcccgccaggcggcaggagtctccgtccccgacgacggaaccagcgccggagaagaagacacggaagaggaagccgtcgacgcggcggtgccaggctgccagcactgctgcaagtcgtccgcgtcgacactgactgcagtgggggacggggccgataggccccagcacgctgtgcaacgcgtgcggcgtgcgctacaggcaggttcgagttcgactcctgcaggaataccgcccggcggcgagccctaactttcagcatgtctggctctg

SEQ ID NO: 8235 - DNA, 661 bp, Zea mays
  Predicted polypeptide sequence is orthologous to G343
ctccaactctctctccccctcctcagtcctctctcacacacacactcactctcgtcaccgaagactagcaaggctagctactagctcgtactggaactagctcgtttcaaggaacttgccgcgtgccaattgcataagtacgtcgtacggttaggcctccctcagttatctcttgtacgttgtgttcgcgatggcgtcggagtgggaaatggccatgggggtggagctcggcatgggaatgggcacgtaccactaccaccacaacgcctccagcatcaccaccgcgccgatgagcagccaccacagcggcggcgccagctactccacgccgcaccaccaccactactatgggatgccgcccacgggcggcgccggcgacgccatgcgcgtggacgaccttctcgacctctccaccggcgccggcgccggcgcccacgagttcttccccaccgcgcctgcgcccgcgaccactgacaaggggcaccaccacccgggagccatgggtgagccgtcacccaccgccgccaactcgtcggatcaccagacgtcgctcctctccttcgccgatgagttctacatacccagcgaggaagctgccgagctggagtggctatccaagttcgtggacgactcctactcggacatgcccaattactcgtcg

SEQ ID NO: 8236 - DNA, 887 bp, Zea mays
  Predicted polypeptide sequence is orthologous to G344
ctccgctagtccgctctcaagtaaaaagctcccgaaatcccctcacctactcctctccctctccctctggcagcgccgcctcgccggcggttgcctgcctgcaccttcgccccccgtctcgacctcgacgcggcctccgttcctccgcgagacgcagcatggatgtgcgccctgcgaatgcggccgacgactcgtctctcggagacctgttcccgcaccagcccgccggtttggagagtgacgagagcaacacagaatggctctctggttacgtagaggactgcttttcgagctccacgtcgtacacaaatcccgtctctgcaatggcaagcgagggtgtcggaaaaccaaagctacctccaccaccatcctccaacggcaggagaaagaaacggagcttggcctccgtcatgaccaacggcgactaccaacaattcgtcctcccgctgtacgtcgagccaccgctgatcctgatcgaccagaaacactggatggcagagagcgagctgatccaccccaagaaggacgacgacgaccgagaggtttgccagcaacaagggcaggagcaagagaagggcgtgccgcggctggtgaagatgtgcagcaactgtctgtcaagccaaacgccacggtggagggacgggccgtcggggcgccagatgatgtgcagcgcatgcggcatgaggctcaagccagagaccaggttgtcagccgagcagcagtgcggccaggaagaacccaccaggaaggagcaagagccagacaggaagaggaagaaggcggctcagaagacgtgctacgagagcagcgacgccccgtcgtcgtcggaccagcaagagaagcggtgcgcccactgcctgtccttccagaccccgcagtggagggcg

SEQ ID NO: 8237 - DNA, 420 bp, Zea mays
  Predicted polypeptide sequence is orthologous to G344
gaggcttagcccggaagcaaagagataatcaggccgaagataggaaaaaaaagatggcagctttacgcccggtttgcgcggtgaaaacgatgatcactcggctgcaggctgcgggatgcggcgccgtgtcaaaaaacgcctggggccgatgagcgcgcggttctgtgtagattactgtggtgtggtgtttgctgaggagttgatgtagccagcccgagttcaccaatgggggaccggggtttcttcgtgcagagtcaacatctgcctatggattacgataaggctggcactggcatggcatcatcgtgcgcacgctcgcagccaccacgctgtttttttttgaatatttcggtgccactgggcggttgaactgaatgcaccgttttgaagccaaaaaaaaaaaaaaaaaaaaaaaaaaaa

SEQ ID NO: 8238 - DNA, 554 bp, Zea mays
  Predicted polypeptide sequence is orthologous to G347
tttttttttttttttttccttatatgaaaaacataagcgcttaaaaccacttgattttacattagctgtcgtcgttgtcgatgatgacgagattagccggaatgaagtgagttgttggtcatcttttccacgaggtgacaccaacggcaacactgctcaccagtttgcccttttcatccagcgtcttaggattctccaccagaaccatcgtctgctgcggccgagcatccctggttggaactggattgacgttgcggcatgtcgggcacccgactgtcgtcgctcccggcgggtatgccagggttgtccggcattgcccgcacgacaggtgccccatctggtttcctgatcttgtcgagccgagcctgccgcagtgagggcaccgtacgttagttgcgctgcgggagtgcaccagcatggtgaagcagccgccacacacgagctcatacatcgccggcccaagcatgcaagctaattaatacgcacacgaaaattggagaaagaaagggatcctgtttattcgtttaaattgctgctgctggcaaacctaaacc

SEQ ID NO: 8239 - DNA, 1158 bp, Zea mays
  misc_feature (51)..(55): n is a, c, g, or t
  misc_feature (61)..(83): n is a, c, g, or t
  misc_feature (118)..(122): n is a, c, g, or t
  misc_feature (665)..(669): n is a, c, g, or t
  misc_feature (713)..(717): n is a, c, g, or t
  misc_feature (843)..(867): n is a, c, g, or t
  misc_feature (1043)..(1065): n is a, c, g, or t
  Predicted polypeptide sequence is orthologous to G347
cggtggcgcctgcctctcgccgccgatacggtgcctctcgcggtctcgctnnnnntcgcannnnnnnnnnnnnnnnnnnnnnntccctttgcttcttggaggtgtttgttgccgtctnnnnngcagttcttgagacatgcagagccagatagtgtgccacgggtgcaggacccttctgttctacccaagaggtgctccgagcgtgtgttgtgcggtatgccatgtggtcaccaatgtgccgcctccagcaatggagatggctcgacttatatgtggtggctgccagacattattgatgtatgctcgcagtgcaacaactgtaagatgctcatgttgtgacacagtcaatcttgtcagaccagtgagtagcatagctcatgtgaactgtggccagtgccaaacagtgttgatgtatccatacggagcaccgtctgtcaaatgtgctgtttgcaacttcattacaaatgttggcggggtgactcccatgatacctttgccaccaccagcactaactgcatcaagtggaacttcatatatcatcccgtcaatttccgtgccgacgaatcaaccgcggaatgtaactgttgtcgttgaaaacccaatgacagtagatgacaagggaaaattggtgagcaatgtcgtagtaggggttacgagcggcgggnnnnngtgacggcatatcacaacccgtgtagctttgtccaaactatctnnnnngggtttaagaatacataccttgtatcatactgctgtttggcgatcggctgctcgacagaggaggaattcccctccctggagagtgtagtggcaaagcagcgcggctttcgccactgcgatcgtgcnnnnnnnnnnnnnnnnnnnnnnnnngcgggtgtgcatactcagagtatatctgtagcttgttaccccttgattcttttgtatgtaatatgggctctgcctgactttcactgtgtgatcaaatttccaagcccgtgggcgctgttgctgcgtgccttgttattagtgaataacaaacattgcaaatggctcttgaaatacannnnnnnnnnnnnnnnnnnnnnncatgtatgttaatcagcaggtgccaccatttgctgttccagactgataatgcagagtttgtatccacgttctttggagaaaacatttgaggct

SEQ ID NO: 8240 - DNA, 676 bp, Zea mays
  Predicted polypeptide sequence is orthologous to G347
gttcttggaggggtttattgccgtcgcctctccgcgtggttcttgaggcatgcagagccagatcgtgtgcaacgggtgcaggaccgttctgctctacccaagaggtgctccgagcgtgtgttgcgcggtatgccatgcggtcagcaatgtgccacctccagctggaaaatcctccagccaaaacaggctctgggccttcaagaaagtgagtagtagcatagctcatgtgaactgtggccagtgccaaatagtgttgatgtatccatacggagcgccgtctgtcaaatgtgctatttgcaacttcattacaaatgttggtggggtgaccccccgtgagacctttgccacctgcactacccgcatcaattggaaactcatacggcatctcgtcaacttctgtgccaacaaatcaaccgccgaatgtaaccgttgttgtcgaaaacccaatgacagtagatgacaagggaaaactggtgagcaatgttgcagtaggggttcaggtggcgggaaaaagtaaacatgccacaaaggcacaaaccgtgtaactttgtttactatgtttaaaatatccgaaaaggtttaagaatcagtggcggactgtcacacccgtttcccaggggcagagccgggtgcatagcatatatgtgccaggatctatttccacacatatgttgac

SEQ ID NO: 8241 - DNA, 819 bp, Zea mays
  Predicted polypeptide sequence is orthologous to G347
cgactggtcccctccttcctcttctcttcctcttcctctcacatcccggacaaatccaatccgaaatcatctccccctcgcctcgcctagaagaggaaggaagaacagagataagcgacaacgcgtccctcctcgccttcctcccgcctcgagctcttcccggagcaaccggagccacagacgtcaggacagcctagcgcgttccacgccggtatgcagaaccagatcatgtgccatgcttgccggacccttctgctctacccgcgtggcgcgtccagcgtctgctgcgcggtttgccaggccatcaccaccgtgccgccaccaggattggagatggctcagcttatatgtggtggctgtcgaactttgctgatgtatactcgcagtgcagacaccgtaaggtgttcatgttgcaacacagtgaaccttgttagaccagtgaataatatagctcatgtgaactgcggccagtgccggacaactttgatgtatccatacggcgcaccttcagtaaaatgtgccgtgtgcaattatgtcacagctactggagtaaatactgtggcacccaccccatctgcgaggccaacatcagatgggtcttcatatagtggctcatctacttctgctcctaaatctcaatctcagaatgtaactgttgttgttgagaaccctatgacagttgatgacaagggaaaacttgtcagcagcgttgtagttggagtcacagctgggaaagagtgattttattgacacttcgtacatcattgttgtgttttctatacacgaagttgggaaataccatgtagcatccaatgatgg

SEQ ID NO: 8242 - DNA, 610 bp, Zea mays
  misc_feature (15)..(39): n is a, c, g, or t
  Predicted polypeptide sequence is orthologous to G351, G545
ttttttttttttttnnnnnnnnnnnnnnnnnnnnnnnnnttgatatcgatgaaacatcatacgcatcttcctttttacatgaatcgatggacatatgatctcagtcgcaggtagcgagagttaatgatggattcgaaatcctgcgcttcttgatcggcagcgggctctgcacctcctcctcctcttttacccatcgcctcatcccatcgctctccggcacaggcatcaggttgaggtcaaagttcctgacggtgacgcctgatgaccccgtccccgtacccgtagcggacgccgtcgccgacagggagacggacacggagctgccgtcccagtagtggcagcgcttgtgcccgccgagcgcctggcccgtggcgaaccccctccagcagatggtgcaccggtgcggcccacccgacgtcgtcgtcgtctcctcggagtggtctgccgcctgctgcgcggcggcgagagcagcagcgtactgctcccccgtgggcggcctgcggtggctggacttgtggccgccgagcgcctggtaggacgcgaaggccttcccgcacaccgcgcaccggaaccggagctcctcctcctcgcgcgccggcgccggcggcgg

SEQ ID NO: 8243 - DNA, 576 bp, Zea mays
  Predicted polypeptide sequence is orthologous to G351, G545
tttttttttttttttaagcagtcacttcagtttactagaatcaattgataatcgatgaaacaatcatcacgcatcttcctttttacatgaactcgatggacatatgatctcagtcgcaggtagcgagagttaatgatggattcgaaatcctgcgcttcttgatcggcagcgggctctgcacctcctcctcctcttttacccatcgcctcatcccatcgctctccggcacaggcatcaggttgaggtcaaagttcctgacggtgacgcctgatgaccccgtccccgtacccgtagcggacgccgtcgccgacagggagacggacacggagctgccgtcccagtagtggcagcgcttgtgcccgccgagcgcctggcccgtggcgaaccccctccagcagatggtgcaccggtgcggcccacccgacgtcgtcgtcgtctcctcggagtggtctgccgcctgctgcgcggcggcgagagcagcagcgtactgctcccccgtgggcggcctgcggtggctggacttgtggccgccgagcgcctggtaggacgcgaaggccttcccgcacaccgcgcacc

SEQ ID NO: 8244 - DNA, 716 bp, Zea mays
  misc_feature (8)..(30): n is a, c, g, or t
  Predicted polypeptide sequence is orthologous to G351, G545
tttttttnnnnnnnnnnnnnnnnnnnnnnnaatacggttaaaagaatgaagctacgaaaacactctacatgcctcagctcaccaaaaggaactctaaatcgttaaactaagttcggtggaaggaccggaggacagccgccgcttcttgaccggcaaggggctctgcacctcttcctcctctcgccaccttgcctttcttgcggccggcaccaaattcagatcgaagcccctcaagctggacgcggaccccgacgccgccgacgcggtgagcgacaccgagagcccgtcccagtaatggcacctcttgtgcccgccgagcgcctgccccgtggcgaagccccggtggcacaccgagcacctgtgcctcccctgcccggcgccgctgccgcccgccgacgaggtattcgtcgtcaccgacgacgacgacgacgccgcctgtacgagcgtcggcggcggcttccggtggctggccttgtgcccgcccagcgcctggtgcgacgcgaaggccttgccgcagacggagcaccggaagcggagctcgcactcttgcgtcgtcatcgtcgtcgtcctggcactggcagccgcagcgtgccctcctcctcctcccgcggctgcgagcgccatgaggcacagggagacgtagtcgtcgtgggtgatggccatctatcggtcacggcgcgcgagcgaggcttgttgaaaagctaatgctgctagct

SEQ ID NO: 8245 - DNA, 437 bp, Zea mays
  Predicted polypeptide sequence is orthologous to G351, G545
ctttttttgataattcttattgtgtttatttacatgtattatttacacaccaatgaaagaattgatccttgcttctacctactcctatatcacatgtatgtagctaataaacaatgaatatgatgactgtatatacacacgatccgaactaatcaccactacgatctagatgaacaatccaagacacggagcacaagtgacgaacaaatgagctgctgatccacacgagcttaacactaactaggccgggatcatgaagcggggcttcttgaacgcgagcgggctgagcacctcgtcttcgtccacgcccgcgcaccgctccggcagcgcaggcaggttgaggtcgaaggcgacggcctgcggcggcggcggcgccgaggctggcacggaggtggcggcaccgaggctgctggtggccgccgaggctggcacggagg

SEQ ID NO: 8246 - DNA, 690 bp, Zea mays
  Predicted polypeptide sequence is orthologous to G361, G362, G370, G1995, G2826, G2838
cgcctcacaagctacggcgagctactaggcgaagtagaattattcctggggccgcgcggcagctagctcctagctcgcagccggccatggcgaagccgcaggaggtccgcagcgtcgactccttctcgcagctaccgttcatccggccggcgccggcgccgagggacgccaccatccgtctgtttggccgcgagttccccagcgaccacaaccagcagcagcaggacgccgcgtccgactcccccgacgctgccaacaacggcagcacggtcacgtgcgagagcaacggcgcggccaagagcggcgccgcggccgagaggaagttcgagtgccactactgctgccgcaacttcccgacgtcgcaggcgctgggcgggcaccagaacgcgcacaagcgcgagcggcagcacgccaagcgcgcccacctccaggcctccctcgccatgcaccgctacgtgcccggacacatgtacggcctcttcaactactacccccacccccaccccatcggcggcggcgcccgctttgaccaccccgcgccgccgccgccgccgctgcagcactacccgatgtggacgactagcgccagccccgcggggccctacggcggcggcccgggctccatgtcgcagccaatcaacggtagcccggtgcccgcggggctctggagggtgccgccgcccccccgcg

SEQ ID NO: 8247 - DNA, 939 bp, Zea mays
  Predicted polypeptide sequence is orthologous to G361, G362, G370, G1995, G2826, G2838
ccgccacacccacatcacatccctccctcctagtcctagctacaacgaccagcgatatagtaaggtgacacttacccggcctgctccacacagtgccccaagcaaaaacctatcgctcctatacatctggcagttgtgccactcctttgagcaacacatcacaccctccctgctgcgggccggatcggagctgcagctgcccttgcttatattccctggtctctcctctccattgcttccttcagctcctcgctctcctcagtccttaccatccatcgatcgcgaaggaagggtgctgaggaggctttcccatgcaccctcgttccctactagccacacaccagctatgagacaccccggctacttccttcttggtacgtactggtggcggtactgaaaactactccgcagagatacacgagaagacgtatagttctgtacctagccaagccaagctacctccctcgctcgctccacacctgcctgcatgggcggcggcggcgaaggcagagacagcggcggcggcggcggcgcggcgagctttcgggaggcggctcgtgacttcagcaacgtcgcgtccttctccgagcttccgttcctgcagcgctccgccgccccgccccgtggaagcccccacaactccggcatccgcatcttcggcatcgacgtcccgcactccccaccggagagaaactctaataaagatgccacggccgctactactactaccgccgccgcttccgccacgcagagcagcggcggcggcggggccaccaccgacagcagcagcagcagcagccgcaagttcgagtgccactactgctgcaggaacttcccgacgtcgcaggcgctcgggggccaccagaatgcgcacaaacgcgagcggcagcacgccaagcgcgtgcagatgcagtccgcgatggccgccgccgcagccgc

SEQ ID NO: 8248 - DNA, 570 bp, Zea mays
  Predicted polypeptide sequence is orthologous to G363
acgcacccacgaaacaataagaataatccggtcaagcaagagaccgccgcgatctgaccagcgccagacatggaccgatcagtttaaaaaaagaaaagaaacagcctgacggattaaccagtctagtcgacggatcagttcgcagttcacagcctgagcgtcagatcgggctcctcccgggcgtgcacggcgacgccgccggccgagtccgccggcgcagcggcgtctggcctgaagctaccgggccagccgaagagcatctcctcgtcgtcggccacgaggaacggcatggggctcagcagcccccgcgcgggcctcctcagctcgtcggcgccggcgcgcgcgtcctcgtgctccgggagcgctgccgccgacgcgtgcgcctggatgccgatggggtacaggcaggagccgtacagcggcagcgacgccacgtcggcgtagtagccgtagccgtagccgtagtaggggcccgctgcgtcgagccgcagcgcgcgccgggccagcgtgcgctcccgccggtgcgcgttctggtgcccgcccagcgcctgcgagctgaagaacttgcgc

SEQ ID NO: 8249 - DNA, 696 bp, Zea mays
  Predicted polypeptide sequence is orthologous to G363
ttttttttttttttttcgaaaaagagagatatctcgagctcttgcacatccaactgctgtacaaaaattcttgcacgcacacgaaacaataggaagaatctggtcaagcaagagaccgccacggtctgatctgcatcagccatgggccgatcatcaatttaaagagaatgaaagcctgacggattaaccagtctagtcgacggatcagttcacacacacttcacagcctgagcgtcagatcgggctcctcccgggcatgcacggcgacgccgccagccgagttcaggacggcgctccccgccggcgcaggagcgacggcggtggctggtctgaagctcccgggccagccgaagctcatctccgcctcgtcggccacgaggaatggcatggggctcagcagcccccgcgcgggcctcagctcggcggcgtcctcgtgccgctgctgctgctccgggtgcgctgccatcgatgcgtgcgcctggatgccgatggggtacaggccggagccgtacagcggcagggacgccacgtcggcgtagtagccgtaggggcccgccgcgtcgagccgcagcgtgcgccgggccagcgtgcgctcccgccggtgcgcgttctggtgcccgcccagcgcctgcgagctgaagaacttgcgctggcagtagttgcacgtgaacacgcgcgacggctcgcgggcgaccg

SEQ ID NO: 8250 - DNA, 737 bp, Zea mays
  Predicted polypeptide sequence is orthologous to G363
ggagctcgcaatatgcttgtcatatcattttattacaatcatgtatttgtaagtagtacctgctttgaaggtctcaacgtataatcatgtatttgtaagtctgttcgcttgctttaatccataccgtcttctactacttctatagtgttttgtctctatgaattgcagtcgcagcagtctgaacagtccgaactgcatgagtaagactttacaacatgtgaatctttgttattggtaaagaagcaaatgtcttgaatatggtttgtcttgtgaaacaatctttaccaatgaaacaaaatgtatgatttcgaactggttatcacaaagatgcagagtaaactaataaacatttacttccatcctcctttcaacctgctacaagtaacataagagcagataaagtgcagccgttgcacatgcgcgcgcgcgggggagcatagtctatacttgttcaccgaacagaaattatgaaaaggattacacgactcagaacagaaaatgctaacatatgatgacctacttattacaatttaatttacaagcgcagggttaggtcaagatttttctccatttgcttcttggactcatctgaacttgctgtgaagctccctggccatactaaccctccaggttcttcaactgcaaaaggcatccatccactcatttggcctccgtcgaatcttgctacggcaaccgcagctctttcaccatgacccttcagaatcgtggagtgcgag

SEQ ID NO: 8251 - DNA, 496 bp, Zea mays
  misc_feature (471)..(471): n is a, c, g, or t
  Predicted polypeptide sequence is orthologous to G370
gggtcggtttacggttgctcgcatggcctcgcttcccccagcctccccgttgctgcgatcgggagcgatcgatcgaatcggaatccttccgtctagccatgcccgttcttccccgcgcgaaatcaacctctgcctgggtttgcgcatgcggtttgtgttttatccgcgaagtctgtggtttcagttgggcagccccgttgcgcgcgtccctggccaagtccgcgcctgctaaggttgtttacattggggattaccgttgttgcttagagaccgcattcgccggtgcataagaaacatcaagcaaacgaccatccccacaatcatataccgtggtcgaagggcgaggagataagaagtttctctggcctcggccaaaccccaaacctgcagctcttcaccagcgagcattagggctctagataggttaggagacacaccatcaaacacacacctattccacatacacaaaanaaaaaaaaaaaaaaaaaaaaaaaaa

SEQ ID NO: 8252 - DNA, 496 bp, Zea mays
  Predicted polypeptide sequence is orthologous to G375
aatatctccacaatacaatgagtctatgactgcacgagctaataatagtcaccggcaattagtagcaaacataagcacaagtgctcaacgcctcaactacaagcggtggtggccgcaggaggcagtgccgtcgtcgaagttccgggagtagctatgcgggtcgtacccgaacctcaccgcggttcgtctcggccgcgccgctcgtcttctccaagagcgcctcagcctcaacagcaggcgcttcaccgccgcagctgaccggcggccgccgctcctggcgtggaccctcccgcccaagccgctgcccccggtgtacgggcctagcagaaacgccgcctccatgatctatcgttcttcactcggtgggttctcacaggtcacaaacgctcttgccagtttgccactaataactagctagctaggtgctgctccgagctggtaggtatctgtgtgatgcagctgtagtttgctcgtgccgaattcgatctcttttttt

SEQ ID NO: 8253 - DNA, 540 bp, Zea mays
  Predicted polypeptide sequence is orthologous to G375
tttttttttttttttttttataataatatacagaaacccatttctattccaagcttcaaatatatagctccacacaataaagcatcatcctgtacagtgagtctatggctgcaacagctagctagtaatagtcaccggcaattagtatagtcatataagcactgctgcacgagctacaactacaagcggtggtgggcgcaggaggcagtgccgtcgtcgaagttctggtagtagctatgcaggtcatacccgaacctcaccgcggttcgcctcggccgcgccgcgcgtcttctccaagagcgcctcaacctcgacagcagtcgcttcaccgccgcagctggccggcggccgccgctcctggcgtggacgagccgcccgcccaagccgctgcccccggtgtacgggcctagcagagacgccgccgccatgatcgttcactcggtcggttctcacaagtcacggacgctctttgccgctaaccaattagctagctagacgctgtctgcttcgagctggagtacgtacgtatctgtgaatctg

SEQ ID NO: 8254 - DNA, 873 bp, Zea mays
  Predicted polypeptide sequence is orthologous to G375
ctcctctcctagtctcccctcctgccggacgtgtctccactgtccactcaccgcgctccagtccgccacgctgccgggcgctgctggccccgacaccgtgggccagccccggcccgtggtgcgcggagcccagcaacatgcacgcagccacgcaccggcaccgcccggcacgctgctgcctgctgctgccgcctgctagcgcttctgtcgtaccagtactactgctgcgttcctcagttccttcctcgctctcgatctatcaccaaaacccgcctgctaatcactccggtgtgggagttggggttgggttcgggcgcgcaacttttcctccccttcttattcacatctcctcaccagcagccgccggcaccaccatccatccatccatcctctcttcttcctctgcaaatcgatcgcccggccttccggtttgtttgccgctgcaaatcgatcgcgcgtcgctcgatcggtgcatctatcgtctcctccgacgtaccgtcctcgctgcgtaccttccagttcgtcgatcgacaacaaggcaggcaccagcggcaagaaggaatttcagttagtgctctataatatgatcaggtcgtagtcagatcatattgctgctggtgatcgaccgacgatgatggccggggcaccgccgacgatgcacatctgcatggactccgactggctcaagggcatcgtcgtccccgaggagcctgggatgggcggatcgtcgtcctcaccgtcagcggaactgatcgcatgccctaggccgcccatgcacgccgcggcggcggatcaccggcgtctgcgcccgcagcacgaccagccgcttcagtgccccccgtgcgagtcgacgcacaccaagttctgctacta

SEQ ID NO: 8255 - DNA, 549 bp, Zea mays
  Predicted polypeptide sequence is orthologous to G378
gtacaagtatattacattgttacaacatttaccctatacatatttacatccacagtgtgtgtgagacaatgtgagccacgtactgtatctgtacatgcgtgctcaagacgtagaaaaaagaaggaaaaaaataatcaaggtatgcaagaaagaaccaggtgtcctgcactcctactaccctactatactgtgctcctggtctgggacacgtgtgcacgcgcatcggctcacggttgcccaaagacatcctaacgaaaagtgtgcgcaccggcttagaccgcgcgacgacacagtgggcacgaggcgtgccggagcagccagacgtcgatgcacggcaggtggaacgtgtgcccgcactccggcaagctccgcgccgtctcgcctgcctcgaagtcctgcaaaatcaaaccaccgaccgggtcgatgtcgaccatcaaaaactgtgcagaaacgacacgaaaatcggccatgcacagcctgcactcgctgcaagcatgcgcggcggcggggatctataggtagctgacctgaaggcagacggagcagccg

SEQ ID NO: 8256 - DNA, 755 bp, Zea mays
  Predicted polypeptide sequence is orthologous to G378
cggcgcgatcaccggtggcctcatcggcccctccacagagacgggcgtgctgcgcggcacgggcgtcggcggcatcacgggcgcgctggtgtccatggaggtcgtcgagtcgctgtggcgctccgacgagccggcaatctggagcgtcgtctacgtgctcgatgtcatctggagcttgctcaccggccgccttgtgcgcgagaaggtggaccccgccgtgctcagcgccgtcgagagccagatgagcgcagcggacacaccggccttgcatgcagaccacgccgacatcttcgacacgggcggcaccaacggcatggtgatggtcgccatggacgcgctccccgtcgttaggttcaccgagcgcagcaacgtcgacgccagcggcgagctcatcgcctgttcggtttgcctccaggaattccaagccggcgacagcgcgaggagcctgccggtgtgccgccacacgttccacctgccgtgcatcgacggctggctgctccggcacgcctcctgccccttgtgccgccgcgctgtctaggccgcgcccgttcctctaccctcaaggatagccgccaccagagctgctctgacaagcgacacccgttccttcaggctgtagccgtacgcacactggcagcgtgatttttctgtagctcatcagatgattcagatgggcgttatgtaaacattggttaatttttaacaaatgcaagtggtgcacatggcgatggccacataaaaaaaaaaaaaaaaaa

SEQ ID NO: 8257 - DNA, 782 bp, Zea mays
  misc_feature (9)..(9): n is a, c, g, or t
  misc_feature (604)..(604): n is a, c, g, or t
  misc_feature (671)..(671): n is a, c, g, or t
  misc_feature (743)..(743): n is a, c, g, or t
  misc_feature (779)..(779): n is a, c, g, or t
  Predicted polypeptide sequence is orthologous to G378
tcggtccgnattcccgctcgacccagcgtccgctctagtttgtgcgaatctgctgccagcagcgagcgaacagaacagtagccaatttgccatctcacagttgcgttcctccgattccccgtcccccgatggacctgtctcccagctcgtcggcgccatccgcgccgccggtgccgtgcgagtggtccggcgccgggctcggctccgcggcgtgcggcctcgcctgcagggtgctctgcgccgtcgccacctgcgtcttcgcggccgtggggtcgctggtcggggcggtgacggggtccatggtggggctggcgaccgagagcgggatgctgcgcggcgccggcatcggggccatctccggcgccgtcttctccatcgaggtcgccgagtcgtcccgcgacctctggcactcgggcgactccggcgtctggaccctcctctacatggtggacatcatctccagtctcttgagcggcaggctggtccgggagaaggtggggccggctgttcagagcgccgtgcagagccagatcagcgccatcagctcgccgttcgaggagacgagcgacctgttcgagaccggcagcgtgaggggcctccccgnagccgcggtgcgccggctgccggtgacggtggtcgcggaggacggcgccgtggacgccgcgggccangcgctgtgctgctcggtgtgcctgcaggacttccgggtgggcgaccgcgcgccggagctgcccggttgccgncacctgttccacgtgccctgcatcgactgctggctnctc

SEQ ID NO: 8258 - DNA, 845 bp, Zea mays
  Predicted polypeptide sequence is orthologous to G378
cgccgccgcgcgggccgccgggtgggcgatcggcgcgctgctcacctgcatcttcgccgtcgtgggctcactcgtcggaatcttcattggtgccttcatggggatgtctaccgaaagcggcatgttccgcggggctggtgttggagcagtttctggagcagtcttctccatagaggctgttgagtcctgcatcgagatttggaggtccagccattcaggaaaatacagcattctctttgtgctggacatcatctcgagcctcttcagcggaagaattgtgtgggagaaagtcagtccagcgctacagcgtgcagtgcaaagccagatgagtctaatgagcacaccgttcatcgacaacagtgaccttttcgaaaccggcagtacaggaggcatgtcaagggatttgattgataggatcccaaagacgaggttcagtgctgctagcaactgtgatcaggaaactgatagcagctgctgcccagtctgcctccaggatttcggagcacggcaattcgtgagggccctgcctcagtgccaacacatattccacgtgcggtgcatcgacagttggctcctccggcacgcgtcctgcccgctatgccgggccggtgttcacatagaccatatacatatgtaaatgaactcgcagggtggcacctggtgtattttcgtagcgaatacccgtgctcctgttggatatcacaagtatagctgtatacatagggtttttttgctctctctttttgtcacttcttgagacttgcttgtgtggggctatgctttcagctgcacgtttttgtcgaagcatgatgccttgatatgtacatctggaaaatggaacgact

SEQ ID NO: 8259 - DNA, 822 bp, Zea mays
  misc_feature (25)..(45): n is a, c, g, or t
  misc_feature (151)..(153): n is a, c, g, or t
  misc_feature (328)..(332): n is a, c, g, or t
  Predicted polypeptide sequence is orthologous to G380
ggttctttcacttccaaaatatacnnnnnnnnnnnnnnnnnnnnngaagagtaaagataaatacaatgtaaaggaagggaggatctaccaaggcaaccatgggagccttacacaccatggtgccatttaacgtctaaaacatcctacaaannnatatctgtacagtttatgtccacagcgaaggggacgggcaaataaaggcaaccctgtctatatacaaaatcgcgctaacttgccacgcggtaaataaccaataatgttactggcgaagatcatccattccttctatctgatgacaaagctgttgtcttgcagatggggcacacgnnnnncaccatcaaccattgctttatgcaatcctcatggtacttgtgaccacattcaagggctcctataagttctctagcttcatactcctcctggcatattatgcaagcatcgttctctaacgaaagctcacagaactgatcagaaatgctagctgctcctggaacatgaaaagtggacctcaagttttcttggatatagctttctgtcaaaccagtattgacatcacctatctgctcttgcaatgctacaagctcctcataagtcatgttatccacatctaaacgcatatctctatgttcatcaataacatgtcctgcttcataaatccttgaatgatccatcactgtagcattctgatatggcagaattcttaaagccccattgttggcttggtttatcagaggtggatgcacttgatgcccaaaagtgtgctcatcattgaatgggagagccagcattcttggatgtaaaggaagacctgtggcagaagga

SEQ ID NO: 8260 - DNA, 780 bp, Zea mays
  Predicted polypeptide sequence is orthologous to G380
ctcctccctgtctttctccccccctctctctccccctcttgacaaattttcctccacccattcccttcctcccctcttcttcttctccacccactccaccgatccccctctttctctctgaattctctctcgtcgtgcccacccttccatctgtctgctgcctctctctctcgcaatcagtcactcggctcttgtttcttccgtctgctgggttgattctttctcttcctctccgtggagaaacaggaggagagaggaaagaagagaaatcggaaccagcctgttctttttgcctggattgcggttcttgcgagttgttcagaaactctgggccagtttctggtcctttaaactactggaaagaggaaccatcagagatgccaaggcagccaacaaattgatatctaattgccctactttggatcatcataatgcaaggacagaggaattctatggagcattttgctgatgtctttggattcgacgttgcatcgagttcaggcaaccctgtgatggatcagcagtcatattggaataatgttcttggatcagtagaatcacataatcttcaaggttatcagatggctcacagtgatgccgccatgccatatggaaatgaaccacagcaagatggtacatttcttggtttctgggaatcaggcgaagcaagttcaagtgccagtgcactaaactatggcagctctaataatgtcaaaacagagcatcttaacattggtgggggaggtggactgaggattggtgaaagccgactggtagctg

SEQ ID NO: 8261 - DNA, 850 bp, Zea mays
  Predicted polypeptide sequence is orthologous to G380
tgaaaaggaaaaatgcagtagttgctggaagccatcattttcttcatggatttgctgggtcaagttcatctgttcatgtgcctcagaatcctgtgcatgggccatggaatccttcatctcaatcaaattgtttacccagttctgcagcttcaaacctaccagaataccacaatagtaatgggtggccatacttagaagaatcttctgcagatgcttcaaacagtttcagttctgtggctgcttgccaggagctggcacctcatggtaactatttatatccagcttgtcacataagccagtccaatacatgggttccacagcctgcaggttatggagtaccacagtggggatatagtaatgcagtggtcaatcctccaggaactgcagacatgtcaaatgggccactgcctcatttctgccagaatagtatgcaggcacctcaaatacaagtgtcccatcaacagttcatcggtaacaatgcggtgcatggtttaaatccttctgccacaggccttcctttacatccaagaatgctggctctcccattcaatgctgagcacacttttgggcatccaatgcacccacctctgataaaccaagttaacaatggggctttaagaattctgccataccagaatgctacagtgatggaccattcaaggatttatgaagcaggacatgttatcgatgaacatagcgatatgcgtttagatgtggataacatgacttatgaggaacttgtagcattgcaagagcagataggcgatgtcaatactggtttgacagaaagctatatccaggaaaacttgaggtccagttttcatgttccaggagcagctagcatgtctga

SEQ ID NO: 8262 - DNA, 831 bp, Zea mays
  misc_feature (621)..(621): n is a, c, g, or t
  Predicted polypeptide sequence is orthologous to G384, G385
tggatactgaacaagtctgaacaggtgcagcagcagcagcagcacaaattacatgctaaataacggttttgtacaccacaagagaagaagcctaaattcagaggaagcagcatccgagaggccaacatgaagaggaagtcaatacccgaaccaactacccttgcgtcgtggtgactcgtttccttcggcgactgaagtgtttcttgaaataaccccagaaattttgggggaaactaggcgaaaaagtaaagggaactatgagcaccacatggcaagcaggagagtctgaggtgcgttcttgacttcccactgacgaaagctctaaaattttgctgctccttcaatgcaaaggataagaacactgttggattcaacgaagctactgctgctggggattgctctggccggagatcaccgccgccttgatgcgctccacggtgcaggcgatgaggctgttcaccgtggccaccgaccccagcgagatcttggcggtggggacagagtcgacgagtatctggaaggccaccgtcaggagcgacccacctgagccgacgccgccgtcgccttgcagcatgctgctgctccctgacgatgggccgtcgggcaggatcgcgaaccagnagggcaggagcgccacgtagtcaggggtcgccgccgttgaggaccacgttcatggcgaccacatccaccgggggcgtagatgacgtacgagcccgacatgtcggtgcagctctcctggaggatcagcatgctgctttgggttcgagttcgtgctattgacacgaagaagcgagacgcaktttccatggtcgcggccgttggcgatgtgag

SEQ ID NO: 8263 - DNA, 3092 bp, Zea mays
  Predicted polypeptide sequence is orthologous to G384, G385
tccatatctcagtcacacactcacgcgcgcgcgggggccgggggccgctggacccgccgttctccttctcctccccccctcgttcctctcgtctcaccattactccctacacgcgccgcggctaggattccgccgaggagacgctgcgcgcgtggatctccggtgctgtcctgctagcgtgcgacgaggccaggcaggcgcgcggccggcgccatgagcttcgggagctattcgacggcgggtccggcggcggcggaggaggaggagggatgcagttcccgttcacgaccgggttctcgtcctcgccggccctctccctcggtctggacaacgccggcggcggcatggtcggccggatgctccccgtgggcggcgcccccgcggacggcgggatggcgagggacgccgccgacgccgagaacgacagccgctccgggagcgaccacctggacgccatgtccgccggcgccggcgccgaggacgaggacgacgccgagccgggcaacccgcgcaagcgcaagaagcgctaccaccgccacacgccgcagcagatccaggagctcgaagcgctgttcaaggagtgccctcacccggacgagaagcagcgcggcgagctcagcaagaggctcggcctcgacccgcgccaggtcaagttctggttccagaaccgccgcacgcggatgaagacgcaactggagcggcacgagaacgcgcttctcaagcaagagaacgacaagctgcgggccgagaacatggcgatccgggaggcgatgcgcagcccgatgtgcggcagctgcgggagccccgccatgctcggggaggtgtccctggaggagcagcacctgtgcatcgagaatgcgcggctcaaggacgagctcaaccgcgtctacgccctcgccaccaagttcctcggcaagcccatgcccgtcctctcggggcccatgctgcagccgaacctgtcgctgcccatgccgagctcgtcgctggagctggcagtaggcggcctccgtggcctagggtctatcccttccttggacgagtttgctggcggtgtgtctagcccgttgggcacggtgatcacgcctgcacgggcgaccggatctgctccgccgcctatggtgggcgtcgacaggtccatgctgctggagcttgcgatcagcgccatggatgaactagttaagctggcacaggttgacgagcccttgtggcttcccagcctcagtggctctcccgacaagaagctgctcaactttgaggagtatgcccactcgttctctccgtccgtcggcgccgtgaagcctgtgggctatgtatccgaggcctctagggagtctggcctcgtcatcattgacaacagccttgctcttgtagagacccttatggacgtgagacggtggtctgatatgttctcgtgcatgattgctaaggccacagtcctagaggaggtgacatctggcattgcaggaagtaggaatggtgcgctgctgctgatgaaggctgagctacaggtgctctcacctctagtgcccatcagggaggtcacatttctcaggttttgcaagcagctggctgagggtgcatgggcagtagtggatgtgtccattgacggattggtgagagatcacaactctggaacagcatccaacgccggaaatatacggtgcaggaggttgccttctggctgtgtgatgcaggacactcccaatggctactgcaaggtcacatgggtagagtatacggaatacgacgaggcgtcagtacaccagctctatagaccactcatccggtccgggctggcctttggggccaggcggtggcttgcaatgctgcagcgccagtgcgaatgcctggccatactcatgtcccctgatacagtttcagctaatgactcgtcagtcataacacaggagggcaagcgaagcatgctgaagctggcacggcggatgacggagaacttctgcgccggggtcagcgcgtcatctgcacgtgaatggagtaagctggacggcgctgcaggcagcatcggggaggatgtgcgggtcatggcacggaaaagcgtggacgagcctggggagccgccgggcgtggtcctaagcgcacgcacatcggtgtgggtgcccgtggctccggagaagctcttcaacttcctccgtgacgagcagctgcgtgcggagtgggacatcctcagcaacggaggcccgatgcaggagatggccaacatcgccaaggggcaggagcacgggaactcggtgtccctcctcagagccagtgccatgagtgccaaccagagcagcatgctgatcctccaggagacttgcactgatgcatcaggctcgatggtcgtgtatgctccagtggacatcccggcgatgcagctcgtcatgaacggcggggactccacctacgttgctctgctgccgtctgggttcgccatcctgcctgatggcccaagcagtgtcggcgccgagcacaagacaggcggctcgctgctcaccgtcgccttccagatcctcgtcaacagccagccgaccgccaaactcaccgtggagtcagtagagaccgtgaacaacctcatattctgcaccatcaagaagatcaagacagcgctgcagtgtgacgcttgactgtcgcgtgtcgccgcagggggggtggtcggtgatgacgagcctgagtcaagaacgaacctcgtgcgggaaagaaacctttgctaggtgataaggatccagcttggacgggtctttagcacggagcaatggtggtggttcgggtattgactcggtctctgtcatctgcttcttctccatggcaacctgttgtctgatacgggatcttgaatagtgcgtggacaatgatgtggttagatggttaaaatcttttgtttcagtcccatcgtttcatcagggaatcaaactttgagttttggccgcctcgttgttagttgtaatatacagttcattttatattgtgaggtaagctatatgccatgtgtaaacatgagagctcaggaatgttgggtagcatcatgagtgtagctaggcatcgaactatcggccaataaaatgtctgatcgataaaaaaaaaaaaaaaaaaaa

SEQ ID NO: 8264 - DNA, 3580 bp, Zea mays
  Predicted polypeptide sequence is orthologous to G384, G385
ggcacgagctctcctctcttctttttagtagctcgctcgccaggccgccaagccacatgcagcatgtggcggagcgcaagtaggtagctgctgcgtcttcctggcctgagggtttcggattcatcagctgggcgccggggtcgccatcgccgccgttgggacggcggcggcggagtttggcgtcgagttcttcagagggttaggtgcacgcgtctctcgcgttcctccttcccaagtcgagttcctttctttccatacccgtccccatgacgttccttcttccatgattcccttccatatttgctccagccaggccatccgcgggctgcgtggctgcgctcctgctattttaatgcctgccttctctccctctcacgcctcataaaaaaaactaataattccttgggatctgaggggatccgcgtggggttggtaggatcgcgggcagagattttagccaggactggaggaaaaccagtccgctctctctccatgagcttcggcggcatgttcgatggcgccggctccggcgtcttctcctacgacgctaccggcggcggcacgggcatgcacaaccccggccgcctcgtcccggccccgcccctgccgaaacctggcggattcggcgccacgggcctctccctcgggctgcaaacgaacatggaaggggctcagctgggcgacttgggtcgtatgggcctgattggcggcggcgggagcgggagcggaggcgacggggactcgctgggccgcggccgtgaggacgagatcgacagccggtcaggcagcgacaacgtcgacggcgcctccggtgacgagatcgacccggacaacagtaaccctcgcaggaagaagaagcgataccaccgccacacaccgcagcaaatccaagaactcgaagctgtgttcaaggagtgcccccaccccgacgagaagcaaaggatggagctcagcaagcggctcaacctagagagccgccaggtcaagttctggttccagaaccgccgcacgcagatgaagacgcagatcgagcggcacgagaacgcgctgctgaggcaggagaacgacaagctgagggcggagaacatgacgatccgggaggcgatgcgcaaccccatctgcgccaactgtggcggcgccgccgtgctcggggaggtgtcgctggaggagcagcacctccgcatagagaacgcgcggctcaaggacgagctggaccgcgtctgcgccctcgccggcaagttcctcggccgcccaatctcctctggcagctccatgtcgtcgtccctgcaaggctgctccggcctcgagctcggcgtcggctccaacaacggctacgggctcggtcccctcggcgcgtcagcgctgcagcccctccccgacctactcggcgccggccttccgggccccgtgggctcggccgccatgcgcttgcccatgggcattggcgccctcgacgttgcgctgcacggggcggccgccgacggcatcgaccgcaccgtcctcctcgagctggcgctcgccgcgatggaggagctcatgaaagtggcgcagatggacgagccgctctggctccgcagccccgacggcagcggcttggaggcgctcaacctcgacgagtaccaccgagcgttcgccagggtgttcgggccgagccccgcgggctacgtcaccgaggctacccgcgaggccggcgtcgccataaccagcagcgtagacctcgtagacagcctcatggacgcggctcggtggtcggagatgttcccgtgcatcgtggcgagggcgagcacgacggacatcatctcgagcggcatgggcggcacgcgcagcgggtcaatccagctgatgcacgcggagctgcaggtgctgtcgccgctggtgccgatccgtgaggtggtgttccttcggttctgcaagcagcacgccaaggggctgtgggccgtggtcgacgtctcggtggacgccatcctccggcccgacggcggccaccaccacgcgcagaacggcggcggcgccgggtacatgggctgccgcctgctccccaccggctgcatcgtgcaagacatgaacaacggctactccaaggtcacgtgggttgtccacgcggagtacgacgaggcggtggtgcaccaactctaccgcccgctgctccagtccggccaggcccttggcgcgcgccgctggctcgcctcgctccagcgccagtgccagtacctcgccatcctctgctccaactctctccctgcccgcgaccacgccgcgatcacgccggtggggcggaggagcatgctgaagctggcgcagcggatgacggacaacttctgcgccggtgtgtgtgcgtcggcggcgcagaagtggcggcgcctggacgagtggcgcagcggcgagggaggagacgctgctgggaacggcggatcagcagccgcgggcgagggcgaggagaaggtgcggatgatggcgcggcacagcgtgggggcgcccggggatccccccggcgtggtgctcagcgccaccacgtcggtgcggctgcccgccacgtccccgcagcgcgtgttcgactacctccgcgacgagcagcgccgcggcgagtgggacatcctggccaacggtgaggcaatgcaggagatggaccacatcgccaagggccagcaccacggcaacgccgtctccctcctccgcccaaatgcaactagtggcaaccaaaacaacatgctcatcctgcaagagacctgcaccgacccatcaggctctctggtggtgtacgccccggtggacgtgcagtccatgcacgtcgtcatgaacggtggcgactccgcctacgtctctctcctcccctctgggttcgccatcctcccggacggccactgccagtcaccaaaccctgcccatcagggttcaccaagctgcggcggtagcggtagcagcagcagcacggggtctctagtgacggtggcattccagatcctggtgaacaacctgcccaccgcgaagctcaccgtggagtcggtggagaccgtcagcaacctgctctcctgcaccatccagaagatcaagtctgcgctccaggccagcatcgtcacgccctagctagcgggcatttgacatggattccggccgccggttctcagaaaaaaggacggagtagtcggatgccatgtcaaatgcttagctagaggacgacatgctgtaacggcgcagatgctaaacaaggctgtgctcgtacgtacgtcgatcgtttcatagcaggtcggggaactagtgcttgagaaggcagtgaaagaaaataagggtattaaaataaattatgtagtagtgtggagtatttattgcatagagcaatatatatatggggtgaggtacacagggattaagtcaagaacgaaccgttcgctaggctttgattgcttgagcaaacacgttttgctatcgctcaagcttgttatatgctcatgtggtggttcgggtattgacttaagtctctggcaaaagaaagtgaaacaccacctattagggcttctcctatatataaaatatatatgtagcagtttgttttcaaaaaaaaaaaaaaaaaaaaaaaaaaaaa

SEQ ID NO: 8265 - DNA, 3010 bp, Zea mays
  Predicted polypeptide sequence is orthologous to G384, G385
gaattcggcacgagagctgatcgatggtagagagcaagagccagctagggtttgggagctgaggctaggaccgtacgtcgtacgtacgtgctgccattgttcatgacgccggcaaggcgcgtgccgccggcggcgatgatcggccggaatggcttcgcgtttgggtcctcgtccgcgctgtctttaagccaggctgacctcctagacagccatcagctgcagcaagcgttccagcagcagctcttcgatcagatcccgaccaccaccacagtggacgatagcagcgacaacctcatccatggccgctctgacacgctggtagatgagttcgagagcaagtcctgcagcgagaatcccgacggaacctctggtgacgatggcctggaggaagaccccaaccagcggccgaacaagaagaagcgataccaccgccacacccagcaccagatccaagagatggaggcgttcttcaaggagtgcccgcacccggacgacaagcagcggaaggagctgagccgggagctcggcctcgagccgctgcaggtcaagttttggttccagaacaagcgcacacagatgaagaaccagcacgagcggcacgagaacgcgcagctgcgcgcggagaacgacaagctgcgagccgagaacatgcggtacaaggaggcgctgggcacggcctcgtgccccagctgcggcggcccggctgccctcggcgagatgtccttcgacgagcaccacctccgcctcgagaacgctcgcctccgtgacgagatcgaccggatctcgggcatcgccgccaagcacgtgggaaagcccatggtctccttccccgtgctctccagcccgctcgccgccgccgccgccgctgccgcccggtccccactcgacctcgccggcgcctacggcgtccagtcagctgctgcgggcctcggcgccgaccacctgttcggcgccggtgccggcgatctgctgaggagcgtgtcagccgggcagctcgacgcggacaagcccatgatcgtggagctggccgtcgcggccatggacgagctcctccggatggcgcggcctgacgcgctgctgtggggtggcggcgcgtcggcaggggcgcagcagcagctggacgaggaggagtacgtccggacgttccccgctgggctcgggccgaggcagtacgggctccgtccggaggcttctcgggacagcgccgtcgtgatcatgacctgcgacagcctcatcgagatactcatggacgcgaaccgattcgcggcagtgttctcgagcatcgtgtcgagggcttccacgcacgaagtgctgtcaactggtgtggcagggagctacaatggtgcattacaagtgatgtcgatggagtttcaggtgccgtcgccgctggtgccgacgcgcgagagctacttcgtgaggtactgcaagaacaacccggacgggacatgggccgtcgtcgacgtctcgctcgacagcctccgccctagcccggtcatcaagtgccggcgcaggccgtcaggttgcctcatccaagagatgcccaatggctactcaaaggtgacctgggtggagcatgttgaggtcgacgacagatcagtgcacaacctctacaggcctttggtcaattcaggcctcgcgtttggcgcgaagaggtgggttggcacactggaccggcagtgcgagcggctcgccagcgccatggccagcaacatccccaacggcgaccttggcgtgatcacaagcatagaggggaggaagagcatgctgaagctggcggagaggatggtggcgagcttctgcggcggcgtgacggcgtctgcggcgcaccagtggacgacgctgtcgggaagcggcgcggaggacgtccgtgttatgaccaggaagagcgtggacgacccgggcaggccgccgggcatcgtcctcaatgctgccacctccttctggctgcccgtcccacccaagagggtcttcgacttcctccgcgatgagacctctcgcagcgagtgggacatcctctcgaacggtggtgctgtccaagaaatggctcacattgccaacggccgggaccatggcaactgtgtctccctcctccgtgtcaatagtgcaaactcgaaccagagcaacatgctgatcctccaggagagctgcaccgacgcctcgggctcgtacgtggtgtacgcgccggtggacgtggtggcgatgaacgtggtgctcaacggcggcgacccggactacgtggccctgctgccgtcgggcttcgccatcctccccgacggaccaccgccggccggtgcggctccgtcccacggagagggtttggacgctggcggcggcgggtcccttctgacggtggcgttccagatcttggtggactccgtccccaccggcaagctctccctcggctccgtagccaccgtgaacagcctcatcgcctgcaccgtcgagcgcatcaaggccgccgtctgcgcggaagccggcaacccgcagtagacatccatccatgcgatatcgaggagggagaaggggggcatgcagcaaggttttgtggaaatgttagtggggagtcaagaacgcacctcagactctccttgccgtgtggtgctcatactgaaaggaaaaagaaggcgtcaccactatgcaaggggggatggttcgggtattgacttcgccgtccaatcaaactactacagaaaggacgtacgggtgctgtggagaagatggatcgatgctgtttctagggtttacttcctcattgttcgtggtgctgccgtagttcaggctaaggtgcctgtgcctgctcgcagtcgtagctagagaacacagagatttgttgcctctgatctttcctttttggatttgcaaagatttgtagatcagtcatttcgtaaaccgatgcgccttggctaaaacgcgcccgttcgttgttgttcgatcgtagctgccttttgctattcataaaacgatgcaatttcaaccactgagtttcttctagaaaaaaaaaaaaaaaaaa

SEQ ID NO: 8266 - DNA, 639 bp, Zea mays
  Predicted polypeptide sequence is orthologous to G384, G385
aacatataaacattattaaaccgacataaatccatgacaaacgcggggggaaaaacggtgaaaacgagaacgacgatggggtactgccccgctgataactgagtctaaacgtcattattttgtcgacaaatatcaaatggtagaagcattattgttcgacattgtgcccgactcttctgcctcgcccttctgcatcaagctggggtgacgatgtcggtcttgacggcagccttgatcttctccagtgcacgacagagcagcttgccaacgtcgtcgaaggcccctggggcagcgcggttgtcagacggggatgagccgggcaccagcgcctgacatgccacggtgagcagggacccagcagtggtgtcgtcgcagccgacgggtgtgctggaggaggagctcggggcgtggcgagccctgccgtggccgtccggaaggacggcgaaccccgacggcaacaggaagacggaggcgtggtcgccaccgttcatgaccgcgcgcatggaatcctcttcgaccggagcggagaccaccatggagcaggacgcgtccgtgcacgcctcctgcaggatcagcgtcttcttgcggtcggttccatcggtaacattggagtagaggacggaaacagcgttgccattg

SEQ ID NO: 8267 - DNA, 719 bp, Zea mays
  Predicted polypeptide sequence is orthologous to G384, G385
gggtgaaattgcctcgttttatgaatagcaaaaggcagctaccatcgaacaacaacgaacgggcgcgttttaacccaggcgcatcggtttacgaaatgactgatctacaaatctttgcaaatcccaaaaggaaagatcagaggcaacaaatctctgtgttctctagctacgactgcgagcaggcacaggcaccttaacctgaactacggcagcaccacgaacaatgaggaagtaaaccctaaaaacagcatcgatccctcttctccacagcacccgtacgtcctttctgtagtagtttgattggacggcgaaatccataccccaaccctccccccttgcataggggggacgccttctttttcctttcagtatgagcaccccacggcaaggagagtctgaggggcgttcttgactccccactaacatttccacaaaaccttgctgcatgtcccccttctccctcctctatatcgcatggatggctactgcgggttgccggcttccccacagacggcggccttgatgcgctccacggtgcaggcgatgaggctgttcacggtggctaccgagccgaaggagagcttggcggtggggacggagtccaccaagatctggaacgccaccgtcaggagggacccgccgccgccagtgtccaagccctctccgtgggacggagccgcaccggccggcggtggtccgtcggggaggatggcgaaacc

SEQ ID NO: 8268 - DNA, 745 bp, Zea mays
  Predicted polypeptide sequence is orthologous to G384, G385
cgtgtgctgcttgcagtagcgcaggaactggcactcacgtgtcggcaccagcggcgacggcatctggaactccgccgtcatcagctgcagcgcgccattgtagttgccggcgacgccggtggagagcacctcgagggtggcagcccgtgacacgatgcttgagaacagcgtcgaccactggttcacgtccatgagcatctcgatgaggctgacgtggttcatgatgaccacgacggcctcccgcgacgcttccgaccggagctccggcagcttgggaccaacgcccctggggaagaacccgcgggcgtactcttcctcgttgagagtctcggtggtagccccgtctacggcaagggcagggatccagagcggctcgccgagcagagccatccgcaccagctcctccatggcggcgacggcgagctcgacaaccaaccccttgtcaaagtcaaacccaccgccagcatgacggtggaggccaccgaacacgtctgttccgccgggcaggaggtggtggtgggaggaaagcgccgggccggagacgttgtttgacaggttgttggggggcagcagcagcaggctgccagcgggcttgccgacgtacttggcggcgatggtggagatgcggtcgacctcgtcgcggaggcgcgcgttctcgacgcggaggtggtgctcgtcgaaagacatctcgccgatgacggccgtgggccgcgggggcgccgcagctcgggcacgaggcgttggc

SEQ ID NO: 8269 - DNA, 765 bp, Zea mays
  Predicted polypeptide sequence is orthologous to G384, G385
gctggataaatctgaacaactgcagcaacagcacaaattacatgctaaattacggtttttgtatcccacaagaaaagaaaaagaagcctaaattcagaggtagcagcatccgagaggccgacatgtagaggaagtcaatacccgaaccaacaacccttgcgtagtggtgactcattttcttgttgcgcgactgaaatatttctacccaaaaattttggggaaactaggcgaaaaaagaactcgaactatgagcaccacatggcaaggagagtctgaggtgcgttcttgacttcccactgatgaaagctctaaaacttgctgctccttcaatgatgcaaggataaaaagagtgtctgattcgactaagctagctactgctgggtaacactctcgccggaaaccgccgccttgatgcgctccacggtgcgggcgatgaggctgttcacggtcgccaccgaccccagcgagagcttggcggtggggacggagtcgaccaagatctggaacgccaccgtcaggagcgacccgcctgagccgacgccgccaccgccaccgccttgcatgttgctgctgcctgacgggccgtcgggcaggatggcgaaaccagagggcaggagcgccacgtagtcggggtcgccgccgttgaggaccacgttcatggccaccacgtccaccggcgcatagatgacgtacgagcccgaggcgtccgtgcagctctcttgcaggatcagcatgttgctttgggtcgagttggtgctctgattg

SEQ ID NO: 8270 - DNA, 837 bp, Zea mays
  Predicted polypeptide sequence is orthologous to G384, G385
acgaacaacaacggtacacgttttagccaagcattggtgatgaaatgactggtcctagattctacaaatctttgcaatccaaaaaaaataaaataaaagaggtaaacaaatctctgttctctagctacgagcctacgagcaggcacaggcaccttttagcctgaacaacaacaacacgacgaacatgacgaagtaaaccctagaaaatatggaaagagatccagaagaaacagcatcttctctgcagcacgcatcctttctctagttgactcgacggagaagtcaatacccgaaccatccccccttgcatagtggtgacgccttctttttccctgcttgcatcagtatcagagcaccacatggcaaggagagtctgaggtgcgttcttgactccccactgataaatatctccgatccccaaaagctgcaccacccctcctctcgctctctctatcttatggatggctactactgtgggttgccttcagcgccgcagacggcagctttgatgcgctccacggtgcaggcgatgaggctgttcaccgtggctacagagcccagcgagagcttggcggtggggacggagtccaccaggatctggaacgccaccgtcaagagggacccgccggcggcctccaactcctccaagccgccgccggcagcaccctctcctccgtgatggggagccatgcccggcgccggcggtccgtcggggaggatggcgaagcctgacggcagcagggccacgtagtccgggtcgccgccgttgagcaccacgttcatggccaccacatccaccggcgcgtacaccacgtatgagcccgatgcgtccgtgca

SEQ ID NO: 8271 - DNA, 878 bp, Zea mays
  misc_feature (680)..(680): n is a, c, g, or t
  Predicted polypeptide sequence is orthologous to G384, G385
taactccttcctccccatctccacattctcccatccgccgttcccctccgcttcctcctaccatggcgtcttcttcctccccgagatctcgccatgctagctctcccgccttctgctagccagctgcgagtacggagcgctcgttttcgggcttcctgcatgcgatatcaccgacgaaacgtgtctctggaagaaggcatcacaggccgggatcggagaatgaaagctgacgatatagagcaagatgagctagggttcgcgaggcactagctgggaccgtacgtaccgtgctgccattgttcatgactccggcaaggcgcatgccggcgatgatcggccggaataatggcgtcgcgttcgggtcctcgtcagcgctatctttaagccaggtgattattccggctgacttcctagacagccatcatctgcagcaagcgttcgagcagcaactctttgaacagatcccagccgccgcagtggatagcagcgacaacatcatccacggtcgctccgacgcgctggtggacgagtttgagagcaagtcgtgcagcgagaatcccgatggcaccgcctccggcgatgatggccagggggacgaggaccctaaccagcggccaaacaagaagaagcggtatcaccgccacacccagcaccagatcgaagagatggaggccttcttncaggagtgtccacacccggatgacaagcagcgaaaggagctgagccgggagctcggtctcgagccgctgcaggtcaagttctggttccagaacaagcgcacacagatgaagaaccagcacgagcggcaggagaacgcgcagctgcgcgcagagaacgaccagctgcgagctgagaaacatgcgtacaaggacgcgcta

SEQ ID NO: 8272 - DNA, 920 bp, Zea mays
  Predicted polypeptide sequence is orthologous to G384, G385
cttagcttctgaaggtctccgccacctcctgctagctacccttctgagctttcaagctttgctgaacgcacgcgggcggacgcggtaaagcatcacatcttctttgagagctgcagggaagagatcgataagagttctattttttgcaaaggcacacagacatatatagttcttctgctagatctcaccgccagtcagctcgcagcgaaggttccctgggctaccttgtcgctggatctgttgctggtcgtgttgttacttgtcaggcaaggtataatatatctccgtacagctaggaataggattgggtagtaggggggtacgcatgtgccagtgaagaaatgggaaggagctagtgtggaggcagcaagaattagggttggagaggttccgcgagaggagaaatgatgatcccggcgaggcacatgccgccgacgatgatcgtccggaacggcggcgcggcgtacgggtcctcgtcggcactgtcgctcggccagccgaacttgatggacaaccagcagctccagttccagcaagcgttgcagcagcagcacctgctgctggaccagatcccggcgacgacggcggagagctgcgacaacacggggcgcggcggtggtggccgggggtccgacccactggccgacgagttcgagagcaagtccggcagcgagaacgtggacggcgtctccgtggacgaccaggacgaccccaaccagcggcccagcaagaagaagcgctaccaccgccacaccctgcatcagatccaggagatggaagctttcttcaaggaatgcccgcacccggacgactagcagcgtcaggagctgagtcgggagctgggtctggtacccctccaggtcaagttctggttccagaaacagcgcacgcaaatgaagaaacagcacgagcggcaggag

SEQ ID NO: 8273 - DNA, 2660 bp, Zea mays
  Predicted polypeptide sequence is orthologous to G386, G707
tcgcttgttctccctagttccgacccgaagcagggaatgagcttcggcgatctcgacggcggcgggtccaagcgcaagaagccgtacaaccgccacgcgccgcggcagatcgaacagctcgaagcgatgttcaaggaattccaccacccggacgagaagcagcgcgcgcagctgagcaggcagctgggcctggacccgcggcaggtcaagttctggttccagaaccggcgcacgcatttgaagaaccaactggagcggcaggagaacgcgaggctgaaacaggagaacgacaaactgcgcgtcgagaacctgtccatccgggaggccataagggacctggtgtgcagctgctgtggcggtccagcggtgctcggggagctgtcgcccgaagagcaccagctgcgcctcgagaatgcgaggctcagggacgagctcgctcgagtctgcaccgtcacttccaagttcattggcaagcccatgtctcacatggaactgctgctcgcgaaggagccgcatcctattacaggctcgtcactggaacttgcagttgctgttggtgttggttccggcgtgccatcgagcaaaatgcccgtctcgacgatctccgagttggccggcagcacatccagctcaacgggaacagtgaccacgcccatggtgactgcatccttgccgatggttagcattgtcattgacaagtccaagttcgcccagcttgcagtgagtgcgatgaatgagcttgtcaagatggcgcggatgaatgaaccgctgtggattccaaccattccctcacctggctcaccaatcatggagactctaaactttaaagagtacttgaaggcattctcaccatgtgttggagtgaagcctactgggtttgtgtctgaggcctctagggaatccggcattgtcaccattgacagtagcgctgctcttatggaggtcttcatggatgagagacgatggtcagacatattctactgcattgttgccaaggcatcaatcgttgaggagatcttacctggtgttgcaggaagcagaaatggtgcattgctgcttatgcaggcagaactacaaatgctttcacctcgtgtccctataagggaggttacatttctcaggttctgcaaacagcttgctgagggtgcatgggctgtagtggatgtttccattgatggactgcagacggatcagtgcctagatacaaacacgaaatgccggaggctgccttcaggttgcgtgttgcaagatacccccaatggctgcaaggtcacatgggttgagcatgcagaatatcctgaggcgtccgtgcaccagctctaccagcctcttatgcgctctggcctcgcccttggcgcagggcggtggcttgcaacactgcaacgccagtgtgagtgcttggccatcctcatgtcatcgcttgcagcgccagagcatgactcagcagcggtttctctggaaggaaaatggagcctgttgaagctggcacggaggatgatggagaacttctgcgcagggatgggcgcgtcatcttcccgcgaatggagtatgctggatggcttaacaggtagcacggggaaagacgtgcgggtcatggtgcagaacagtgtggatgaacctggggtgccaccgggtgtggtgcttagcgtcgccacagcagtatggctgcctgtgaccactgagcggctcctcaacttccttcgcgacgaggagctccgtgctgagtgggacatcctcagcaatggtggccctatgcagcaggtgctacgcgttaccaagggccaactggatggcaactctgtggctctgctgagatccgatcatacagactcccacctgaacagcatcttgattctgcaagagacgtgcactgacagatctggcgcaatggtcgtgtacgccccggtggacttcccggcaatgcagcttgtgcttggtggaggggactcgaagaacgtggcgctcttgccatctggtttcgtcattctgcctgctgggtctagcgccggtggggttgggcacaaggcacgcggatcgctgctcacagtcgcattccagatccttgtgaacagccagcccacagcaaagctgacggtggagtcagtggacaccgtgtacagcctcatctcatgtaccatcgagaagatcaaggcggcacttcactgtgacgtctgttaacttgggaacaggaagcttcaggcatggaggcaaggcaacagccggtgatcagcctgagtcaagaacgaaccgcgcaaaacagtagtgacctttgctaggtggtacgggtccatagggctggcccgtagcacacagcaatggcggtggttcgggtattgactcagcctccaattgttctgggttaaattttgcattttggacctacgcctgggcaatgccatggttggttttggtggttttagggagtctggagtcatctatgctttttgttggctggctcgtggtttttggtatcaggtttgcttttgtaaccatagatgtaggagagccccccttgatgttgatgatacagtcaatatcagacaaatgcagcattgtatcgtgagattcagtctcagatcactgtggatttaccttgtatggaacagtaggaggaggagcggcagtttatgtaaaaaaaaaaaaaaaaaaaaaaaaaaaaa

SEQ ID NO: 8274 - DNA, 322 bp, Zea mays
  Predicted polypeptide sequence is orthologous to G388
tagcgtggtcgcggccgaggtacatggcagctgttatgtttttggttcttgcaaccatgtcttctacctccccatcattctgccaagctgggggctgtaatttttttaacttttacttatcttgcattggcttttgtgatgttcactggcaaagaaccttgcttgatctgtatggtgtttcatacgtgtaggcatcggctgcccacgggctccaccaccgccgtccgatgagacatgctacgaggacctcaagtgttcggcttcgaggtgccacctgggttgcatacacaggggctacaatttttttttttttttttttttt

SEQ ID NO: 8275 - DNA, 1122 bp, Zea mays
  misc_feature (2)..(34): n is a, c, g, or t
  misc_feature (173)..(178): n is a, c, g, or t
  Predicted polypeptide sequence is orthologous to G390, G391, G438
cnnnnnnnnnnnnnnnnnnnnnnnnnnnnnnnnngcaagcagaactagcaaatagtaatactgcaacctgcaacagtgatcaatgtcgccggcgacaggccggggagacgagaccacgaccaggcacgcatacagctgttgtagttgtttgtcacgcacacacacaaacagannnnnngtcagttctcgatcatccacacagtacacaaattcttaacataggcggcacaacggaaaagcaactaatgatacgtagtaaggcaaaaggcggcatccggtctggcgctgccgagcgatgttgcgagcctcagatgaaggtccagttggcgagcatgagcgccaggcactgcggggcgccgtcgtcgcccaccaccttccacgccactgcctgctcgtacgacgcctgccgccccatgctcgacctgcacacgccaccggggaggtacgccaggccctgctgcatgatcgcggggagctgcgcggacagggccttctggccctcctcgtcgaggaccgcctccagcggcaggtcctgcgatgttcaccatcgtcgtctccaggatgtcgaagccggcgctgttggcgaacttgagcgtgaaagccggcgacttcagagagcagcagagtatcgcgtcgctgtgcttccagaacagcatcagcggagagtccgcgccttcggtgtccgaccagcggatctccgttccggtgtgcgccctgtagctcctgccaatccacgtagctagtgcaagtgcctcgggagagcccggcggatgcttcagttcgatacgcgaaccgaggcgagaaggagcgatcgccatggccaccctctgcacggaggccatcacgcccctgacgtactgcctggccattgccgcaacgctctcgcgaaggtggttctcgaacgagaactggaaggcgatggtcaggaccgatctcgtggcgcccgtgccggaaccatcgcttgaagcgcgcatgccgcctccacctgatccaacctcgagcgcagaggcaaggtcaagggtgcgtgtggtggcggcagttggcacatccatcttagcatcaagcggtatcacacggaagcctgagggcagcaacggtgcatcgtcggcaaaagattcatcg

SEQ ID NO: 8276 - DNA, 1851 bp, Zea mays
  Predicted polypeptide sequence is orthologous to G390, G391, G438
ccacgcgtccggaggtccatcaggacccaacactccaaattttgtcagagctgaggtgcttcctagtggctatctaattcgaccctgtgagggaggtggctccatgattcacattgtggatcatgttgatttagatgcttggagtgtgcctgaggtccttagaccactttatgaatccccgaagattcttgcacagaaaacaactattgctgcactgcgtcacattaggcaaattgcgcatgaatctagtggggaaatgccctatggaaggggacgccagccagcagttttaagaacatttagccagaggcttagcaggggtttcaatgatgctgtcaatgggtttccagatgatggttggtcactgatgagcagtgacggtgctgaggatgttactattgctatcaactcttctccaaacaaacttattggtcctcatgtcaactcctcccagctgtttactgcaattggaggaggtatcctgtgtgctaaggcatcaatgctgcttcagaatgtgccacctgccctactagtacgatttctgagggagcatcgctccgaatgggctgatcctggtgttgatgcttattctgccgctgctttgagggctagtccatatgcagttcctggtttgcgtgctagtgggtttacgggcagccaggttattctgccgcttgcacataccttagagcatgaggagttcttagaggttattaggcttgagggacacagcctctgccatgatgaagttgttctgtcacgagatatgtatcttctgcagctgtgcagtggcgtggatgaaaatgcagctggtgcatgtgcacagcttgtctttgcacccatcgatgaatcttttgctgacgatgcaccactgctgccctcaggcttccgtgtcattccactagatgcaaagacggatccaccgtcaggcacacgcacgcttgacctagcatctactctcgaggttggatctggtgggactactcgcacttcaagcgatgcctccagcacctgcaacacaagatcagtgctgaccattgctttccagttctcatatgaaaatcacctacgagagagcgtcgcagccatggccaggcaatacgtcaggactgtggtggcatcggtgcagagggtagccatggcaatagctccttcgcgcattggtggacagcttgaaatgaagcaaactccaggatctcctgaggcacacacgctggcaaggtggatcggcaggagctacaggtttcacactggagcagaactgcttcgcacagacacccaatgcacggatgcttccttgaaagcactgtggcagcactcggactcgatcatgtgctgttccctgaaggctgctccggtgttcaccttcgccaaccaagccggcctcgacatgctcgagacgacgctgatcgctctccaggacatctccctcgagaagatccttgacgacgatggcaagaaggcgctctgcaccgagtaccctaagttgatgcagcagggtttcgcgtacctccccggcggtgtgtgcgtgtcgagcatggggcggccggtgtcgtacgagcaggccgtggcgtggaaggtcctgagcgacgacgacacgccgcactgcctcgccttcatgttcgtcaactggtccttcgtgtgagtgaggaccggccccctagcatttgcagctgttatttgttgaactctgtatccaagtactggtcgctcttgcctttgcccaggcaaccctgtgaaacgcacctgccccccagttcatcccgtggccgtggaacaaacaccttttgtagttgcttgcttgctatgttatgatggatcctggtctgctgcgtctcctaaaaaaaaaaa

SEQ ID NO: 8277 - DNA, 2700 bp, Zea mays
  Predicted polypeptide sequence is orthologous to G390, G391, G438
gagagctaagagcaacaaggcgacgagatttgtgtggctacgattttgcgttgccgacggaacatgggaacaatggttgcagcggtggcgttgcgagggggaagcagcgatagcggaggatttgataaggttcccgggatggactcgggaaaatacgtgcgctacaccccggagcaagttgaggtgctcgagcggctctacatagattgccccaagccaagctcctcacggcggcagcaactgctgcgcgagtgtcctatactctccaacattgagccaaagcagatcaaggtctggttccagaaccggaggtgccgcgataagcagcggaaggagtcttcgcggcttcaggctgtgaacagaaagttgacggcaatgaacaagcttctaatggaagagaatgagcggcttcagaagcaagtctctcagttggttcatgaaaacgcgcacatgcggcagcagctgcagaatacttcattggccaatgacacaagctgtgaatcaaatgtcactacccctccaaaccctataagggacgcaagtaacccttctggactccttgcgattgcagaggagaccttcacagagttcctctcaaaggctactgggacagctattgattgggtccagatgcctgggatgaagcctggtccggattcagttggtatcgtggccatttcgcatggttgccgtggcgttgctgcccgcgcctgtggtttggtgaatctagaaccaacaaaaggcatagagatcttgaaagatcgtccctcttggttccgtgattgccgaagtcttgaagtgtttacaaggtttccagctggaaatgggggaacaattgaacttatttacatgcagatgtatgccccaacaactttagtccctgcacgtgatttttggacactacgatacacgacaacaatggaagatggcagccttgtggtctgtgagagatccttgagtggttctggtggtggtccaaatgcagcctctacacaacaatttgttagggctgagatgcttccaagtgggtatttagttcgcccatgcgaaggtggaggatcaattgtgcatatagtggaccatctagatctcgaagcatggagtgttcctgaagtgcttcgaccactgtatgagtcttctagagttgttgctcagaaaatgactactgtggcactgcgccaccttagacaaattgctcaagaaacaagtggagaagtagtgtacgccttgggaaggcaacctgcagtcctacggacctttagtcaaagactaagcagggggtttaatgatgccattagcggtttcaatgatgatggctggtctgtaatggggggagatggcattgaagacgttgttattgcttgcaactcaaccaagaaaattaggaataccagcaatgctgggattacatttggagccccaggaggcattatttgtgcgaaggcatccatgttactgcagagcgtcccaccggcagtactggtacgatttctgagggagcatagatctgaatgggctgattacaatattgatgcgtatttggcttcatcattgaagaccagtgcgtgctcacttcctgggttgcgacccatgagattttctgaggggcagatgatcatgccacttgctcacacagttgagaacgaggagattcttgaagttgtccgccttgaaggtcagcctcttactcatgatgaagctcttctttcaagggacatccaccttctccagctttgcactggaatagatgagaaatctgtgggttcctccttccagcttgtgtttgcaccaattgatgagcatttcccagatgatgctccattgatttcttctggctttcgtgtcataccacttgatgtgaaaacagatggtgtatcctctggtaggacgctagatttggcatctagtcttgatgtgggctctgctgcaccccaagcctcaggggatgcatctccagatgactgcagtttgagatctgtgctgacaatcgcctttcaattcccgtatgagatgcaccttcaggacagcgttgcagcaatggcccgtcaatatgttcgtagtgtcatttctgctgtgcaaagagtgtcgatggctatatctccctcccaatctggtctaaatgctgggcataggatgctttctggcttccctgaagctgccacacttgctagatgggtttgccagagttatcactaccatctaggtatggaattacttaatcaatcagatggagctggtgaagcattgttgaaaatgctctggcatcatccagatgctgttctgtgctgctcctttaaggagaaacctatgtttacgtttgcaaacaaggcagggctggacatgttagaaacatctcttgttgccctgcaagacctgacgctagacaagatcttcgacgagtcaggaaggaaagcactattctcagacatctcgaaactaatggaacagggctacgcgtacctgccgtcaggcgtgtgcatgtcaggaatgggccgccatgtttctttcgaccaagctgtagcgtggaaggtgctcggcgaggatagcaacatccactgcctggcgttctgcttcgtcaactggtccttcgtgtgactgacgcccaacccgtcgggtggttatggcgagctgacccttttttgtatggaaaatcatcagctgtgacaaaaggcatatgttgcatgcactagttgaagaaac

SEQ ID NO: 8278 - DNA, 716 bp, Zea mays
  Predicted polypeptide sequence is orthologous to G390, G391, G438
ttttttttggcaccagactttgcgcagtatccaatttcttcataaatacactcgattcaagacgtacaactagtgcatgcaacataaagccttctgtcacagctgatggtttccccatattgggatcaccatacaaaaaaattggcctgctcatcacacaggccatgggatggcgtgtcaaacgaaggaccagttgacgaagcagaacgccaggcagtggacgctgctgtcctcgccgagcaccttccacgctacagcttggtcgaatgagacatgccgacccattcctgacatgcacacgcccgacggcaggtacgcgtagccctgttccattagttttgagatatctgagaatattgctttccttcctgactcgtcgaagatcttgtctagcgtcaggtcttgcagcgcaataagagatgtttctaacatgtcgagccctgccttgtttgcaaacgtaaacataggtttctccttaaaagagcagcacagaatagcatctggatgatgccagagcattttcaacaatgcttcaccagcttcatctgattggttaagtaattccacacctagatggtagtgataactctggcaaacccatctagcaagtgtggcagcttcagggaagccggaaagcatcctctgcccagcatttagaccagattgggagggagatatagccatcgacaccctttgcacaacagaaacaacactac

SEQ ID NO: 8279 - DNA, 717 bp, Zea mays
  Predicted polypeptide sequence is orthologous to G390, G391, G438
gttggatctggtgggacaacgcgtgcttcgagtgacgcctccagcacctgcaacacaagatcagtgctgaccattgctttccagttctcatatgaaaatcacctacgagagagcgtcgcagccatggccaggcaatacgtcaggaccgtggtggcatcggtgcagagggtagccatggcaatagctccttcgcgcattggtggacagcttgaaatgaagcaaactccaggatctcctgaggcacacacgctggcaaggtggatcggcaggagctacaggttccacactggagccgaactcctccgcacggacacccaatgcacggatgcttccttgaaagcgctgtggcaacactcggactcgatcatgtgctgttccctgaaggctgctcccgtgttcacctttgccaaccaagccggcctggacatgctggagacgacgctgattgctctccaggacatctcccttgagaagatccttgacgacgatggcaggaaggcgctctgcaccgagtaccctaagattatgcaacagggcttcgcgtacctccccggtggcgtgtgtgtgtcgagcatggggcggccggtgtcgtacgagcaggcggtggcgtggaaggtcctgagcgacgacgacaccccgcactgccttgccttcatgttcgtgaactggtccttcgtgtgagaacccggtccccctagtagtagagccaagttgcct

SEQ ID NO: 8280 - DNA, 849 bp, Zea mays
  Predicted polypeptide sequence is orthologous to G390, G391, G438
cgagggccttttgtctagagatatacatctgcttcagctttgcactggaatggacgagaaatcaatgggatcctgcttccagcttgtctttgcaccaatcgatgagcttttccctgatgatgctccattggtatcttcaggctttcgcgtgatcccgttggacataaaaacagacggaccaccctctggaagaacgttggatttggcctctagccttgaagttggcgcaaccacgcaacaagtggcagggaatggatctcaggacgtttgcaacctgagatctgtgctgacaattgcctttcagtttccctatgaaacacatctccaggacaccgttgcagctatggcccggcaatatgttcgaagcatcgtttctgcggttcaaagagtatcaatggccatttctccctcccattctggcttgaatactgctgggcagaagttaatttctggctcccccgaagctgctacacttgttcgctggatttgccaaagctaccggtatcacttgggggtggatttggtcagccactcggatcaagctggggaatcacttttgagaatgttctgggaccatcaagacgctgtcttgtgctgctctttcaaggaaaagcctgtgtttactttcggcaaccagatgggagttgacatgttagaaacgactttagtcgctctgcaagatctcacccttgacaagatctttgacgagcctggtagaaaggcactacatgcggaggttcggaaactgatggaacagggctatgcgtacctgccggctggggtgtgcctgtctgggatgggccgccatgtctcctacgagcaagctgttgctttgaaaagtctcggtga

SEQ ID NO: 8281 - DNA, 640 bp, Zea mays
  Predicted polypeptide sequence is orthologous to G390, G391, G438
cccacgcgagcacaaccaccacctactccctactccctacactactccccccgcaagcacgcccagcgccatggccatggcggcagcgcgcacgggggcctgctactccgcctccgcttcctctcctctcctgcactactagcgggtccgctggcgacgatggcggcggtggcgagcagggagaggctctccccgggcgccgcgccgcaggtggacgcgggcaagtacgtgcggtacacgccggagcaggtggaggcactggagcgcgtctacagcgagtgccccaagcccagctcgctgcgccggcagcacctcatcagggactgccccatcctccgcaacatcgagcccaagcagatcaaggtctggttccagaaccgcagatgccgggagaagcagcgcaaggagtcctctcgtctacaaaccgtgaaccggaagctgagtgcgatgaacaagctgttgatggaggagaatgaccggctgcagaagcaggtttcccgtctcgtctttgacaacgggtatatgaagaatcgactccacagtccttctgtagccaccaccgacacaagctgtgagtctgtggtgacaagtggtcagcacaaccaacagcaaaaaccagcagttctgcatcctccacaaa

SEQ ID NO: 8282 - DNA, 678 bp, Zea mays
  Predicted polypeptide sequence is orthologous to G390, G391, G438
gaaagcaaggtagctaataatcatggtgttatggagcaacaagctgttcctgtccgcctgggggccactggattattttatattcctacacagatcaacttctacgcacagtataaagcgaagctgctacaacaggccggcgcgcttggtatgcatgcgtcccagcccaggatatatatactgcaataattttcaaacgcggagctcttaattaattcatgacactgacagagcacagagcggttctgttccaattccaggacgacgaatccctctgctcttcttcaactcaggcatcatcagtggcggccgggatctctgtccgctcagcttggatcagttccgcaagttcatccaatttataccttaacacgcaggagaccaccttcaacagtcaaaaaacatctgggaggagttgacatgagcaccaataagtttgtttggagaaagaatcgacaacaataggaacatcctcagcaccatcattgctcattagagaccaaccatcacctggaaccccatttgtagcatcattgaaacacctgttaagcctcttgctaaatgttcccaagaaagctggctgacgtccccatccaaacgacatttccccgctcgattcatgtgcaatttgcatttttttgtctttttctgaacaccaatcttccaaagattcataaa

SEQ ID NO: 8283 - DNA, 822 bp, Zea mays
  Predicted polypeptide sequence is orthologous to G390, G391, G438
cttgcgctcctcctccttcactcctcaccctccccgcaggccgcggctcggcaagcaagcaacaacccccgccactcccctccctcaccaccatggcgtcgggcggctgcgctctcgccccgaggccatgacttggcgccgcccgtggccgtggctctccgtcttctccctctccccgcgacgacaacccctcctcctccctgggcggcggcggcggctctagctagctagctagatggcgtcggcgatggtggtgttcgggggcggcaaggaccggccgtcgcctggcggcggtggggcgccgcaggtggacgcgggcaagtacgtgcgctacacccccgagcaggtcgaggcgctcgagcgggtctacggcgagtgccccaagcccagctcgctgcgcaggcagcagctcatcagggagtgccccatactcagcaacatcgagcccaagcagatcaaggtctggttccagaaccgcagatgccgcgagaagcagcggaaggaggcctcgcgcctgcagactgtgaaccggaagctgactgcaatgaacaagctgttgatggaggagaatgacaggctgcagaagcaggtctcccgactcgtctacgagaatgggtacatgcgacagcagctccataatccttctgctgcgactacagacacgagctgcgagtctgtggtcacaagtggtcagcaccaccaacagcaaaacccagcagctccgcgtcctcagcgggacgcgaataacccagctggtctactagctattgctgaggagaccttggcagagttcctgtcgaaagcaacaggaactgctgttga

SEQ ID NO: 8284 - DNA, 654 bp, Zea mays
  Predicted polypeptide sequence is orthologous to G390, G391, G438
ttttttttttttttttattaaattatgcaatccatttataataatcaaaaccataaaggaggggccatgctagcttcaccatcaaacaaaaagtcattcttgtttgacatcacacgatccatccgtgtacaatactgcaattcaggtcctaccatttcacatatttcttcaaaaacaaaaaaaccgaaaccattttacatcccaataaccaaagggcgatttgagacgtgccctaaagcacgtcaccgatcaactgattttcccctgagcgagacggacctggcagcaaacgcgtcacacaaacgaccagttgacgaacatgaagcagacgcagtgcacgccgccgctgccgtcgtcgagcaccttccacgccagcgccttctcgtacgacaccggccggcctaggcccgacacgcacatcccgccggggacgcacgcgaacccctgctccatgacgccggggagctccgcgcacaggttcttcctcccttggtcgtcgaacactctctccagcgcgatgtcctgcagcgccaccagcgtcgtccccagcatgtcgagcccggactggttcgcgaacgtgaacactggcaaggccttgagagagcagcagagtatagcgccggcatggtgccagagagttttcagcactgcttc

SEQ ID NO: 8285 - DNA, 699 bp, Zea mays
  Predicted polypeptide sequence is orthologous to G394
tgacttcctcctcccgcacgcagcgcagcttgcaacccgcaacgaaccaaggccgcgccgcgcgcgccctgccggccgtcagagggaaacccagctctaactgaagtgccggctacatatactgctgtgctagctagctagctagctactcttctggtcctgagcgcacgtaccccatggctcaggaggacgtccacctggacgatgccggcctggcgctgggcctgtccctcggcggcggcggcggcggcggagcctccgccgcggcgcgccacggtaccagcagaagccggctgagcacggaggcgccgcgcacgctggagccgccgtcgctgacgctgagcatgccggacgaagcgacggcgaccgcgaccggcgggtccggcggcagcggcggggccgcgcgcagcgtgtcgtcgcggtcagtggagggcgtgaagcgggagcgcgtggacgacgccgagggcgagcgggcgtcgtcgacggccgccgcggcgcgggccggcgccggcgccgaggacgacgacgacgggagcacgcggaagaagctgaggctgaccaaggagcagtccaagctcctggaggaccgcttcaaggaccacagcaccctcaacccgaagcagaaaatcgcgttggcgaagcaactgaagctgaggccacggcaggtggaggtgtggttccaaaacaggcgagcaagga

SEQ ID NO: 8286 - DNA, 889 bp, Zea mays
  Predicted polypeptide sequence is orthologous to G394
ccttccttccttcccctcgctcgccttcctggcttcttcctccccagcacgcacacgcacacgcacacacccagccttttggctgccctgccggccgtcagagagagaaaccgagctctaactaactgaagtggcggccacatagctagctactcttctgatcctgagcgcgcacgcgccatggctcaggaggacgtgcacctggacgacgcaggcctcgcgctgggcctgtccctcggcagcggcagcggcggcgcctctggtgcggcgcgccacggtggtatcagccgccggctgagcagggaggtgcggctgccgtcgccgcacccgctggagccgtcgctgacgctgagcttgccggacgaagcgaccgcgaccgggtccggcgggggcggggccgcgcacagcgtgtcgtcgctgtcagtggcgggcgtgaagagggagcgcgtggatgacgccgagggagagcgggcgtcgtctacggccgcgttgccgcgggcctgcgccggcgccgaggacgacgacgacgacgggagcacgcggaagaagctgaggctgaccaaggagcagtccgcgctcctggaggaccgcttcaaggagcacagcaccctgaacccgaagcagaaagtcgcgttggcgaagcaactgaagctgaggccacggcaggtggaggtgtggttccaaaacaggcgagcaaggacgaagctgaagcagacggaggtggactgcgagctgctgaagcgctgctgcgagtcgctgacggaggagaaccggcggctgcagcgggagctgcaggagctccgcgcgctcaagttcgccccacacccacaggcgccgccgtcgtctgcgacgcatgccggcgcggcggcgggcgtcgttccggcgccgc

SEQ ID NO: 8287 - DNA, 2229 bp, Zea mays
  Predicted polypeptide sequence is orthologous to G409
atcccccgggctgcaggcaacgtttctctcctctcagcgcaaaaagatagatcctctgctctaccggcctaccacgttcgtctcccgcgccggccacccaccgctgccaccgagggtaaaaccgtcaacccgccttgccccggcgcctataagaagttccctctccatttcttcaaactttagttccagagccctccagagcaaaaaaaatatattatcgaatactaaagcattttcctcgtcgatagaatatagaattttaaaaagggagcgaaataggtttttcctttttgcagctccgtcgtccaccaacctcctccgatccggccgccgcagcgtagccgaattgtcccctcgctagcttctccggccggctagaggctgtttcaggcggcctcgatctcctccgcgcggctgaggaaggagatcacgcggttgctcaggggctggggcgtgcatgatgggattttggttgattccgatggagactccggcgaggcttctgtggagcacgagcttcttccgccacaagatcgccgccatgctcgcctcctcctcctgcttcttatagatcccaccccctcgccgtcgtcgtcggcacggcagctagctcgctagcttctgtacataggtcgacgcgccatatagatactagtctcggattaagcgataattaaggcaaagaatctccaagtttgcttcgctcttgcattgaaccatggagtctggacggctcatcttcaacgcgccgggctctggcgccgggcagatgctcttcctcgactgcggcgcaggcggcggtcccggcggcggcttgttccatcgaggcgggagaccgatgcttggccttgaagaagggcgcggcgtaaaacggcccttcttcacctcgcccgacgagctcctcgaggaagagtactacgacgagcagctgccggagaagaagcgccgcctcaccccagagcaggtgcttctgctggagaggagcttcgaggaggagaacaagctggagccggagcgcaagacggagctggcgcgcaagctgggcctgcagcctcgccaggtggccgtctggttccagaaccgccgcgcccggtggaagaccaagcagctcgagcgcgacttcgaccgcctcaaggcctccttcgacgctctccgagcggaccacgacgccctcctccaggacaacaaccgcctccgctcacaggttgtgtcgttgaccgagaagctgcaagagaaggaggatgcgacggagggcggcgccaccgctgacaccgccgcgccggcggtggacgtcgaggcttccctggccgacgacgtcgaggagccagcagagcctgcggcgacgttcgaggtgctgcaggaggtgaagtccgaggacaggctgagcaccggcagcggcgggagcgcggtggtggacgcggacgcgctgctgtacggcaggttcgccgcggcagttgatagcagcgtggagtcgtacttccccggcggcgaggaccactaccacgactgcgggacgatgggccccgtgaatcatggcgccggaggaggcatccagtcggacgacgacggcgccggcagcgacgaggggtgcagctactacgccgacgaagccgccgccgccgccgccgcgttcttcgccggacacgccacccaccaccacgcggacgaggacgaggacgccggccagatcagctggtggatgtggaactagacgttcgatcttcccacgccgatcgatcgaccgtcttcgaatcctgtgtcaacaagaagaaaaaagaatcgtgccgtgatttttctttgcgcaacgctgctgtaagcctgtaatggtgaatttctagctatggttatgccgttatgaaggaagaaagtgtatgcatgcatggtagggtaaagagtgggtaattaatatcgttgatcatcccagtcactcgtggtgttccagaagatcaatggagttgggggagaaataagtgcgcatagaggcaagtactactctttttatggcacagtgcctatgtcaaatcagggtgttattaccagttggttttttttttaaaaaaaatactgtactattacgcattttcgcatgatttagctgtgagttctgcacagtgaaactgaaacagctagtgtagtgtattaatgaatggaacagtgccccccaaaaaaaaaaaaaaaaaaaaaaaaaaaaaaaaaaaaaaaaaaaaaaaaaaaaaaaaaaaaaaaaaa

SEQ ID NO: 8288 - DNA, 1227 bp, Zea mays
  Predicted polypeptide sequence is orthologous to G409
gcacgaggagttttttttttttttttttccatgtctttgacttgctctctccgtattattaggagtaactgcaatgctcaagctcaacatcagggacaccgtgtcaattgtgggacacgattgttggtaaatacactctctacagttattacgcggtactgcactacactctgggtatccactcgtgcccctgtatgaagctggcgacgctgtacgcgtcgacgtggaccttgggaacctggctgctccacgccaccctctggcccgcggcgccgccggggccggcgctgtcgaaaaccaaaaaaataataatcccaaattaaagaaaaggagcagaagaaaaacaactttcatcgccgtccgccaccggagctcacttcgtcggtctatccctcagtgtcaacccccttctcagaagttctaattgcacctcagtccctggccggtctgcccggtcgccgcctcgccggaggaagcccctcgtctccttgccctgcggcgggttcatggggttctcgctgtaccccatgaagacgtccacgcggttgctctggagcactagcttcttccgccataagctcagctcctcctcctgcttcctctgaggacgccccacccgcctcgatcgcttcggcggcgggccgctgctgctgcgctgtcctagcatccgttcaagtgtgtgtttgcgttcttaggtttcaagattggcttttgttgcgttcttggcgagacgaagggactagggcgcggacaaagaatcagcatgcatccgagcgcggtcagtttcgactccggcgacgggcggcggcgcggtggcgcgcagatgctgctcttcggcggcggaggcagcgccaacagcaacggcttcttccgaggtgttccgatggcggtcctgggcatggacgacgcgacgcgcgtgggcaagcggcccttcttcacgacacacgaggagctcctagaggaggagtactacgacgagcaggcgccggagaagaagcgccgactgacggcggagcaggtgcagctgctggagcggagcttcgaagaagagaacaagctggagccggagcgcaagaccgagctggctcgccgcctggggatggcgccccgccaggtagctgtttggttccagaaccgccgcgcgcgctggaagaccaagcaactcgagaccgactatgaccgcctcaaggctgcttacgacgcactcgccgccgaccaccagggcct

SEQ ID NO: 8289 - DNA, 737 bp, Zea mays
  Predicted polypeptide sequence is orthologous to G409
cttttttttttttttttttttttttttagggatgaaataaaacatcttctcgatgataatgaagacatggaacatccgtatctaacaaggaatcaagtacagaaccaacaggtaattaataaactttataagaaccatgttcgtttgatcaagggtgatatatatgacatttaaaaccagcaaatttagtcaactttgcactcctagccatatgcgtgcatcccctaatactgccgatcgttccatacccatgcccagttgttgagcagggcgtccggggggaagaagaaggcgcggtcgtcgtcctctggcgacgacggtggcgagcgcgccccggcgaagtacgactccgggctgtcgttggtccctgccgccgccggcgctgcagcgctgccggagcagagcttgtctccttccaagacagcgtaggctgtcgcttgggcggcaactgtctgctctccaggctctgccgccgccgccgccgactctttcgtttgcagtttctcagttaacgtgatcacctgtgagcggagacgatcgttatcggcgaggagcgcgtcgcggccggcgatgaggtcgtcgtgcgcggccctgaggcggtcgaagtcctgctccagctgcttgctcctccaccgcgcgcggcggttctggaaccacacggccacctggcgcggcgcgatcccgagcctccgcgccagctcgctcttccgctcgggctccagcttccgcttgggctc

SEQ ID NO: 8290 - DNA, 869 bp, Zea mays
  misc_feature (680)..(680): n is a, c, g, or t
  Predicted polypeptide sequence is orthologous to G409
caaagaaaaaacaaataccggatagatattaaagcattttcctcgtcgacttaaaaaatagaacaaaaaggttcttccttttcgcagctccatcgtccaccaacctcctccgattcggccgtcgtagcgtatagccgaattgccccactccaggactctcgccagcttctccggccgactagaggctgtttccggcgagtgctcggctgatctcctccgcgcggctgaggagatcacgcggtctcgctcgggggggctggggcgtgcatgatgggactttggttgattccgacgatggagactccggcgaggcttctgtggagcaccagcttcttccgccacaaaatcgccgacatgcttgcatcctcctcctgcttcttatagatcccacccctcgacgtcgtcgccggcagctagctcgctagcttctgtacatacgtcgacgccatatctagctagtctcttcatccagtcccgataagtgataactaataattaggagcttgcttcgacgaccttgcattggtccatggagtccggacggctcatcttcaacgcgcccggctccggcgccgggcagatgctcttcctggactgcggcgcaggcggtggtcccggcggcggcttgttgcatcgaggcgggagaccgatgcttggccttgaagaagggcgcggcgtanaacggcccttctacacctcgcccgacgagctcctcgaggaggagtactacgacgagcagctgccggagaagaagcgccgcctgacgccggagcaggtgcacctgctggagaggagcttcgaggaggagaacaagctggagccggagcgcaagacggagctggcgcgcaagctgggcctgcagccccggc

SEQ ID NO: 8291 - DNA, 445 bp, Zea mays
  Predicted polypeptide sequence is orthologous to G416
ttttttttttttttccttgcggtagttctgttcctgggaaaatcgtaacaggactaaccgcaaggaaaaagaagaaaaggaaaatccaaattacagacgaggcaactcgtttggaacgaagagcgagatattttctaatcaagataaaactggagcagaatttgctagatgcttactctggagatggatggaatgggcaaaggtgcattccctgctctttctgctgtaatctgctggtgtaaagaaagttttcaaatctatatacatccttgtagagtcaatgcattcttttgaactttggaacctgaaaaatgctgtcttatcttgtcacgatgaatagaggaaagttcacggaaagtgtaatgtagcttttaaggcttgcaacaagatgcttattattttgaaacttattcataaaaaaaaaaaaaaaaaactcgacctgcag

SEQ ID NO: 8292 - DNA, 899 bp, Zea mays
  Predicted polypeptide sequence is orthologous to G416
gctttgcagccccctccctccaccgcctcctccacgccctagcgctccggcccccgccccgagctcgtcgtggccggctgcgctgcggtgcccgcacctgtgggggcgtgcgggccggtggtgaaacgacccgcgacctcggtgcctctcgacgtctgcccgcttcctcgccggcgccattttgtctaaatcccctgtgataagcaccactgctcgtgatgcattcttcggaaaataaactgggttggaatgagacctctatggggttggttcctgtaccaaaaagaccagctagacctgatgcttcccaccaatgcaaatctgattcctttatgaagcgatcaccaaggaaagttagaaatgctactctggcaaaaagcataaagagcaaataccactatagtcccctcaaacagcggaagggttcagattctgttcctgggaaaatcgtaacaggactaaccgcaaggaaaaagaagaaaaggaaaatccaaattacagacgaggcaactcgtttggaacgaagagcgagatattttctaatcaagataaaactggagcagaatttgctagatgcttactctggagatggatggaatgggcaaagccgagagaaaataaagccagagaaggaactgcaacgtgccaggaaacaaatcataaaatgcaaaattgctatacgtgatatcatccgccaacttgatttgtatacttctactgggagtgttgatgacccactaatgcctacagatcagtccaccaatcccgaacataccatgtgctcaacatgcaagtctcatgaatcattttccagcaattaaattatcttctgcaaagggccctgcaaaagggcatgtcatgagaaatgtttgggaactcccctaaacaaaagcgtactt

SEQ ID NO: 8293 - DNA, 611 bp, Zea mays
  Predicted polypeptide sequence is orthologous to G427
gaagagttttttttttttttttttatgggggacaaactatgtcaacacaataagaacaagaataaagtatgctgtgagccacacatcatcagctcaaagtatcagccgcagcaaacaaatatgccagtggtcagactaatggctagatatacagttgaaccggtcgatatggtcctctttatttccgtgagtacagtcgccatgcagagctccgtttgattagcgtgttggtatggtatacatgtgtacatgtgtgtcagcaggtgtgcgttacatacacggtatatacggtgcagctagctctcctccatcaccttttacgcttcgatttgagggttgacgtctgggagttgttgtgccagttcctcttcctctggttgatgaaccagttgttgatttgcttcagctgcaggccggtctcttcgacgagcttagccttatcgtcttccgtggggtatggccacttggagtgctcctgccaccattgcttgaggatgctggtggtgtccccaggcagcttcccggccctccttttcctcaggatctcctcccgcacatcctctattctcgacttgaaaccctgcttgagctccatcttgagctcctgcctg

SEQ ID NO: 8294 - DNA, 654 bp, Zea mays
  Predicted polypeptide sequence is orthologous to G427
gattcggcacgacgaaggcggcatcgcggcacacccgctgtacgagcgcctcctggaggcgcacattgcctgcctactcgtcgccgcccccgtcgaccagctcccccgcatcgacgcgcagatcaccgcgcgccccctgccgctcgccgtggccgccggggccacgaccgcgggagggccgtccagcggggaggagctcgacctcttcatggactaatgagttaaaggatcaaatggaggcaacactactactcaatccatatgagctgtgtgcgcgtccggctgcatcgtcgaggagttacagatggagcagtccatgcagtcgtacctcttgcgttcgccgacgggaaaaattgatggcagatcaaattccagaatggaaaggcagctccagctgggtgagaaagatcgtcatcaggttctaaaggatttctcaaagttgcttgatgatcagtgattaccgaaggatggatgagcatgatcagtatgagtcagttggtttagatgattcactagaggatgagaggaatcttgatgaaaccatggctgattgaagggtcgcggaagtagagcctaatgcaagggatgtgaggactggtgcagcaggtgacaagaagttgccatggatgctccatgaccaggggcactgtgctg

SEQ ID NO: 8295 - DNA, 950 bp, Zea mays
  misc_feature (760)..(760): n is a, c, g, or t
  misc_feature (796)..(796): n is a, c, g, or t
  misc_feature (842)..(842): n is a, c, g, or t
  misc_feature (909)..(909): n is a, c, g, or t
  Predicted polypeptide sequence is orthologous to G427
gcacgagggagcacactcgggaggcgaggagctcgacctcttcatgacacattatgtgttgctcctctgttcattcaaggaacaactccagcagcatgtgcgtgttcatgcaatggaagcagtcatggcttgttgggagctcgaacaaactttacaaagccttacaggtgcatctcctggtgagggcactggggcaactatgtctgacgatgaagacaatcaggtggacagtgagagcaacatgtttgatggaaatgaggggtcagatggaatgggatttggcccattaatgttgactgagggtgagagatccttagttgagcgcgtccggcaggagctaaagcatgagcttaagcaggggtacagagacaaacttgtggatattcgggaagagatattgcggaagcgaagagctgggaaactccctggcgacactgcttctaccttaaaagcatggtggcaggctcattctaagtggccgtacccaaccgaggaagacaaggctcgactggtgcaggaaacagggctacaactgaagcagatcaataactggtttatcaaccagcgtaaggggaactggcacaacaattcggcgtcatcctcgtcggacaaaagcaagagaaaaaggtaatatcacaagaaactagactaagcttctgcttccacatccttgacacctttctggtttctgtttgctgtatgcttatgcttgtaataaaggaacactgcaggtgatggaaacgcagaaccagcctggtanggcatggtcggggaacgaagtttatgtaaataatgncttctactgtgaagagtgccatcatatttgttgctccagaaaagancctcaggccggtgtttcctgaacccatccatattcatacaaagacatcacgcgatggaataatgttncgagtagtcaaattaaaataaataacttgtttaggggaatg

SEQ ID NO: 8296 - DNA, 659 bp, Zea mays
  Predicted polypeptide sequence is orthologous to G427
ggggacaccaccagcatcctcaagcaatggtggcagcagcactccaagtggccataccccacggtgagtgcattgtatagctagtatcatgcaagaaagcaaccagccatctgctgctgcctgctgctagctactgcggctaccaatctccatacataacactgatggtttgtaaagtgccatgcgtgcatatcctaaataaagatggtatcgttttgagtggctggtactacaggaggacgataaggcgaagctcgttgaagagaccggcctgcagctgaaacaaatcaacaactggttcatcaaccagaggaagaggaactggcacaacaactcccagacgtcaaccctcaaatcaaagcgtaaaaggtgaccaataatataattaatatgccccctctcatccgatgcatgcatgattgctgattagataatgcacatatgtattctccgaatcatatcgacggtttcatgacgcaaatgcatgtatgtatttatgtatgtatcaggtgatggagagctgcgccaccatgtactgcacacctgacacgtataccaattaccaacacgctaatcaaacgacggccatgcatgcatggcgactcacaagaaataaagaggatcgattgattcaactgtatatttctagtcattagtca

SEQ ID NO: 8297 - DNA, 601 bp, Zea mays
  Predicted polypeptide sequence is orthologous to G427
gaatgcaattaacctctctgttcttcgatctcttcctgccagcagatgagatggtcagatcaggtcactgtatatatgtgcacaggggggggggtggacaaactatggctatacaataataacaagaataaagtatggtccgagcacatgatcggctcaaaatatattaatcacagcagcaagcaaatatgccagtggtcagactagtgtacgtgtgtttgtgtgtgtcatgaacctgtcacctctctgactagtgactaatgactagaaatatacagttgaatcgatcgatcctctttatttcttgtgagtcgccatgcatggccgtacgtcgtttgattagcgtgttggtaattggtatacgtgtcaggtgtgcagtacatggtggcgcagctctccatcaccttttacgctttgatttgagggttgacgtctgggagttgttgtgccagttcctcttcctctggttgatgaaccagttgttgatttgtttcagctgcaggccggtctcttcaacgagcctcgccttatcgtcctccgtggggtatggccacttggagtgctgctgccaccattgcttgaggatgctggtggtgtcccc

SEQ ID NO: 8298 - DNA, 852 bp, Zea mays
  Predicted polypeptide sequence is orthologous to G427
cggcagcgggagggccgtccggcggcgaggagctcgacctcttcatgacgcactatgtattgctcctttgctcattcaaggaacaactccagcagcatgtacgtgttcatgcaatggaagcagtgatgggttgctgggagcttgaacaatctttacaaagcctaacaggggcatctcctggtgaaggcactggagcgaccatgtctgatgatgaagacaaccaggtggatagcgaagccaacatgtttgatggaaatgatggatcagatggtatgggctttggccccttaatgctgacagagggtgaacgatccttagttgagcgtgtacggcaggagctaaagaacgagcttaagcagggttacaaagaaaagcttgttgatatcagggaagagattatgcgcaagcgcagagctgggaaacttcctggagatactgcatctgtgctgaaagcttggtggcaagctcattccaagtggccatacccaactgaagacgacaaggcacgactggtgcaggaaacgggattgcagctaaagcagattaacaactggttcatcaaccaacgcaaacggaactggcacagcaacccaacatcctcgggtgaaaagactaagaagaaaaggtgatattgatccagagcaatcttgacgatgctaaacgtccactgtgtactttatggcgaagtacattaccctccctccgtagccaggagcggagatgtgcatcttgggtggcccagtggtcacttaatgccccaagtttgaccacgttgtgggactggtgctagtagtgacctctgcagtatagtaatattcactaatgttgtgggaatcatgtggtgtataaccg

SEQ ID NO: 8299 - DNA, 709 bp, Zea mays
  Predicted polypeptide sequence is orthologous to G427
ggacagtgagagcaacatgtttgatggaaatgaggggtcagatggaatgggatttggcccattaatgttgactgagggtgagagatccttagttgagcgcgtccggcaggagctaaagcatgagcttaagcaggggtacagagacaaacttgtggatattcgggaagagatattgcggaagcgaagagctgggaaactccctggcgacactgcttctaccttaaaagcctggtggcaagctcattctaagtggccgtacccaaccgaggaagacaaggctcgactggtgcaggaaacagggctacaactgaagcagatcaataactggtttatcaaccagcgtaagcggaactggcacaacaattcggcgtcatcctcgtcggacaaaagcaagagaaaaaggaacactgcaggtgatggaaacgcagaaccagcctggtagggcatggtcggggaacgaagtttatgtaaataatgcttctactgtgaagagtgccatcatatttgttgctccagaaaagaccctcaggccggtgtttcctgaacccatccatattcatacaaagacatcacgcgatgaataatgttgcgagtagtcaaataaaataaataacttgtatagtgaataactagaaactagcattcatcgttttggtattgtatagcgctagagtgtaattgtttggtcggactgtcttgtataatggtg

SEQ ID NO: 8300 - DNA, 945 bp, Zea mays
  Predicted polypeptide sequence is orthologous to G427
ttcttgttcccagattctaatatattcctggctttattgcagacgcactatgtattgctcctttgctcattcaaggagcagttgcagcagcatgtacgtgttcatgcaatggaagcagtgatgggttgctgggagcttgaacaatctttacaaagcctaacaggggcatctccgggtgaaggcactggaggaaccatgtctgacgatgaagataaccaggtggatagcgaagccaacatgttcgatggaaatgatggatcagacggtatgggctttggccccctaatactgacagagggtgaacggtccttagttgagcgtgtacggaaggagctgaagaacgagcttaagcagggttacaaggaaaagcttgtcgatatcagggaagagatcatgcgcaagcgcagggctgggaaacttcctggagataccgcatctgtactgaaagcttggtggcaagctcattccaagtggccgtacccaactgaagacgacaaggccaggctggtgcaggaaacggggttgcagctaaagcagatcaacaactggttcattaaccaacgcaaacggaactggcacagcaacccaacatcctcggctgaaaagaccaagaagaaaaggtgatgatggcccagagcaatcttgggaaaagctagagatgtccactatactttattatggcgaagtacattctccctcacttcgtaggcaagagggaaaggtatcttgggtgacctgagtggccacctaatgcgcaagtttgaccacgtgtggggctggggttggtagtgacctcagcagtatagcattcgctaacgtgatgtgggtgaatcacgttgcagtagaaccggcgagcgggaggggggtaatttatgttgtattgtaattgtgttttttattaccttgtaatgatattttagggggaatcccaagattcatattcgc

SEQ ID NO: 8301 - DNA, 1547 bp, Zea mays
  Predicted polypeptide sequence is orthologous to G428, G1594
catccccaacctctctctctcccccctaggagtgggagctcctggctccatctatccgcctgcagatatcacaagcttttcctgctgctgctgctgcagcagcacctgcagcttctccgtctgcagtgcgagcagctgctaaaaattcccccataagcctctggcttcctgcccccctcactttcttggaagcccagcacaacacgaggatcatattcactccctacagtggcgtactagaataccagttgtgcgcaaacagcggcagcagccgtgatgtacaggtgagctggctctgccgctccactccatggaggatctgtacagcatccacccggggatctcgcgggtcgtcggaggcgcggcgagcgaggcgtccgtcgccggcgccggcgccggcgggccctcgccgtcggatctgacggagctcatgaaggcgcagatcgccagccaccctcgctacccgtccctcctctccgcctacatcgagtgccgcaaggtgggagcgcatccgcatgtgacgtcgctgctggaggaggtcagccgggagaggcgccccgacgccggcgccggggagatcggcgtcgatcctgagctcgacgaattcatggacgcttactgccgggtgctggtgcgctacaaggaggagctgacccggccgttcgacgaggccgcgtcgttcctgagcagcattcaggcgcagctcagcgacctctgcagcggtggaagctcgccggcggctaccgccacgcactccgatgacatgatgggctcctctgaggatgagcaatgctcaggggacactgatgtgccagacatggggcaagaacatagctctcacttaggtgaccacgagctcaaggagatgcttcttaagaagtacagtggatgcctcagccgtcttcgttcagagttcctgaagaagcggaagaaagggaagctaccgaaggatgctcggacggtgttactagagtggtggaacacgcactaccgctggccttatcctacggaggaagacaaggtgaggctcgcagcaatgaccggtctcgacccgaagcagatcaacaactggttcatcaaccagaggaagaggcattggaagccatctgaggacatgcggttcgcgctcatggagggtgttgccggtgggtcttctgggacgacactctacttcgatacaggcacaattggaccctgaatcatacaccacttgggatgacaactggccagctcatattagtaataagatctggcatgtggagtgacgatctgctcggtgaaaattgaaaataaatctgctgagctgaggttgatcagactagtcagttgccctattattttacaagatcatgtgtatatggtgccgtcgtatcagaacaaactgtatgcatgtatgggcgaattgagacctgcaaaaggagtttaattagtagtttcaagtattggctcatggatttgtaatactcgctacccaatttaattgttagataggctgaagggcttataaaggtaaatttacttctgctaaaaaaaaaaaaaaaaaaaaa

SEQ ID NO: 8302 - DNA, 1447 bp, Zea mays
  Predicted polypeptide sequence is orthologous to G428, G1594
ggcacgagagagagcagccgagccggttcaaccccatgaataccgctgctgcagagatcacggcctgcttctgcgtctgcagctccagcagtagcaacagcaggggctgcagtgcaaacgactgctagttcccctttccccgcatgatctctgccccttcccctaccttctcttgttcttgcttgcacgacccttttccttgtgcgctagtgccgcttcttcttcgtcttcctggagctccccgcatccacacatgccccaagaaccagacaataaaacaacacggaaccatcggagtctttttctactactatttccagcgatttgattatatggatgtgtgcacaggtgcacgtagataggtagaatagaagggagattatagctagctagaggcagcgagcagctcggttgctgggacacgcgatcgagctacagcaaagaagactgcagggtggcgcggcgggcatggaggatctgtacagcatccacccggggatctcgcgccacggggcggcggcgactagcgaggcgtccggggtcgccggtggaccgggctcacccccgcccccgcccccgccggcggcggatctgacggagctggtcaaggcgcagatcgccgggcacccacgctacccgtccctcctctccgcctacatcgactgccgcaaggtgggcgcgccgtcggaggtggccacgctgctggaggagatcggccgggagaggtgcgccgccgcctccgccggcggggaggtcgtcggcatggaccccgagctcgacgagttcatggagacgtactgccggttgctggagcggtacaaggaggagctgtcgcggccgttcgacgaggcggcgtccttcctcagcagcgtcaggacgcagctcagctccctctgcggcggcgccgcctcgctctccgatgaaatggtggagtcctctgaggacgagccatgctcaggcgacacagacgcgacgacagacccagggcaggagcacagctcgcgcctggccgaccgcgagctcaaggagatgctgctgaagaagtacagcggctgcctgagccggctgcggtccgagttcctgaagaagaggaagaaagggaagctgcccaaggacgctcggtcggcgctgatggactggtggaacacgcactaccgctggccgtaccctacggaggaggataaggtgaggctggcggccatgactgggctggacccgaagcagatcaacaactggttcatcaaccagcggaagcggcattggaagccgtcggaggacatgcggttcgcgctcatggagggcggcgtctccggatcctcctccgggacgacgctctacttcgacacgggcaccatcgggccgtgatcgatgcgatagatacctctgacgaattgggggcaaattgttggttgatactgagattagttacatgaagcaatatccgctg

SEQ ID NO: 8303 - DNA, 1094 bp, Zea mays
  Predicted polypeptide sequence is orthologous to G428, G1594
cacgagagcagcttggttgctggggcacgcgatcgagctccaggcaagaagattattgcaggaaggcgcggcaggcatggaggatctgtacagcatccacccggggatctcacgcgccgggggcgccgccacggcggccagcgaggtgtccggggtcgccggcggaccaggctcgccccctcccccgccgtcgcagccccctccgccgccgccggcggatctgacggagctggtcaaggcgcagatcgccgggcacccgcgctacccttccctcctctccgcctacatcgagtgccgcaaggtgggcgcgccgccggaggtggccacgctgctggaggagatcggccgggagaggtgcgccgccgcctctgccggcggggaggtcggcctagaccccgagctcgacgagttcatggaggcgtactgccgggtgctggagcggtataaggaggagctgtcgcggccattcgacgaggcagcgtccttcctcagcagcgtccggacgcagctcagctccctctgcggcgccgccgcctcgctctcagatgaaatggtagggtcgtcggaggaggacgaagcatgctcgggaggagacacggaggcgacggagccggggcagcaggagcacagctcccgcctggcggaccgtgagctgaaggagatgctgctgaagaagtacagcgggtgcctgagccggctgcggtccgagttcctgaagaagaggaagaaagggaagctgcccaaggacgcgcggtcggcgctcatggactggtggaacacgcactaccgctggccgtaccctacggaggaggacaaggtgaggctggcggcggcgactgggctggacccgaagcagatcaacaactggttcatcaaccagcggaagcggcactggaagccgtccgaggacatgcggttcgcgctcatggagggcgtcaccggcggcgggccctcgtccgggacaacgctctacttcgacacgggcaccatcgggccgtgaccaccacactaccagcttgggcaacgcaaagtgcatacgtttttctttgtgtatatgggcgacaacgtgtcggtaggtacactcagcatactgg

SEQ ID NO: 8304 - DNA, 1808 bp, Zea mays
  Predicted polypeptide sequence is orthologous to G440, G864, G1421, G1750
gggtaccgggccccccctctagtttttttttcttttttttttttttttttcccacgaaacttattttttcccctttcattgcttaacagtaacagctcaatgaacttgtccactacaatgtctttgacaagcattaccaaataacaaagcaaacacttaggcactataccttaaacataatataacctaccaaaattacctctctgcggccgctaatgggggtgtgttcggcaaagaggaaatctcctgggcacgagcagatccaacttgcccggggaaaaaacccaagatatctctcccctttccaagcacactctcaggggcacgtttatgaaaccaaacaaccctaacatatcaagggcacactccctttcaattcacacgcaaaaatcaacggtttgcaggaagtcgtccatgccgcggccgaggtcgcagccgggcatctccgggaagacgtcgttgatgtcgtcgaggtcgaggtcgatctccatctcctcgtccccgaagtccccgagcaggaggtcatgttcgtcgtccaggccgaagtccgcatcggagagatccagggcgtccagcccggcgcggaagtccagcgggtcgatgtcgggcagctgcaggccgcgcagaaggtcctggtagaactctgggtcctccggcagctgcgctgattcggtcgacggcggggcgggcgtcggctctggggactgcgtgttccgcgcttccttgctcggttcaagcacggacgacggcgacgggtgcgcgaatggagcggtcgaggcggacgacgaggaggaagccgtcggggtgctgccgcttgccggagtgtctgctgaggacgcggccacgggcagcccgcggcggcgccgcttctcgtcggcgaagctccgggaggcggacaggtaggccgcggaggccgcaccagcggtgtcgaaggtgccaagccactgcctcttgccggtgaacgggttgcggatctccgccgcccacttgccccacttgcggagcctcactccgcggtagcgctccggcgccccgccgttggtgcacgcggccacagcggccgccgggagaaccggcttggctggggccttgccgatgaaggcctcaaaagagaagcgcttggtccttgatggggtgccgccggcctcctcgtcgtccgagtcggagtccgagtccgtggcgtcggggtcctcaaataggacacggacgcggcgcctcggctggaccggcgccggcagctgctgcgtccgggacttcaagagggcagcagagggtttaaggccaaactcagacatcttcttagcgttgggcttcttcgccagggccttcttgaggagaacctgttgctggttcaacggagacatctctcttctatctcttccgacggggagaactccaaaacttgtcgccaaaattgccaaaactatggggggaaaacttctaaagaaaaacaagaaactctgggtgcaaaaaaaatgacggagacgagcgcaaatcggccgaatccgtcaatctcctctacagaagccgcacggccttatgtggaggaatccggaatacttcaccccgaacccgtccctgagcatcgacgaggatttgttccagccgttgagccccttgcgcatagatcggccagagcaagcgagggcgcggaggatgacggcgacgacggcgatgatgagcgctacgaccaccagatcggaaaaggggcaagaagacatatacgagagttgtctgcttcttcttctccgacgccggcgacgtcgtcgtcgcctccggcctcccttacacgcgcttaaacggggtgc

SEQ ID NO: 8305 - DNA, 864 bp, Zea mays
  Predicted polypeptide sequence is orthologous to G440, G864, G1421, G1750
ccccaatctcccctttcgtcttctcttcccgctcccgtcccgaaattagcccaccgattagcttgcttgccctggcagatcgaagccgtagccctagccgaggagcgcccatggccgctgcgatcgtggcctgaggcggcggggctcttcccatggggtgaggggatggaccctagcctgaaggaggaggtgatgaaggcggtggaggaggcgaggtccgcggcggcgccgcggtgccgggtggtgcggatcatcgtgcacgacgaggacgccaccgactcgtcttccagcgacgacgagggagaggaggcgggggagcgcgccgcggcgcacccggccgcggcgccggcggggagcgtgaagcgcagccgcgtgctgctccagtccgctgggtgcggggcggaggaggacggcgagggggccaggttcacgggcgtgcggcggcggccgtggggccggtgggcggcggagattcgcgacccgctgctccgccgccgcgtctggctcggcactttcgacaccgccgaggaggccgcggcggcctacgtcgcagcgcgcctccgcatccgcgggcccagcaactcgctccctccgcccgagcaccgcccggccttgcccccacgtcccccgccgccacctcagcagcgggagaagaagctgccgctgccgccgccgccgccgcctctccttccgcttccgccgaagaagcagcagtatccgccaccgcctctgcttccgccgaagaagcagctgtatccgccaccgcttcccctcctcccaccaaagaaacagcagcagcatcaccatcacccgtcaccgcctctgcccacgcttccgccgaaaaagcggctgccgtcgccgcct

SEQ ID NO: 8306 - DNA, 819 bp, Zea mays
  Predicted polypeptide sequence is orthologous to G440, G864, G1421, G1750
ccgtcccctgcctggaccctcccgatccgcctctcctcggattccgggtggttcccattccatcgacgtaccccctagtattcactgcttcggtgttgtgggctccgtagatcgacgtggcaccagaactatccgcgctagctgttgatttatgtcgcctgctctgctgccgctccatggttctgagctcacgtcgtcagcatcctcttcttgctcctttctccagcctgggcaggggggcgccagagactgcgggtttcgcttcaggatctcaggatttggatttggggtgaagtactctgggtttctacatttaggccctcgcttcctactttgccgcacctgagatagtaaaagagttcaagaatcccccccaaatcacagtcagtcttgggtctggtttgggtggatttcattacgtttcctccaagttcaaacagccagcaggatttccgagttgagtctgaagatcttcgcttttccggtttccatcagaagttagagagaacccctattctgatttgccagattccatctgtgctgcagttcttgcgcagttcaagagactgccccaactttatccaaaaagtttcctccgtctcatttgtggtcaatctggaagcggtgtgtcaagatgcggccctcggtgcagaaggtccgcattttctgttctgatcctgatgctactgactcatctgatgatgaagatggccagatcatcgcagtgaagaaaatggttatggagatactagtcccagtgacaaactcgaagacatctaatagtctgaagaccctttgtgcgtgtggagcaaagggact

SEQ ID NO: 8307 - DNA, 925 bp, Zea mays
  misc_feature (624)..(624): n is a, c, g, or t
  Predicted polypeptide sequence is orthologous to G440, G864, G1421, G1750
gagtctcgccgccgcaagcttgtgtaaggtgtaaccctaaccctaaaacacttaccttcgcctccagcaccacgcttccatggaggggcgcggaggctaagtatagccaacctctacaccatatccccatggattgagcggattcccaaggcatgggtacaaaccctcacctgcaagagctggccgcttcggcggtggcggcttctgaaccaccaccgcgggcgcgcgtggtgcggatcctagtgcacgatgctgacgccaccgattcgtcctccagcgaggatgaggcaccgccacttcttcctcggcggaggtcgaggggtggtagcagcagcctgagcgtgaggcgccgtgttatggaaccggctggggcaagctcggccgttcggttccgtggcgtccgtcgtaggccgtgggggcgctgggctgcggagatccgcgacccgcacaaccgccgcagactgtggctcggcaccttcgacaccgctgaggaggctgccaacgcctacgacgctgcgaacatccgcttccgcggtgtcagcgccactaccaacttccctgcggcccgctactcgccccctccaaagccagcgaagcctatcatctcgctgactcctgaacccnggaaggtgatcaccttgccaccggtacctgtgaagccaaccttccctgttcaggtgaaggaagtgggtgggagctggggcggcctgatcaagggagctaggtcggaggtcaaggcgtttgcacccaagccagtatggaagatgatccccagggtgcaccagaagttccgggttgtgccgatggctctgggctgcgtgccgtccatgctgcctccatctacgtggaggaggttggcggtggctgatggtcccagtatctgcaattactatcgctagaggtttttattgtctatctccatggc

SEQ ID NO: 8308 - DNA, 584 bp, Zea mays
  Predicted polypeptide sequence is orthologous to G446
attcggcacgacgatgcgaggccaaactcaaaaggcgcaacttgcaggtagaatgggatgaacatgggtatggagaaagacctgaaagagttagtctatgggatatcgaaactccagagaacatggttttctcttccccattgaattcgaaaaggcaatgtcttcctagttatggagtttctggcctacatgtgtcatcaatttcaaagccacaaggaagtccttttggtaacttgcagcacatgccagggatcagttcagacattgctttgctgcttctcaatcaatctgcccagaacctcgggagttcaattgcttgtcaacaatcatcattttccagcattattcaaaatgctaagcaaagctatttccctccaacgacattaggtgcttccactgggtggaatgaatctcagcagcagttaaacgcccttggtattcaaaaaggtgatcaagtaagctgtgatgttcagccaggtattgattcaatcactgcaccggagatgaatgttaaaccaagagtcccaagaagcacggattcatactcaagtcagagcatttcggatccaaacagcaagagtgac

SEQ ID NO: 8309 - DNA, 856 bp, Zea mays
  misc_feature (715)..(715): n is a, c, g, or t
  misc_feature (751)..(751): n is a, c, g, or t
  misc_feature (816)..(816): n is a, c, g, or t
  misc_feature (832)..(832): n is a, c, g, or t
  Predicted polypeptide sequence is orthologous to G446
cgaagaatcatctggagcacttacacatggtgattttgctggagagctccaagttcagcagcaggttgaacagcatgaactacttgcgccaccaaagatagaatcatcaaagtcacctgatggagggaagtccgtcagttcgttcccaaaccaagggtgtatcccacagttcttttagggtctggactggatgattccaccttcctattaccaagactccaatggcatccaatcagttaccgcgtcggataacatttttaatccatctgaaggtataccttccaccatgaacgctgacgccttggatgcgtttcaaacatcttgcctttccgagtgcttccctaactccattcaagagttcatcggcagtccggatataaacacacttgcatttatgtcgcctgagatgcaacaattggatgccggcagcaacttgccgagcacatccaactcctatgtgcagatgagtttctcagaggagagccacagcgcatccttaagtggccttcacatggaagccatccatataaacagctcgtcatgctctcagccactggcgacggggagcttcgatgcaggggcgttcccgaaactgtcaaacataagagaatgccaacccttgcctctgcaagagatccacaccagttccatgggaacaccttcatgcagtatggacgcggcggcagagtacggcaacgatagaagtgcgaagcanatgaaaccaccggtccggacctatacgaagggtcanaagttaggatcagttggaagtgtattgacgttacacggttcagagatacccatgagtgaggtcanccattgcgtgcatgtntggactccagggaagctggacatc

SEQ ID NO: 8310 - DNA, 762 bp, Zea mays
  Predicted polypeptide sequence is orthologous to G446
aagctcataatttaagtcattgcatgaaaaaatagaaaatagacctgtaatgcaccgccatataataatggtctcttctcgtgctagaaaagaatcaaagcattcagagaattggatgcacgtgatgtatcttttatttacaagaagagccgctgcgtggctacgaagaacactcatttctcgtatttgcgacgttacactgtgcaggctgcgcaggacatatagccctgactttctaagccatttgcatgcagtcgttcaagacatgcacgccattctcgctcatctgctgtacttccgaaggcgccaggatccgaatgcatctcacacagttgatgaactcctcccacgggtcgtctccaacgaggagaacatcgttctcgtagtcgacataaacaagcttccagtctgaactgccagggtgttccagtttcccctgtagtccaaacatgcaggcaatggctgacctcaactcatggtagtctctaaaccgtgtaacgtcgatagatcttccaactgatcctaacttttgaacctttgtatatgtccggaccggtggtttcagtggcttcacacttcgatccatacagtactcgaccgccgccgcatccatactgcacgaaggtgttcccatggagctgttgtgaatctcctgcagaggcaaggcctggcattcttttatgtttgatagttttgagaacgtccctgcatcaaagctccctgtcgccagtggttgaaggcaggagctgttgatatggacag

SEQ ID NO: 8311 - DNA, 891 bp, Zea mays
  misc_feature (669)..(669): n is a, c, g, or t
  Predicted polypeptide sequence is orthologous to G446
gtagatgatgacgtcctcgtacgagaaggccacgtcgggtgtcctgaggaacgcggcggcgctgctcgacgaaatgcagctcatgggagaaacgcagggtgccaagaaggtgatcaactccgagctgtggcacgcgtgcgcggggccgctggtctgcttgccgcagcgggggagcctcgtctactacttcccccaggggcacagcgagcaggttgctgctaccactaaaaagatacccaactctcgcatcccaaactacccgagtctcccgtcgcagctgctatgtcaagtccacaacatcactttgcatgctgacaaagaaactgatgagatttatgcccagatgaccctgcaaccagtacactcggaaactgatgtgttcccaatcccaacgctcggtgcttataccaaaagcaagcaccccagtgaatatttctgcaagaatttgactgcaagtgatacaagtacgcatggtggtttctcggtgccacggagagctgcagagaagctgtttccgcagttggattattcaatgcagcctcctaatcaggagcttatcgttcgagatctgcatgataacatgtggacattccgtcacatttatcgccagccaaagcgacatcttctaacaactggatggagtctttttgttggtgcgaaacggcttanagctggtgactctgtcttatttatcagggatgagaagtcacagctccttgtgggtgttaggcgggccaccagacaacaaccggctttgtcatcatccgtcctgtctactgacagtatgcacattggtgttcttgctgctgcagctcatgcagcatcaagtggtggctcgtttactgtttactacaatcctcggacaagcccgtcgccatttgtgattcctct

SEQ ID NO: 8312 - DNA, 781 bp, Zea mays
  Predicted polypeptide sequence is orthologous to G447
ctgtctgaagttcaggttttgcctaaccatctgtctgatgtttcgactcagcaacagctctaggtaagtttcattcttcttgcctacattgtttcaaaacaaagaaaactacacatatatctagaacataccctaatctgaggagcatttcctctcccaactataaaagccaagacgtctacggcatcctgcatctgcttaccctttccgtggcgataattctgtagatggctggacactggttgctttttgcagctataattctcatctcgaatttccgtgatcaggtcactcaaattggtcgtagaacctgatggaagggttaccagggttctggtcgcggcgaggcttccaggcattcccaccatctgagctgctgcaagcctggttggagaggacattgttccccaaatcaccatctaagctcatctgctgcacttcttggggggataggatcctaatgcacttcacacaattcacaaactcctcccatgggtcgtcaccaagaagtaggacgtcatcctcatgatccgtgtagactaacttccatcctattctctgtcggtcctcaagttggccctctataccaaacatgcgggccacagcatgcttcaattcttcatatccggagaacctgcctatgtcaatggatcggcctacagctccacgcttgtagacctttgtgaatgtccgcattctctgcggaggtgcaggggggcaagaatttctattcaacatgacaccatcgttgattgcagaatcaattgagttaaaagcyatc

SEQ ID NO: 8313 - DNA, 557 bp, Zea mays
  Predicted polypeptide sequence is orthologous to G447
atctgcaacaagaaggtacatgggaacaataactggtattagtgatatggatcctttaaggtggaaaaactcccaatggcgcaatattcaggttgcatgggatgaagcagcaccaagtgagagacgcaccagggtttccctttgggaggttgaacctgttatcgctccattcttcatttatccctcgccattgttcactgcaaaacgtccgaggcaacctggggtaacagatgatgatagctcagaaatggacaatctttttaagcggaccatgccatggtttggtgaggaggttggcaagagagatctgagtactcaaaacggtttagttcctggattaagtttggttcagtggatgaatatgcaacacaacccctctcttgccaacacggttatgcaaccggaattgctaaattcgttagctggaaaacctgtacaaactctggctgcggctgatctatctaggcaaattagttttccagccccagttcctgcaacaaaataacatccagttcaacacttcgctgctacctccccaaaaccagcagaccgaacag

SEQ ID NO: 8314 - DNA, 921 bp, Zea mays
  Predicted polypeptide sequence is orthologous to G447
gcaccccttaaaggacttcgctgctacctccccaaaaccaacagacctaacagttagcaaatgtaatagctacaccaaaccaattgggaagtgttatagtaccacaaaaggcagttcaaaattgcagttctgaacagaaacagaatctggttacacaaccactgcaagtcagccaaccaatggttagtgtggcacagcctcaacttgtccatactcaactccagcaacctcaagtagttctccaggctcagcctcagcaacctcaagtcattgtccaagctcaactacaacaacagcaacctctggttcaaaatcacaccaccatacaaggtggccttcaacaaatccagcttctgcagcaacagcaagttcagcagtcagtgcaggaacaacagcaaataaagatacagccttttcaggtacctaatgatgccaacatggtaacacagttatctgatcagatgaaaatacaactattgaaggctctacagccacagcagcctctggtcatggaacagcagaaaatgatatttgatttgcagcaacaagcagtaaattctcagtcaactgctcagcagtgctcacaggtagctacccaagtggttggtttgcatagcagtagcactaatcagtacccgacgcagcaaaagactcaacctctcaaaacatttcaagattttcctgggaatgctgtttctattgtaaaaccagaaattgtcacctccgtgggtgctcgctctttgcatgtgcctggtggggtgcagtcaatgaagatggatgaagttccctcttcttcacatcgccatccacaaacaacaatcctgttattttgcgatcaactccaagtagctccaagaaccaatgtttacctactgcagcaaaggctcctcagtcatctgttgtattgggttctacacttga

SEQ ID NO: 8315 - DNA, 867 bp, Zea mays
  Predicted polypeptide sequence is orthologous to G447
gcacgacgttttgaaccataatacaggatccttgccaccccagcaacttgtaagatcacactcagcactcactgagagcgaagaaccttccagctcaacagttccatctggcagccgtatctccccaataaattcatttagtagagcaaaccaaggaaccagaaatttgcctgagatgccagcaacaccgcacattgagcacttacttcaggaaattcaaagtaagacagataatcgaatcaagaatgatatacaaggtagtaaggaaacggtccatgcacctaatcgtcatctagcttcagatcaacttgatgcgtcatctgctacctccttttgcttagatgagagcccacgagaaggcttttcctttcctccagtttgtttggataacaatgttcaagttgatccaagagagaattttcttattgcggaaaatgtggacacattaatgcccgacgccctgttgtcaagagggatgtcgtctggaaagggtatatgcaatctaccttctggacaaagggatcatagggatgtggaaaacgagctatcctctgctgcattcagctcccagtcatttggtgtgccggacatgtcttttaagcctggatgttcaagtgatgttgctgttgctgatggtggaatggcaagccaaggactgtggaatagtcaaacacagcggatgagaaccttcaccaaggttcaaaagcgtggatccgttgggagatcaattgatataacacggtaccgaggttacgaagatcttcggcatgatcttgcgtgcatgttcggtattcaagggcagcttgaagatccctacaggacggactggaagctggtctatgttgaccacgaaaatgacatcctcct

SEQ ID NO: 8316 - DNA, 630 bp, Zea mays
  Predicted polypeptide sequence is orthologous to G447
tagcgtggtcgcggccgaggtacaacatcatctttcacctacggtaatcttcatctcccatcctctatactacattccttccatgtgagaaaacctacacatatgaacaaaaacactaccaatccatcgagcgattcgctctcccggacgtaaatctggcgacacatctacaaacattctgcacctgccatcccctcacgagacgcctacttgtgatccggcatgtatggaccggcaagttaggtcattcaaactggtcatatgaaccagtagatgggttaccggagttctgatcgcagcgagctctccaggcattgccgccgtcggagctgctgcaggcctggttggggagaatgttgttccccagatccccatccaagctaatctgctgcacttcctgaggcgacaggatcctaatgcacttcacacagttgacaaattcctcccaagggtcatcaccaagaaataggatgtcatcctcatgatccttgtagacaagtttccagccaattctctgtcgttcctcaagttgcccctccatactaaacatgcgagccagagcatgcttcaactcatcgtatccactgaactgactaatgtcaatggaccgacctacagctccacgtttgt

SEQ ID NO: 8317 - DNA, 586 bp, Zea mays
  Predicted polypeptide sequence is orthologous to G447
gaggacgtaacacatcacatatggcgatggcgagcagatcctccgcgaccggaacggcggtgctgtgctttcttgtggtggtctccctcttcctggccccgtcgttgttcgttgccggaactgaagcagcagcggcctacggtgcaggcaggaagatgaagcaggcagctgcgggagctgtggcgacgaagcaggatggctacggctaccctgcaaccagttcaccagcgggatacccggcggtgccttgttgccctcatccacctgagggcggtcggggttaagagagagcccagctgcagctagacttcatgtgcatgatattgcagaattaccgtctctgaatacacatacagaaactagcatttatatacggatcatatattatctgtatcctcatgtcatgagagatgtgtatcactctcgctaaataattagcagctacgacgcgcctgcctgtcacactgtgctactattctatattcctgctccctctctattatatacatacacacacgtgtgtgtgaaataaagatcagcttggagcatcgcgcatcaaaaaaaaaaaaaaaaaaaaaaaaaaaaa

SEQ ID NO: 8318 - DNA, 1005 bp, Zea mays
  Predicted polypeptide sequence is orthologous to G447
tatttttttttttttttttttttttttttttttttaaatcgaaaaaaatctcaacccatattttgattttttttaggaaacccatgccggtttgagggccccattttcgaatacctctcatatggaatctaaaaaaagggccccccaacgagggggtgctgcctccacaaaacaggattcatcaaaaaaaaccggttgtttggcaacaattgttgctgctgtaggaaggcacccaccaatggggtaccccctgccaacggattaaaaaactggtggccctgttggagggccccaacaaaattcgacataattagttgggtgaaaggaaacaactgttgcaagtaggcaacaggggttgccccaactagctgagttaaagctgggacaatctggtgcaacaatttttgttgcagggatgtaggggcattggccacaacgagcgggctagatgaaagcagttgttgctgttgtaggtaggcggcagggttcaccatggctagttgactaagcgctggcagaaactgttgcagttgttgttgttgctggtttgcaactacgtttgctagagcaagtgggttggatgcaagcagctgctgttgcaagtaggcgacagggttcaccatggctaggtggctcagtgctggtaggaactgttgttgctgttgcgttgcgatggtttgtattgttagatgtgccaaggattgttgttgcaattgggcaattggttgttgtaagacgctcgccgcaatcgcttgttgtagcctataggcttgcacagctgggtgttcgaaggccattgaagtaactggtgggaggaactgtggagtaatggaactaggagcaagtgagcattgtggaataatggacgcatttgttgcgctcgcaaaaagcgcaagaagcgcaaggagggataatatcttggtagccattgttgttaggttgttgctagtgcgcttcgcttggtgtgtttctaaatgctcaaaatattataggtccccggccata

SEQ ID NO: 8319 - DNA, 996 bp, Zea mays
  Predicted polypeptide sequence is orthologous to G447
attttttttttttttttttttttttttttttatcgaaaaaaatctcaatcaatatattgattatttctaggaaacccccctcgggatgagggcccccttttcggggacctctcatatggaatctaaaaaaaggcccccccaacgatggggtgctgcctccacaaaacagggtttatcaaaaaaaactgggtgtatggcaacaattgttgctgctgtaggaaggcacccaccaatgggttaccccctggtaggggattaaaaaactggtggccctgttggagggaccccccaaaattccacataatcagttggttgaatggaaacacctgttgcaagtaggcaacagggtttgccccaactagctgagtcaaagctgggacaatctggtgcaacaattgttgttgcaggtatttaggggcattggccccaacgagcgggctagatgaaagcagttgttgctgttgtaggtaggcgacagggttcaccatggctagttgactgagcgctggcagaaactgttgcagctgttgttgtggctggtttgcaactacgtttgccagagcaagtgggtttgatgcaagcaactgctgttgcaagtaggcggcagggttcaccatggctaggtggctcagtgctggtaggaattgttgttgctgttgcgttgcgatggtttgtattgttagatgtgccaaggattgttgttgcaactgggaaattggttgttgtaagacgctcgccgcaattgcttgttgtagcctataggcttgcacagctgggtgttcgaagcccattgaagtaactggtgggaggaactgtgtaataatggaacttggagcaagtgagcattgtggaataatgaacgcatttgttgcagctcgcaaaaagcgcaagaagcgcaaggagggataatatcttggtagccattgttgttaggttgttgctaatgtgcttcgcttggtgtgtttctgaatgctcaaaatattataggtgatcccc

SEQ ID NO: 8320 - DNA, 1025 bp, Zea mays
  Predicted polypeptide sequence is orthologous to G447
gcacgacgttgaaacacaccaagcgaagcgcactagcaacgacctaacaacaatggctaccaagatattagccctccttgcgcttcttgcccttttagtgagcgcaacaaatgcgttcattattccacagtgctcacttgctcctagtgccattattccacagttcctcccaccagttacttcaatgggcttcgaacatccagccgtgcaagcctataggctacaactagtgcttgcggcgagcgccttacaacaaccaattgcccaattgcaacaacaatccttggcacatctaaccctacaaaccatcgcaacgcaacaacaacaacattttctgccatcactgagccacctagcagtggtgaaccctgtcgcctacttgcaacagcagctgcttgcatccaacccacttgctctggcgaacgtagctacataccagcaacaacaacagctgcaacagtttatgccagcgctcagtcaactagccatggtgaaccctgccgtctacctacaactgctttcatctagcccgctcgctgtgggcaatgcacctacgtacctacaacaacagttgctgcaacagattgtaccagctctaactcatcagctagctatggcaaaccctgctacctacttacaacagttgcttccattcaaccaattggctgtgtcgaactctgctgcgtacctacaacagcgacaacaattacttaatccattggcagtggctaacccattggtcgctaccttcctgcagcagcaacaattgctgccatacaaccagttctctttgatgaaccctgccttgcagcaacccatcgttggaggtgccatcttttagattacatatgagatgtactcgacaatggtgccctcataccggcatgtgtttcctagaaataatcaatatattgattgagatttatctcgatatatttctgaactatggtcatcatataaataactgaagacatcaaatcgtaattttaaactcatgcttggtcaaaacgtagataatacaatat

SEQ ID NO: 8321 - DNA, 904 bp, Zea mays
  misc_feature (678)..(678): n is a, c, g, or t
  misc_feature (687)..(687): n is a, c, g, or t
  misc_feature (710)..(710): n is a, c, g, or t
  misc_feature (778)..(778): n is a, c, g, or t
  misc_feature (857)..(857): n is a, c, g, or t
  Predicted polypeptide sequence is orthologous to G447
tcaaaaagcgagcgtccgcccacgcgttcgcactatccggaaacagcttcatcagcaacttcagtgtggctttcccaagcggactggctcctacatcatggtttccccatgtctaactttaatcagcagcagcagatgttcaaagctgcggctcctgagactgatattcagggtgcagatcccagtaataacacactctttggaataaacggtgatggtcagctgggctttcccatgggagcagatgatttcttatcaaatggaattgatgcttccaagtatcagggtcatatttcaacagatattgatggtaactacaggatctcaaaggatggccagcaagaaatatcgtcatccatggtttcacagtcgtttggtgcatcagatatggcattcaattcaattgactctggtatgaatgatggtttcgtgaacagaacctcttggcctcctgctcctcccttaaagaggatgaggacatttaccaaggtgtacaaacgtggagctgtaggtcggtccattgacattagtcagttcagtggatacgatgagttgaagcatgctctggctcgcatgtttagtatggaggggcaacttgaggaacggcagagaataggctggaaacttgtctacaaggatcatgaggatgacatcctacttcttggtgatgacccttgngaggaattntgtcactgtgtgaagtgcattangatcctgtcgcctcaggaagtgcagcagattagcttggatggggatctggggaaacacatttctcccnaacagcctgcagcagctccgacggcggcaatgcctggagagctcgctgcgatcagaactccggtaaaccatctactggntcatatgaccagtttgaatgacctaacttgccggtcatacatgcgga

SEQ ID NO: 8322 - DNA, 1116 bp, Zea mays
  Predicted polypeptide sequence is orthologous to G450, G456
cgcttcccccgctttctccttccttcctcctcctcccggctcccctcacccagccaccggccatgtcggtggagacggagcggagctccaccgagtcctccggggcttccgggctcgacttcgaggacaccgcgctcacgctcaccctccgcctcccgggctccgcgccttccgccgccgccgccgccgcggcttccctgtccctctcctcctcgtcgtcctccgccttccccgaccccgaccgcaagcgcgcctcctccgacgctgaccccggccgctcctccccgctcgccgcgtcctccgacgctgcaccggcacccaaggctcgtgtggtgggctggccgccggtgaggtcgtaccgcaagaacgcgctcgccgacgccgcgggctccagcaaggccgccaagttcgtcaaggtggccgtcgacggcgcgccctacctgcggaaggtggacctgcaggcgtacgccggctacgaccagctgctccgcgcgctccaggacaagttcttctcccacttcaccatcaggaagttcgccgacgacgagaggaagctggtggacgcggtgaacgggacggagtacgtacccacgtacgaggacaaggatggcgactggatgctcgtcggcgacgtcccctggaagatgttcgtggaaacctgccagcgccttcgtctgatgaaaggttcagaggccgtgaacttggcaccaagagccgcccgatgaggcacactccgttgggcgttggcacgcacgcacgcactggcgtcttgaaggaaagggggaactctgctggtcttgatgaggatcttcacgtgagataggaacgtgtgtacagttgtcgccttatggtattgagttgaggaaacttggaagttccattacttgtctgtagtctctactttatatagatgcgaagaagcttgagatacacattgcctacaatgtcttttgatgaataagaccagacagcaccgaaccgaactcgtcctccacacggttgctttgccatctcggtggttttgtggtggtggtggtggtcgtgcttcctataggtgtgaggctgatggcgtggctgccatttatacaatctttaatcgtgttttgttgagctttt

SEQ ID NO: 8323 - DNA, 1519 bp, Zea mays
  Predicted polypeptide sequence is orthologous to G450, G456
ccacgcgtccgtcccttcccaacccaacccattgcatttgcaagcccttttacattgcagagcgccagagcctcgctcgctctcggaacagagctaggcagctaacagacgaagaagaagcaagccaagcagaattgagagagaggcgaggacgtggcgacgacggcagccgcgatggcgacgacgacggacctggggttcgaggcgacggagctccgcctgggcctgcccggcgggggaggtggaggggagccggcgctgggcggcgaggggaggagctcttcctccgcctccggcaagaggggcttcgccgagaccatcgacctgaagctgaagctggagccagcggccgtcgtggaggcggaggaggaggaggaggaccacggcgttgctgttgcccttgagaaggaggaggaggccgggaagatgaagcggtccccgagccagagcagcgtcgccgccgccgccgtgctggctgaccccgccgagaagccgcgcgccgccaaggctcaggtggtgggatggccaccggtccggtcgttccggaagaacatcatgtccgtgcagtccgacaagggcgccggcaaagacgccgccgccgccaacggcgacaagtcctcggcggcggcaggcggcggtgccgcgttcgtgaaggtgagcttggacggcgcgccctacctgcgcaaagtggacctcaagatgtacaggagctaccagcagctgtccaaggcgctcgagaacatgttcagctccttcaccatcggaagctgtgggtctcaagggatgaacggcatgaacgagagcaagctggtggatctgctcaacggctccgagtacgtgccgacctacgaggacaaggacggggactggatgctcgtcggcgatgtgccgtgggagatgttcgtcgaatcatgcaagcgccttcggatcatgaaaggatcagaagccattggcctggcaccaagggccatggagaaatgcaagaacagaagctgaggagaagaccgacggacggaagcttgcatctcagcaccaccaggggtggatggatgcaagaagaacaaatctccatggcttttgaagctctgctcgtctctgtatcatactcgtcgtccctgccctccaggcctctgtatctccctgatcaatgaagtcgttttggtgtgtcaactgttctctccgtgcccagcttgtcagtgaaagagtcagtcagtgtctatcaagtctcatcttgtcctatacagaagagagaagccatgcatgaacatgtacctgtcctataacaatgtctttttttgctacctgttttttctctttctctctctttttttttggcacaagatgcaaaggcaccctgctcctgatcaaagggccttttgcatcataagctgtttgattataattaccatggtgtgtcagtggaacaaataactgttgcaaggtgttaaaaaaaagttgtattgtaatatgatcacctctcttccttgttgttttcaaaaaaaaaaaaaaaaaaaaaaaa

SEQ ID NO: 8324 - DNA, 642 bp, Zea mays
  Predicted polypeptide sequence is orthologous to G450, G456
aatgaacatgtattgcattgtagttgcagcataaactgcgcaaagacacatcggcaaatctccaagataaacgttccagaaaacctgttcgtataagtattgtcacaagaggtaacccggcccaggtacaccaccaaactattgccttgtttcttaacaccaagtgctcttaaaaaacatcagcaaaaaagaagcttatactccgattaagaacatgtagcatcagtactcgaatcatcccagtagcttgagccgtttgacagaccttgcaaaatcatcccacggcacatctccgagcagcatccagtccccctctccgtcctcgtaggtgaccaccacgtccatatggctgctggtggtggtggcggtgatggcggtggacttgctgctgatttccttgtcgtcttggctgccggtggtggtcgggaacatgcgggcgagcgtggcgaggagctcgtcgtatgaggcgtggagcgacaggtccaccttcctgccgatggcgtcgccttccttcttcaccttcacgtacttggcggagccgccgccgcacgccctgctgcgcgcggagctcaagggcggccacccgaccagcggcctcttggcgccgccgcttctcccgccgcacgacgagccgtcgtcgaa

SEQ ID NO: 8325 - DNA, 850 bp, Zea mays
  Predicted polypeptide sequence is orthologous to G450, G456
ctcctactccgctgcaaccccaaatctctccttcctcgcatacgcgcgcagcagaggagctgagaccaacgaagaagaagaacaaccgagcaagcacaagcttagctagcgtggaggtgcccaaggcgacgacggccgccgcgccaggctagccaaccagctgctcatcgctcctagctgcggagccgatggctggagccgacgtcgacgtcgggacggagctccgcctcggcctgccaggaggaggcgccgatgcggccaaggctgccaagaggggcttcgaggacaccatcgacctcaagctgaagctgcccaccgccggcatggaggaagctgccgctgccgccgccgccaagccggagccggccgccgagaaggccaagaggcccgccgaggcgccggccgctgatgccgagaagccacccgcacccaaggcacaagctgtgggttggccaccagtccggtcataccgcaggaacgtcatgaccgtccagtctgtgaagagcaagaaggaagaggagcctgagaagcagcagtccgctgccaacgccggcggcaacggctccgccttcgtgaaggtcagcatggacggcgcgccctacctgcgcaaggtggacctgaagatgtacaacagctacacggagctctccgttgctctgaagaagatgttcagcaccttcaccacatccggggaacacatgaatgagggaaaactagttgatccggtcagcggtgctgatgtggtcactacttacgaagacaaggatggcgactggatgctcgttggcgacgtcccgtgggagatgtttgtcgagtcatgcaggcgtcttgaggatcatgaagagctctg

SEQ ID NO: 8326 - DNA, 912 bp, Zea mays
  Predicted polypeptide sequence is orthologous to G450, G456
caccgcacgcacgcactcgcctccgacagcgaccgcgcaacgtccttctcccgcgccgcccggccggccggtccctgttccctctcctcccctcggagcagcaggagcaggagcagccgcgttcgtcctctgcgctgcgcggcccgccggcctgaccaagcaaagcttatcggccggagccggacgaacgaacgatgcagcaggacctcagaaactcagagagaagaaacccggaacaggcgcatccagtgatgtcggcgagctcgaccaactccgcggcttccccggccgtgtccggcctcgactacgacgacacggcgctcaccctcgcgctcccgggctcctccgccgagcccgccgccgatcgcaagcgcgcccacgccgaccacgacaagccgccatccccaaaggcgcgggccgtgggctggccgccggtccgcgcgtaccggcgcaacgcgctgcgcgacgaggccaggctcgtgaaggtggccgtggacggcgcgccgtacctgcggaaggtggacctcgcggcgcacgacgggtacgcggccctgctccgcgcgctccacggcatgttcgcctcctgcctcgttgccggagccggagccgacggggcggggcggatcgacaccgccgccgagtacatgcccacctacgaggacaaggacggcgactggatgctcgtcggagacgtccccttcaagatgttcgtggactcgtgcaagaggatccgcctcatgaagagctccgaggccgtcaacctatctccgaggacatcatcccggcagtgattgttgttggtgtggacgccatatgccctacgcggcttatctctccgaattagttcacagagtgtgtgctggagaggcttggctgctcaggtcctccatgcacacgtcatacaccgtacgt

SEQ ID NO: 8327 - DNA, 696 bp, Zea mays
  Predicted polypeptide sequence is orthologous to G450, G456
gattaacaaccctggaataaaatccccaagtaaattctgggaaacacgggaggggacatgacataacccccatccccctacccacggatatattattgcttctgggccatgaacgaattgaacaaaacaggtccccccccaactaataattaaaacgcgttatatttctagaaagaaaaaaaaaaacggcagcgcactggaaggggaccattcttctgaaacaatgggcaacatctttaacactgcatcttcttcagctcttgttcttgcacttatccttcgttcttggggcaaaacctatggcttcaaaactcttcatgatcctcaaacgcttgcatgaatcgacaaacatctcccccgggacgtcccccaccagcatccagtccccatccttgtcttcgtaagtagggaccacatcatcagcatccccggccggatcaaccaatcccccctccttcatgctgttcccagttgcggggacgaaggggcccaacatcttcttgagtgcagcggaaaggtccttgtagctgccctacctcttccggtccaccttgcgcagggagggcgcgccctccatgctgaccttcacgaaggcgttggcggcagcgggctgttgctgcttctcaggttcctcttccttcttgctcctcacggcctggacgacggtcatggcgttcctgcggtaccaccggactg

SEQ ID NO: 8328 - DNA, 1202 bp, Zea mays
  Predicted polypeptide sequence is orthologous to G451
cgcaagccaagcattctcacgctaagctgttctcttcttgcctcatccatcgtgcatctatattctcggcgcgagttacgtctttttcgtcgtccggccggcgagcattttgcttctgtgatcgatcggcgcgcgcgacgtacggccatggagatgatcgacgcagagctgcgtctgggtccgcccggcagcagcaacagagacgtcatcaacgtcgtgcagccttcgttggcggcggcgaaacggccgtcgtcgtcggtggtggagagcgaggcgtccgggacggacgaccatgaccatgacgacgccgcaccgacctccaaggtgcaggtggtggggtggccgccggtgagagtgtaccggaagaacgcgttccacgcggcggcggaggcgaggaggaccaggcggggcgagcagcagggaggaggaggcctgtacgtgaaggtgagcatggacggggcgccatacctccggaaggtggacctgcggacctacggcggctaccgtgagctgagggacgcgctggacgcgctcttcggctgcttctcctcctcggccgacggcggatgccagttcgccgtcgcctacgaggacaaggacggcgacctcatgctcgccggcgacgtgccatgggagatgttcatctgttcttgcaagaagctcaggatcatgagggggtccgaagcaagataaccaagcaacgaggatgcaaggacctgttgtatgcatatgcatggaggccggccggactcatgctgtcatgcatgagagtttgagagaggagaagaagacgacctactggaactgaaggcggttgggtatacctgcatggggagggagcccacgcatgcacgcgcgcgtcgtcgtgttctacggccagctagccaccagaccggctgccggcccatatgcacaccacggagatggaggtgatggttcaaggatcacggcggcgtacgcgcgcgtcatcagtcacgccgtcctgtcatcagatgagatggaggggtgatgcatgagggcagtgctagctgtggacggctggctggacgtgcagatcggagcgagattgtactgtgcacgcacataagctttgtacagtggcatgtgctggtcatctgtaattttgatttttttccccctccttttgtaagtgagcaagtttgaggaaaaaatgtatgaatgaagaaaaggagagggggatt

SEQ ID NO: 8329 - DNA, 1176 bp, Zea mays
  Predicted polypeptide sequence is orthologous to G451
cggctcatcatcacattcgcatacatctcttctagcacgcaaagatcgagctatagctagctctgcaacaagagagaaggaggactacccttcgccggccggcctaaggaggagtacgtacagaacttgggacatggaaaccgtcgtgggcgacctcatggcgaccgagctgaggcttggcctgccgggcaccgtcgacgactgcagccagccccaactggtgaaggccacgccgccgtcgacgccaaggggcaagaggcgcgccaccgccgatgccgtggaggaagccgccggcgccgaggaggcaagcaagcgtgacgccgagacggcgcccccggcagccaaggcgcccgtggtgggttggccgccggtgaggtcgtaccggaagagctgcttccagcaggccagcagcaagcaggcggcagcggccaaacaggaggcggcggcggcggcgcccggctgcacggcatcgtcagcagccgccacaaacaccaccagcagcagcagcgccgccgtcgtcgttggctccttcgtcaaagtgagcatggacggcgccccgtacctgaggaaggtggacctgaggatgtacaggggctacagggagctccgggaggccctggaggccttgttcgtctcctccagcagcgccaacaacctgtcggagttcgccgtcacctacgaggacaaggacggcgacctcatgctcgtcggagacgtgccgttcgagatgttcgctagcacctgcaagaagctgaggatcatgaagagatctgaagccacaggcctggggtcgtcgtcagcgaggcaacaatgaagatctcatctgatctatcgagaggacctgcatgcccggcaacaacacgtcgatcgatcgtcatggccttattaattgtttctttctttcttttcttttctgtttaattatttttgttgttctggttggcgccgccgtggatcggagggatccccaagccgaaggatgagcttggctggcgcatcgaagcgcatgcaacggatgtgtgcggctttggttctgtaataagacaaccaggggtccttttttcgatctgttattagcggcacaaaaggagctagatgcatgctgaggttgtttcagttcactctccatgtgtgtctgtacaaacgaaacaatacagttatattttgatcgttgaa

SEQ ID NO: 8330 - DNA, 715 bp, Zea mays
  Predicted polypeptide sequence is orthologous to G451
acgtgggtgcggctgcacccctagaatgaactaatatacatgggcccaggtcacttacaaaagaggaactcaaagttacagacaggctagcaagcacaagctagctatgaaactacagcatatgagctagcgtgcacagtaccaaaaaaaatcctaggtagtagcttttcaccgatgctactacttggctgaataatctccgatctgccatgcatgcacgtccagtcagccgtccacagcagcacgtccgcctgactgatggcgggagacacggcgtgacgcgtactacgccgccgtgatccttgaaccatcacctccatgcagccatgctccatctgatcatgtgcatgtccatggtgtgtatggtcgtatgagccggccgggctggccgtagaacacgacgacgcgcgcatgaatgcattggggcctccctgctgtgcaggtactataccctacgcatgcgcctccaattccattggatgaccgatataaagacctccctttttctctctctctctctccccctctgtcccatactcgcatgcatgagttggacggaccgtagctagctggactggacctccatgcaagccatgcatccaacatgttctttgcatcctcgatgcgttggttatcttgcttcggaccccctcatgatcctcagcttcttgcaggaacagatgaacatcctgagagagagagaacccaacacaat

SEQ ID NO: 8331 - DNA, 990 bp, Zea mays
  Predicted polypeptide sequence is orthologous to G451
gaattccattgtgttggcaaggaccaagacagagcacagcgcagctcgtcggcctctcgacgccggttgctgcaaccaccgcctttattgcccacgcgggccgtgcggaagaagcaagaagacacgccaatggaggtcgccgcagcatcggcagcgagctacggattcaaggccgacgacgacgttgacagcctcagggcgacggagctcaggcttggcctgccgggcacggaggagaaggaggaggccgaggagccccagcacaaggcggccccgccgccgccgtccacgcccagaggcaagaagcgcgacgtcgtcgccagcagcgggcccgaggacgcgcccaagaagcgcgactgcgagaccgacgccgacgccgacgccgcgccgccgccggccgccaaggctcagctggtgggatggccgccggtgaggtcgtacaggaagagctgcttccagcagcaggcggcggccaagaacaagccggcgacagcgttggcggaggaggccccggccgccggcgggctgttcgtgaaggtgagcatggacggcgccccctacctcaggaaggtggacctcaagatgtacaagggctaccgcgagctgcgggaggcgctggaggccatgttcctctgcttctccggcgccgccgacgcgcccgccgtcaacccctccgacttcgccgtcacctacgaggacaaggacggcgacctcatgctcgtcggcgacgtgcccttcggcatgttcatcagcacctgcaagaggctgaggatcatgaaggggtcagaagcgagagggctcggctcggccaagaacgactgatgatgagacgtctatcgcagccttgtgctgtgcgtgcgtgcatgcgccagcaaattcttttggtcttttggggtcttatttcttctccaagcgtccctgcatgggtgtgggcgtgtggtgttgagtattatgtaccctctcccctaacattgtctgccaacaatggag

SEQ ID NO: 8332 - DNA, 865 bp, Zea mays
  Predicted polypeptide sequence is orthologous to G451
cgagtcaagagcagagcagctaccaaacaagctctcctttcgcttccgatccatggagctcgacgccgacaacctgagcgccaccgagctccgcctcggcctgcctgggaccagcagcagcagcagcgacgactggcagaagaagccgtcgccctccgtcggggccaagcgcgctctggacgacggcaccaagagcgaggcctcggggaccagcccggccgccagagacctcgacttcgaccacgaccacgacaccgccgcgcctcccaaggcgcaagtggtcgggtggccgccggtgagggcgtacaggaagaacaccttccaggcggcggcggcggccaagaaggtcgagcagaagcagaagcagcagcagcagggaggcctgtacgtgaaggtgagcatggacggcgcgccgtacctcaggaaggtggacctccggatgtacaaggggtacagggagctcagggaggctctggacgcgctcttcaccaactccttctccgcggcggcagagggcggcggcgaccaccaccagcacgccatcgcctacgaagacaaggacggcgacctcatgctcgccggagacgtgccctgggagtaagtacaccgtcgggttcggatcagcaagcatgctgctccgttctgtggatctgaggatacgtttggtgaacagaagcctgattaattgtgattcttaatttcaccccctttgcagtatgttcatctcttcgtgcaagaagctcaggataatgaagggctctgcctctgaggccaggtgatcgctgatccatacataaacagaggctacagacacgccacctgggaacgcggatccaagagcacacccggatcgtacttgacgagg

SEQ ID NO: 8333 - DNA, 881 bp, Zea mays
  Predicted polypeptide sequence is orthologous to G451
ccagctcatcacatccatctcattctactactgcctcagagaccaagctgctgcaaccggagaaggagatctattctacaaagtgaagtacttagcttgggacatggaaaccgtcgtgggagacctcatggcgaccgagctgaggcttggcctgccgggcaccgtggacgactgcagccagcaccagcagcagacccagctgaaggtggccgcgccgccgtccaaccctactaggggcaagaagcgccccgccgccgaggaggaggaggcaaacaagcgcacgcggaggcagcacccccggcggccaaggcgcccgtggtcggatggccaccggtgaggtcgtaccggaagagctgcttccagcaggcaaagcagcaggccgtcagcagcagcagcaaggcggccgacaaagaggatgctgcggcgccggcgcccagctgcacggcgtccgcagccgcctcaaacgccaccgccagcgccggggccggctcattcgtcaaggtgagcatggacggcgccccgtacctgcggaagctcgacctgaggatgtacaaggggtaccgggagctccgggaggccctggaggccatgttcgtctcctccggcagcgccaacaacaacaacaacctgtcggagttcgccgtcacctaccaggacaaggacggcgacctcatgctcgtcggagacgtgccgttcgagatgttcgctagcacctgcaggaagctgaggatcatgaagagatctgaagccacaggcctgggatcggcgagacaatgaagaaggtctgacgacgaccgagggcccgacaacgttcatgtcgatctcttctttttttttctttttgccccattattttattttgttcttcttgtccgagagac

SEQ ID NO: 8334 - DNA, 886 bp, Zea mays
  Predicted polypeptide sequence is orthologous to G464
ccaagcaacagcagcagcagcatccgccgtcgtgccggatcctcacggcccgggacctkcagccgaggtccctgtcaccggatycctccgtgtcctctkcctcccccgcggcaggtgcaggtaccgcggcgccaagcaagagggccaaggcggatgcggcgcccaactcgccagggacggtcgcgtytggccacccacagagctttggagtggtgggatgsccacccataagaactktcaggatgaacagcctattttaaccagsccaaagagaatgcatcgggagctgcsccaagaagcccatcgtcgaacctgacatgcaggaagacaaggaggagagcaagaaaggccgkaccktcggttgggtgaaggtgaacatggaaggagatatcattggaaggaaggtcgatctcaatgcccwtygttyttacaagacccttgcctcagcacttgagctcatgttcatgaagccgtccattggtctttgcacttctagcagttcaaagaytytaaagctattagacagctcatcggagtatcagytcacctatgaggacagggacggggactggatgcttgttggagatgttccctgggagatgtttgtaggttcagtgaagaggytcaagatcatgagaacctcagacgccaaaggtctcggtccacgattccaagggtctcacagacccacagcdgcttgcacgagaggcaggacgtgaaaccaccgatgtgcgtttggtgctaacaccgctggtgaagcttgaactgtatttgatatcacgtaacagtaacagcagcccatatcgctggcatagttgtgagattacggggctgtttggtttactgtctaaggcgccacaacatggctaacttttatgtctaagtt

SEQ ID NO: 8335 - DNA, 597 bp, Zea mays
  Predicted polypeptide sequence is orthologous to G464
cacacacactgacacacccacacactagttgtatgtgctagagctgcagttaccttggcatcagaggccatgaaactgaaacaggagcaagcagacgacgactgcagcaagatgcagggaggtcgtggcctgatgagcaaccttgagctcaggctgggcatgtcttcagacaatggcgacgccagctgcggcggtgatccgtggcttggcgttggagtgcacccctggagccttgcctccagacaagcagagaaggtagcccaggagcaagaccaccaccagcgttctccgccgcagccggtgggatggccaccggtgggcgcgttccgcaggagccacctgcaggtttcttcgaagaccgtggaggaaccggcgggcaaggtgaagtccggcggcgagaggctggcgccggcggccaccatgttcgtgaaggtcaacatggagggctgcgccgtcgggaggaaggtggacctgctggcgcaccgcgggtacgcgtcgctgtcgcgcgcgctgcaggccatgttccgtggcttcctgtcagatggtgagtggaggatcgttggcagtgaggacgacgccgacgacgacgagcagcag

SEQ ID NO: 8336 - DNA, 371 bp, Zea mays
  Predicted polypeptide sequence is orthologous to G464
ggacggagagggggactggatgctgttcggagatgtgccgtgggatgattttgcaaggtccgtcaaccggctcaagctactgggatgattggagtactgatactacatgttcttaattggagtataagcttcttttttgctgatgttttttaagagcacttggtgttaagaatcaaggcaatagtttggtggtgtacctggaccgggttacctcttgtgacaatacttatacgaacaggttttctggtcttttgcatgtgagaacgtttatcttggagatttgccgatgtgtttttgcgcagtttatgctgcaactacaatacaatacatgttcattaatccaaaaaaaaaaaaaaaaaaaaaaaaaaaaa

SEQ ID NO: 8337 - DNA, 693 bp, Zea mays
  Predicted polypeptide sequence is orthologous to G464
ggtgatctgtacggatatcatctatcaagagagcttactaggagtctgacactaatctcttatggatgagatgaagagtacaaatacttctattgcgcatgaggttgaggtgcatcctggattctcaccatcgaggtttgtgaaggtttttatgcaaggtgaagttgttgggaggaagataaatctggccactcaccagaactatgcctcgttgtccttcgctttaaaacgattaggcaacaactattctatgccatcttgcgagcttaatgggttagtaaacaatgaagttgatggggcatcagatgacaacaacttcattcttttctatgataccatggatggtgaccgtttattcgttggggaagtcccatgggagattttcgtcatttctgtcaagaggatctacattgtttgtgttccgcaggaacaagagaacgttgcagacaacggagaggaagaagacagagagaatggtgaagacaatgctgctgtttctgctactgccctagatggagatgatatcccagctaatgacgacgacgacgacgttgttgatgacggagatgctacggccactactcctgctgatggaggtttctgaggagtcgtagccaactcaaatatgaagaaaacaaataaataaacagcatgcaagcatggctgtgtttggagcttggttgctgcttcata

SEQ ID NO: 8338 - DNA, 1456 bp, Zea mays
  misc_feature (9)..(9): n is a, c, g, or t
  misc_feature (1393)..(1393): n is a, c, g, or t
  misc_feature (1420)..(1420): n is a, c, g, or t
  misc_feature (1441)..(1441): n is a, c, g, or t
  misc_feature (1450)..(1450): n is a, c, g, or t
  Predicted polypeptide sequence is orthologous to G470
ggttcttgnaacagcatggcatgcagtgaacactgatagtatgttcactgtctactacaagccaaggactagtccagctgaatttgtggtttcgcgagataggtactatgaatcactgaaacgaaattattcaatagggatgagatttaagatgagatttgaaggtgaagaggcagcagagcaaagattcactggcacaatagttggaataggtgcttctgatccatctggttgggctgactcaaaatggcgttcccttaaggtgagatgggatgaaccttcttctatttctcgtcctgaaagagtttctccttggcaaatagaaccttctgttagcccatgtcatgtgaaccctcttccagttagattcaagaggtctcgatcaagcgttaatgctttgccatctgacgtgtctactgtaaccagagaagtcacttctaaagtcatggcagactcgcagcaaaatagtctcacaagagccttgcacaatcaaggaaggacacaattgacagttcgataccatgataacagtgatgtgaagactactcaggatcttaccgtgtggtcttcaggaactgagcaacagagaaacaatattgctgcccagacaaagctatgtctggagggttggacgccaactagaagtcctgaaggctacaatcagatattctcggcatttaaaccactgaaagatatacataacccacttggtccttttcctagtcaaatatctgggactcactcaaatagctgggacacagctgatgctcgttatccagtccaacaagctaattacagcatgttacctggcacatggtctttgaggcctcataacagtggttttaggatgaatcaacaaaattatctagtgatgcctgaaggtgcaaattttacggggaaatcagctttcacttcacttcaggaccatggcactgataaatgctccacaggctgctttggtcatattgagtcaagttcccacacagaccatgcatcctcaagtttgatcaggccccagcctttggtccttggaaatggtgttcagaaaagcaaaggcacttcatttaaattatttgggattccccttggcagcccagaaaaatctgaacctctggtatccccaccaagtgtcgcatatgacgggaaacttcaaacttctccatcagaaaaagggaatcagctagacgtagttgaagtggataattgttctcatccttctaagactgtgaagccacttgatggtcctcagtcagattctattacagagaataatcagccttctccagaagctacccttaatatccagaacaaagtgcaaagtagttccaccagaagctgcaagaaggttcatccatatgttggcaccttttttcccttggctagttagtccatnccttggatacataaatggcttaactanggcccaaaccttccaattggnattacttcncccaag

SEQ ID NO: 8339 - DNA, 1671 bp, Zea mays
  Predicted polypeptide sequence is orthologous to G470
gcacgagatctgttctcacaaaagaaggtgcaaccaaggtcgaaatcgattcagctcaaacacaacaccaaaattcggtcttgcaaggtcaggagcagatgaccttgaggaacaacctgactgaaagcgctgattctgattccactgttcagaagccgatgatgtggtccccatcactcaatgggaaagcccacactcattttcagcagagacctgctatggataattggatgccattgggaaggcgtgaaaatgacttcaaggacacccgttctgccttcaaggatgcccgcaccgcctctcaatcatttggagatacacagggtttttttgtgcaagcttatgatgacaatcatcaccgtctctctttcaaaaatcagggttcaactcatcgcttcgcagatccgtacttctatatgcctcaacaatcgtcagtgacggttgaatcaagcacaaggacacaaacagcaaacaatgacttgtgtttctggggtgaccagaatgctatgtacggcaatccaagtgaccaacaacagggtttcaactttggacaaaacccatcaagttggttgaaccagccatttccccaggttgaacagccacgagtggtcaggcctcatgcaacggttgctccatttgatctggagaagactagagaaggaagtggcttcaagatttttgggttccaagttgatacaaccagtccatctcctgtccaattgagctctccattgcccgctatccaggagcatgtgttacaaactcgaccatcggcaccggtgaatgaattgcaacctgtgcaaattgagtgcttgcctgagggatctgtaagcacagctggaactgcaacggagaacattcagcaagccccgcagagttcaaaagatatccaaagcaagtcccaggggtgcttcaacaaggagctgtacaaaggttcataagcaaggagtcgcacttggcaggtcggtggacctctctaaattcaccgactacggcgaactccaagcagagctggacaagatgtttgacttcgagggtgaattggtatctggcagccaaaactggcagatcgtctataccgacgacgagggcgatatgatgcttgtgggagacgacccgtgggaagagttctgcagcatagtgcgcaagatctacatctacacgaaggaggaggtccagaagatgaactcgaaatcagctgcgccaaggaaggaggaatctccggcagcgggcggcggaggaggttgcgccgccgccacaaacgagtagtatggtggtttgctcttggtggcaagttgaggccaaggttttactactgctattgttattgctgatttgctctccccgccttccggtgtaaatatctgtgtgtacccagtcccggccttgtgctagtaagtagcaagcagtgttaccttttggtattttaaccagcagctaagttcgcggcattttagtccctgtaagcggtaagcagctctgtagcgtgagatagatggccaagcgccggtacgtacgtgtagtgtctggtcttctcactgagtgtactataaagagttaatataggagctgaccctgtgaacccgcgtgatggatgcatatgcttagtgcaaacctgcattttgtctcaaaaaaaaaaaaaaaaaaactcgagactagttctcctcgtgc

SEQ ID NO: 8340 - DNA, 1560 bp, Zea mays
  Predicted polypeptide sequence is orthologous to G470
ccacgcgtccgcggacgcgtgggggcatgcagaggaagctgggttcagatatttggatgcgaatgaacaggcctgatggttacagtgaaatgttatcgggatatcaaccacctaatgaagatgtacggaattcgcagggtttctgttctttacctgatcagattgccgctggacgccctaatttctggcacactgtaaatgctcattatcaagaccagcaaggcaatcacaatctgttccctggttcatggtccatgatgccttcaagtactggctttgggatgaacagacagagctatccaatgatccaggaagtcggtgggatgtctcagagttgtacaaacaccaagtttgggaatggagtttatgctgcactacctggccgaggcattgatcgatacccatctggatggtttgggcacacgacacccggtggtcgcgtggacgatgcccagccacgcgtgattaagcctcaacctttggtccttgctcacggcgaagctctgaaaatgaagggcaactcgtgcaagctttttggaatccatctcgacagcccagccaaatctgaacctttgaagtctccgccaagcgttgccacaccggcagctgagaagtggatggcagacggaatcgacgcagacaaaagccctgagccgcacaagacgccaaagcaactcggtgctacacaggtggatcctgtcccagagagatgcccacaagcttcaaggggcacacagtgcaaatcacaaggcgggtcgactaggagctgcaagaaggtccacaagcaaggaatggcgctgggcaggtccgtggaccttaccaagttcaacggctacacggagctggtggcggagctggacgagatgttcgacttcaacggcgagctgaaaggctgtagcaaggagtggatggtcgtgtacaccgactacgaaggcgacatgatgctggtcggggacgacccctggaatgagttctgcagcatggtgcacaagatcttcgtgtacacgagggaggaggtccagcgcatgaacccgggcgccctgaactcgaggccggaggacagcggcctcgccaattcgacggagaggggctccgcatctactgctgctgctagagaggcacccggctaccagtccgcctcgtcgcttaactccgacaactgctgatgccttggcagctagctggtcgtcccaagtagtagagaacaaggcaaatgtatccatagatctccttgtagcggagcttaatgcctttttttcccctttctaatatgcattggatgagcccgtagcgcaccgtagtagtatctaaagctggtgttctgagttggttggaccttcctgcagttttggtttctccttctgatgtggcaagttttagctggtcgcacctacctaatgtatgcttagcaaacgaagtcccactaagcgctgtacataactgcccctccctgcatcaactctaatatatcatctgcttaatcgtcaaaaaaaaaaaaaaaaaaaaaaaaaaaaaaaaaaaaaaaaaaaaaaaaaaaaaaagggcggcccggacgcgtgg

SEQ ID NO: 8341 - DNA, 2029 bp, Zea mays
  Predicted polypeptide sequence is orthologous to G470
gcacgaggactgcatggcacgctattaacacaaagtccatgttcactgtctactacaaacctaggacgagcccttcagagttcatcataccatatgatcaatatatggagtcagtaaaaaacaattattctattgggatgagattcaggatgaggtttgaaggggaagaggcccccgagcagaggtttactggtacaatagttggctgtgaaaatcttgacccactatggcctgattccagttggagatacttgaaggtgcgctgggatgagccttctactatcccgcggccagataaggtctctccctggaagatagagcctgcttcatcacctcctgttaatcctctccctctttctagaggaaaaagacctagacaaaatgcgcctccaccttcccctgaatcatctgttctcacaaaagaaggtgcgaccaagattgatactgattctgctcaaacaccacatcaaaattcggtcttgcaaagtcaagagcagatgagctttaggaacaacctgactgaaagcaccgactctgattccactgttcagaagcagatgatgtggtccccatcacccaatgggaaagttcacactaattttcagccgagacctgctatggataactggatgccattgggaaggcgtgaaactgacttcaaggacacccgttctgccttcaaggatgcccgcaccgcttctcaatcgtttggagatacacaggggttctttatgcaagcttatgatgacagtcgtcaccgtctttctttcaacaatcagtttcaagatcagggttcagctcatcgctttgcagatccatacttctatatgcctcaacaaccttctctgacggttgaatcaggcacaaggacgcaaacagcgaacaatgacttgcgtttttggagtgagcggaattcgatgtatggtaatccaagtgaccaacagcagggtttcagctttgggcaaaacacatcaagttggttgaaccagccacttccccaggttgaacagtcacgagtggtcaggccgcatgcaacggttgctccatttgatttagagaagactagagaaggcagtgggttcaaaatatttggtttccaagttgatacaaccaatccatcacctgtccaattgagctctccattgtctgctatccgagagcatgtggtacaaactcgaccatcggcaccagtgaatgaattgcaacctgtgcaaattgagtgcttgcctgaggtgtccgtaagcacagctggaactgcagctgagaacattcagcaagtccagcaaagttcgaaagatattcaaagcaagtcccagggcgcttcaacaaggagctgtacaaaggttcataagcaaggagttgcgcttggccggtccgtggacctctctaaattcaccgactacggtgagctcaaagcggaactagacaagatgtttgagttcgagggcgaattggtatctgctaaccggaactggcagatcgtttataccgacaacgagggtgatatgatgcttgtcggagatgacccgtgggaggagttctgcaacatagtgcgcaagatctacatctacacgaaggaggaggtccagaagatgaactcgaaatcatccgtgccgaggaaggaggaacccccagcagcaggcgaaggctgcgccgccgccgccgcaaacgagtaggatgtctgcctgcactgcagcaagcagttttagatgactaggtcgtgtggaggaagccgacgatgatgcatgcgtgatgaacccgttccttgtgcaggaggtggtgccagcccgggtcccagggaagtaaaaactcctgagatcttttgcttgtccgttgcagccccatcccccgtccgtttgggttttagttgggaacgtagaaactactgtctccgcctgccactccgaagctcgctgttggtagcaagtttttattgctagtattattgttattgctgatttgctcccctctgcctttgcgatgtaaatatttgtggtacccagcccagccccagccccagccccagctt

SEQ ID NO: 8342 - DNA, 847 bp, Zea mays
  Predicted polypeptide sequence is orthologous to G470
gcagacgttcaagtgccagttgcgcggcggagatcgcgacgaattccttacggcagggaggtggtcgggggaactgggaagtgcatgtgagatccgatggcggcggctgcctgcgccggtgcggaagcaggacgcggatgcggagggaaggacgcgctgttcgtcgagctgtggaaggcctgcgcggggccgctgtcctgcgtgccgccgcttggggagaaggtctactacctcccgcagggccacatcgagcaggtggaggcatcgacgaaccagcttgccgagcagcagggcacgcccctctacaacctgccatggaagattccctgcaagctcatgaacatcgaactgaaggttgagccggatactgatgaggtgtacgcccagctcaccctgctccctgataagaagcaagatgagaatacatctacaacagtggaggaagaggaggtggtggtgcctcctgcgctaccagccacaaatgagggtcctcacatccattccttctgcaagacattgactgcctcagacacaagcacacatggtggtttctcagtgttgcgccggcatgcagatgagtgcctcccaccattggatatgagtcaacatcccccaaatcaagaattggtggccaaggacctgcatggggccgagtggcggttccgtcacatctttcgaggtcagccacggagacatctcctgcaaagtggttggagtgtttttgtgagcgccaagcgtcttgtcgcgggggatgccttcatatttctcagaggtgagaatggggagctccgtgttggagttcggcgtgcactgaggcaccaaaccactatcccatcttcagtcatat

SEQ ID NO: 8343 - DNA, 867 bp, Zea mays
  Predicted polypeptide sequence is orthologous to G470
cgccttcgctccctcccaacccccttcctcctccgtctagggtttcccgccgccgcctgatccgagtcagatgccgcccgcaacagccatggcgccgccgtcccagcccccgtctaactcaggggatccgctgtacccggagctctggcgcgcctgcgccggcccgctcgtcaccgtcccccgcgtcggcgacctcgtcttctacttcccccaggggcacatcgagcaggtggaggcgtccatgaaccaggtcgccgggaaccagatgcgcctctacgatctgccccccaagctgctctgccgcgtgctcaacgtcgagctcaaggcggagacggacaccgacgaggtctacgcgcagatcatgctcatgccggagcccgagcaaaccgatgtgccggctgagaagccgagttctgcacctgctgcgtcgccgaggccagcagtcaggtccttctgcaagacgctcaccgcctcggacaccagcacacacggtggcttctctgtgctgcgccgacacgctgacgagtgcctccctcccctggatatgacccagtcgcctcccacacaggagctggtggcgaaggatctgcatggcatggagtggcgcttccgccacatctttagagggcagccaaggaggcatctccttcagagtggttggagtgtttttgttagttctaaaaggcttgttgctggtgatgccttcattttcctcagaggagaaaatggtgaacttcgagttggtgttaggcgggcaatgaggcaaatgtctaatgtaccttcttcagtcatatctaggcaaagcatgcacctcggagtccttgcgactgcatggcacgccattaacacgaagtccatgttcactgt

SEQ ID NO: 8344 - DNA, 758 bp, Zea mays
  Predicted polypeptide sequence is orthologous to G470
tttttttttttttatctaaaattttgtttgaaaatgtataaatcacgatggtcatagaaggcatttgtttttgtgcatagtatgccaaaatataaagtacatcatacacaaccacatcaaattctcccacgggtcatctcccacaagcatcatatcaccctcgttgtcggtataaacaatctgccagttttggtttgcagatactaattcaccctcgaattcaaacatcatgtctagttccgctttcaattcaccttagtcagtgcatctagagagatccatagatcggtcaagcgcaactccttgcttatgaacctgaagaccattcaaagcagaagtgtaaattgaagaggataggatcataggactacacaagatattatataggtccggtcgcaaagcaattatgcaatattatttcctttattttgctgaactttaattagcatggtattgactagaatagttggaaagtgtaaaagaggtggagtagtgctttcgttggcgaccaaacctgtcctaacagtgaagctctttagctgtaagaaatgataatagcgaactcctaataaacacacgatacgagctaacacacgggctttcaacaatatatgaaatggtcggctactaatgaaataattttacctactaatgaattgttatatatgcatgttcttcataagtgatttaataaactgatggtactttattgacataaaatcatttagcacttgacagatatcaaggtctactatcca

SEQ ID NO: 8345 - DNA, 2624 bp, Zea mays
  Predicted polypeptide sequence is orthologous to G470
gcacgccgtaatcagggcacgcccctctacaacctgccatggaagctttactgcaagctcatgaacatggagctgaaggctgagccggatactgatgaggtgtacgcccaactcaccctgctccctgataagaagcaagatgagaatacatctgcaagagtggagaatgaggaggcagaggaggaggtggtgcctcatgtgccaccagccacaagtgaggggcttcgcatccattccttctgcaagacattgactgcctcagacacaagcacacatggtggtttctcagtgttgcgccggcatgcagatgagtgcctcccaccactggatatgagtcaacatcccccaaatcaagaattggtggccaaggacctgcatggggttgagtggcggttccgtcacatctttcgaggtcagccacggagacacctccttcagagtggttggagtgtttttgttagtgccaagcgtcttgttgcgggggatgcattcatatttctcagaggtgagaatggggagttacgtgttggagttcggcgtgcactgaggcaccaaaccactatcccatcttcagtcatatcaagccacagtatgcatcttggtgttcttgcaacagcatggcatgcagtgaacactgggagtatgttcactgtctactacaaaccaaggactagtccagctgaatttgtggtttcacgagctaggtactgtgaatcactgaaacgaaattattcaatagggatgaggtttaggatgagatttgaaggtgaagaagcggcagagcaaagattcactggcacaatagttggaatatgtgtttctgatccatctggctgggctgactcgaaatggcgttcccttaaggtgcgatgggatgaagcttcttctgttcctcgtcctgaaagagtttctccttggcaaatagaacctgctgttagcccatctcctgtgaaccctcttccagtcagattcaagaggtctcgttcaagtgttaacgcctcaccatctgatgtgtctactgtaaacagagaagttgcttctaaagtcatggtagagtcgcaacagaataatctcccaagggccttgcacaatcaaggaaggacacaattgacaggtcgataccgtgatagcactgatgtgaagactgctcaggatcttaccatgtggtcttcaggaactgagcaacagagaaacaatattgctgcccagacaaaacgatgtctggagggttggacgcaatctagaactcccgaaggttacaatcaactgttctcggcatttcaaccactgaaggggaaggatgcacaaaatccacttcgtccttttcctaataaaatattctgggactcgctcaagtacctgggtcacagccgatgccccgttatccagctcaaaaacccaatcacaacatgttacatggcacattgtcttttatgcctcatagcagtggttttaggatgattcaacagaataatctagtgacacctgaagctgcaaattttactgggaaatcagctttcacttcacttcagggccatgtcactgatcagtgctccacaggctggtttggacctattgagtcaaattcccacacagaccatgcatcgtcaagtttgatcaggtcccagcctttggttattggaaatgatgttcagaaaaccaaaggcacttcattcaaactatttgggattcctcttggcagtccagaaaaatctgaacctctggtatccccaccaagtgtcgcatatgacgggaaacttcaaacttctccaacagacaacaatgagccttgttcagaagctacccagaatatccagaacaaagtgcaaagtagttcaaccagaagctgcaagaaggtccataagcaaggcagcgccctcgggagatcgatcgatctaacaaagttcgcttgctacgatgagctgattgccgaactagaccagatgtttgacttcgatggtgagctgaagagtccttgcaggaactggttggtcgtctacactgacaacgaaggcgacatgatgctggtcggcgacgacccctggaatgagttctgtgacatggtccacaagatcttcatctacacaagggaggaagtggagaggatgaacccaggcgccctaaactcgaggctcgaagactgcctgtctgactcgctgggaagagggctggcttccaaagagccccggagcggcccctcgacttcggctgtcgattctgagaaccgcgctaacttgtccagtcagtgagcccttttgaaagtggtgaagcagacaaaaggccacgtgtcagagtgaccggaagaacgagaaaggggtgtgtttcagtggtgtgtagtaggtaggtaattttgtgtgtatgcctccgggtaaaagccccgcggtacccagtttgtagatggtgcttctcctggtgctagtttcccgtcgtaagctggatttttttggggggtgtgtgccctgctctgtgtgctgacccgcctgggggtaagttgtagcagagcaggagaaagcaggcaagaaaccgctggtgcgcctgcttggccaatccttttccttgcggagcgctgtaaatagccttggatctgaagcgtagtaatgtattgtcatggtactcgaaaaaaa

SEQ ID NO: 8346 - DNA, 820 bp, Zea mays
  Predicted polypeptide sequence is orthologous to G475
ggtgccaggtggaggggtgccacctgtcgctggcggacgccaaggagtaccaccggcggcacaaggtgtgcgaggcgcactccaaggcgccccgggtcgtcgtcctcggcgccgagcagcgcttctgccagcagtgcagccggttccacgcgatctcggagttcgacgacgcgaagcggagctgccgacggcgtctggccgggcacaacgagcggcggcggaagagcaacgccagcgaggccatggcaagaggcgtcgcgcacccacacggagtgacggctttcggccacggcggcttcctgccctcgcgcggcctcgtccccgcagggtcgtccccggcggcggctggtgctctctctcttctgtcatcggccagaggcagcgtggcgggcgccagcgggccctggctggtcacggcggcgcgggaggacatcccggcgcgctccagcgcggcgctcgacgaccttatcgccgagaaccgcgccgccgcgctcctcgcgcggcagtacttcgtctccgaccgctcgccggcgcccagacgggatttcgtcgcctcttcgacggcgggttgctccctccagcagcagcagcacccgcccgaccacgaccacacagccggctggcacccgcacccccacccctacagtggcggtggcggtggcagctgtggtggtcggtaccagtaccaccacgtggcgccgccgagcgcgtggcacgcgacgacgctggaccttatgcagccgacagcaagcaccaccgccgctcccgccaccgccggcgcagcgttgtggccagcagtgccggagagggcgggcgcgag

SEQ ID NO: 8347 - DNA, 566 bp, Zea mays
  Predicted polypeptide sequence is orthologous to G477
ttttttttttttttttataaggacgataatcaataattcaaggaagttatgcagcaagggtttaaccattcaactcctactacctaatgcaacatataagtgataaaagatttaaaacaataaggaggtggcaaatgcactggggcttgccttgatgaggaggagagccagactcttctactaggatattgcaattgcagtaaaccctgctagggcaccttctgaaagaccttccggagcacgttcagttggagaaacctcagattgaggagctgactcctcttccacttccacttcaacttcttcttctaagtgctctgtgcacgatggccgacccctgcaggtgttcctagggtcttcgtcgaggggcttcacgacgcgcatcatggggaagctctgggggacgaccgtcgagcggttgtgcagagcaacactcgtgcatcgcagggtgtgctcgcacgggttgcagtggccgcgcggccatggctagttgtgcgtgtagggagagagatgttggagtatgcttggaactgtcatctccataagcaggggaaggatcgtagtgg

SEQ ID NO: 8348 - DNA, 456 bp, Zea mays
  Predicted polypeptide sequence is orthologous to G477
actccaacatctctctccctacacgcacaactagccatggccgcgcgggcactgcaacccgtgcgagcacaccctgcgatgcacgagtgttgctctgcacaaccgctcgacggtcgtcccccagagcttccccatgatgcgcgtcgtgaagcccctcgacgaagaccctaggaacacctgcaggggtcggccatcgtgcacaggttgtcagcattgcaaccactgctcaggagaagatgaagtcgtggaaggagactttcaggagttccaagactacgacgagttctaggcgtgggttagcggcaacccccagtcggctgcctgtgaaggccgcgtttatctacgtttcgtttttgcactttgattatttgtaaagactatgtggatgtctcagacttatgatgtaatcgactattattccctttttagtactattaaaaaaaaaaaaaaaaaaaa

SEQ ID NO: 8349 - DNA, 1646 bp, Zea mays
  Predicted polypeptide sequence is orthologous to G478
atagctcgatcgctctctgtgtccgctcctcctgcctcctgcacacacatacactcagagagcatagtagcagtagccagtaggatgatgatgaacaccaacgcgatgtcgccgacagcaagtaccgacgccgacttctcgttcggccccttgcagccctacgtcggcttcgacgtcgccggcatgggcatgcccagcgtcgtcgtcgagaggtcgtcgtcgctactgcagcacaacaccagcagcagcagccacaacaacaacctagggctatacgacagtttcgacttcgccgccgccgcagggttaccgttccaagaatctggtctcctgcccccggcgagcctgccgctggcgccgtcgccgccaagcatggcggccatggcaatgccaccgtcgtcgctgctgctgacgctcccaggcgtgcctgcggcggcggatgtcgtctataacccctttggtggcggcggcgcgggagggttcctgaagcgggaggacggcggccccctcgtggacgctgctggaggcggcgggaggatcgggctgaacctcgggcgccgcacctacttctcccccgcggacgtactcgccgtggaccggctgctgacgcggtcgcggctggcgggtggcggcgtgggcgtgggcctgggtatgggcctcggcatgggcgtgctggggctcggcgccgcccaccaccagcagccgccgccgcggtgccaggccgagggctgcaaggccgacctctccgccgccaagcactaccaccgccgccacaaggtctgcgagtaccacgccaaggccagcgccgtcgccgccgccggcaagcagcagcgtttctgccagcagtgcagcaggtttcatgtgcttgctgagtttgatgaggccaagaggagctgccggaagcggctcaccgagcacaaccgccgccgccggaagccgagcagcgcacaggacgaggactcgtcaccgccaccacccaagaaactggatacttgcataactaatactgcctcttacaatgatgatctcaagagcgcgagcaacacggcagctgcggccatctcgccgaacggcagcggcgtcagctgcctagacgtcatggacaacggccagacgagcagcgcagcggcgccgacggctctgtctttggccgccccgccgccgccgccgctgcacgagaaggacggcagtctcgactcgatgctgatgcagcgggtcctgcagggccgacgggaggacgacgacgacgaacagcgtcgccacttcatcacctcgcttgtgatgcagacgacccagcagcagcacagcggcggcggcggcgccggcaacatcttgtcgtgctcgtcggtatcagatcagcacaacggcggcggctgcaacggtttctttgaggtggacttcatctagtgtataatcagatgcatgacgtgaggaaagcaagcaaaaacaaagctgggttggtttcactgtagagcggctagtagccttttcttttttactgttgttcttagtacgacttgagctagctagctagtggttggacttcttttaccagatggaaatgcttgtgtacgtagtatgtgtattcctttttcctattgcgaaaaatgtaaattattattacgtgtaaaaaaaaaaaaaaaaaa

SEQ ID NO: 8350 - DNA, 1694 bp, Zea mays
  Predicted polypeptide sequence is orthologous to G478
caggtccctcctcctgcacacacccacagtgcacatatatagtaggagaatgatgatgatgaacaccagcgccgccatgtcgccagcaagtaccgacgtcgtcgtcgtcgacgacttctccctcggcgtcggcgtcggcgccatgcatcagccgtacgtcgtcggcttcgacgccgacgccggcatgggcatcatcatgcccagcgtcgtcgtcgataggccgctgctccagcagaacaccaacctattagaagagtacgacagtttcgacttcgccgccgccgcggggctgctactaccgttccaagaactacctgctggtctcctgccccccgcgaattacctgccgccgccaacgccaataagcatggccatggccatgtcgccgccgtcgctgctgctgacgacgctcccgggcgtgccagtgcctacggcggcggcggcggatgtcgtgtacggaggattgggcgggggcggcgcgggaggactgtcgttcgtcctgaagcgggaggccggcggcggcgggggaatgatcggcggcctgaacctcggacgccgcacctacttctcccccgccgccgtggaccggctactcggcggcggcggcctaggcgtgggcctcggcatgagcgtgctggggctcggggtcggcgccgccgcccaccagcagcagcagcagccaccgccgcggtgccaggccgagggctgcaaggccgacctctccgccgccaagcactaccaccgccgccacaaggtctgcgagttccacaccaaggccagcgccgtcgccgccgccggcaagcagcagcgcttctgccagcaatgcagcaggtttcatgtgcttgcagagtttgacgaggccaagaggagctgccggaagcggctcaccgagcacaaccgacgccgccgccggaagccgatcagcgaacagggtaatgaccactcgtcattgccgccgccgccgccaaagacagcggatacttgcatgaccacctcgtacaatgatgaccccaacagtgcgagcaacacggctgcagccaagtcggcggccatctcgcagaacggcggcgtcagctgcctcgacgtcctggacaacgagcagcgcggcggcagcggcgccgacggcgctatctctggccgcgccgcccccgccgctgcatcacgagaaggacgggagccaggactccgtgctatgatgcagcgccgggtccattggtccatggccggcggctggacgacgacgaatcgccgtttcatcacctcgctggtagtgatgcagacccagcagcagagcagcacggcggcaacgtcttgtcgtgctcgtcgatcggtgtcagatcagcagaacggcggctgcaacggtttctttgaggtggacttcatctaatgcgatgcagatgcacgtaaaaggagcagggaaaagcatatagctagcgtcgctagctgtgtattgtttctgagatgggaaggatgcatggcgtgaggaaagcaacaaaggctagggtttggttggttccactctagctaggggccttttctttttactgtggttagtacttgggctagctagctagtagtgctggccggacttctgttctattaattactagagggaaatgctggtgtagtatgtgtgtgttttccttttccctgttgctaacaatgtatatactattacgtgtaaaaaaaaaaaa

SEQ ID NO: 8351 - DNA, 2059 bp, Zea mays
  Predicted polypeptide sequence is orthologous to G478
ctcacaatcactcaaccactgcctccagctccagcagcagctagctcagctcgatcgtcctcccgacccgatccatccaccccactccccgtgctccaccatctcggcatctcgctcgctcacttagctcgagctgcggcaaacagccggccggcagtccggcacacgggagatgatgaccgggaggctgaacgtggccacgtcgtcctcgccaggaggagacgacttcctgttcatgcccatgcagcagcatcagccgccgccgcctcctcctccgccctacgtcgggttcgagcacggccacggcgtggcgggaggcggcagccagcgcgttgccggaggggtgcagcaccacctctacgacggcctcgacttcgccgccgcggcgctgcagttccagcagcaggcggaggcgccgcacctgcaccagcagcagctgctcacgctgccgtccagtctcggccccatggcgccgccgcctccgccgccgccgccgctgcccatgcctatgcccgtgcccgggatgcccggcgaccacgtgtacccggcgctcgggatggtgaagcgcgagggcggcggcgcggacgggaggatcgggctcaacctcggccgccgcacctacttctccccaggggacatgatggccgtggaccgcctcctgatgcggtcccgcctcggcggaggcggcggcgcgttcgggctcggcttcggcttcggtttcggcggcgcgcaccaccaggctccccccgcgcgctgccaggccgagggctgcaaggccgacctctccggcgccaagcactaccaccgccgccacaaggtctgcgagtaccacgccaaggcctccgtcgtcgccaccggcggcaagcagcagcgcttctgccagcaatgcagcaggtttcacgtgctgtcggagttcgacgaggtcaagaggagctgccggaagcggctggccgagcacaaccgccgccgccggaagccgcccaccaccgcctcatccaaggacgccgcgtcgccgccggctaacaagaagcccaactgcggctccatcacaagctcttactccactgacaacaagaacctgaacacggccaagtcgaccatgtcatcgaacacgggcagcgtgatcagctgcctggaccaggccgcgggcaacaagcagctgcaggcgaggccgacgctgaccctcggcgcgtcgccggacaaggaccagcagcagcagcagcagctgagagccatgctccaggcccaagcggcggccggcggcggccaccaccaccaccaccaggagcagcacttcataacctctctgcaggttcacaacaacgacggctgcggcggcggcaacagcagcagcaacaacaacatcatcctgtcgtgctcctcggtgtgctccagcgcgctgccgtcggccaacggcgaggtctcggaccagaacaacgctggtggcatgcataacctgttcgaggtggacttcatgtagaccgtcgagatcggggcaaagcaaaaggcaggcaggcaagcaagcaagcacgggagtacgtccgtccttctggcaaggtgtccttggtgtgtatcagtgtaggtaaaaaggaataggagagagagagagagagagagcaaaacagctaggcatggagtgggaggagaaacaagacgagaaaagacacatagaaaagagagagagagagaaaggacgcagagaaggattctatccatccatcagtccatcacactccatgcatcagtagctagctagctagcagcaagctgcagagcctgcagcaagctgctgctggtctacaacctcttgttgcaaggttccatggccatagcaaagccatgcgtccgtcccgttgcattggctctctctctctatatatatacctgtacgtactgtcgtgctgcagctgctgccattgcaagcctttctacctttccatttcaagcggggaataataactgctatttcactttaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 8352 - DNA, 1975 bp, Zea mays
  Predicted polypeptide sequence is orthologous to G478
cacactccgaccctcagtcctcactcaaccactgcccgccagctagctccagcagctagatcaggtcgaccgtcctcccgatccacccccgtgctccgatccaccacacgagctggctagctagccagagcggcggcacgcaggagatgatgagcgggaggctgaacgcggccacgcccgcctcgccgggggacgacttctcgttcgcgcccatgcagatgccgccgccgccgccctacgtcgggttcgagcacggcggaggcggccagcgcggcgccggagcgatgcaggcgcagcagcaccacctctacgacggcctggacttcgcgtcggcgctccagttccagcaggaggcgtcgtcccactcccaccaccaccagctgctcacgttgccgtccagcctgggcccgatggcgccgtcgatgccgatgccgatgccgatgccgctgccgatgcagatgcccgtgcccggtgaccacgtgtaccacccggcgctcgggacgatggtgaagcgcgagggcggcggcgcggacggcgggaggatcggcctcaacctcggccgccgcacctacttctcccccggggacatgctggccgtggaccgcctcctgatgcggtcccgcctcggtggcgtgttcgggctcggcttcggcggcgcgcaccagcaccaggtcccgcgctgccaggccgagggctgcaaggccgacctctccggcgccaagcactaccaccgccgccacaaggtctgcgagtaccacgccaaggcatccgtcgtcgccgccaacggcaagcagcagcgcttctgccagcaatgcagcaggtttcacgtgctgtcggagttcgacgaggtcaagaggagctgcaggaagcggctggccgagcacaaccgccgccgccggaagccggccaccaccgcctcatccaaggacgccgcgtcgccgcctgctgccaacaagaagaccaacggcggctccatcacatgctcttactccactgaaaacaagaacgacgacctgagctgcagggccaagtcgaccatgtcgtccaacacgagcagcgtgatcagctgccagctggaccagcccggcaacaagcaccagctggcgaggccgacgctgactctcggcgcctcgcaggacaacaaggaccaccagcaacagctgagcaccatgctccatgtccaagcggccggcggctaccaccaccaggagcagcagcacttcataacctctctgcaggttcacaacaacggcggtagcggcaacaacaacaacaacaacataatactgtcgtgctcctcggtgtgctccagcttgccgccgcccccgtcggcgcccaacggagaggtctcggaccagaacaccgccgccaacaatggcaacgggaacatgcataacctgttcgaggtggacttcatgtagaccgtggagatcgatccaaagcaagctaagcaagcacacaggagtacgttcttctggcaagctaggtgtccttggtgtgtaaaaggaataggagagagagagcaaaaaaggtatgaagtgggtggagaaacaaggagagaaagagagagagaagggtgcaagtgcaaggattccacccatccatcacactccatatcagtagcagcaagctgcagcctgcaggtctagcaaaggtagctacgtaccctcttgtttgcaaggttccatggctatagcaaagccatgcatccgggccggatggatggaaggcccccattacagtggctagctgcctctctcaaccagtctacctcgatctactgcgctgctgctgcagctgcatccatcgcaagcctttctacctttccatttcaagcgggggggaatagttaacagtggctgtgtttcacttgtttttctccactagtttttcttttcttgttgcaaggtgcacgagggtgcagtgtgtgtcgtactaataccaaactacctgttcaaaaaaaaaaaaaaaaaaa

SEQ ID NO: 8353 - DNA, 1411 bp, Zea mays
  Predicted polypeptide sequence is orthologous to G478
cgatcgatcgagatatcgtgtcaacgtgccggccggggcgtgggaagatgatgaacctatcggctgccgccaacggccgcgacgagttccccccctacgtcgtgccgtccaacgcggccgctccgcccccttccctgctcccaaccatggagcagcagcaggagagcagcatccacagggagcatcatcagctgctgggctacaacctcgaggccaactcgctggccctcctgcccccgtccaacgccgccgccgcccaccaccacaccaccttcgccggcggccacagcccccacgacatcctccacttctacacacctcctccttccgccgcctcgcactacctcgccgccgccgccggcaacccctacagccacttagtctccgcgcccgggaccaccttccaccagacctcgtcgtcctactacccgcccgcggcggcggcgcaggccgcgcccgagtactacttccccaccctcgtcagctccgccgaggagaacatggccagcttcgccgccacgcagctcggcctcaacctcggctaccgcacctacttcccgcccagaggaggctacacgtacggccaccacccgccgcgctgccaggccgagggctgcaaggccgacctctccagcgccaagcgataccaccgtcgccacaaggtgtgcgagcaccactccaaggcgcccgtcgtcgtcaccgccggtggactgcatcagaggttctgccagcagtgcagcagattccatctgctggatgagttcgacgatgctaagaagagctgcaggaaacgcctagcggaccacaaccgccgccgccggaagtcaaagccatcggatgctgatgccggagacaagaaaagggcacatgcgaacaaagcagctgcagctaaagacaaagcagagagtagcagcaagaacatggatatcggagatgggttaggcgcacagatactgggaagtgcactcttgtccaaggaacaagatcaaaccatggatcttggagaggtggtgaaagaagcagtggatcccaaggggaaggcatcaatgcaacagcattacggcttccccttccattcgtcgtcagcaggatcttgcttcccccagacccaagccgtctccagtgataccacatccaatataggtcaagtgcaagagccaagcttagggttccaccatcagcaccaccaacacagcaacatcttgcagctcggccaggctatgtttgatctcgacttcgatcactagtcaatatgtgatgcacatgcaccctctctttctcaccccaccccacccctcccctcccctctatcttgtttgtgcgcgtaatccgaatatttttcctttttaaattatctgtgttaattactgtaacgtggacataataatgatagtctatgcttgccatgcaa

SEQ ID NO: 8354 - DNA, 873 bp, Zea mays
  Predicted polypeptide sequence is orthologous to G478
cgcgaattacctgccgctgccaacgccaagcatggccatgtcgccgccgtcgctgaggctgctgacgctcccgggcgtgccagtgcctacggcggcggcggatgtcgtgtacggcggattgggcgggggcggcgcgggagggccgtcgttcctgaagcgggagcacggcgtcggcagcggcggcgggaggatcggcggcctgaacctaggacgccgcacctacttcacccccgccgccgtggaccggctgctcggcggcggcctaggcggcgtgggcctcggcatgagcgtgctggggctcggggtcggcgccgctcaccaccaccagcagcagccgccgcggtgccaggccgagggctgcaaggccgacctctccgccgccaagcactaccaccgccgccacaaggtctgcgagttccacaccaaggccagcgccgtcgccgccgccggcaagcagcagcgcttctgccagcaatgcagcaggtttcatgtgcttgcggagtttgacgaggccaagaggagctgccggaagcggctcaccgagcacaaccgacgccgccggaagccgatcagcgcacagggcaataatgaccactcgtcgccgccaccgccggcgccaaagaaagcggatacttgcataaccacctcgtacaacgatgaccccaagagtgcgagcaacacggctgcagccatctcgccgaatggcggcagcggcggcggcagctgcctcgacgtcctggacaacggccagataacgagcagcgcgacggcggcggcaccgacggcgctatctctggcagcgccgcccccgccgctgcatcacgagctgcatcacgagaaggacgggagcctggactccgtgctgatgcagcg

SEQ ID NO: 8355 - DNA, 826 bp, Zea mays
  Predicted polypeptide sequence is orthologous to G478
ctcacaatcactcaaccactgcctccagctccagcagcagctagctcagctcgatcgtcctcccgacccgatccatccaccccactccccgtgctccaccatctcggcatctcgctcgctcacttagctcgagctgcggcaaacagccggccggcagtccggcacacgggagatgatgaccgggaggctgaacgtggccacgtcgtcctcgccaggaggagacgacttcctgttcatgcccatgcagcagcatcagccgccgccgcctcctcctccgccctacgtcgggttcgagcacggccacggcgtggcgggaggcggcagccagcgcgttgccggaggggtgcagcaccacctctacgacggcctcgacttcgccgcctcggcgctgcagttccagcaggcggaggcgccgcacctgcaccagcagcagctgctcacgctgccgtccagtctcggccccatggcgccgcctccgccgccgccgccgctgcccatgcctatgcccgtgcccgggatgcccggcgaccacgtgtacccggcgctcgggatggtgaagcgcgagggcggcggcgcggacgggaggatcgggctcaacctcggccgccgcacctacttctccccaggggacatgatggccgtggaccgcctcctgatgcggtcccgcctcggcggcggcggcggcgccttcgggctcggcttcggcttcggcttcggcggcgcgcaccacctgcaggctcccccgcgctgccaggccgagggctgcaaggccgacctctcccggcgcaagcactaccaccgcctgcacaaggtctgcgagtaccac

SEQ ID NO: 8356 - DNA, 1166 bp, Zea mays
  Predicted polypeptide sequence is orthologous to G483
gcacgaggattttatttcacgtttcagtaacattttcatccaaaatattgtggaattgtcgaaggagttaaacctcccgttggataattcaccatttccaccaccaccaccaacaaatccagctgcagaaaatattgctggtataccaaaacctgtacaaaacaatcttcctgggatcttgggtgatgcaaagctgactgcatgggaattgtggcataagcaggagtactcattcctgaaaattgcttatttccgcagagcagtgccaataaaagagcaaacagttattgcgtacattcttgatgctgctcgagaaggatgtgagatggactggagtaggttttgcagggaagtagggctgacacctgatatagccaccgcaatccgtcatgcaatctcaaaggttggatcacgtgagaaaatgaagccaatcaaagaggagctcccagagaatgtaacttatgacatgatcaagacattcctgactattgaggggtgtggattgtcagagcaagtctttggtaacggtaccgccgacggtgtctctagtagaatagctgagtcaccaatatcttcctgccatgcaagtgaagcaggcggaaatggtgtcccagcagcggcagaggccagtgatgcaaacccttcagctaagagaggtcaaactgtttgtgctgaggagccagcaacaaaactgcaaaggacagacgagcatggagctgagttaactggcacggcgactgctactgtagattctgtgctagatctggttgcgagctgcaatggggtatcgctggaggatgttgccaagcacttcaagggatccaagagagaatcggtcctggagatattggagggccttgaatctgaattcacaatttacaagaaaaacgggaactacatggtcctgtgacaaacttgcccgcgtagtctgggaagggggtatgcctcagctgtgtgtgtatatatctatctatacgatggtgggtgactttggactatggtagcaaggttgttggctggtgtgcatgtgctcattttggggattgggcagaactagcagatgtacgaacgtgtgtttggagttgggatcctttctgtcatctcgtatatgagtatcttggactaaaaaaaaaaaaaaaaaaaactcgaggggggggcccggtacc

SEQ ID NO: 8357 - DNA, 711 bp, Zea mays
  Predicted polypeptide sequence is orthologous to G483
ttttgcataagagtaccagcactaatgattaataatcacgacaagcatgacatgtaccataaccatcacacagcctcactcttaattacgagcagccatctctctgtaatcagaaatggaatcacttgttacggaacgggaggcacatcagatgatcatcaggtcatcgagttattgggtggcaacaacagagcatgggtaacaacagggcactctcagtaataataatagtttactaaaaacccgcaaaggctgcatggaagcgaaaccatgataaggaagcaaattcgttactgcggctggacgtagtagtagcccatgggatcggcggcgggcaggccggcggcggggtgcgggatcccggctgctcccatggcggcggagtcggcgtccttggcctcgtcccgcggcacgatgtcgacgaggaagtcgaagacctcggtgcgcgcgacggcggcggcgatgtcggacttctgcagcgtgcggcgcttgttctcctcggcgtgtgcccagccgcggtgggtgagctcgaggatgaacatctcgcaggcgcgggagaagacgacgggcgcctcggcggcgatcatgcgcacgtcctcgtcggccttcatgatcttcttgatgcgggcgagcggcaggttgtggttcttgaagtcggtggtggcctcgatctcgcggtattgctccgcccagaatagctgctgctggtgc

SEQ ID NO: 8358 - DNA, 852 bp, Zea mays
  Predicted polypeptide sequence is orthologous to G483
cgactcctccggcagcccgcaacgactcgcgccgcctccggtcgcgccgggtccaggtaaagcggcttccatctcctcggtctcagcgcgtcatcccctcctccttcctcttccgtttcccttagggttggagtagacacgtcggctcaaggatccttcgagggactgactggttgtgcaaatacctacttttaaattattgaaagtgggagcatgaaagggtcaggacacttattgattttgaacaaagatctagcatggaaccatcctcacagcctcaaccaatgatgggtgttgggtcacaaccttatcctgctgctgctccctatgtgccagtacctggatctcttgctgttcctcctggctcacagccagcagcagcattccccaatccaactcaactcagtgctcagcaccagatggtgtaccagcaggctcagcaatttcatcaacaacttcagcaacagcaggaacaacagctcagggagttctggactacccagatggatgagatcaagcaagcaaatgacttcaagatccacaccttgccacttgcaaggataaagaagataatgaaggctgatgaggatgtgcggatgatctctgcagaagctcctgttgtgtttgcgaaggcatgcgaggtattcatattagagctgacattgaggtcatggatgcacacagaggagaacaagcgccggaccttgcagaagaacgacattgcagctgccatcaccaggactgatatatatgacttcctggtggacataatctcgagggatgaaatgaaagaggaggggctcggacataatcccatagttggcctgccgcctgctatgggggctccagctg

SEQ ID NO: 8359 - DNA, 930 bp, Zea mays
  Predicted polypeptide sequence is orthologous to G483
ctaggggagagagagagggggaaggccaagaagaggcttcctctccccccattctccaatccgtgccctagtcgagccagccgcgaggaaggaggcgtctcgcctagcgcccgcccgtcggccgaccttctgctgcaccttcgaactctggaaagatcatagatttttgggcaatagcaagtggacatggaaccatcctctcagcctcagcctgcgatgggtgtcgccgccggtgggtcacaagtgtatcctgcgtctgcctacccgcctgcagcaacagtagctcctcctgctgttgcatctgctggtttacagtcagtgcaaccattcccagccaaccctgcccatatgagtgctcagcaccagattgtctaccaacaagctcaacagttccaccaacagctccagcagcagcaacagcagcagcttcagcagttctgggtcgaacgcatgactgaaatcgaggcaacagctgatttcaggaaccacaacttgccacttgcgaggataaagaagatcatgaaggccgacgaagatgtccgcatgatctcagccgaagctcccgtggtcttcgcaaaagcttgcgagatattcatactggagctgacgctgaggtcgtggatgcacaccgaggagaacaagcgccgcaccttgcagaagaacgacattgccgcagccatcaccaggaccgacatttacgacttcttggtcgacattgttcccagggatgagatgaaggacgacggaatcgggcttcctaggcccgggctgccacccatgggagccccagctgacgcatatccatactactacatgccacagcagcaggtgcctggtcctgggatggtttatggcgcccagcaaggccacccggtgacgtatctgtggcaggatcctcaggaacagcaagagcaagctcctgaagagcag

SEQ ID NO: 8360 - DNA, 912 bp, Zea mays
  Predicted polypeptide sequence is orthologous to G483
cgacgagacagagagagaaggccaagaggcttcctctccccattcctcccttccgtgccctagccgagccagccgcgaggaaggaggcatcccgccgtctcgcctggcgcccgcccgtcggccgaccttctgccgcagcttccaattgtaaaaagatcatagatttttgtgcaagagcgagtggatatggaaccatcccctcagcctatgggtgtcgctgccggtgggtcacaagtgtatcctgcctctgcctatccgcctgcagcaacagtagctcctgcttctgttgtatctgctggtttacagtcagggcagccattcccagccaatcctggtcatatgagtgctcagcaccagattgtctaccaacaagctcaacaattccaccaacagctccagcagcaacaacaacagcagcttcagcagttctgggttgaacgcatgactgaaattgaggcgacgactgatttcaagaaccacaacttgccacttgcgaggataaagaagatcatgaaggccgatgaagatgttcgcatgatctcagctgaagctcctgtagtctttgcaaaagcttgtgagatattcatactggagctgacacttaggtcgtggatgcacactgaggagaacaagcgccgcaccttgcaaaagaatgacattgcagcagcgatcactaggactgacatttatgacttcttggtcgacattgttcccagggatgagatgaaggaggacggaattgggcttcctagggctggtctgccacccatgggagccccagctgatgcatatccatactactacatgccacagcagcaggtgcctggttctggaatggtttatggtgcctagcaagggcacccagtgacttatttgtggcaggagcctcagcaacagcaggagcaagctcct

SEQ ID NO: 8361 - DNA, 899 bp, Zea mays
  Predicted polypeptide sequence is orthologous to G484, G2631
gcccgagcaagccgaattgtcgtccgaattcgctcgcggggagcacttgctacctcgcgcccgccttctgtcgcgcggattcgttgctgcgcctggagatggacccgatggacatcgtcggcaagtccaaggaggacgtctccctccccaaatcaacaatgtttaagataattaaggagatgcttcctcctgatgtacgagtggcaagagatgcacaggatcttcttgttgaatgctgtgtagagttcatcaatctcctttcgtctgaatcgaatgaagtgtgcagcagagaagagaaaaaaacgattgctcctgagcatgttatcaaggctctaagtgatcttggcttcagagagtacattgaggaggtttatgctgcatatgaacagcacaaacttgatactttggattctccaaaagctggcaaattcactgggattgagatgacagaggaagaagctgttgctgagcaacaaaggatgtttgctgaggctcgagcaaggatgaataatggagcccccaaaccaaaggagacagaacaagagccgccacagcaaccacaagcacaaccccaacttcagctgcatactgaaccacagcaacccgtgcaatctcaagtgcagttgcattcgccaacacagcattccctccaacctcaagtgcagctgcacccccagccacaacagctcccacaagtgcaggtgcactctcagacgcagctgcaccctcagccacagcagccccaagtgcaggtccatccgcagctgcagcaactcccacaattacaggcccactcgcagccaccgcaaccccaagtgcaaatcacccacagccgcagcagcccccacaagtgcagttgcagtcatcagtccagcagacctccaaactcaacctcaggt

SEQ ID NO: 8362 - DNA, 842 bp, Zea mays
  Predicted polypeptide sequence is orthologous to G484, G2631
cctccccgcgcgccctaaccctagcttctcgattcaactctgcgcgagacgaattctctcccgaattcgctcgccgaaagcacctgctacctcgcgcccgccttccgtcgcgcggattcggtgccgtgcgtggagatggacccgatggacatcgtggggaagtctaaggaggacgtttccctccccaaatcaacaatggttaagataattaaggagatgcttcctcctgatgtacgagtggcaagagatgcacaggatcttcttgttgaatgctgcgtagagttcatcaatctcctttcgtctgaatccaatgaagtgtgcagcagagaagagaagaaaacaattgctcctgagcatgttatcaaggctctaagtgatcttggcttcagagagtacattgaggaggtttatgctgcgtatgaacagcacaaactcgagactctggattctccaaaagctggcaagttcactaggattgagatgacagaggaagaagctgttgctgagcaacaaaggatgtttgctgaggctcgagcaaggatgaataacggagcccccaagccaaaggagccagaacaagaaccgccacagctaccacaagcacaaccccaacttcagctgcatactgaaccacagcaacccatgcaatctcaagttcagttgcattcgcaaacacaacactacctccaacctcaactgcagctccaccatcagccacaacagctcccacaagtgcagctgcactctcagccgcagctgcatccccaagtgcatctgcaccctcagccgcagttgcccccacaattgcaggtccatcagcagctgcagcaacccccacaagt

SEQ ID NO: 8363 - DNA, 713 bp, Zea mays
  Predicted polypeptide sequence is orthologous to G502, G519
aggaagtgatagtgcacagctacgcatacacatctaccgtctgcgcaggaagtgaaactaaagaatgagccagcgccaagccaaagaccgggccggctcccatgtacgaaacaccgacacactcgacttgtaaccccgaccaggttcagtcaggttcgactcctagtcctatgctgtatttacagagttcgcaacgccgtccgtcttctctcctgacctccatcctcgcctgagctcactcagaaggggcccaagaccccgcggctccggtgggctggttccccctgaccctgggcgacgcgaagagcgaggagtagaagtcctcgccggccggcggcagcatgtcgaggccgctgtacatgccctggatgtcgtcgtagctgagatccacgaacaggtcgctgctcctggcgctgccgccggcgtccagcgcctccttcttkggcacatcatcgccggcggggcggyatcgttgtccacgatctccgactccggcgtgcgcgtctcgccccacgagtgggtctgcgagtgggagatgctcacgtccatggcctcctcctctttggctgcgcgagtgacgccggcggctgcccctttccccagccgcatcttctcccactcgttcttcttgttgtacagccggcacagcacccagtcatccaacctgagcgaccccytcttagcgcgtccgccggggtcagcgagcctgtact

SEQ ID NO: 8364 - DNA, 1022 bp, Zea mays
  misc_feature (484)..(504): n is a, c, g, or t
  misc_feature (565)..(589): n is a, c, g, or t
  misc_feature (796)..(836): n is a, c, g, or t
  misc_feature (880)..(919): n is a, c, g, or t
  Predicted polypeptide sequence is orthologous to G502, G519
aagagccaacacagctacaatatatactgtaaaatatatattgtaggagtaagtacactcgaagcttggcgatgacgaatatggcctgcactacctaccaccagtacggagactgcaactacaagcccttacaaaattactagtacttattagtataataactaatcaatgaaggaacagaaaccctgcactgaaccaatcatgtacagtatgtatatgtacagccacacacacacatgccgcgcacgatccaccacacccgatgcactgcgccatccgtctccgtctccgtctcacttccgccggggccagacggtctcattgccgcctctccatgtaatccagctatagtttcatattatatcctccttgcaagtcaacaatggcggctcgcctgagtcaaagcccacaccgtgcggttgcattgcattgcgctgcccaagacagatcaatcaaccaaccaaccgcagccgaggatgcttcnnnnnnnnnnnnnnnnnnnnnaacatgatgggcggtgtcgtctagaacggcttgccccagtacatgaggatgtcctgcagcnnnnnnnnnnnnnnnnnnnnnnnnncgacggggtcgagcatggagcccgcggggttcacggggtcggaggcgaaggtccgctcccactcgctgatcttgggctggctctgcacctcccggtcgcacgccagctgctccggggacagcacctgctccgagcagctggagtagtccgcgtgcagccgcggcatcgagtccgacggccggtcgtagtacgccgccagctccgggnnnnnnnnnnnnnnnnnnnnnnnnnnnnnnnnnnnnnnnnnctgctccggcggggagctcaccgccgccgtggcgaacacaggcnnnnnnnnnnnnnnnnnnnnnnnnnnnnnnnnnnnnnnnngcccgccgcccttcttgttgtagatgcggcacaggacccagtcatccaacctgaggctgttcttcttgcgcgccgagcggtcgacgtcggcgaggcggctcgt

SEQ ID NO: 8365 - DNA, 1141 bp, Zea mays
  misc_feature (1084)..(1084): n is a, c, g, or t
  Predicted polypeptide sequence is orthologous to G502, G519
gcacgaggaacccgcccacaggacaggacacacagagccgagccaccccacccaccatcggcgaccagcagccagccgcgggagcgagctgtttaaagacaccgagtcggagtcggacggaggactggcaggcacaaccgaagccaccgcttctagttctcgggttcatcgccagcaatccagaccacataatgggacagccggtgacgaggaggagggagagggacgcggaggcggagctggacctgccgccggggttccggttccaccccacagacgacgagctggtggagcactacctgtgccgcaaggcggcggggcagcgcctccccgtgcccatcatcgccgaggtggacctgtacaggttcgacccgtgggacctgccggagcgcgcgctcttcggggcccgggagtggtacttcttcacgcccagggaccgcaagtaccccaacggctcccgccccaaccgcgccgccggcgacgggtactggaaggccaccggcgccgacaagcccgtcgcgccgcgcgccgccgccgccgacgcccgcacgctcgggatcaagaaggcgctcgtcttctacgccggcaaggcgccgcgcggggtcaagacagactggatcatgcacgagtacaggctcgctgacgccggcggacgcgccaagaaggggtcgctcaggttggatgactgggtgctgtgccggctgtacaacaagaagaacgagtgggagaagatgcggctggggaagggggcagccgccggcgcagtcaaagaggaggaggccatggacatgagcacctcccactcgcagatcacccactcgtggggcgagacgcgcacgccggagtcggagatcgtggacaacgacctgccgttcccggatccggcgatgatggtgcccaagaaggagcgggtggacgacggcggcagcgccaggaccagcgacctgttcgtggatctcagctacgacgacatccaaggcatgtacagcggcctcgacatgctgccgccggccggcgaggacttgtactcctcgctcttcgcgtcgcccagggtcagggggaaccagcccaccggacccgcggngttgggccccttctgagtgagctcaggcgaagatggaggcatggagatcaggagaga

SEQ ID NO: 8366 - DNA, 815 bp, Zea mays
  Predicted polypeptide sequence is orthologous to G502, G519
acgctcgggatcaagaaggcgctcgtcttctacgccggcaaggcgccgcgcggggtcaagacggactggatcatgcacgagtacaggctcgccgacgccggccgcgccgccgccgccaagaaggggtcgcttaggttggatgactgggtgctgtgccggctgtacaacaagaagaacgagtgggagaagatgcagctggggaagaccgccgtcgccggcgtcggcgccaccaaggaggaggcgatggacatggccacctcgcacacgcactcccactcccaatcacactcgcactcgtggggcgagacgcgcacgccagagtcggagatcgtggacaacgacccgttcccggagctggactcgttcccggcgttccaggacccggcgatgatgatgacggtgcccaaggaggagcaggtggacggctgcagcgccaagagcggcaacctgttcgtggacctcagctacgacgacatccagggcatgtacagcggcctcgacatgctgccgccgcccggggaggacttctactcctcgctcttcgcgtctcccagggtcaaggggaaccagcccgccggagccgccgggttgggacagttctgagctgaggcgaggatggagccatggatcaggagatgaagacggttgcgaactctgtaaatacagcataggagtcgaacctgaccctgacccttgttggggttacaaggttttccgagtgtcggtgtagcgtacatggagccggcggcgcggccgggccggctcattctttagtttcacttccaaagcagacgggtagatatatgtgtagctgt

SEQ ID NO: 8367 - DNA, 771 bp, Zea mays
  Predicted polypeptide sequence is orthologous to G502, G519
acaaaaatcccagtaccaaatcaatcgcatataaacagtttaattcaactcgtagcagcaataatcctgtagtccagctccatgatcattcacaagccgacatggcctcatcgccggcggctcggaccagtcatctttctcagtacggcttgccccagtatgtgaggatgtcctggagcagcgggtcgccggcgggcagccctacccccaccgccgcggagccgagctgatgcccgccaagccccagcatcgagccggccgggttgattcccgggccggcgccggcggcgaaagtgcgctcccactcggcgatcttgggctggctctgtacctcaggccgctcgccgccgccgccgccgcacgacgacgtggcggccagcgcgtggcccgagcagctcgagtccgcgccgtgcgcccggggcatcgagtcggacggccggacctcgtagtacgccgccagctccgagaacggcagcggcgcgtaccccgtcccggccgcggccgttgccgttgccgtggcagacggcagcacggacggcttctgctccggcggcgagcccatggacatggaccccagcgcgccctggctgctggcctcggccctgccgccggctccggtcggcttctccagcgcgcctttcttgttgtagattcggcacagcacccaatcatccaacctgaggctgttgttcttcttgcgggcggtgcggtcgacgtcggcgaggcggtactcatgcatgatccagttggtcttgtcgcccttgggcgcct

SEQ ID NO: 8368 - DNA, 755 bp, Zea mays
  Predicted polypeptide sequence is orthologous to G502, G519
attgctcctgatttaaactcaggttgccagatccatttgatatgatatttcgggatcactcctgcgctggacatgcctaaacctgattatctcgtgcttaactcatcatcattgtatggtaccagaaaaaggttgggctacgggaccatgagagaggggggagggaacacttaaaatccccatcaggcctctctctgaggtgcaactcttgttatgctgccgctgctgacttcgtcttcttcgtctgacaagtcggtaacgccggtgacacagcttgaggacggcgactgtggcgccgggaacagcaacggctgccgtcctcccacaccttcccggagctgcggcggcgcagcggatgcgcggtgtctcagagctctgctgtggttaccatcccggcccggcctgcttcttcttgctcccttcttcagaaagacccggcacacgacccactctcccggctcagcatcgcaacaaccctgcagtcattggcacgccatgttttgttcgggggcaaatgtaagctacatgcggcaaaatatcgcggtcgaggttgcaaagcgaaccaagctacttccaaacggaggcatcatggtgggagttctgagttctcacgtggctcgcattcttcttcctctgctcggccacgccgcgggacgcggcggcgagccggtactcgtgcatgacccagcctgtccgcgacgacgacggcggcgacggctcactgcggtggaaggcgagcgccgtcttgccgccca

SEQ ID NO: 8369 - DNA, 910 bp, Zea mays
  Predicted polypeptide sequence is orthologous to G502, G519
ctcgagacttcctcagcaatcaatcagctttccagcgatcggcagctcctcgatcgtttcgaagctccaatccgcccggccgcctccgcctgttgccactagctaggtgatcgatcgaatggactgcggtggcgcgctgcagctcccgcctgggttccgcttccaccccaccgatgacgagctggtgatgtactatctcctccgcaagtgcggcggcctgccgctcgccgcgccggtcatcgccgaggtggatctctacaagttcgacccatggcagctcccagagaaggcgttcggtggggagaaggagtggtacttcttctcgccgcgcgaccgcaagtacccgaatggctccaggcctaaccgggcggccgggacagggtactggaaggccaccggcgccgacaagccggtagggtcgccgcgccccgtggccatcaagaaggcgctcgtcttctacgccgggaagccgcccaagggcgtcaagaccaactggatcatgcacgagtaccgcctcgcggacgtcgaccgctcggccgccgcacgcaagaagaccaacaacgcgctcaggctggatgactgggtgctgtgccggatctacaacaagaagggtgttattgagcggtacgacacagtggacgacgacgacggcgacggcgccgtggccgaagacgtcaagccggtgccggcgccggcggcgtcgaagaacccgcgtgccagtgcccgcgtaggggcagcagcggcggcgccgatgaaggtggagctccccgagtacggcggcggctactacgactacgacgacctggagacgccgtcggcggggatgctgtgcttcgaccgcccgtcggccccggcgcccgcggaccgcgactcaaacacttccgtgccgtggacgacgcaccacacgcca

SEQ ID NO: 8370 - DNA, 820 bp, Zea mays
  Predicted polypeptide sequence is orthologous to G502, G519
ggaggcaaggaaacaggcagctctccacggacaacgcgattctatttatttatctggctgccagccagccagccgcctttcgaaaccgagcacgagggagccgacgtggtggtctctggaacctggttcgagcgagcgagcgacccatctatccagccgcctgccgggaatttctgtgacgacgacgaggaggaggagggggtatggcaatggtggcggcgcagggaggcggccggagggacgccgaggcggagctcaacctgccgccggggttccggttccatcccaccgatgaggagctggtggtgcactacctctgcaggaaggtggcgtgtcagcagctgcccgtgcccatcatcgccgaggtcgacctttacaaattcgacccgtgggatcttccagagaaggcgctgtttggccgcaaggagtggtacttcttcacgccgcgggaccgcaagtacccaaacggctcgcgccccaaccgcgccgccgggagggggtattggaaggcaacgggcgcggacaagccgatcgcgcccaagggcggtggcggggcggcaggaatcaagaaggctctcgtcttctactccggcaaggcgcccaggggattcaagaccgactggatcatgcatgagtaccgcctcgcggacgcggaccgtgcgccgggcaagaagggctcacggaagttggatgagtgggtgttgtgccggctgtacaacaagaaaaacaattgggagaaggtgaaggctgaggagccggaggcggcggcgccgttccgtcaccagcagggcgcagcggaggatttcatgtctgacagctt

SEQ ID NO: 8371 - DNA, 667 bp, Zea mays
  misc_feature (571)..(571): n is a, c, g, or t
  Predicted polypeptide sequence is orthologous to G502, G519
ggactggattatgcatgagtaccgcgtcgctcaagcggaccacaccctggggaagaagggctcacataagctggacgagtgggtgttgtgccggctgtataacaagagaaacaattgggacaaggtgaaggtcgaggagcaggagttggaggcggcgccgcgccgacaacatcaccgacaaagtgcggaggattccatgtctgacagtttccagacacacgacttagacatcgacaacgcctccgagctacataattgctacggtaacaacatggtgcaagggcaggccatgaccgccagaaacgacattggcgtcgtgacggtgaaggaggacaacgactggttcaccgacatgaatctggatgatctgcaggcgtcctacaacatggcccatacggtgaatccgatcccggcccaaaccgcgaacctggtgacggggcaaggccatggctacttgcaaggctatggctacttgcagtacatgaactcaccgtcgatgaagatgtggcagacaatcctgcctccgttctgagtgtccacgatgaagagatgctcttgtacgtaagggggncatagaagtgactaggactggaatagaaacaacatggtataggcttgtaaccgtttattcatttgctaaataatacctatgtgggttggtaatacc

SEQ ID NO: 8372 - DNA, 929 bp, Zea mays
  Predicted polypeptide sequence is orthologous to G504, G1425
cgcctgcgcctccgtctccggccggctctcctcgatcgctacgatttcagggggggcccccggacgaaaccaccaaaaatcccagcgcagatcactcgccggcctcctgctccagcagatcctctcccaaccgacagcgtaacaaaaaccccggctatcctcttcgctgtctgctctccttcacgctactagagcgcggctctgccaaactgcagggatccatcgtcccgcggggccggccagccggggtagtactacggtgatgaggtccatggagagcacggactcgtcgtccggtgagctaccaccaccgcagaagcagccgagctcggcgccggatctcccgccgggcttccggttccaccccacggacgaggagctggtcgtccactacctcaagaagaaggccgcgtccgtgccactccccgtcgccatcatcgcggaggtcgacctctacaagttcgatccgtgggagctacctggtacgtaagataaggcgacattcggcgagcaggagtggtacttcttcagcccgagggaccgcaagtaccccaacggagcgcggccgaacagggcggcgacgtccggctactggaaggcgactggcacagacaagcccatcatggcgtccggcggcaaccgcgagaaggtcggcgtcaagaaggctctcgtgttctaccgcgggaagccgccaaagggcctcaagaccaactggatcatgcacgagtaccgcctcgcggatgcggcgagctcaaccaccagccggccgccgccgccttgcaacgccggagggcaggccacgtctctcaggctcgacgactgggtgttatgccgcatctacaagaagatcgacaaacttggagtcggcgatccgccgcggatcatggagtgcggcgaggactccgtggagaatgcggtggcagcctacc

SEQ ID NO: 8373 - DNA, 866 bp, Zea mays
  Predicted polypeptide sequence is orthologous to G504, G1425
attcggagtcttctctcgtccctgtccccctccagcaccgccgccgccgccaccgcgccgcaacctcgccatggcacgccctccgtcggcggccctcaagccgccgtatccggccttccaatcccatcccagcgatctcgagctcgtcaacttctatctccgtccctgggtcgagaccggcgtcaagaccggcgcgttcatccacgacgcagacgtgtacgccgctgaccccaactacctcacccgtcagttcgcgccggcggtggcccaggacggcgagcgggcgtggtacttctacaccccgctgcgccacaagagcgtccacgggacgcggaagacgcgcaccgtggccaccggcggcgggtgctggcacaacgaggcgaaagctaggcccgtgtacatggtctccaacgggatgcaccagattgcgcatcgccagagcttctccttcgtcgagaaggatggcggcgtgcgggtccgcacgggttggctcatgatggagctccgcctcgtcgaggacggcgccgccgggcagaaaccggaggaggacggcgccctcgggagtcgcgtcctgtgcaaggtgtaccgcagcccgcgcaaccccgagccaagcggcatcgaagccgcgacggcgcccgggcagaaggcggaggcagacgacgatgaatcttgcgacgacgaatctagcgacgcgacgttggacgacgatgacagctccaacgcgtcactagcggcggcatcgggacccaagagggaatccgacgaggtggaatccagcgacgcgacggtggcggcacttagtcgccatagcgcgccgaacgacgagatctccggcgggtccgcggtggcgcccggacgcaaggaaa

SEQ ID NO: 8374 - DNA, 878 bp, Zea mays
  Predicted polypeptide sequence is orthologous to G504, G1425
ttttttctcacctcccgtggcagcagccggccaacacccgcaccgcagtccacagcaagaaccaagccacagcgaagaaaagatccaatggtgatggcgccggcggcggcgcagcagcagcggcgccgcgacgcggaggcggagctgaacctgcccccgggcttccggttccacccgacggacgaggagctggtggcgcactacctctgcgcgcgcgccgcgggtcgccgccccccggtgtccatcatcgccgaggtcgacctctaccgcttcgacccctgggacctgcccgagcgcgccctcttcggccgccgcgagtggtacttcttcacgccgcgggaccgcaagtaccccaatggctcccgccccaaccgcgccgccgggtcggggtactggaaggccacgggagcggacaagcccgtggagcacggtggcaggacggtcggcgtcaagaaggcgctcgtgttctaccacggcaagccgccgcgcggggtcaagacggagtggatcatgcacgagtaccgcctcgccgacgccggcgcccgcgcccgcgccaggaagcccggcaccggcacgctcagggtaagcggcgagcacctcgcagtctcgcgccgaattttcttccttggtttcatctcctcgttataaggaatcaccaccggccaccgggatgctgacgcgctgttcgatcgactctcctgcagttggatgactgggtgctctgccggctgtacaacaagaagaacgagtgggagaagacgcagcagcagcaggagaagaagcagaaatcagaagcaatggagtcggaggcctcgctctcgcactcccactcagacacgcggacgccggagtcggagatcgacgacgacccgttcccg

SEQ ID NO: 8375 - DNA, 841 bp, Zea mays
  Predicted polypeptide sequence is orthologous to G504, G1425
gatctttcaagctatccttgcttcctagctccctttggcgtgctgtaccggacgacaggggtaggtaggtaggtaggtgtagctagctcggcgagcgagggagcaatccggccaacagcacacgcgtcgatcgccatgccgagaagcggcggcggcggcaatggcggtggcattagtagtagtagtagggtgatgcccaacctcccggccgggttccgcttccaccccacggacgaggagctcatggtgcactacctcatgaggcaggccgcctccatgccgtgccccgtccccatcatcgccgaggtcaacatctaccagtgcaacccctgggatctccctgccaaggcattgttcggcgacaaggagtggtttttcttcagcccccgggaccgcaagtaccccaacggcgcccgccccaaccgcgccgccgggtccgggtactggaaggccaccggcaccgacaaggccatcctgtcgtcgtccacgcccacgagccacggcggcgccaacatcgtcgtcggcgtcaagaaggcgctcgtcttctacggcggcaggccgcccaagggcaccaagacggactggatcatgcacgagtaccgcctctcgggcgcggcggacgacgactgcaagggcagcaccaggcgcagagtgtcttcctcctcgtcgtcctccatgaggctggacgactgggtgctgtgcaggatccacaagaagagcaacgatttccagttgtcgtcgtcgtcggagcatgagcacgagcaggagggagcggcggcgggcggctcagcgacgactgtggaggaactagacgctctcgtcgtcgtcgacaacagcagca

SEQ ID NO: 8376 - DNA, 1331 bp, Zea mays
  Predicted polypeptide sequence is orthologous to G505
atggagaggttgggcgtcggcgtcggcgtcggcgagctgccgccggggttccgcttccacccgacggacgaggagctgatcacctactacctcctctgcaaggccgtggacggcggcttctgcggcggccgcgccatcgcggagatcgacctgaacaagtgcgagccatgggagctcccgggtaaggcgaagatgggggagaaggagtggtacttctactgcctccgcgaccgcaagtacccgacgggcctgcgcaccaaccgcgccacggcggccggctactggaaggccaccggcaaggaccgcgaggtccgcagcggccgcagcggcgcgctggtgggcatgaagaagacgctcgtcttctaccggggccgcgcccccaggggccagaagacgcgctgggtcatgcacgagtaccgcctcgacggcacctacgcctaccatttccttcccggctctacgagggacgagtgggtgatcgcgagggtgttccagaagccaggcgaggtcccatgcggccgcaagcaccgcctgggcggccccagcgccgccgccggcgattcctgcttctcggactccaccacctcggcctccatcggcggcggcggcggaggaggagcgtccgcgtcgtctcgcccgctgctcaccgtcacggacacttcctcgccgtcgctgttcgtggccaacgcgaacgccgccgccagcaacaacaacggcaacccggtcaccgggcgagagctcgtgccctgcttctccactaccgccagtcccctggaagccgcggcgctcggcgtcgtcgggcacccgtacaacgcggccccgctgcgtctgggcttggacttcgaggcgccgtccccgggcttcgtcgtcccgaacctgcgttccctgcaagtgcaggacgacggcggcctgccgctgttcctctcggcagcagcaggcggcggcatgtcgtccgcgacgctgggaataatggggtcgctgggcgggtctctccactgcccgccccacgccggcatggatgtcgtcaaggtcgagggccgcgccgcgccgccgcagatggctgtcggccccggcctcctcgatggcgccttcgcctggggcttctagtgctcactgctcaggcgctgcacgccgccgtggcatatgggcatgcatgcatcaccagcaaaccgatggatatatatatgcctctccacatgcatgtggtagttcgtggtttctctgcatgcgttgtacgttaagcttcgttagtaagtggaagtggcagagagtcgtcgtttatgtacgctattaagcttgattagtatcaggatgtggctgaccgaccctcc

SEQ ID NO: 8377 - DNA, 1259 bp, Zea mays
  Predicted polypeptide sequence is orthologous to G505
atggagcggttcggcctggacggcggcggtggcggtggcgagctgccgccggggttccggttccacccgacggacgaggagctcatcacctactacctcctccgcaaggccgtggacggcagcttctgcggccgcgccatcgcggagatcgacctgaacaagtgcgagccatgggagctcccgggtaaggcgaagatgggggagaaggagtggtacttctacagcctccgcgaccgcaagtacccgacgggcctgcgcaccaaccgcgccacggtggccggctactggaaggccaccggcaaggaccgcgagatccgcagcggccgcaccggcgcgctggtgggcatgaagaagacgctcgtcttctaccgcggccgcgcccccaagggacagaagacgcactgggtcatgcacgagtaccgcctcgagggcgcctacgcctaccatttcctccccagctccacaaggcaggacgagtgggtgatcgcgagggtgttccagaagcccggcgaggtcccacctgcagcccgcaagcaccgcctcggcgcccttagcagcactaccggcaccgccgcgggcgattcctgcttctcggactctacctcggcctccatcggcggcgcgtcgtcgtcatccacgcctggcccgctgttcgcgtcggcggccgccgccgtggccaatgccggcgccgccgacggcgacaccagctcctactgcggcggcgctgccaaccatggcaacctggtcaccggccgtgagctcgtgccctgcttctccactgccaccattaacggccccctagttgccgccgcgctcggcatcgggcagccgtacaacgcagccccgctgccgttcgagcagcagccgccgcctccggccttcctgccgagcctgcgttcccttcaggacaacctccagcttccaccgttcctctcagcaggcggtctgggcggcggcggggctctccactggctccccgccggcggcatggaggtcaaggtcgagggccgctcggcgccaccgcagatggctgtcggccccggccagctcgatggcgctttcggctggagcttctagttcttcgctgcactacatggttgtgcccatctatctagctagtagtggtttcttcatgcgttgtacgttaagcttggttaatcaactgctagtaagtgactgggtcgtcgttctaagtaatgtagtaactgtgttgtagtctctcatctaactgcagtagcagctttatttgttcgtggatt

SEQ ID NO: 8378 - DNA, 649 bp, Zea mays
  misc_feature (612)..(612): n is a, c, g, or t
  Predicted polypeptide sequence is orthologous to G509
caattaattcaatcacttccttcacaaatgcacattccatatcgcatgactgcaagtctgcacgcacgtacgtgtgcttcctggtcctggatcagcccatccacccttgtcggaacccgatgttggccatgtcctcgaagctgctgtcgtagaagaagctgcacccgtagtctcctcctcctcctcccctggagcctaggtccatcaccggcggggagctggtcgcctcctgcggcaacaagtgaccgaagaccgacgaggtgtactgccacatcgctccgttcgtcagcaacgcgtccaggccgctaccgaggttctcctgcggcggcgcgagtccgacggaagaagagcccggctggtctactacgacgtacgcgtccaccacgctgggctggcccggcggcaggacgaccccctgcgactgcgatgcgccggcaaagaccggcggcgagggggagacgccgttgtcttgctcgctgccgtcgactttccgcttctggaacaccctgcacagcacccagtcctccttcggtggcgtcgtacgcggcgagtcgaggcggaactcgtgcatgacccagcatgacttgacgccgctgggggcacggccctggnagaagacagcgtcttccgcatgccgacgacgacgggc

SEQ ID NO: 8379 - DNA, 659 bp, Zea mays
  Predicted polypeptide sequence is orthologous to G522, G1453
ttttttttttttttttgccaaatcagtgctgaagctccttagcttcagctgttagctaaccttattattaacaccagacattatgccaacttatgcatggacgtgtgacctactcggttacactttgttatgcacataccattctactataccatgacacatgaatcagttggctactttatatactacgttacattacatccagcacgcctcaatgttattaactgtgtaatgagggaataatgcactagtccagtgatttagtgcgtatgtgaatatgtattaccattgacgctgttatttccacaaatcattgtcccctccacaggaggctgacgttgacacgtagtccaaggcctcttctttctcttcagactgctgaatcacctgcagtgccggattggagtagttattagctgaatccttattaggggtgatgtctccgtggctaagctgggacgccatgaacttgtcgagagctcgccaatctgtgtccccgccagtcgccagatagagaggctcggcctgaagctcctgcagggtgtagcgaggggcaccatgctcctgtgtaaggccgcatgctggctggagagtagtgtctacttggccaataaggtcagggagcttggggctctccagctgagggagctgctgcagga

SEQ ID NO: 8380 - DNA, 681 bp, Zea mays
  Predicted polypeptide sequence is orthologous to G522, G1453
gatgaaaattacaatcacatttgttggcaaacatacaaagggaaagtagtcaaggaaaaaaaataaaagagagaccaactttcagctataaccacataatatatgacacgcaccatcccatggacgcatgcatgcatgcatccctccgcgccacaccatgcacgcgggcggcgcgccggccgtccgcgcccgccactcatttgtcgaacacacacagtccaaagtcgccgtcctccccggcggccgggccgagcagccccgtccacctctccgcctcgtctctcccgtcgctgttgaggaacagcaatgccgccatgtcatcatcctcaacgtggtccagctgggagcccacgttgctggcggcggccgtcgacgacgctgccgccgcctccaagccgcactccgccgcggggctgagctgcgacgcgacgaacttgtcgagcgccctccagtccgtggccacttcatcagcccgcgccttcttgcccggccgccggccgctgtcggcggcgtccacaacctcatcagaggctgacgccgcctggctcttgttggccggcgccgacgggctctcgagctgcggcagctcgaccaggtggctggaggagtactgcagcagcgcggcggcggcgccgccgtccagctcgccctcctgcttgaagcgcgcgctcttgttggact

SEQ ID NO: 8381 - DNA, 1782 bp, Zea mays
  Predicted polypeptide sequence is orthologous to G525
ttcggtacgaggacaactcgctagctctgcatcatccgtcgttctggtgagcgagcgagcgagagacctagctagactgaccggcggccgccggcaggccgagaacgaagcgtttgtgcatgtatgaaagtttcgatttttatactgtcgtctacgaattgttccttgatatatgggtgttgttagtgcttcatcgatctgatctcagtgaaggagcaggagccatggcggaccagcagcagccacagcagcagccgcaggagatggacgttgaccgtaccggtggcctcgaactgcctccagggttccgcttccacccgagcgactttgagattgtcagccactacctcaagaataaggtgcacgacagggactacagctgcatcgccatcgcggacgccgacctaaacaagaccgagccatgggacctcccgaaagttgcaaagatgggcgagaaggagtggtacttcttctaccagaaggaccgcaagtacccgacggggctgagggcgaaccgggccactgaggcgggttattggaaggcgaccggcaaggacaaggaggtctacgatccccttgcagcggaagggctgctgctggtcggcatgaagaagacgctcgtgttctacaaaggcagggctcccaggggtgacaaaaccaactgggtgatgcacgagtacaggctcgaaggcagcggtaggctccctgctagtcctgcatccgcatccggctcagccaccaacatcgctgcggccatgatgaaagcttcagcttcggcttgcaaggatgagtgggtggtctgtcgtgtgttcaacaagaccaccgggatcaagaagacggctgcgccggcataccaggtggccatggccggtgctgagatggatcagaatcagaacaacattccggccatccccatccccatgccgctgcagctgccactgcccgtgcccatgcagatgcaatttcccatcctgccagattttgtcatggacccggtggccccctactaccccaacccaaatgccggcgccgggatgatgccgcctatggcggccggtattggcggcgccggcgggctccagatcaacggcgccctgttcggcaatccgatgcccgcgccgctgccgatgaacttctaccaccaccagatgggcatgggggcagcagctggccaggtggacatgggggcagcggctggccagatggacatgggagcagctggcgctggcgctggcggcttcgacgttgcagcgccggagagtaggccgtcctcgatggtgtcacagaaggacgaacaggctaatgccgccgagatctcgtcgatgatgtctgtgaccggcccagggtccgcgaccaccaccatagagatggatggcatatggaagtacaagtactgaaaaagtggatatggagtttggagacaaatgcatgaattcgcatgaatatgcatgttatatctactatatctgcattgcattttgtgaaaatttgcatggttcctatatttctgcaataactagtcggtaagatatgtgtgtgcatgcatgtgctagtatatacatgcattgtatcattgcatgtgtggtatatgtgtgtgtcgtttggtcttagtaatccggggcatgatggtacccatacctggatttacatctgcttgggcgtgctgatgttgtgttgtaatttgtaaaaagcagattgaagttcggtacagtatattatcgtgaacctatatatattatacttgtgtgaaaaaaaaaaaaaaaaaaccgagactagttctcc

SEQ ID NO: 8382 - DNA, 894 bp, Zea mays
  Predicted polypeptide sequence is orthologous to G525
actccactcccgcggaaaaaaaacccatatccctccggcataaacccaaaaagctgcaagcagtgtgaccaaaagcaggcctgacggcgatcctcggctctctagccaggcagcaggagatggagcacgacgtgcaccaccagcaccagcaggccatggagctgccgccggggttccgattccaccccaccgacgaggagctcatcacgcactacctcgccaggaaggccgccgacgcccgcttcgccccgcgcgccgtcggcgaggccgacctcaacaagtgcgagccatgggacctgccatcccgggcgacgatgggcgagaaggagtggtacttcttctgcgtcaaggaccgcaagtacccgacggggctgaggacgaaccgggccaccgagtccggatactggaaggcgacgggcaaggacagggagatcttcaggagcaaggccctcgtcggcatgaagaagacgctcgtcttctacacggggagggcgcccaggggaggcaagaccggctgggtcatgcacgagtaccgcctccacggcaagcacgccagcagcagccgcctcatgccgtcgtcggtcagagctggcgcgtcaaaggacgagtgggtgctgtgcagggtgttcaagaagagcatcgagccgccgccgtcagtgggcaagaggtcgtcggtcgcgtgcacggggacgatggtggtggaggacgtcgtgggaccgccgtccatgtccatggaggacgacctcaccgcgtgcgcgctgcctccgctgatggacgtgtccggcggtggcggcgccaacatggcggcggcgtccatcgagctgctggcgccaccggcaccacacgtgacctgctttctcaacgcgctggagggccagttcttcctgaacccac

SEQ ID NO: 8383 - DNA, 853 bp, Zea mays
  Predicted polypeptide sequence is orthologous to G525
cacttgaatccgtgcctgctctaatagaggctctgcaatggagcaggagccgcaccggcccatggagctgcccccgggcttccgcttccacccgaccgacgaggagctcatcacgcactacctggcccgcaaggccgccgacgcccgcttcgccgcgctcgccgtcgccgaggccgacctcaacaagtgcgagccctgggacctgccatcgctggcgaggatgggggagaaggagtggtacttcttctgcctcaaggaccgcaagtacccgacggggctgaggaccaaccgggccacggaggccgggtactggaaggccacgggcaaggacagggacgtcttcaggggcaaggcgctcgtcggctccaagaagacgctcgtcttctacacggggagggcgcccaggggagagaagtccggatgggtcatgcacgagtaccgcctccacgccaagctccacggccacggccacggccacggccaaggcgcagccgtcgtcgtcgtccccaaggccgccgggaccaagaacgagtgggtgctgtgcagggtgttcaagaagagcctcgtcgtaggtggtgcagctgcagcagcagcaccaaccgcaggcaagaggggcggcacggagacgtcgtccaactccaagacgggcgacgtagcggccatctcccacctccctccgctgatggacgtgtccggctccggctccggcgccgccgccgcggcggcggcacacgtgacctgcttctccgacgcgctggagggccagttcttggaccagacgacgaccacgccgccgccagaagccgccgcccgcgccacggacgacgacggccacctcggcgccctcgccgcc

SEQ ID NO: 8384 - DNA, 710 bp, Zea mays
  Predicted polypeptide sequence is orthologous to G526
tcttctgccacaaggatcgcaagtacccgacgggcacgcggaccaaccgcgccacggagattccctactggaaggccaccggcaaggacaaggagatcttcaggggccgcggcgtcctcgtgggcatgaagaagacgctcgtcttctaccgcggccgcgcgccgcgcggggagaagaccggatgggtcatgcacgagttccgcctcgagggcaggctcccccagccgctcccgcgctccgccaaggacgagtgggccgtgtgcaaggtgttcaacaaggatctgtttgcggcgaggagcgagccattattggcggcggccggcgcggcggagctccagcgcgtgggctcgctgggcttcctcaacgagctcctcgactccgcggagctgccggccctcatcggagccgacgtggacgaggtgatcgacttcaagggccccgcccccgcgtccatgccggacgcgagctacctcccggtgaagatggaggaggagcacgcgctgctgcagatgcagcagtgccagtaccagccgccgcccccgatgttgtacccgagccagtacttctctctgccggcgatgaactccggccacctccctccggcgatccggaggtactgcaaggcggagcagcaggtggtctcggcgcagacggcgtcggtgatcagcccgtcccgcgagaccgggctcagcaccgaccccaacgcggcg

SEQ ID NO: 8385 - DNA, 1516 bp, Zea mays
  Predicted polypeptide sequence is orthologous to G526
tgactgactgtaataccagagatcgaaccctatggagctgcagctcaagaagagagtttttgtgcatttgggggccgggggcaagagagagagagagagccatggcggcggaccagcagccgcagctgcaggaggagatgaacgacgctgccggcggcggcctcaggctgcctccagggttccgcttccacccgagcgacttcgagattgtcagcttctacctcaccaacaaggtgctcaacacgcgcttcacctgcaccgccatcacggaggccgacctaaacaagattgagccatgggacctccctagcaaggcgaagatgggcgagaaagagtggtacttcttctaccagaaggaccgcaagtacccgacggggctgagggcgaaccgggccaccgaggccggttactggaaggcgacgggcaaggacaaggaggtctacaacgccgcggaaggggtggcggtactggtcggcatgaagaagacgctcgtcttctacaggggcagggctcccaggggtgacaagacaaactgggtcatgcacgagtacaggctcgaaggcagcggcaggctccccgccggcctcgcgtccgcaaccggctcagccgccgccaacgccgcggcggccttgaaagcttctgcttataagcaggatgagtgggtagtgtgtcgtgtgttccacaagaccactgggatcaagaagaccactgctgcaccggcgtaccaggtggccatggccggcgctgagatggatcagaatcagaacaacttcccgggcatccccttccccatgccgatgcaatttcccatgctgccagacttctccttggacccggtgcccccctactaccccaacgccgctggcgcggggatgtcgatgcttcctatggcagcaggtataggtggtggcgccggtgggttccagctcaacggcgccgccctgttcggcaatccgatggccgcgccgcagcccatgagcttctaccaccagatgggcgcggcggggacagcttgcgctggcggcttcgatgtttctgcgccggagagtaggccgtcctcgatggtgtcgcagaaggacgaccaggctaatggcgctgagatctcgtcgatgatgtccgtggccggcccagggcctgcgaccaccaccaccatagagatggatggcgtgtggaagtactgaaaacgtggagggtggagggcaaagacatgaattcgcataaattaaatatgcatgtaatatctatatctgcattgcattttgtgaaatatgatgcatgcatggtttgtatattccgtaataaccagtagttggtaagctatgtgtgtgtatggatgtactagctagtacatgcaccgtatcattgcatgtgtggtatatgtctcgtttggtgttagtaatctgcttggttgtgctgatgactgatggttgtaagaagcagattcgagtttggtacaatattatcgtgaacctatatattatatatatgttaattatagtaaaaaaaaaaaaaaaaa

SEQ ID NO: 8386 - DNA, 1041 bp, Zea mays
  Predicted polypeptide sequence is orthologous to G536
gagaatgtttacatggccaagttggctgagcaggctgaaaggtatgaggagatggttgagtatatggagarggtggctaagactgtrgatgtggaagagctcactgttgrggagcgtaaccttctgtctgttgcatacaagaatgtgattggggctcgccgcgcttcatggcgcattgtttcttccattgaacaaaaggaggagtcccgtaagaacgaggagcatgtgaatcttatcaaggaatatcgtggcaagatcgaggctgaactgagcaatatctgtgatggcatcttgaagctgcttgactcccacctagtgccttcttctactgctgctgaatcaaaggtcttctacctcaagatgaagggtgactatcacaggtatcttgcggaatttaagactggtgctgagaggaaggaatctgctgagagcacaatggtggcctataaggctgctcaggacattgctctggctgagctggcacctacccatccgataaggctgggacttgctcttaatttttcagtgttctattatgagattctgaactccccagacaaagcttgcaacctggcaaagcaggcgtttgatgaagctatctctgagttagacagccttggtgaggagtcatacaaggatagcactctgatcatgcaactcctgagggataacttgaccctttggacatccgacctcacggaggatggtgctgatgagggcaaagatgcccagaaaggcgatgcaggcgagggacagtaatcttcggagggggtgcaaagttgttcgagccccaatgttttagatgctctatgctgtcgaagttgtgctgtgccattattgtagctgatttcgtctccattcacttctttttccttgttagtaggctggtattggtcgaattagtaccccattgctttgtgttgccgctagtccatgtggactggtattgttcccctggatttatttggcaagcgtgtccgtgctcgctctagcgttttattgagcttttaaagtcatcgcattctttttcgattgcaatca

SEQ ID NO: 8387 - DNA, 882 bp, Zea mays
  misc_feature (467)..(484): n is a, c, g, or t
  misc_feature (543)..(569): n is a, c, g, or t
  misc_feature (841)..(878): n is a, c, g, or t
  Predicted polypeptide sequence is orthologous to G536
tcccatccgccggcggcgccgagtccaaggtcttctacctcaagatgaagggtgactaccacaggtaccttgctgagttcaagtctggtgcagagaggaaggatgctgcggagagcaccatgaatgcctacaaagctgctcaggacattgctcttgcagatctggctccaacccaccccatcaggcttggcctcgctctcaacttctcagtgttctactacgagatcctgaactcccctgatcgcgcctgcaaccttgcaaaacaggccttcgatgaggcgatctctgagctagacagcctgggagaggagtcctacaaggacagcactctgatcatgcagctcctgcccgacaacttgaccctatggccttccgacaccaacgaggatggcggcgacgagatcaaggatgctgctgccccgaaagaatccgcggagggtcagtaagatggattcagtctcacgacnnnnnnnnnnnnnnnnnnaggagtgaccagaaccagaaccgccgtcctcgattctgatagattatcttctagtatannnnnnnnnnnnnnnnnnnnnnnnnnngtcgcgccggtgtatgcgatgaatgtgccttatgaagttttttaattaagcattctagatgttataccgcatgctttgtttcggtttctatgtcgataaatggtggccggatgctggttttcgtgctccgagccggccaccaggaagaagacctgcctgcccttgtgggtgcagcgttgttagaatgacctacggtgtatttgactttgacaggcctgctgcctagtggactgatattctgttatgcgcaaagctatttggcttgatgtctnnnnnnnnnnnnnnnnnnnnnnnnnnnnnnnnnnnnnncccg

SEQ ID NO: 8388 - DNA, 1900 bp, Zea mays
  misc_feature (30)..(59): n is a, c, g, or t
  misc_feature (127)..(131): n is a, c, g, or t
  misc_feature (333)..(338): n is a, c, g, or t
  misc_feature (425)..(449): n is a, c, g, or t
  misc_feature (484)..(489): n is a, c, g, or t
  misc_feature (572)..(576): n is a, c, g, or t
  misc_feature (1612)..(1615): n is a, c, g, or t
  misc_feature (1878)..(1899): n is a, c, g, or t
  Predicted polypeptide sequence is orthologous to G536
attcgccgacgacgcacgcggaggttcagnnnnnnnnnnnnnnnnnnnnnnnnnnnnnngtctcctgctgtcttgatttcgggtcgctgctgtttcgatcccctttccttcctgacgatttgcttannnnngcgttggatttgtaacctaaacatctcgtttccgcaccgttttggggccgcgtctactggtggttgggtccctttagatcgagtaggcgcgaggatggggacacatccccgattgatctgacgtgatacgcgtacggatccgtcaaagcctctactccagtataaccagatgattatgtgtcatgcttattaagcggcgtgnnnnnnaccgctggaagttcgtacataggtactcagatctgtcccttttcaaggttagaggaagtgttggaagctaggatacatggtttcagnnnnnnnnnnnnnnnnnnnnnnnnnaggcaaaattcgccaagcaaatactctagtactcnnnnnncatacagttaatgataaattgccgttacctgaccatgaatttccgtgatttatgctgagaattttgcattacccctggaaatnnnnngtctgaatttgactagctagtacctattcgtgccacagatcaataaagtgttgtcccatatattgatgtatatttgcagatccggcgtactgcaaattttgaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgcgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccaaggtcttctatctcaagatgaagggtgactactacagataccttgctgagttcaagactggagctgagagaaaggacgctgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgctgaagagattagggaggcgcccaagcgcgactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtcggtaaaatttnnnngctccccgtatgagatgctgccgggcaaggcctcggtgtcccacctcgtttcaggcgtgggacgctggagcctggtctggttgggttgggaagccctttaaactgttgtcacttgcattttaccttttccatcgctgtttattgtgagtggtcctaaatctatggctcgtctcagtggtctagtatatgttttcttggtttctcttgattcctcacacggtgagtgggaccgttcgcatttgtctgtcccatcccatcttaannnnnnnnnnnnnnnnnnnnnnt

SEQ ID NO: 8389 - DNA, 1253 bp, Zea mays
  misc_feature (1246)..(1246): n is a, c, g, or t
  Predicted polypeptide sequence is orthologous to G536
gcagaggtgaagtgagactgcggatgggccctctcggcccaaacgccgacggcattggcgcgttgaccgcacgacctgccgattccttcgagcgatatagggcgcccccgtccacaccacccctcgtctccgccctagcgccactgagccactcgacgtcgagatcgagacgacccgagtccgccgcgcccgtgcaccaccgaccgtcgaactcccgaaagtaactctatttcttgatcaacatcaacatgtcgcgggaggataatgtttacatggccaagctggctgagcaagcagaacggtacgaggaaatggttgagtacatggagaaggtggctaagaccgtagatgtggaagagctcaccgttgaggagcggaacctcttatctgttgcctacaagaacgtaattggggcccgccgtgcctcatggcgcattatctcctccatcgagcataaggaggagtcccgtaagaatgaggaacatgttattcagatcaaggagtaccgtggcaagattgaggctgaattgagcaacatttgtgatggtatcctgaagttgatcgactctcaccttgtgccttcctccactgctgcagagtcgaaggtgttttacctcaagatgaagggagattatcacaggtaccttgctgagtttaagactggtgctgagaggaaggaagctgcagagagtacaatgatagcttataaggcagctcaggatattgcgttggcggaactggcatctactcatcccataagacttggacttgcacttaacttctcagttttctattacgagattctgaactctccagacaaagcttgcaaccttgccaggcaggcgtttgatgaggctatttctcagttggatacgcttggcgaggattcatacaaagatagcaccttgatcatgcagctcctgagggacaacctaaccctatggaccgctgacagcacaacggaggacggcatcgaggagggcaatgaggcctcgaagggtgatgctggtgagggtcagtagtctggtaaaacctcgattgatggttcggcatgtttttgaagtctactgtgttggaaaccatgttctaatagaaggcgtctcccgctccatgcattccaagattctgtcctccccctccctccccccatgttgtaggctggtagtggtcaaattagttggccctgggtccatttggactgatgtattgtttactgctattgaagtcattcgttctcgttttgctnaaaaaaa

SEQ ID NO: 8390 - DNA, 1470 bp, Zea mays
  Predicted polypeptide sequence is orthologous to G536
gcacgaggtgcacaccaccctcgtctccgcgcccgcgccactcacatcgtgatcgagacgacccgcgtcctccgcggtccgcgcccgcgcaccatctcgcctcgcattcccgaaagtgttttttttttgttattgcagtatctgtattccttgatcaacatgtcgcgggaggagaatgtttatatggccaagctggctgagcaagcagaacggtacgaggaaatggttgaatacatggagaaggtggctaagaccacagatgtgcaagagctcactgttgaggagcgtaaccttctatctgttgcctacaagaatgtgattgcggccccccgtgcctcatggcgcattatctcctccatcgagcagaaagaggagtcccgtaagaatgaggaacatgttgcacagatcaaggaataccgtggcaagattgaggctgaattgagcaacatttgtgatggtatcctaaagctgcttgacacgcaccttgtgccttcctccactgccacagagtcgaaggtgttttacctcaagatgaagggtgattatcacaggtaccttgctgagtttaagactggtgctgagaggaaggaatctgcagagagcacaatggtagcttataaggcagctcaggatattgcattggctgaactgccacctattcatcccataaggcttggacttgcacttaacttctcagttttctattacgagattcagaactctccagacaaagcttgcaatcttgccaaggaggcgtttgatgaagctatttctcagttggacatgcttggtgaggattcctacaaagatagcaacttgattatgcagctcctgagggacaacttgaccctctggacggaggacggcattgaggagggcttagaatcctctaagggcgatgctggtgagggtcagtagcctggtaaacttagattgatggttcgacgtgtttctcaagcacatcgtgttggacgcccagtgctgacaaaaggcttttgctgctccatgcattccaagcttctgccccctcgttcgcaccctctttatgttgttggctggtagtggtcagatttagtcccattggtttagttggccctgggtccatctgaactgatgtattgttactgctatggaagtcattcctttagttttgctctggcagtggattgctgttgggtcgtgttttcagtctttattggttccgatcggacgctgttgcggcaaaccacccctgtagatactcttcacatgctgaagaaaactaccagcagccgtttagcctgaataattgctaaatgataggttaccgatgaggctgattggtttttatttttttttaccctgtgacatcaagttcttgggtaactttttttaccgttgatgctcaaacaaattgttaagtgggagaattgtgaagtgggagtggtaatggatcatgatctaaatgattcttcacaattcattgaaacc

SEQ ID NO: 8391 - DNA, 1323 bp, Zea mays
  Predicted polypeptide sequence is orthologous to G536
gcacgagtattgccgagcacagcacagcacagcacaagcacgccttccgttttgggaaggcgaggagaggggaaccccggcccagggagagttgtggggaggggatcggcggcggaggagatggaggagcgggagaagctcgtgtgcctggccaagcttgccgagcaggcggagcggtacgacgatatggtggaattcatgaagaatcttgctaggatggacgtggatatgagtgctgaagaaaggcatttgttctcagttggtttcaagaacactattggagcaaagagagcatcatggagaatcatttgttcacatgagcaaaaggtcgcagctgatcgtcagactggtgtgatgatagatgcctataagaagaaagtagaagaggaactaaggaaggtttgcaatgaagtattgtcagtcattgctattcactgccttcccttggccagtacgggtgaaaatatcgtattcttttataagatgaaaggtgactactaccgttacttggctgaatttagcactggaactgaaaagaaagctgcctctgatcagtcacttatggcctatcagcatgccatggttgtcgcctccagtgagctctcacctgctcaccaaatccggcttggccttgccctcaatttgtcggtcttcttttatgagataatgaactctcatgagagagcttgccaagtggcaaaacaagcatttgatgaggctcttactgagataaattctggtgagggagtttacaaggatagcacacttatgatgcagcttctgaaggacaacttagcattgtggacatcagaactaactggaggtgaagcatccaagggtaacgacgatgtcgacatggagggttgatacattctccatgttttaaggaaacacagaacgcacgcaaaaatatccaggctgtgatgctagcgaacctgggtcctcaagttttttctgcatcggaactaagaagagccttgtgtatttttctgaagtttctgtccgtctcggggttttttttttgaggtctgttcctctcttttggccatcgtttggtcctggagtcagtcactcactaccaagtgtttcagaggtctgaactggtgagcatccagatctgttgttgctttttttttcatgtgcttcagaggcatctttgtacaccgatggaaaactgtttctcttatcaacgcatagactgtcagtgctggtactaatcatgttcggtgactgaagcgtctctgtaatgttgagatcgatcataaacaactccaccaaattatgtaaaaaaaaactggtctgaagatgcttcgtcaatgacat

SEQ ID NO: 8392 - DNA, 1261 bp, Zea mays
  Predicted polypeptide sequence is orthologous to G536
ctcgtgccgaattcggcacgagagttccccgaccacaccgttcctccgagcccaggagcagccccgcgccaggaggaagtttgttcttttaacaatatgtcgagggaggagaatgtttacatggccaagttggctgagcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggaatcttgaagctgcttgactcccacctagtgccttcttctactgctgctgaatcaaaggtcttctacctcaagatgaagggtgactatcacaggtatcttgcggaatttaagactggtcctgagaggaaggaatctgctgagagcacgatgatggcctacaaggctgctcaggacattgcgctggctgagctggcacctacccatccgataaggcttgggcttgctcttaacttctcagtgttctattatgagattctgaactccccagacaaagcttgcaaccttgcaaagcaggcgtttgatgaagctatctcccagttagacacccttggggaggagtcatacaaagatagcactctgatcatgcagctccttagggacaacttgaccctttggacctctgacctcacggaggatggtgctgatgagggcaaagaagccccgaaaggtgaggctggtgacggacagtaatcttgggagagcgcatattgttcgagcccattgttttagatgctctatgctgtcgaagctgaagctgtgccgtgctattattgtagctgatttcctgttccctcacttctttttttatattagtaggctggtagtgttcgaattagttccccattgctttgtgttgccgctagttggcattaagtccgtgtggactggtattattcactggatttgagaagcatgtcagtggttgctctagcgttttattgagttttgaagtcatctccctcatttcggtttcaatcatttagcagattgtgcatatggttgtgtaaaacacagttttgcacaattgcacaatttacgtagtgtggtttgaaataagagtgagatttgggctggatgaaaaaaa

SEQ ID NO: 8393 - DNA, 1622 bp, Zea mays
  Predicted polypeptide sequence is orthologous to G536
gcacgagctcaaaccaaaaattcaagagtgggctcaatggcattcaggtggaactgcaggctactgatgcaagtgaaatcagccttgatgagatcaaggatcgggcccgcaaatcatcaagcagtctttcacagcaccaagtctataatggcatacaaatccacagtagtaggccgagtccatgatgcatgatcatgatgcctagcgaaacgcgtcgcttccgctccacaggatcctctgcgccacccacaaccgtgcgaccgtccgtgctgccggcgaccccgatccgccgacccgtcccgtcccaccacaccctaccgccgctcgcagctatgtcgccgtcggagccgacgcgggaggagagcgtgtacatggccaagctggcagagcaggcggagcggtacgaggagatggtcgagttcatggagcgcgtcgcgcgctccgccgggggcgccggcggcggggacgagctctcggtggaggagcgcaacctgctgtccgtcgcctacaagaacgtcatcggcgcccgcagggcctcgtggcggatcatctcctccatcgagcagaaggaggaaggccgcgggaacgaggcgcacgccgcatccatccgcgcctaccgctccaagatcgaggccgagcttgcccgcatctgcgacggcatcctcgcgctcctcgactcccacctcgtcccatccgccggcggcgccgagtccaaggtcttctacctcaagatgaagggtgactaccacaggtaccttgctgagttcaagtcaggtgcagagaggaaggatgctgcggagagcaccatgaatgcctacaaagctgctcaggatattgctcttgctgatctggccccaacccaccccatcaggctcgggcttgctctcaacttctcagtgttctactacgagatcctcaactcccctgaccgtgcttgcaaccttgcaaagcaggcctttgatgaggcaatctccgaactagacagcctgggagaggagtcctacaaggacagcactctgatcatgcagctcctgcgtgacaacttgaccctatggacttccgacaccaacgaggacgccggagatgagatcaaggaagcagctgctgcccccaaagaatccgcccccgagggccagtaagacggatccgatctcccgacctgatgcgtgtctgctgatgtcggggagtttaccaggactgtgccgttcttgatttctgatagcttatcttctagtacacctcgtgttgttctcttcgtcacggcgccggtgcgtgtgcgctgaagctgcctgccattgccattgccgctgtttttaattaagcacacactctagatgttatgcccgcatgctatgtttcgattctcaaagttgataaatgatggctggatgctggttttcgtgctccaagcctgctgcttcttccagggaaaaaaagacctgcccttgttgcagcgttgttgtttagaatgacctatatttgactggtattctgttacggtggctttgcaaagctgtttgtttggtttaatgtctcggaataatatgaattggctgcattggacgtgtgtgtttcttttaaaaaaaaaaaaaaaaaaaaaaaaaaaaaaaaaaaaaaaaaaa

SEQ ID NO: 8394 - DNA, 1194 bp, Zea mays
  Predicted polypeptide sequence is orthologous to G536
cgacggagcccttcgcacgcagagccgcagagatccgtcacactgcaacttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccaaggtcttctatctcaagatgaagggtgactactacagataccttgctgagttcaagactggagctgagagaaaggacgctgctgagaacaccatggtggcatacaaggctgcccaggacattgctttggctgagcttgctccaactcaccctattaggcttggactggcactcaacttctcagtgttctactatgagattctcaactcacccgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgcggaagagatcagggaggcgcccaagcacgactcgagcgaggggcagtaaagccggctttacgtgcctagaagctagtacctagtgtttgctgctgtctaatgacactatgcaatgtgatctggaccctggtttcttgggtgcgacgcttgtagcaccagtgttatgattatccctcgggaaaatttgggggctccccatatgagatgctgccgggcaagacctcggcatcccacctcgtttcaggcgggggacgctggagcgtggtccggttgtgttgggaagccccttaaactgttgtcgcttgcattttaaccttttcatcgccgttcagtggtcctaaatctatggctcgtctcagtggtctagtataaaaaaaaaaaaaaaaa

SEQ ID NO: 8395 - DNA, 725 bp, Zea mays
  Predicted polypeptide sequence is orthologous to G536
ttttttttagtagtcaccataccacatttgattattgccaataggatacactaacagtaacagtaacagggttccacaatagcagtataacaacaaaacgaaaggtcgacgattgaaggaaaggacacacgaaaatggtccttgtacaagcatggcatggcatggcatgatcgatggagatgtttggctactactgctcctcgtcaggcttgtttgcatcccgcatttcatcgccaccatcctcctgcatgtcagaagtccacaaggtgaggttgtcacgaagaagctgcatgatgagtgtgctatccttgtacgactcttccccaagactatccagctctgaaatagcttcgtcgaaggcctgcttggccagcgagcaggcgcggtccggcgagctgaggatctcgtagtagaagacggagaagttgagggcgaggccgagcctgatgggatgcgtgggcggcagctccttgacggcgatgtcctgcgcggcctggtaggcggcgagcgtggagtccgcggcgtccttgcgctcggcgccggtcttgaactcggcgaggtagcggtggtagtcccccttcatcttgaggtagaagaccctggcgtccacggccgccgccgccggcacgaggcgctcgtcgaggaggcgcaggatccccgcgcagatcccggagagctcggcctcgacgcgcgcgcggtaccccctggcggcggcggcgtgcccc

SEQ ID NO: 8396 - DNA, 665 bp, Zea mays
  Predicted polypeptide sequence is orthologous to G536
tttttttttttttttttggaaatgaaatatgctgtgaacattgggtatttagaataactgttcaaaaaacaaaacaattgaattgttgctcaaatgtattgcatcgttagggattagccaaaacaacacttatgataaaatacacatggcaagcagtacaacaacaacaataagaccaaccaaagagcaataacacaaaaggagtgccaatttatgctattggatgaattaattaaatgcaacaaatgtgaaaaggagaatgcgtgatcagctttttggttgttgctgcgagtgagtccctttcattcgttggctttgccggtttggggagaccacgagcaagatcaggagagttgagaggttaagcatcagccaaagcctaataggataagggggccaactcctccaaagcaatatcctgtagtaatcacccttcatcttgaggtagaagaccttggactttggaactattaatgaggggggaaggtgggaagcaaagagcttgaggattccaacgcagatcttgttgagttcaacttcaatcctgttatggtagccctccatgagagtggcacggtccatgttgacacaaccttattccctatactcaatggaggatacgatgcgccatgaagcacatcggattccaattacattcttgcaag

SEQ ID NO: 8397 - DNA, 466 bp, Zea mays
  Predicted polypeptide sequence is orthologous to G545
atggatcttcacctggcaaagccaatatcgcggaagaagatagtggacgctgttcgcagtgtctgcaaatgtgagaattgacaaagcgtttctgcatcgggtgaagaactctcaggaaaccagtggtttcattgactaggatggcgatgatcagagctcacaacatccatctggtcattatatagttagcactggttcaggaagctctcttgttttctgttggctgtggcctgcagggctgtcactttggcctgcactgaggtgtatcagatatctgttttcttttctataaacatctcttgaagtttctggtctcgtatgtatttgcgcttcaggaaatgctggccagttgatctgagtgcctacattcttatgataatatatgctctggtattatctacagttcagtagttcggcacttgaaaatgacgccgattgatcgcaaaaaaaaaaaaaaaaaaaaaaa

SEQ ID NO: 8398 - DNA, 637 bp, Zea mays
  Predicted polypeptide sequence is orthologous to G546
ttttttttttttttttttttttaccgggaacttactgagttcaataattatcggttgtgtgaagtaatcttatcttatatacatcctatatacatgtggaatacatctgctacaccggaggctgtgggtcgttcgaaggcacttccttcgtaggcagaaccgtggccctacacagaggacacgtggagtgagagtgcagccacatgtcgatgcagcagacatggaacaggtgagtgcacgccggcagccgcctgacaacctctgccttcctgcacaaggctcaggcacaccgcacactgcgcccacccgcgcccgctgccgctgccgctgccctcgccacggccggagccgccgccaaccggcaggcccctacggaacacgaacgacggcagcgtggacaccgcggaggggctcagcccaccgtcgccgtcgtcggtggtgctcggcaggaagaacggccgggccgccacgtacacgacggttccccccgggccacggcggcggcggcggcagcacaggcattcgcagaggacgatgatgaggacggagacggcggtggcgcagaagccgatggcgaggagcacaagcgtgtcgtgcgtgctgtatccgcccttgtccgtggagtatggcatcgagt

SEQ ID NO: 8399 - DNA, 1323 bp, Zea mays
  Predicted polypeptide sequence is orthologous to G549
ctcacacgcgcgcgagccgagagagcatggatcccaacgacgccttctcggcggcgcacccgttccggtgggacctcggcccgccggcgcacgccgcgcccgcgcccgcgcctccgcctccgccgctagcaccgctgctgctgccgcctcacgcgccgcgggagctggaggacctggtggccggctacggcgtgcgcccgtccacggtggcgcggatctcggagctcgggttcacggcgagcacgctcctcggcatgacggagcgcgagctggacgacatgatggccgcgctcgcggggctgttccgctgggacgtgctcctcggcgagcgcttcggcctccgcgccgcgctgcgcgccgagcgcggccgcgtcatgtccctcggcgcccgctgcttccacgccgggagcaccttggatgccgcgtcacaagaagcgctgtccgacgagcgcgacgccgcggccagcggcggcggcatggcagaaggcgaggccggcaggaggatggtgacgacgaccgccggcaagaagggcaagaaaggggtcgttggcacgaggaagggcaagaaggcgaggaggaagaaggagctgaggccgctgaacgtgctggacgacgagaacgacggggacgagtacggcggcgggtcggagtcgaccgagtcgtccgcgggaggctccggggagaggcagcgggagcacccgttcgtggtcaccgagcccggcgaggtggcgagggccaagaagaacgggctcgactacctcttccacctgtacgagcagtgccgcgtcttcctgctccaggtgcagtccatcgctaagctgggcggccacaaatcccctaccaaggtgaccaaccaggtgttccggtacgcgaacaagtgcggggcgagctacatcaacaagcccaagatgcggcactacgtgcactgctacgcgctgcactgcctggacgaggaggcctccaacgcgctgcgccgggcgtacaagtcccgcggcgagaacgtgggcgcctggaggcaggcctgctacgcgccgctcgtcgagatcgccgcgcgccacggcttcgacattgacgccgtcttcgccgcgcacccgcgcctcgccgtctggtacgtgcccaccaggctgcgccagctctgccaccaggcgcgggggagccacgcccacgctgccgccggactcccgccgcccccgatgttctagcgtgcgtcgtcgatgtgtgcctgcaccgtcgccgtacgtctcacagttcctttttcttttagagtgtgaaccaccatggaaaattggattccctctcatatgatgttgccacttctcagtt

SEQ ID NO: 8400 - DNA, 892 bp, Zea mays
  Predicted polypeptide sequence is orthologous to G549
ttccacaccgggagcacattggacgccgcgtcacaagaagtgctgtccgacgagcgcgacgccgcggccagcggcggcttggcggaaggcgaggccggcaggaggatggtgacggccggcaagaagaagggcaagaaaggggttggcgcgaggaagggcaagaaggcgaggaggaagaaggagctgaggccgttggacgtgctggacgacgagaacgacggagacgaggacggcggcggcggcgggtcagactcgacggagtcttccgctggcggctccggcggcggggagaggcagcgggagcaccccttcgtggtcacagagcccggcgaggtggccagggccaagaagaacgggcttgactacctcttccatctgtacgagcagtgccgcgtcttcctgctgcaggtgcagtcccttgctaagctgggcggccacaagtcccctaccaaggtgaccaaccaggtgttccggtacgccaagaagtgcggcgcgagctacatcaacaagcccaagatgcggcactacgtgcactgctacgcgctgcactgcctggacgaggaggcctccaacgcgctgcgccgggcgtacaaggcccgtggcgagaacgtcggtgcctggaggcaggcctgctacgcgccgctcgtcgagatcgccgcgcgccacggcttcgacatcgacgccgtcttctccgcgcacccgcgcctcaccatctggtacgtgcccaccaggttgcgccagctctgccaccaggcacgggggagccacgcccacgccgccgtcggcctccccccgcccccgatgttctagctgcgtcgtcgatgtgtgcctgcaccggcgcggcgccgtacgtctcacatcgcaggtcaggctgttccatggcgccatcgaa

SEQ ID NO: 8401 - DNA, 693 bp, Zea mays
  Predicted polypeptide sequence is orthologous to G550
cttttttttttttttttttttctttttttgacaacaagttgctgaagagtgaaatacctgaagcaatacattccttcccctaatgttatttatctacacccagggacctcttattgatctcctggtctttctcaaacccatatagctaattaattctatgtacatcctgcgtgccgcctatattacaagtccacttacacatacgctagctaagtttcccactcagcatatagatagatattacaatcctatgatgatttatataaaaacaaaattcagtacgtactgtcaggctgatcagctcatgttcagttcagaagttcagatgaaaaggaacgctgcatgaggaaattcctgctgctgctgatggatgtacttgaagaagaatcaagacccctcctggaaggccacggagcgcgtgagcgcaacggggttcgcgtgaaggagcggcgagcttgtcatcatggccttcttggtggcctcgccgcgcttgggctcgaacaccgtcccgagctgcttgctgtgcccaccggcgtggtcgtctgctgcgtcctgctgcttcgtctggtcgcctttgatcccgacgagggaccagattgagctcctggccacctcgtccacgtcgtctatccggatgctcttgggcgcccacaccttggcgttgccgccgtttctcccatcgtcaccctcccg

SEQ ID NO: 8402 - DNA, 849 bp, Zea mays
  Predicted polypeptide sequence is orthologous to G550
cacttgtcagatcttgcccgtatggtatggagctcgccggagcagcctcccctcacccgccgccggaatcccacgtggcgccgccccgcccacctccgcagccgccggaagaggatttatgtgaagatagaggggacatgagtgtcaccggcgaaaagccatgcacacatcgggaatcagatgttggtcagacaaatagttgtagccttaacaattccagtgagtgtgagaatcatacacccagcaacgacgaaatatcggaaccagagtccaatttggagatggccaagactgatcagggcggcgatgtgccgagcggagagaaggtcctgaagaagccagacaagatcctgccgtgccctcgctgcaacagcatggacacgaagttctgctactacaacaactacaacatcaagcagccaaggcatttctgcaagagctgtcagaggtactggaccgcaggcggaagcatgagaaacatccccgttggtgctgggaggcgcaagagcaagagctccagcgcgagttgccgcagcgtgttgattcccgttccaggcagcagtagtgtagctaatcctggcggagaggcttccctgtttccgttgtccgtaaaagcaaaccaagcagcagttagcttcgggcctgattcccccctctgcacctccatggcctccgtgctgaagatcggaggaggaggagagcaggttaagagctgcagccctgcctcagcagcagcacagcccaggaacggagaaacccagacccagacgtgcgcaccttcttctgctgctacaacaccatcagatggtccaggaaatggattgcagaaaggagcagagagcgcacacc

SEQ ID NO: 8403 - DNA, 686 bp, Zea mays
  Predicted polypeptide sequence is orthologous to G550
ggcaaccaaatattccaatccataatatatacaaataaggggacttgctctcattatcaattttttcctcccccgacccatatatattggctatctacaaatatctatctattgtatagtttcaatgtccgctggcagctatgagccccacctccccacctaaattaaattacatacaaccctctaatgtacaaaattctcagctgtgaatcgagcgaggctcaagacccctcctggaaggtcagtgaccgcgagagcgcagctgggttcccctgcaagaacggcaagccgctgatggctgccgagtgaggagttgccgtccttgccgcctcttcgttctgctcaaaaacccttgcgagcttgcagcctctgccgccatctttgcctgccttgtcgccgccgatcccgattagcgacaggatagagctcctggccacctcgtccacgtcgtcgatccggatcgtcttgggcacccacaccttgccatttcctttggcgcctccttcctcgtcgcggtctctagggtgctttcctggcgtgaagcagatgttggacttggtggatgctgctggagaggcggaagtaatggacgagcccgtctcggactggccggagtgaggcggccatgcgccactccaagctcctggaaccatgcaaccccagtaggcagcaacaacagctgctgc

SEQ ID NO: 8404 - DNA, 713 bp, Zea mays
  Predicted polypeptide sequence is orthologous to G550
agaacattaaccggtgccaggtaaaagactatcaacattcaacatcaattcacaggcctactgtatttacataagcgctccttgagcagtcagaatcttcacaccaacctagctatcgctagaaagaaaaaaaatgtaaatcttggccaggcctgagttgattgccaaactgctgcgcttagcgacagatcaactcaagaaaaagcttaaataggaacattgaccatcctctggtatcctttgttttgaggacactttatttttgtatcaggccctctcctgaaatgtctgaaagcgggaaaacgctgctggattggcctgcagggattctggcgtcttagtcgcactatttttcagatccttggactggaaagacttgaatatgattctgtcatcaggcttgataccaagagaggcccagatcgaactctttgctgcctcttctgggttgtcaattcggagagctttagggacccaaaacttcttttctgccttctgttcttcctgcaaattagctacccttgtatgctttcctaacaccccagagttgcttcctgaaagagctaaaccgtttggaggaagagatagtaatgtaggggcactacttccaggccatggtgcaccccatagtccacttggccagccaggaatgcagctcacgaaggctggcacgagagggaaagggaatggaacagcaggtgcacaaattcctg

SEQ ID NO: 8405 - DNA, 487 bp, Zea mays
  Predicted polypeptide sequence is orthologous to G557
tttttttttttttgccatgcaaaccatgttaaaatcaaatgcattaattccataagttctttttccctgaaccgtcggcacttggctgtctgaccccagtttttggggttccctcctttggccacaaagcaagctcaccaaatccactccatataaacatatatttatcatgattcattactatttttctcttttttcagtgctattggccgtggccctctccactagcagtgcttcctgaacctcttctgtttacagcggtgttcttcagtatctgtcggagcatctggttctcgttctggagggtggagagcctctcttccatctccgagttcttcttctccagatctctcaccttcacctccagatcagttaaataagccttcttcctctctctagcctgctgagctgacaccctgctcctcagtaaccttttgaggcgcttgcgcttcttgtcggcgtggctgcggtcgcggcggcgcgcgct

SEQ ID NO: 8406 - DNA, 511 bp, Zea mays
  Predicted polypeptide sequence is orthologous to G557
cgtgctgcgatgagcagcgcgcgggaggaggagaagaagatcaacgcggagatgaggagcaggagaagcagcaggcgaagacgagcaccacgagctcgctcccctccagcagcgagcgctcctccagctccgcttgcaacaacctcacggaaggaggtaggtgccgcgcccaacccgttgctggttaatcagctgaagttgttgctgccctgccccgcatggcaccccaggagcggagagcgacgaggagatacggcgggtgccggagatgggcggcgcgtcggcgtcggcctcgtcgggcgccggtgcggacgagcttcccaagggggaggacgacaagcaggggcaggtggccgcgcccaaccagttgctggttaatcaaactgttgcttgctttgcacctttgatttatcaggaaaaatttgaatgtttattacattcccattggacatttgttactgtttggttgcgactttgcttagcaattttcctcaggaatcttgtgtttcct

SEQ ID NO: 8407 - DNA, 893 bp, Zea mays
  Predicted polypeptide sequence is orthologous to G557
gcacgctttgacgagcaccacgagctcgctgccctccagcagcgacctgctcctccagctccgctcgcaacaacctcacggaaggaggggcggagagcgacgaggagatacggcgggtgccggagatgggcggcgcgtcggcgtcggcctcgtcgggcgccggcgcggatgagcgtcccaagggggaggacggcaagcaggggcaggtggcggcgggggcgcagcctccggcgggcgggaagaagcgcgggcgcaccgcgggggacaaggagcagaaccggctgaagcggctgctgcggaaccgcgtgtccgcgcagcaggcgcgggagcggaagaaggcgtacctgacggagctggaggcgaaggccaagggcctggagctccgcaatgcggagctggagcagcgggtgtccacgctccagaacgagaacaacacgctccgccagattctgaagaacacgacggcgcacgcgagcaagaggtccggcggcggcgccggcggcaagggcggagacggcggcaagaagcaccacctcgccaagagctagtgagaaatgagagagggagttggttcgtgccctgctcgcgctcgcctgatctgaccattgctggcgtgttgctgttcctgacgacgccttctctttttcttcttttctcctactgttacccgtgggtttcgtctcttgcctcgctgatgcactgttttaactgttagccatcccgtctactcaccagtgaacaccgctgctagttaatttctcggtggtttagggtgccgtgccagaacgccgtgtaacttcgttcttgtactgtcctgtagtccagccttgcggtttggcaattcgattcaagattactgtaaaaaaaaaaaaaaaaactcgagggggggcccg

SEQ ID NO: 8408 - DNA, 1069 bp, Zea mays
  Predicted polypeptide sequence is orthologous to G557
gcacgaggcaggagcaggagcaggagaagcagcaggcgaagacgagcaccacgagctcgctgccctccagcagcgagcgctcctccagctccgctcgcaacaacctcacggaaggaggggcggagagcgacgaggagatacggcgggtgccggagatgggcggcgcgtcggcgtcggcctcgtcgggcgccggcgcggatgagcgtcccaagggggaggacggcaagcaggggcaggtggcggcgggggcgcagcctccggcgggcgggaagaagcgcgggcgcaccgcgggggacaaggagcagaaccggctgaagcggctgctgcggaaccgcgtgtccgcgcagcaggcgcgggagcggaagaaggcgtacctgacggagctggaggcgaaggccaagggcctggagctccgcaatgcggagctggagcagcgggtgtccacgctccagaacgagaacaacacgctccgccaggtgcccgcctcgcctcgcctcgcttccgtccaccaccctccattcgtttgcttcgcttcggcgattcgatctgagctccaaagcgagcgttcctctcgttccgaccgactgaccccaacccctccctggtgccgtcgcgcagattctgaagaacacgacggcgcacgcgagcaagaggtccggcggcggcgccggcggcaagggcggaaacggcggcaaaaagccccccctccccaagagctagtgagaaatgaaaaagggagttggtttgtgccctgctcgcgttcgcctgatttgaccattgctggggtgttgctgttcctgacgaccccttctctttttcttcttttctcccactgttacccgtgggtttcgtctcccccctcgctgatgcactgttttaactgttagccatcccgtctactcaccagtgaaccccgctgctagttaatttctcggtggtttagggtcccgtgccagaaccccgtgtaacttcgttcttgtactgtcctgtagtccacccttgcggtttggcaattcgattcaagattcctgtaaaaaaaaaaaaaaaaaaaaaaaaaaagaaaaaaaaa

SEQ ID NO: 8409 - DNA, 1714 bp, Zea mays
  Predicted polypeptide sequence is orthologous to G558, G578, G629, G1198, G1806
gcagaaactctttgcttccgcctggctcgcgatgcttgtttgggtgcgcgggctgcggcgaggtgaggcgacggcggcgccgggcggttgcatggtggccgatggagagtagacggggagggtcgtcggcggcggcggcggaagatgcgggcggggcgatgccgagctttgggccaacgcagcacgccattcgcgcagatgtgaacagcatgcaaccttctcgagttactgactttggggcactggcacagtctgctggattccgaatagaagatcttgctaaccttaatgcaaatgctttgttcaatctgaagccaaattctcatacgattgacaacagtcctctccagtttggaaattacggaaagtctatttcttctcatataaatactacagaagcaacaacagctgcaacaagaattgaccctcagctgtcagcacagcaaacaggagcacaaccaattctggtggcgttaccaactggtaacatggagaattggggagagtcagctatggctgatagccctatgactgacacatctacagatccagacactgatgagaggaaccagatgtttgaacaaggacttgttgctgtccccacagcatctgattctagtgacaaatcaagggacaaactagatcagaagacacttcggcgtcttgcccaaaatcgtgaagctgccaggaaaagccgtttacgaaaaaaggcatacatccaaaaccttgagagtagcagactgaaacttactcagttagagcaagagcttcagcgggctcgtcaacagggtatttttatttcgacatcaggagatcaacctcaatcaacaagtggaaatggagctttggcatttgacatggagtatgcacgctggttggaggagcacaataaacatgtaaatgagttgagggctgcagtcaatgcacatgctggtgataatgatcttcgttgtattgttgatagcattatggtacattacgacgaaattttcaagctcaagggtgtggcagctaaagcagatgtttttcatgtgctgtctgggatgtggaagacccctgctgagagatgtttcatgtggttaggtggcttccggtcatctgagcttcttaagttactggcaggtcacctagagcctcttactgatcagcagcttgttggtatatccaacctgcagcagtcctcccaacaagctgaagatgctctttctcaagggatggaagcattgcaacagtcgcttgcagaaactctagcatctggatccttgggccctgctggaccttctggcaatgttgcaaattacatgggacaaatggcgatggctatgggaaaacttggcactcttgagaactttctacgacaggctgataatctacggctgcaaacacttcaacaaatgcaacgcatcttaactacccgacaatcagcacgagccctactcgcaataagtgactacttctctcggctgcgtgctttgagttctctttggcttgcccgtccaagggaataaattcaattaattcataactaggataatttttttgtactgtttctagtatggccattagtttcttcagaacgctcatgtgtcagtgagatatttggatcatattgtaggccatcatggtttactggacaactttgtaacaattttggagagaaaaaactgagttgtaaatacatctggaataatctaagatcttatgaaggggaaaa

SEQ ID NO: 8410 - DNA, 1163 bp, Zea mays
  Predicted polypeptide sequence is orthologous to G558, G578, G629, G1198, G1806
gagaactggggagagtcagctatggctggtagccctatgactgacacatctacagatccagacactgatgagaggaaccagatgtttgaacaaggacttgttgctgtccccacagcttctgattctagtgacaaatcaagggacaaactagatcagaagacacttcggcgtcttgcccaaaatcgtgaagctgcccggaaaagccgtttacgaaagaaggcatacatccaaaaccttgagagtagcagattgaaacttactcagttagagcaagagcttcaccagactcgtcaacagggtatttttatttctacatcaggagatcaacctcaatcaacaagcggaaatggagctttggcatttgacatggagtatgcacgctggttggaagagcacaacaaacatgtaaatgagttgaggcttgcagtcaatgcacatgccggtgataatgatctccgtggtattgttggtagtgttatggcacactacgatgaatttttcaggctcaagggtgtggcagctagatcagatgtttttcatgtgctgtctgggatgtggaagacccctgctgagagatgtttcatgtggttaggtggcttccgatcatctgaggttcttaagttactggcaggtcacctagagcctcttactgatcagcagcttgttggtatatccaacctgcagcagtcctcccaacaagctgaagatgctctttctcaagggatggaagcattacaacagtcgcttgcagaaactctagcatctggatccctgggccctgctggaccttctggcaatgttgcaaattacatgggacaaatggcgatggctatgggaaaacttggcaccctagagaactttctacgacaggctgataatctacggctgcaaacacttcaacaaatgcaacgcatcttaaccacccgacaatccgcacgagccctacttgcaataagcgactacttctctcggctgcgtgctttgagttctctttggcttgcccgtccaagggaataaattcaattaactcataaataggattttttttgtactgtctctagtatgtcaattagtttcttcacattgctcatgtgttgatgggatatttggatctaagatcttatgaatggatgacatgtatgtgttcaagtgaaaaaaaaaaa

SEQ ID NO: 8411 - DNA, 1864 bp, Zea mays
  Predicted polypeptide sequence is orthologous to G558, G578, G629, G1198, G1806
tggccatggtgcaaggcgaggagagttcttggaggatggagagggcagcgctgcctctcaaccaggcgctcgcgtacggagtccaagcccacgccgccgccgccgctgcaccgccgacctgcttcctggacttccagcctgcggccgcatccgctgcctacttcgggttcggtgagctggaggaggccctcatccacggtggtggcgccgccagcgccggcggcggcgtcgatccgggcgtgatcatcaagaacgacgtcgcgcaggcaaagtcagcggcaggatatctcgcgggcgctggcaccggcaggccccccacgctggagatcttcccttcgtggccaatgaggcaccaacagcagctgcacagtgggaattcgcagtcagtagggagcaccggcactgactcgagctcagctcagaacacaatgtctcagatggagttggtgtccccagcctcctctgcgccgcggcaggaggtcatgatggtgaccactgatgattacagctacaagccaggcctcgccgctgcgcccgctgctgccgccccgccgagctttcagcagcaccacccgctcccgctgcagctgcacggaggagagggagggggagaccatgacaagaggaagcatggatccacaagaaaagatggcaagttggtagatgccaagacggaacggcggctggcgcagaacagagaggctgcgaggaagagcaggctgaggaagaaggcttacgtgcagcagctcgagactagcaggatcaggcttcagcaggtcgagcatgagctccagagagcacggtcacagggcctgttcgttggagggtgcagcgccgccggggacatgagctctggcgccgccatgttcgacatggagtacgcgcggtggcttgacgacgacaccaagcggctggcggagctccgaggcgggctgcaggcgcacctgctggacggcaacctgggactcatcgtggaggagtgcatgcagcactacgacgagctgttccagctcaaggcggcgctcgcgcgctccgacgtcttccacctcctcaccggctcctgggccacccccgccgagcgctgcttcttctggatgggcggcttccgcccgtccgagctgctcaagatcctgataccgcagctggacccgctgacggagcagcagctgctggggatctgcaatctgcagcagtcgtcggagcaagcggaggaagctctcgcccagggcctgcaccagctgcaccagtccctggccgacacagtcgccgcgggcacgctcaacgacggcgccgccgcccccaactacatgaacatcatggccgtcgcacttgagaagctcgccagcctcgaaaatttctatcaacaggccgacaatctaaggcaccagacgttgcatcagatgcgccggatcctgaccactcggcaggctgcgcggtgcttcctctccattggggagtactacagccgcctcagagctctcagcaacctctgggcttcccgtccccgcgacaacttcatcgggacagagagcctcagccccacagcaacggaactgcaagccctgcaccaccagcagcagaaccagttcgccggattttgaggcctcacctggtgagggagggtgtaaaactttggccgcgagggtggtgttacaaagattagaggttttgagagggagatgcattgtaatgttctatcattaaagtactgagaaagcaacatcactaggcgaaaagggcggggagaaggaattgctgtagtgcgatgttgggtggctcacctgttcatatggctcttgaactgattgaagggttagcaccgcagaatttttgtgcgtgtcaggagagaacaaatcagttacac

SEQ ID NO: 8412 - DNA, 497 bp, Zea mays
  Predicted polypeptide sequence is orthologous to G558, G1198, G1806
tacagccgccttagagctctcagcaacctctgggcttcccgtcccggcgacaccttcatcaggtcagagagcctcagccccacagcaacggaactgcaagccctgcaccaccagcggcagaatcagttcagcggattttgaggccttacctggtggtgcggtggtgtcggagggtgtaaactttggcggcgaaggtgatgttacaaagattagaggttttgagagagagatgcattgtaatgttctatcattaaagtactaagaaagcaatatcactaggcgaaaagggcggggggaaaggaattgctgtggtgcgatgttgggtggctgacctgttcatatggctcttgaactgattgaagggttagccccgcagaattttttgcgggtagcagcagaaaacaaagcagtggcagaagattctggctgctcacttgccagagagcactaattgcagttagagtgacagagtaaccattaaaaaaaaaaaaaaaaaa

SEQ ID NO: 8413 - DNA, 952 bp, Zea mays
  misc_feature (778)..(778): n is a, c, g, or t
  misc_feature (872)..(872): n is a, c, g, or t
  Predicted polypeptide sequence is orthologous to G558, G578, G629, G1198, G1806
ggggctaccccctacattaatcaaaaagtacacaaatggacagaataatcattctcctaacagcaaaatgagaaaatgggatgcaacaataccaacatatactacagtaaccaaaggaagattcttgttactctcttcccattccgccccccatgtcccaggaagttacattaggactaaatctctaaccagtacaaacaacagaaaccctgatcctgccctctctaattattattgcattgctaacacacccataaatcaccataacttacaggattatattgacctacttgtacacccacctgagtacaatttggaccaagcagcggccaaaagtaattgtacaacaaaaacagtaccaccaaagatctgtgatgcatcgctgcgaacgacgcagcagcaccgtaaggcagagggaactcaaaatactgacggcccttcgttattcacgtggcctagcaagccacagagaacttaaagcgcgcaatcgtgaaaaatagtcgtggattgcaagaagagcacgagaagcctgtcggatcgttaggatacgttgcatttgatgcaacgtctgctgtcgcaggttgtcggcttggcgaagaaaattctctagcgtcccgagtttgcccatggccatggccatctgacccatgtagtttgccacatttcctgaagaacctgctggaccgagagatccagccaaagtctctgccaaagattgctgcagtgcttccatgccctgtgacaacgcatcctctgcttgttgggaagattgctggangttggtcaaacccagcatttgctgctcagttagaggctcgaggtgattcgctaggagctttaaagctcagatggacgaaaaccccaagccatangaagcacctttcagcaggtgtcttccacatgcctgaaagttatgaaaaacatcagcctttgcagcacacctttgacttga

SEQ ID NO: 8414 - DNA, 764 bp, Zea mays
  Predicted polypeptide sequence is orthologous to G558, G578, G629, G1198, G1806
gagtggttttggatccttttgctggagatgtgcatagtgtgagcagagagagagagacgggtggaggatggtcagagccttcataagggcttcaggtggggctctgctggagacgacgaccgccgccgccgccgccaccaccatcgccaggcatctgagctcccccaaattctctgctggagcgcccctagcttcccaccgccgacgatgatggcggcctcttccaccatgagcaaggaggaatcagcagcaagctacgacatggcggaatttgaccagtcagcaatcttcctctacctcgaggatggccacgatcaagaacaacaacgacagactctgaacatctttccatcgcagccaatgcatgtggctgagccaattcctaccaagggtgttagcatgggcatggtggcagccagcatcatgctgcccaacggaaactcttcttcacccaagagacaagagcaaggtggtggccagcagaggaatgtcgctgctcctgcaggcgccgctgtgccgttgcctaataacttagccaaggataacaggaatagccttactaagaaggaagaatctagtggtggaaagggtgcagcatctgccgcaggtggtgttcaggagagagtgaaagaccctaagacactgaggaggcttgcacagaatagagaggcagctaggaagagcaggcttatgaagaaggcttatatccagcagttagagacaagtaggatcaggctcagccagcttgaacaacaagttcaagt

SEQ ID NO: 8415 - DNA, 904 bp, Zea mays
  misc_feature (25)..(25): n is a, c, g, or t
  misc_feature (49)..(49): n is a, c, g, or t
  misc_feature (868)..(868): n is a, c, g, or t
  misc_feature (877)..(877): n is a, c, g, or t
  misc_feature (893)..(893): n is a, c, g, or t
  Predicted polypeptide sequence is orthologous to G558, G578, G629, G1198, G1806
actggtcaaaccagttccggtccgnattcccggctcgaccccgcgtccngatattcttgatggcaagaggaacaaaataagcagataaatgagctgaggactgcagtaaatgctcatgcaagtgatagtgacctccgtcttatagtcgatgggataatggcacattatgacgagatattcaggctgaagggcattgctgcaaaggctgatgtgttccatatactttcaggcatgtggaaaacacctgctgaaaggtgcttcttgtggcttgggggtttccgttcgtctgagcttctaaagctccttgtgaatcagcttgagcctctaactgagcagcaattgatggggctatccaatctgcagcaatcttctcagcaggctgaggatgcattgtcacaaggaatggaagcattgcagcagtccttggcagaaacgctggctgggtcccttggtccatcaggatcttctggaaacgtggcaaactatatgggtcaaatggctatggccatgggaaaacttggcacactcgagaatttccttcgccaggctgacaatctacgacagcagaccttacatcagatgcaacgtatcctgacaatccgacaagctgctcgtgcgcttcttgcaatccatgactacttttcacgtttgcgcgcactgagttctctttggcttgctaggccacgagagtaacatcacccccgttggggtcactcgatgaactgatctgtgaatgtgggactgctggctgcaaactcgcaaagcatttgcagatgactggaggatcagtcctctctgtacaaagtgtattaacatcttctggtctcatattgtgctccagtgttgtacaatttagggaaaagctggnattacttgntagtatcatgaaattngtattggcata

SEQ ID NO: 8416 - DNA, 791 bp, Zea mays
  Predicted polypeptide sequence is orthologous to G558, G578, G629, G1198, G1806
cttttgttccatccccaggcgtacatacggaacctcgagacgagccgcgtgaagctggcgcagctggagcaggagctcataatggccaggcgccagcagcacggcgcgtacggcgtgggaggaggagtcgcaccgccggcggcgcccgtggacccgcgcgtcgctgcgttcgagctggagtacgcgcactgggtggaggagcagagcaggcaggcgacggagctgcgggcggcgctgcagtcgcacgcgccggacgtccagctgcgggtcctcgtcgacgccgcgctggcgcactacggcgcgctgttccaggccaaggcgagggcagcccggtccgacgccttcttcgtgctgtccggcgtgtggcggtcccccgcggagcgcttcttcctctggatcgccggcttccgcccctccgacctgctcaaggtgctggagccgcagctgagcccgctcatggaccaccaggcgtccgaggtgcgcaagctgcagaacacggcgcggcagctggaggacgcgctgtcgcagggcatgagcaagctgcagcagacgctggtcgacaccctcatgaccgtcgacgtctccccggacggcgccgggggcggatacgcggggcagcagatggcctgcgccgtgggcaagctcgccgacctcgtcgacttcgtggacaaggcggaccacctccggcagcagacgttgcggaacatgcacaagatcctgacgccgcggcaggcagcgcgcggcctgctcgcgctcgcggactacggtcagcgcctgcgcgcgctcagctc

SEQ ID NO: 8417 - DNA, 906 bp, Zea mays
  Predicted polypeptide sequence is orthologous to G558, G578, G629, G1198, G1806
ctagcggctagcgcagcgcattatttgccttcccgtcctcgcgccgattccatcccgcgaggctagctgctccgtcgacccgtctgtcgtttactcacgccgccggctcttgactctgccgccttgcctcggccagcatcgccggcagcgccgtctcgccgccggagtacatggcgtcggcgtcgccggcgcagttcgcggcggcgcccctcaggatggggtacgggaggccggcgccggcgccgcccccgcccgtgatgggcatgtggagcagcgagccgttcagggtcgacagcggcagcgcccacgccaccagcgcgtccaccgtcaacaccaagctggaggagacaaggttagaagacgacgcacaggtagcacttgagccggcaagaagtacggagcaggaaaccagtaggccgccagagagggcccagagaaggctcgcgcagaacagagaggctgctcggaagagtcgcctgcggaagaaggcctacatccagcagctagagacaagccgcatgaagctgtcgcagctagagctagagcttcaacgggcgcggcagcagggtgcatatgcgaatagtgggagcatgggagactcggctctcggctacagatgcccgatagatccaggtgtttctgtgttcgagatcgactacagccactgggtggacgagcagaagagacacacggcggagctgacgtcggcgctccaggggcagcagacatcggagctggagctccgcctgctggtggagacgggactcagcaactacgagcacctgttcaagatcaaggcggcggcggccaacgcggacgtgttctacgtcatgtcgggcttgtggaagacccccgccgagaggttctttctctggatcggcgggttccggccgtcggaagtcctca

SEQ ID NO: 8418 - DNA, 828 bp, Zea mays
  Predicted polypeptide sequence is orthologous to G558, G578, G629, G1198, G1806
gacaggtgaacatcaatgtgcattctaatggttcgctgcaaatcaggggcatacagagtgagaattttacagcagttggtaatgatacatcaacaacacttaactacaaagctaagcagcctaagctacatgaacatccccttctatttgggtcatagtatgtgcagatatgtccgaatcaagtctgtcgcagccttgtcaaatctcctgaccattgaaaaccaaattgtgaaaagtattgcagtcaaatagcatgttcttgctattccttgggccgagcaagccagagagagcttagggcacggagacgtgaagagtaatcacttatcacaagtagcgcccgagctgactgtctagtggtcaggatcctttgcatctgttgtagagtctgacgaaggaaattctcaagcgttccaagttttcccatagccatggccatttgacccatgtagtttgccacatttcctgttgatccagaagacgaaagagacccagccaaggtttcggccaatgattgctgaagggcctccattccttgtgaaagagcatcctcagcctgctgtgaagattgctgaaggttgcttatccctgacagctgctgttcggtgagaggttcaagttgtgtcgaaagaagctttaaaacctcagatggtcggaaacctcctagccacaaaaaacacctctccgccggtgtcttccacatgccagataagacgtgaaaaacatctgccttggctgcattgcctttgagcctaaaaatctcatcatagtgtgacatgatcttatcaacaacacttcgaagaacagtatcacttgcatgagcactga

SEQ ID NO: 8419 - DNA, 797 bp, Zea mays
  Predicted polypeptide sequence is orthologous to G558, G578, G629, G1198, G1806
gtcctttgaagctgggctagacgctagagcacatcctgtgctgtgagaaacgtaacctaataaaccttgtgttcagcgatttgacggcctccgttatccgaagaaacaacttcaaccagacatgtggcgagcgaggtgattagctagtgacaagtgttgatctaagggagatcgttttgagcatgctatgatggagctctactccggatatcttgaagatcatttcaacctccacaagctaaggtcatgagaaggctcgcgcagaacagggaggctgctcggaagagtcgcctgcggaaaaaggcctacatccagcagctagagacaagccggatgaagctggcccagctagagctggagcttcaacgggctcgacggcagcagggcgcgtacgcaaatgggagcatgggagacccagctctcggatacacagggtcgatcgatccaggcgtcgccgcgttcgagatcgaatacaggcactgggtggacgagcagaagcggcacacggcggagctgatgtcggcgctccaggggcagcagacgtcggagctggagctccgcttgctggtggagacggggctcagcaactacgagcacctcttcaggatcaaggcgctggccgccaacgcggacgtgttccacgtcatgtcgggcgtgtggaagacccccgccgagaggttcttcctctggatcggcgggttcaggccgtcggaggtcctaaagattctgagcccgcagctggagccgctggcggaggcgcagcgcatgctcgtgggcggcctccagcacacgtcaac

SEQ ID NO: 8420 - DNA, 886 bp, Zea mays
  Predicted polypeptide sequence is orthologous to G558, G578, G629, G1198, G1806
ggaagacatcgctactaccccagccacagtacccattgggtatttatctgctcccttgctgaagctggaatgtgcagctcgatcggttagcgctacgagtcctcgctgaatccagccaaatgatccccttgagcttgccagttagagcacgcacctaatataatgctggccttccgtcagaagtaacagctagctaagagaagcacaagaaaaatctggtagcttgagttctgactcgaactcagagatggcttatgcaagccccgggactgatgatacgtcgacagatctagatactgacgagaagaatcacatgttggagctagggcagcttgtgtcccttacagcttctgatcccggcaacaaagcaaaggacaagctactaggtcaaaaggcactgcgccgtctggcccagaaccgtgaagctgctaggaaaagccgtctaagaaagaaggcatacgttgagcaacttgagaatagcaggctgaaacttagccagctggagcaggaactccagcgtgctcgccaacagggcatcttcattcctactccgggagacgaccagcagccaaactctactagtgaaaaaggtgctttggcgtttgacaaggactacgctggatgggaagacgagcacaggaagcagataagcgagctgagggccgcgctcagcgcacacgccggtgacgacgagctccggcgcatcgtggacggcgtcatggcgcatcaccacgaagcgttcaggctcaagtgcgtggcagccagggccgacgccttccacgtgctgtcggggatgtggaagacccccgtggagaggtgctttatgtggctgggcggatttcgaccgtcagagattctaaagtttctcgcaagccatctggacccc

SEQ ID NO: 8421 - DNA, 906 bp, Zea mays
  Predicted polypeptide sequence is orthologous to G558, G578, G629, G1198, G1806
aacgacgccctcgcttggaggagttggagggcgggacgatgcccagacggagctgagggcgcggaggcggcggtggtactcgctgatggagacgaagcaccgagccgtctggcgggtcgtcaggatccgccgcatctggtgcaaggtctgctgcctcaggctgtccgcctggcggtaaaagctctcgagggtgtcgagcctgtcaagtgccagggccatgagagcggtgtagttggcgacattcgcgccgtcgctgagaggactagcgcccacggcgtccgccagcgactggtgcagctgctgaagcccctgcacgagcgcctcctcggtctgctccgacgaccgttgcagattgtacatccctatcagctgcggctccgcgagagggtcgagctgcggtatcagcatctgcttgaggatttcagaaggacggaaccctcccatccagaggaagcatcgctcggccgtggtcgcccacaggccggtcatcaggtggaacacgtcggatcttgcgagcatggccctcaggtggaacagctcgtcgtagtgccgcatgcagtcctcgacgatggcccccaggttcgcgtcgatgatctggggctgcagcacggcctggagctccgtcatgtgcttggtgtcgtcttctagccaccgggcgtactccatgtcgaaaatcacagcgcctgaactcaagtctccagccgcaccacctcctctcgggaacagaccctgaaacatgcatggtgatggtggtaataacgctattcaaacactagatcagatgttctatatatgtcccctgtctcctgatgcgtctagagaactttgaacctgtgagcgtgctccatgcagctcctgctcgatttgctgaagcctgatccgactcgtctctagctgctgtacgta

SEQ ID NO: 8422 - DNA, 884 bp, Zea mays
  Predicted polypeptide sequence is orthologous to G558, G578, G629, G1198, G1806
ctcgtgtctcgtcttgggtagcgtacgcaccttagctcgcaaccatccatccatccacggggctcgggcgcagcagcctcccccgtcgtcgtcttcgtcgtcgccttgccgccgctctgatccgtgcccgatgcatcgtcagccatctcctcacgccttcagcagcagcggcagctgggcggagcagggcgcgggcgggtaccgccacggcagggacggcgccaccttcctcctccccgagctcctccagcgcagtaataacgccgccctgccccttgtttatccgcctgcctgcgtattttgtttcctttctttttcttcttgttggatttctcatggctgttggttgcacgcgcgcgcatcgcgggggctaatgtgaaggccccaaccccagctccaagtcctccagcgccgccaccttcgtgccgccgctcgccgccgcgcatggaggaggagtagcggccccgtttggcatggcgccgctgggagtggcggcggcggacgaagcccggttctgcatgacgccgtggtcagcggcggcgcacttcgagaactggggcgactccggcatcgtcgtcaccagcccgctcgccgagacggcctccaccgacgtcgacatgggtggaggtggagccatggcgcagagcgtcgacggacatgacaactcattgccggcgtgcaaggtggagcccagggatcacaaggcgcagaggaggcttgcgcaaaaccgcgaggcggcccggaaaagccggatgaggaagaaggcgtacattgtggagctggaaaacagccggtccaagctgtcccatcttgagcaggagcttcaaagggcaaggcagcaggggatgttcatttgcagtggacgctccggagatcatggatgc

SEQ ID NO: 8423 - DNA, 270 bp, Zea mays
  Predicted polypeptide sequence is orthologous to G559
ggtaccgagctcgaattccgttgctgtcgcgcccttccggcttgattctcccaaattgccactgtgtgggattaatgttgcagtgtcatcttgtgacctccttgaactgcccgtgaccgtgtctgccatattcttctttaccgctgaggttcaagttcttcttactctctgcaacgacacgccaggagcaaggaggtggcaagtcgtgcagaaatatcctgtcgcccttcgtcgagcagagggcggttcatgatgctgccgacagcaacg

SEQ ID NO: 8424 - DNA, 884 bp, Zea mays
  misc_feature (665)..(665): n is a, c, g, or t
  misc_feature (780)..(780): n is a, c, g, or t
  Predicted polypeptide sequence is orthologous to G559
gcacgacgtactccaaatactcttctcatttcctctcggttctgctcggtggcaacccagcgcgtagatcttattcttggacgagaattctcctcaagttctcggatttctgtttttgtgccgcttagcaattcaaccccgaaattcttttgcggcgcagtcttcacccgaatcttgggtcgtagccaagaagatgaacaaggataaggctccgatgccgggagacggcgaccccagcgatggcttgccgccgcagaccacgcgccgtgccggggcgccgccctcgtcgtcgaccccgccgcgggagtacgacatcagccgcatgccggacttccctacccggagcaccggccaccggcgtgcgcactccgagatcctgggcctccccgacgacctcgacctcagcgcccctggaggcggcgacggaccgtcgctgtcggacgagaacgacgaggagctcttctctatgttccttgatgtggacaagctgaactcatcgtgcggggcgtcgtcggaggccgaggctgagtcctcgtccgttgcggatggcgtcggtgagggggctgagctgggccacgcgcccaggccaaggcatcagcacagccagtccatggatgagtccatgtcgatcaaggcggaacagctggtgggggagcaggggatgnaggggatgtcgtctgcagaggccaagaaagcagtctctgcggcgaaactggctgagcttgctcttgttgacccaaagagggctaaaaggatttgggctaatagacaatctgctgncagatcaaaggaaaggaagatgcgatatattgctgaactcgagcgcaaggtgcaaaccctccaaacagaaagcacaacattgtcagctcagctaacattgctgc

SEQ ID NO: 8425 - DNA, 915 bp, Zea mays
  Predicted polypeptide sequence is orthologous to G559
gcaaccctccaacagaagccacaacattgtcagctcagctaacattgctgcagagagacaccactgggctaacaaccgagaacagtgagctgaagattcgcctgcagaccatggaacagcaagtccacttacaagatgctttgaacgacacactgaaagctgaggtccagcggctgaaggtggcaacagggcaggggccggccaatggtggtggaggcatgatgatgaactttggcgccgtgccacgcgcgtttggaggaggcaaccagcagatgttccacagcagccagagccaagcgatgcaatccatgctggcgacgcaccagctgcagcagctccagctccactcccagcctcagcagcagctgcaggcgcagcatctccagcagggggcgagagacctcaagatgaaagggcatctgggcgcccaagcccagtggggcggtgggaagtctgggagcagcggcagctgaggctactggcacgggagttttggtgtatgtggttactggttagctaggaggggagatccccttgttctcgggcgggtgctcccgtgcatgggtagttaccgttagctcgggctatctatctacaggctcagttcagcttcagttttactgttaactcgggggctcagctctcctgcagcgtactgtgtccggaaactcggatggtaacaggtgttttatccgttggaatctgtctgtatctctttgctagtttaagggtaaaaatggtcgggatttcagggcttcaaatgaaatctcccgtcttgagtaaggtccgggatccattgctattccattgggatatgtacccctccctgggggctccagggggggtgtaccaaaaaaaaaaaaaaaaaaaaaaaaaaaaaaaaaaaaaaaactcgaggggggcccccgccccccc

SEQ ID NO: 8426 - DNA, 831 bp, Zea mays
  Predicted polypeptide sequence is orthologous to G559
acgatacagcccttccctcttcaatcctctcgtcatttcctctcgcttctgctcagctgcaacccagcgcttagatcttattcttggacgagaactctcctcaagctctccgatttctgttctcgcgccgcttagcaattcaaccccgaaattcttttgcggcgcagtcttcacctgaatcttgggtcgtagccaagaagatgaacaaagacaaagctccgatgccgggagacggcggccccagcgacggcttgccgccgcagtccacgcgccgtgccggggcgccgccctcgtcgtctaccccgccgctggagtgcgacatcagccgcatgccggacttccctacccggagcaccggccaccggcgtgcgcactccgagatcctgggcctacccgacgacctcgacctcagtgctcccggaggcggcgaaggaccgtcgctgtcggacgagaacgatgaggagctcttctccatgttccttgacgtcgacaagctgaactcatcgtgcggggcgtcgtcggaggccgaggctgagtcctcctcggccgcgggtggcggcggtgagggggctgagctggccgacgcgcccaggccaaggcatcagcacagccagtccatggatgggtccatgtcgatcaaggcggaacagctggtgggtgcgccggggatggaggggatgtcatctgcagaggccaagaaagcagtgtctgcggcgaaactggctgagcttgctcttgttgacccaaagagggctaaaaggattttggctaatagacaatctgctgcaagatcaaggaaaagaagatgcaatatattggcgaactcgagct

SEQ ID NO: 8427 - DNA, 931 bp, Zea mays
  misc_feature (802)..(802): n is a, c, g, or t
  Predicted polypeptide sequence is orthologous to G559
tccctcctggcttctgcccctttgtctgcgctcctcacgccgccccccgccccagcctcacacccgcattccccagatctccatggactcgacccctcccacggacccggcggcctcctgcttggcctccgcctctgcggcggtggcatcgggggacgtcgccgcgatgctgccggactcgccgccgcggcgtggggcgggccaccgccgcgcacagtcggagatcctcctcggcggcgccgcgctccccgacgacctcaccttcgacgcggacctcggcgttgtcggggaggcctgcgtggccggcgacgaggatgaggaggatgacgacgacgacgaggaaggggtcggcggcgctggcggcagccggatgttcgagatgttcctcgagaacggtggcaagctcccaggaccgccggagccgtcggcgcatccgcattcgacgccgccgcggccacggcaccatcacagcatgtctatggatgggtccacgtctttgtttggttccgccgccgccgggacgcctgggaggtcgggcgctgatgccaagaaggctatttccgacgctaagctcgccgagctcgcgcttgttgaccccaaacgtgccaagaggattttggcaaaccgccagtcagctgctaggtcgaaagaaagaaagatgcgctacattgcggagcttgaaaggaaagtacagactctccaattagaagcaactacactatcagctcagctggccatgttgcagcgagatacgactggtatgacaagtgagaatagtgatctgaagatacgtgtgcagacnatggagcagcaggttcagctgcaggacgctctgaacgacaggctaagagacgagattcagcagctgaagggtgcaacaggacaggtaaacgccagcattggaaaaacaggaaactctggtatgtcatca

SEQ ID NO: 8428 - DNA, 647 bp, Zea mays
  Predicted polypeptide sequence is orthologous to G559
aaatcttgccgagcttgccctaatcgatccaaagaaagcaaagaggattataaataatagacagtcggcggcaagatcaaaagaaaggaagatgaggtacattgctgagcttgagcggaaggtgcagttcatgcagagagaagccacagcactggcaacccagctggcattgctacagagagacacggctgggctgactgttgagaacggcgacctgaagatacgtctggagagcacagagcagcagatccacctacaagacgcactgaacggggccctgaaatcggagatgcagcggctgaagatggcgacagggcaggcgggcaaccagatgatgaacttcgccgaaccgccgcacacgttcggcggtgcgaaccagcaggtcttccaccacccgggccaagcagtgccgccattcctggtggcgatgcaacagcagcagcagttgctgctgccgcacatgaaccagccgttgcaccctctgcagagccagcagctgcatcaggcggcgacgctcagcatcgacatggaagggctgccggcggctccacctggccagtggcaatggggtggtgacacgtggtcggagagcagcagtagctgattcggcggcgacgacgacgtgggttgtggatgtatgccatgtt

SEQ ID NO: 8429 - DNA, 2356 bp, Zea mays
  misc_feature (34)..(46): n is a, c, g, or t
  misc_feature (254)..(278): n is a, c, g, or t
  misc_feature (375)..(414): n is a, c, g, or t
  misc_feature (533)..(557): n is a, c, g, or t
  misc_feature (711)..(740): n is a, c, g, or t
  misc_feature (749)..(785): n is a, c, g, or t
  misc_feature (795)..(800): n is a, c, g, or t
  misc_feature (838)..(880): n is a, c, g, or t
  misc_feature (1068)..(1072): n is a, c, g, or t
  misc_feature (1124)..(1128): n is a, c, g, or t
  misc_feature (1191)..(1195): n is a, c, g, or t
  misc_feature (1833)..(1855): n is a, c, g, or t
  misc_feature (2278)..(2284): n is a, c, g, or t
  Predicted polypeptide sequence is orthologous to G561, G562
tttcaattctgcgggcaatgcgttgatttctccnnnnnnnnnnnnnggattcatgcagcatccagctgcatccagttatttggcttagcctcgtcgtttatattagagtagttcgtgggcgatgattattattacggtggctaaattcgagttatgcacatattcatcacggagaccccgagagttggtgcatgatgcactgaatcccagctgcacatgtttaaaacagcgacacagttatatcccagtaggannnnnnnnnnnnnnnnnnnnnnnnnagtgcagcatcgtcgcgtcagcagcggcgaagctctatactggtcagacccattaggtgtattccattcccacctacagtcggtgaatcactcgtcnnnnnnnnnnnnnnnnnnnnnnnnnnnnnnnnnnnnnnnnccttagcttattaactggtgaagtggtttctttcgccctgtaactctttgggtgtaacttatggagagcgattagcaaattattaccgttttagatagttctgcgtcaagattttaaannnnnnnnnnnnnnnnnnnnnnnnntgtctctgtcaccctttgcgtgaagagagctaggtgggccgtagaaaaggcttcagttcagatctcatttcagatagcacaggaccaatctggtctgcagtgttcaactggaatataagatttcgctgcataggtcaaaggtttgtacgagtgnnnnnnnnnnnnnnnnnnnnnnnnnnnnnntattatttnnnnnnnnnnnnnnnnnnnnnnnnnnnnnnnnnnnnnatactattgnnnnnntgagtaaattgtatgttgtgataatctgaacttttacnnnnnnnnnnnnnnnnnnnnnnnnnnnnnnnnnnnnnnnnnnnggctacccaaaagactggaaatacaacatctccttctaaggattacccaactccttctccatatcctgattggtcaaccatgcaggcatattatggccctggtgtcttgccaccaacatattttactcctgcaatagctccaggtcatccaccgccatatatgtggggtcctcagcctataatgccannnnntttcgggacaccatatgctgcagtatacccacatggtggagcttacccacannnnnttgtgcccatgatgtcaacttcaatgagcgtggagccagccaaatctgcgaatagcaaggagnnnnnttccaataagaaacttaaggaaatagatcggactgcagtgtctgctggcagtggtaacagtaaaagaacagtgtcatccattgaagattacagtgcagaagcctcaagcgatgtaaacgatcagaatgtgaacgaaacgtccaggaagcggagctcagatggtggacctggcgcagaaaccaccacaggtggaaacacggaatgtgttttagctcctaaccatacgctggggaatgctaccattttgccacaacactgcttttcagctccagtaattaagcccagtgctacaaatgtcgcgaactcgagggcgataggcacggcattatctccaccacctggtgtgatggttccagttcataatgcagtaccatctgacttatcagttaaggatgagagggaattgaagcgcgaaaagaggaagcagtcaaatagggagtccgctagacgatcaaggctgagaaaacaggctgagacagaggagttggctacacaagtggagtctcttgcagcagagaacacgtcccttagatctgaaatcggccggttaacagagagctcagagaagctcagactagagaactcagctctaatggtgaagctgaaggacaccgcagaaccgtctcccagcaaagcannnnnnnnnnnnnnnnnnnnnnntgcctcggcggagaacttcctttccatgatcgacagcgccaacgcgccgagcgtcagcaggcacacggagcacggcggtcccaggctccggcagctcctggactccagttccgcgacagacgtcgccgccgtaagctgatgatgaagccggtccggcaaatacgccacagcacatgcatgtggcctggggattccgcaggctcatgcggctcgagtgctcgtcagcgttacggactcggactctgtactccagtttaggcactgattccaccgagggtaccggtaattttatctgctctcgcgccagagtgccgggctgccgcctgcgaccactcctgtcctgtgtacccagagttgtaacgtagtagggtgttgtgctgcatgccgaccttttgaaactttcgagaccgtcatttgcaccannnnnnncgtcgcaataagacaatacagatcggagtttgtacaggacggatgctgcctggtgtgcgcaattctctactg

SEQ ID NO: 8430 - DNA, 1507 bp, Zea mays
  misc_feature (1073)..(1073): n is a, c, g, or t
  misc_feature (1355)..(1355): n is a, c, g, or t
  Predicted polypeptide sequence is orthologous to G561, G562
gaattccgactcccgcctccccggggtgcgtgtttccccatccggctcgtccgccgatcctcgcgaggcctcctcgaccccgaccccgacccggcgcggccaccggttcaagtcattcacaaaaaaacatgggtcatgatgaagctgtagttactcagaattcagtaaaagcaccatcaccacccaaggatcagccagctatttatccatgctttgattggtcgactatgcaggcatattatggcccaggggtcttgccaccagctttctttaaccctggagtagcgcctggtcatgcccctccaccatatgtgtggggtccgcagactatgccaccggctgcctttggaaaatcatatgctgcaatatacccaccatgctggtacggtggtttcctgcatccactcatgcccctagtggtaaacccattgagtgcagagccagctaagtctgggaacagcaaggataatagtttaaagaagaaactaaaggaaattgatggatctgctgtgcaagtggcaacagtgagaaaacaagtgggatcacagctagaaggatccagcgatggaaacaacccaaaggtgagcggaactccaaagaagaggagcttagatgataggactacatcagaaacatgtggggaatcaggaagattgccagctttgtccagtgtgcgcattccagacacaatgatgaaaccatgtgtgagcaccggtagtgacttcaaagttagtggtgcgacatcaaccgaatggccagctaaggacgacaaggaatccaagcgtgaaaggaggaagcagtcaaacagggagtctgcccggcgctcaaggctgaggaagcaggctgagactgaagaactggctagaaaagtagagctactgaccgcggagaacacgtccctccgaagcgagatcagcaggctaacggaaagctcccagaaactaaggatggagaactcggctctgatggagaaactagcggacggtacatcagaccaagcacaagaagcttccgccggccaccagacgacaccaacggcgccatcgtcggctcgcgtcgtcaagaacttcctntggatgatggatggcgaaggcgcgtcaagaggcggcagcggcagcagcagccggcgcagggatcacggtgcgcccatgctccgccagctcctgagctcgggtcctctggcggctgacgccgtggccgctagctgatcagtgccgtgcttcccttgtgccgagcgcgtgtggactggcgatttttttaaaagagcgcacaagccgccacgcacggacgacctgtaaattacagtagctatgcctatgtatggggcatcgttccggccgctctgctgagagccnatatacggatcccatcactgagctttggtaactctctgtcgactgtcgttagagtggttgtgccaaactgaatcaactgacacgattcaacagtactaataataaccatcaggaggtttgcctctgaactccaaaaaaaaaaaaaaaaaaaa

SEQ ID NO: 8431 - DNA, 795 bp, Zea mays
  Predicted polypeptide sequence is orthologous to G565
tcagaacccaacacgccactgcctagctagtagctagcagagcagctagccaagcaacccagccgagtagccgaccagagagagcgagagaggcagagaggagcggacctgcccgtcgcaatggcgatgccgccgaagcccggcgacccgccgcagcgctcgcctgcgcggagccccaacctcaacctgccctgcccgctgccgccggtcccgggcgggccgcctgcgccgtcggccgccgggttgcccccgccgcgcgcgagtcaccaccgccgcgccagatctgaggtggcctttcgcttctcggacgacctggccggcggcgtgggcggcggcttcgacgagatcggctccgaggacgacctcttctccaccttcatggacatggacaagatcgccggcgccgaccgcgaccgtgccgccgagacctcctcgccgccgcgcccagccaagcaccgccacagcgcctcctttgacggcttcgggatgggggctgccgccggtggcctggccgggcagcaggacggcggcggaggcatgtttggagaggtgatggaggccaagaaggccatgtcttccgagcagcttgccgagctcgctgccatcgaccccaagcgcgccaaaagaataattgcaaacagacaatctgcagcacggtcaaaggaaagaaaatctagatatataacagaactggagcggaaggttcaaactcttcagacagaggctactactctttcagcgcagctcacactattccagagagacacaactggactttcggcagaaaatgctgag

SEQ ID NO: 8432 - DNA, 839 bp, Zea mays
  Predicted polypeptide sequence is orthologous to G565
gccaagagtagtagccgcgtgcccgcgtgcgcttcccgaaccccgagtcccgaccagagagagatacggagaggagcagacctgcccgtcgcaatggcgatgccaccgaagcccggcgacccgccgcagcgctcgccggcacgtagcccaaacctcaatctcccctgcccgctgccgccggtcccgggcggggcgccgccaccgccgcagcagcagccgggcgccgggctgcccccgccgcgcgtgggccaccaccgccgcgccagatctgaggtggccttccgcttcccggacgacctgcccggcggcgggggcggcggcttcgacgagatcggctccgaggacgacctcttctccaccttcatggacatggacaagatcgccggcgccgaccgcgaccgcgccgccgagacctcctcgccgccgcgcccagccaagcaccgccacagcgtctcctttgacggcttcgggatgggggctgccgccggcggcccgggcggccagcaggacggcggtggaggcatgttcggagaggtgatggaggccaagaaggccatgtcttccgagcagctctccgagctcgccgccatcgatcccaagcgcgccaaaagaattattgcaaacaggcaatctgcagcacggtcaaaggaaagaaaagctcgatatataacagaattggagcggaaggttcaaactcttcagacagaggctactactctttcagcacagctgacactattccagagagacacaactggactttcagcagaaaatgctgagctcaagataaggttgcaggccatggagcagcaggcccaactgcgtgacgctctaaatga

SEQ ID NO: 8433 - DNA, 657 bp, Zea mays
  Predicted polypeptide sequence is orthologous to G568
acaacttatccttaatcacaaaaggttgttcaaagtcaaatgtaaagctttcagtgaacaataagaatttgtcaagatcgttattgtcttctatccaacaacaaagtcccgtgctggagaagccatacaaaacccaagttaataacagtgcagtaaaagcaacaagatctctcaatgccaataagagatctgaaacaagcacacattcagcaaaaaagactgtaaacttagtctctgcttcgattaatttgaaacactctggtgctaagtctattctaagggaaaggaacttgtttattccaactactaattcatcaaaggaagataagaaaacttttgtgacaactgcggtaaggaaacatgaggtttgtatacttagcatcttatatctacacttgccattgaccattagtgaacatatttatattagagttttctatatcatttcataggcggtagatacatcaatttgcatggaaatttgagccctcccaccaattgagacactaactttttttattgccactacaagcatatgctagtattacaactaactattgcaatatattagagcgatatgcaggagaatcacaatggcacaaaaaatattgtagtatcatctgaaatgcaagtagtacctcggccgcgaccacgctt

SEQ ID NO: 8434 - DNA, 883 bp, Zea mays
  Predicted polypeptide sequence is orthologous to G571
gcacgcggtctgaccaaggtgtcgccggcaaaggcgtccccatccgtggcatcgacggcctcagctcagaggcggcgatgttcgacgtggagtacgggcggtggcaggaggagcactaccggctgatgtacgagcttcgggcggcgctgcagcagcacctgccggagggggagctgcagatgtacgtggagagctgcctggcgcaccacgacgagatggtgggcatcaaggagggcgccatcaagggcgacgtcttccacctcatctccggcgtctggcggagccccgccgagcgctgcttcctctggctcggcggcttccgcccctccgaagtcatcaagatgctgctgagccacgtagagcccctgaccgaacagcagatcgtgggcgtgtacgggctgcagcagtcggcgctggagacggaggaagcgctgagccagggcctggaggcgctctaccagtcgctgtctgacaccgtggtctccgacgcgctcagctgcccctcgaacgtctccaactacatgggtcagatggccgtcgccatgaacaagctctccacgctcgagggcttcgtcagacaagctgagaaccttcggcagcagacgctgcaccggctgcaccaggtcctgacgacgcggcagatggcgcggtcgctgctggccgtgtcggactacttccaccgcctccgcacgctgagctcgctctgggtcacacgccccagggcaccgcaggagcaataatagggccacagctggtgacggcggcgctgagaatggtgatcgccggccgccgcatacaacggcgccacacgcgcatgtgtccattcatgcatatatgagtcgtgcatgggcgcatgcatggtgtgtcgttcgtcatcaagaac

SEQ ID NO: 8435 - DNA, 2503 bp, Zea mays
  Predicted polypeptide sequence is orthologous to G583
ggcacgagggacgacaacgcctccatgatggaggccttcatggcttctgccgacctccccaccttcccctggggagcgccggccgggggcggcaactcgtcggccgccgcggcgtcgccgccgccgcagatgccagcggcgatggctcccgggttcaaccaggacacgctgcagcagaggctacaagccatgatagaggggtcgagggagacctggacctacgccatcttctggcagtcctcccttgactccgccaccggcgcctcgctgctcggctggggggacggctactacaagggctgcgacgaagacaagcgcaagcagaagccgctcacgccctccgcccaggccgagcaggagcaccgcaagcgcgtgctccgcgagctcaactccctcatctccggcgcggcggcggctcccgacgaggccgtcgaggaggaggtcaccgataccgagtggttcttcctcgtctccatgacgcagtcgtttctcaacggttcgggcctccccgggcaggcgctcttcgccgggcagcccacatggatcgcctctggcctctcctccgcgccgtgcgagcgcgcgcgtcaggcctacaacttcggcctccgcaccatggtatgcttccccgtcggcaccggggtgctcgagctcggctccaccgacgtcgtgttcaagaccgccgagagcatggctaagatccgctcgctctttgggggcggagcagggggtggctcgtggccgcccgtgcagcctcaggcgccgtcgtcgcagcagcccgccgccggagccgaccacgcggagacggacccgtccatgctatggctcgccgacgcgccggtcatggacatcaaggattccttgtcgcacccgtcggccgagatctccgtctccaagcctccgccgcatccgccgcagatccattttgagaacgggagcacgagcacgctcacggagaaccccagcccctccgtgcacgcgccgccacccccgccggcgccggctgctccacagcagcggcagcaccagcaccagaatcaggcgcaccagggcccgttccgccgggagctcaatttctcggacttcgcgtccactccttccttggcggcgaccccgccgttcttcaagcccgagtccggcgagatcctcagcttcggcgccgacagcaacgcccggaggaacccgtcgccggtacctcccgccgccaccgccagcctcaccaccgctcccgggagcctcttctcgcagcacacggcgaccatgacggccgccgcggcgaacgacgcgaagaacaacaacaagcgctcaatggaggccacctcccgggcgagcaacaccaaccaccacccggcggcgacggcgaacgagggcatgctgtccttctcgtcggcgccgactacgcggccgtcgacgggcacgggcgcgccggccaagtcggagtccgaccactcggacctggacgcgtctgtgcgcgaggtggagagcagccgcgtggtggcgccgccaccggaggcggagaagcggccgcgaaagcgcgggcggaagcccgcgaacgggcgcgaggagccgctgaaccacgtggaggcggagcggcagcggcgggagaagctgaaccagcgcttctacgcgctgcgcgccgtggtgcccaacgtgtcgaagatggacaaggcgtcgctgctcggcgacgccatctcctacatcaacgagctccggggcaagctgacgtcgctggagaccgacaaggagacgctgcagacccaggtggaggcgctcaagaaggagcgcgacgcgcggccgccctcgcactccgctgggctcggcgggcacgacggcgggccgcgctgccacgcggtggagatcgacgccaagatcctggggctggaggccatgatccgcgtgcagtgccacaagcgcaaccacccgtcggcgcggctgatgacagcgctccgcgagctcgacctggacgtgtaccacgccagcgtgtccgtcgtcaaggacctcatgatccagcaggtcgccgtcaagatggccagccgcgtgtacacgcaggaccagctcagcgccgcgctctacagccgcctcgcggagcccgggtctgccatgggcaggtaatgaaggaggagagctgctcagctcggctcgcctgtggctgccggattaggggacgacactgatactactgctactcgccaccggactgtcgtcgtggtcaccacggttacaacacgataggcagaaagattcaggagggagggagacgacgacgatgccggtgctgtataaactttagaaggatggatggatggatgatgataccgagcttctgctgctgttcatcatcatcttcttgtgtttttgctagtagcgtgttaattagcaggattaagcaaccaacaagtgtccaaccgttgttgttaattaagtacatgttgtgagcgacccaaaaaaaaaaaaaaaaaaaaaaaaaaaaaaaaaaaaaaaaaaaaaaaaaaaaaaaaaaaaaaaa

SEQ ID NO: 8436 - DNA, 571 bp, Zea mays
  Predicted polypeptide sequence is orthologous to G584
ataatactgctgtttatgctgatctaaacaagtcccctgaagtgattttgagtactgtgaaaatcctgagatcctagattcagataaagcgtctcgtcgcctcagcgaacacatcgatgacttgcaaaatatacagatggctgcagatagggtaacagaagtcactgagctggaagaatcgcctgggctctcagcctcagccttggattatggaacccaacgcttgtgttcaagcagtgcttctcagggagccaaacccactaggacacaatcaaagaactgtagttcctagatcacagcatgcatctaatgtactgggtggaaatgagttggtgattgttggacctcgatatgctggttctgtgccacccattgcaacaagaggtctggaaaacagcaaggagagcggtggaaggggcttcaaacccaaaccttgtaacaacattttccaaaatggctcttcaaagcctgaaagggaaccgggcaattcgtcaaacaaaagaacagctggtaaaacggaggaccttggtcacaaggatagttcatctgaagtgtcctacgagtactgtgt

SEQ ID NO: 8437 - DNA, 533 bp, Zea mays
  Predicted polypeptide sequence is orthologous to G584, G1136
gatctcggggctggaggccatgatccgcgtgcagtgccacaaacgcaaccacccgtcggcgcggctgatgacggcgctccgcgagctcgacctggacgtgtaccacgccagcgtctccgtcgtcaaggacctcatgatccagcaggtcgccgtcaagatggccagccgcatgtactcgcaggaccagctcagcgccgcgctctacagccgcctcgcggagcccgggactgtcatgggcaggtaatcaggcaggagagctcatcagctcgcctgtgtgtgcctgccggatagggacgataccgatacactgctacccaccacggggactgtcatcgcggtcaccatggttacaaaacacacacacgcacgataggccatagagattcaggaggaggtggaggacggcgacgacgatgatgatgctggtgttgttgaaaactctagaaggatggatggatgatgacacctagcttccggctgctgttcatcatcctcttgtgtttttgctagtagcctggtaattagcaggatta

SEQ ID NO: 8438 - DNA, 1970 bp, Zea mays
  Predicted polypeptide sequence is orthologous to G585
ccacgaaatggaaatggtcacttccaaattgcacgagctggaattatatactcttctgatcttcttcaccgtctctttatagcgtgatatgcgtttctggcttcttgcttacgtgaaggattattagtaaggcgcgtgatggcgctctcagcttccccggctcaggaagaactgctgcagcctgctgggaggccgttgaggaagcagcttgctgcagccgcgaggagcatcaactggagctatgccctcttctggtccatttcaagcactcaacgacctcgggtgctgacgtggacggacgggttctacaatggcgaggtgaagacgcgtaagatctcccactccgtggagctgacagccgaccagctgctcatgcagaggagcgagcagctccgggagctctacgaggccctccggtccggcgagtgcgaccgccgcggcgcgcggccggtgggctcgctgtcgccggaggacctcggggacaccgagtggtactacgtgatctgcatgacctacgccttcctgccgggccaaggcttgcccggcaggagttccgcgagcaacgagcatgtctggctgtgcaacgcgcacctcgccggcagcaaggacttcccccgcgcgctcctggccaagagcgcgtccattcagacaatcgtctgcatcccgctcatgggtggcgtgcttgagcttggtactactgataaggtgccggaggacccggacttggtcagccgagcaaccgtagcattctgggagccgcaatgtccgacatactcgaaagagccgagctccaacccgtcagcatacgaaaccggggaagccgcatacatagtcgtgttggaggacctcgatcacaatgccatggacatggagacggtgactgccgccgccgggagacacggaaccggacaggagctaggagaagtcgagagcccgtcaaatgcaagcctggagcacatcaccaaggggatcgacgagttctacagcctctgcgaggaaatggacgtgcagccgctagaggatgcctggataatggacgggtctaatttcgaagtcccgtcgtcagcgctcccggtggatggctcaagcgcacccgctgatggttctcgcgcgacaagtttcgtggtttggacgaggtcatcgcactcctgctcgggtgaagcggcggtgccggtcatcgaagagccgcagaaattgctgaagaaagcgttggccggcggcggtgcttgggcgaacacgaactgcggtggcgggggcacgacggtaacagcccaggaaaacggcgccaagaaccacgtcatgtcagagcgaaagcgccgggagaagctcaacgagatgttcctcgttctcaagtcgttggttccctccattcacaaggtggacaaagcatccatcctcgccgaaacgatagcctatctaaaggagcttcaacgaagggtacaagaactggaatccaggaggcaaggtggcagtgggtgtgtcagcaagaaagtctgtgtgggctccaactccaagaggaagagcccagagttcgccggtggcgcgaaggagcacccctgggtcctccccatggacggcaccagcaacgtcaccgtcaccgtctcggacacgaacgtgctcctggaggtgcaatgccggtgggagaagctcctgatgacacgggtgttcgacgccatcaagagcctccatttggacgctctctcggttcaggcttcggcaccagatggcttcatgaggctcaagataggagctcagtttgcaggctccggcgccgtcgtgcccggaatgatcagccaatctcttcgtaaagctatagggaagcgatgaaagggcgctacatgtgaagcttaattaatggaagcaaacttgtatttcttgtgcaaaagcttactatatatttctgcaaaacctggtgtgccttgttttgattttcagtcgccaattgtgcctttgtttttatcaagtgatga

SEQ ID NO: 8439 - DNA, 790 bp, Zea mays
  Predicted polypeptide sequence is orthologous to G590
cgcctcctagtcccccccttcgccttctctcccgagtcccatcggagcccggagctctctcgcctcccgcgaggctgtgtggtgaggcgcggacgagatgaacgagcaggggctcggtggtctcggcgggggccgcggggccgtgcaggggcacgggcgggaggcgatggcgctcttgcagcaccagcagcttcaacagcaacggcggcagctggaggaggaggatgaggtgcggcgccagatgttcggcggggtggcggcgttcccggcagcgctgggccacggccagcaggtggactacggggaggacgccggcgggctcggggacagcgacgcgggcgggtcggagcccgagccaccgccggagcggacgcgcggggggtccggcggcggcggcggcaagcggagccgcgctgccgaggtgcacaacctctccgagaagaggaggaggagcaagatcaacgagaagatgaaagcgctgcagagcctgatacccaactccaacaagaccgacaaggcatccatgcttgacgaggccattgagtatctgaagcaactgcagctccaagtgcagatgctgtctatgagaaatggtgtttacttgaaccctccatatttgtctggcacaattgagcctgcacaagcatcacaaatgtttgctgcagttggtgggggcaacattacagcgtcaagctctggggcagtgatgccaccagtaaaccaaagttcaggacttcaagtatttgatccattaaatcctccacgagaccaaccactgtcttttgtatta

SEQ ID NO: 8440 - DNA, 924 bp, Zea mays
  Predicted polypeptide sequence is orthologous to G590
cgcgctggggtcgtcggagtcggatcccgcgaggccggcgcgcccgcgcggcaagaggagccgcgccgccgaggtgcacaacctctccgagaagaggaggaggagcaggatcaacgagaagatgaaggcgctgcagaccctcatacccaactcgagcaagacggacaaggcttccatgcttgatgatgccattgagtacctgaagcatcttcagctccaggtgcagatgttgtctatgaggaatggcctctatctgcccccaggaaacctgtctggagcacccgagactctggcacccttagaaatgtgcgcagcacttaaccaaagtggtgccaaggcatcaaattccggcgttgtcgttctacctggaaacaaaattcctgtagctcgtcttctacttgatccaccaaaccatgatcagcggcatgaaaacccgcttgtattacaaagtgttcctagtagttcgaccgctgtagagcctcggttccttcaacagccagcacagcccaacctccaatcctttcagctggctgtacctcccgagatgatcttcgacgaggcggacatgatgctaaagcatcgcctagcttcaggtcgagaaaccacatctctaccagtaggacatgaggccaagcctggtaggcaggaagcatgcatggtaaattctgatatttctaacagaggttcactcgggaaagaagtatttatgccctacttgcatagcttgcagagcggcgatacggagggaggtctgagggcaggatcaaactaactacacggtggttcaccctggcagattttccccatcgggatggacagaggtgcctagctaggagtcgctagtcgatctgaaatgttagaagctagatcaggttgcagtctagtaaaccatcttgtaaaacagagagctacccctctatatgc

SEQ ID NO: 8441 - DNA, 1054 bp, Zea mays
  Predicted polypeptide sequence is orthologous to G591, G793
cgaatgttcttatcaagagtgtggatccatatataaataaagtattcaacgcagatagcagatccactagcaacgctgaaacgcacgctcagcctccattgaccaaagcctgcctcggacctccactttggaaaaatggagaaggaagaacatcgctatcaacatcatcttccatttcatcctgtatctaaactttgtcaaccatttgcgcaggccgcagacacactcatacatcagtcccttttgattagtccatatacacccactaccagaaaagcagcagcccccccaccacaaagtgtatggctagctagtgcactacagacccggaaagaaacattatgagagcatgccagactcttttagcagctccctctctccatcactcacactcatagggggcattgaaagatggaggagcatgagcaggttattgcttaccatatccttgcaattaaagcacctttgaacaaaagatcggaaagggaaaggggatatcatataccatttggtacaacttcaagtggagaggatcttttaggtcttttttccctgcctcctccttgttagtgaatcgaagccggcatttctatcttacgctttgattggtaggttaacgcctgctaacagccccgaaaggatgcaagttacgcttgctgccactatactaggaaggagtgttgggttctggttttactggttgtccgtcctgcgaatgttgcgtgtcatagattgccatggcgagcgagatgggcatcatgcagagtgctttggactggaggaattgcatcgctgccccaatgtcttcttccatcagctttgcgatctgtctttctgtgccgtccgttgaccacttctcccaaatctgctgtttgctcccactatcacttgcttcccccttaactgaaagtgggatatcagcgaccagctgtgccacagcaccagcaccacccagcctgctcatgcttagaaccttgacttgaagcctcagaaacttcacataatcgaggatctcatctagcataactgctctattcctcttgtttctcgtgcc

SEQ ID NO: 8442 - DNA, 922 bp, Zea mays
  Predicted polypeptide sequence is orthologous to G591, G793
cagcagagcaggcaaaccgctcccagtcccagtctctcacctgaggtgactggcgtctcttgtcgcaagccgccagaagcttcggcccctgacgcgtgggggccccgtccgcccccgcccccgtccccacgttgccggccatggcggggcagccaccgccgtccggggcctccgaggacgacttcctcgagcacttcttcgccttcccctccgcggcctccgccggcgctgccgggggccacgcgggcgccggtattggcggggaccaccccttccccctcgccctcagcctcgacgccgccgccgaggccaagccggaccgtgatcccgtgcagctcgccggcctcttcccgccggtgttcgctggcgccggcggcgtgcaccagccgcacctccgcggcccaccgcctccgcagatgttccaggcgcagccgaagccgggcgagggaggcatggcgccgcagccgccagccccgcggcccaaggtgcgcgcgcggcgggggcaggccaccgatccccacagtattgcggagaggctaaggagagagagaattgcagaaaggatgagggcattgcaggaattagtccccaacacaaacaagacagatagggcagccatgctagatgagatccttgattatgtgaagtttcttaggcttcaagtaaaggttctgagtatgagcagactgggcggtgctggcgcggttgcgcagctggttgctgatattccactctcagttaagggcgaggcaggcgacggcgggggggcgccgcagcagcagcagcagcagcacgtgtgggagaagtggtcgacggacggcacggagaagcaggtggcgaagctgatggaggaggacatcggggcggcaatgcagttcctccagtccaaagcgctgtgcatgatgcccgtctcgctcgcgat

SEQ ID NO: 8443 - DNA, 644 bp, Zea mays
  Predicted polypeptide sequence is orthologous to G592
gcagtattgataaattcctccagttccaggacgcggtgccttgtaagatccgtgccaagcggggatgcgccacccatccgcgcagcatcgccgagagggtgaggagaacaaagatcagtgagcgaatccgaaagctgcaagaactcgttccgaacatggacaagcaaaccaacacatctgacatgctagatttggctgtcgactacatcaaggaactccagaagcaggttaaggtgttaaaggagacccaagctaattgcacctgcccagcaagcaagagccagcagcactcttgctgaagccctgatgcacactatacatgacctgcagaactcgaaagcatcttcacttgggatagaaaaagatgtaagacagctctcattttttttttgtgggtttgaactgtagcatttgaggcttatctaccagacagtgtgtagctttatatgagcacaggggaatggaacaatggcatcatcctcaagcattcaagtgatagggagaagggtaaaattggggagatatataggagaaacaactgtatagtttcgttgtagctttgctatatgtatactacactttcggtataaagtggttaatttaccccaaaaaaaaaaaaaaaaaaaaaaaaaaaaaaaaaaaaa

SEQ ID NO: 8444 - DNA, 870 bp, Zea mays
  Predicted polypeptide sequence is orthologous to G592
cggagctcgttaccttgacctgcttctggagatccttgatgtagtcgacggccaagtccagcatgtcggaggtgttggtttgcttgtccatgtcgggcacgagctcctgcagcttcctgatccgctcgctgatcttcgtcctcctcacccgctcggcgatgctgcgcgggtgcgtggcgcacccgcgcttggcgcggaccttgcagggcacggcgtcctggaactggaggaacttctcgatggcggccacctccgacgacgacgtcttggggaggctgaactggtgcgccagcccgccgccgtgctccaacgagtcccgcgggcgtttattcgtcgcgggcaggctgtccggcaagagcgccgacgacgagtcgtcccacccgccggagctcatcgggtaccccggcatgtaggcggcgtccccgccgccgccagcgtcggggctgctcgctccgacgacatcctcctggctgtccatctccgagatctgggacatgagcgacccctgccgcgacgagaagctcagctggcccccgagcctgccgctaccgccgccgccgcccgcgagggagtcactggcaccaccgtcctggaaccccatgcccatgctcgccctcagcatcgccccgtacccgttgtccatgccgaaatggtccaggaacccggcgggggagctgctctgccgaatcaggctgctggcggcgccgacgccagtgccgcccgcttccatgccagagctgacggtgcggtagaggccgccccccgacctacccgtctcttgctggtgctgggactgggactgggagtggaacatcatttgctcctgctggtggtgggaggccatgtccgcccgcactcgggaagtgggca

SEQ ID NO: 8445 - DNA, 673 bp, Zea mays
  Predicted polypeptide sequence is orthologous to G592
gaaatttaaactaaaatccacactaaactactctaacacatgtaaatcaagatgaatacatgtgcaatctaaacgtacattaactgacgcagctatcactaacatgcgaggcctactctgcctgctaatgaacttgttgcatgtacagactagctactatcgtctcaattccaatatatacctcctcgatcagtcctcaccatgtaacgtaacgcaactatgcgagctgaactggcccccctgagaaaaaggtggcgcggctcctttttaacgggtgaactggccctgcagctcgccggcggagcaggtgcagctggcgcggccgtcgttcagtaccttgacctgcttctgaagatccttgatgtagtccacggccagatccagcatgtcggcagtgttggtttgcttttccatgttgggcacgagctcctgcagcttccgtatccgctcgctgatcttcgtcctcctcacccgctcggcgatgctgcgcgggtgggtggcgcacccgcgcttggcgcggatcttgcaggggacggcgtcctggaactggaggaacttctcgatcgccgccatctccgccgaggccgccctgccgcccttgttctttccgctgggcaggctgagctgcggcgccagcggctgctgcagcgcggggccggagtcgcgggggcgc

SEQ ID NO: 8446 - DNA, 703 bp, Zea mays
  Predicted polypeptide sequence is orthologous to G592
tttttttttttttttagggctccgtatatgagtactatatttaggacccgagagaccgagccctataaccatttgatgaaattttataaaatagggccgctgttggaaggatgttttatggttttgagccctatatttaaaataggaccatgtttagagcctctcttggagatgctctaacataggtaaattaaccactttctactgaaagggtagtgcgtgtgtgtatatatagaaaagctacagccaaactatacagttgtttctcctatatatatatctctccccacttttttttacccttctcccaatcacttgaatgcttggtgatgccattgctccatccctcttcgctcatacaaaagctacagtgcctggtagataaagcctctcaactgctgcagttcaaaacctcatgaaacaacatgcatgagagctgtcttacatctttttctttcccgagtggacatgctttcgaggtcatgtacagtgagcattacggtttcagcaggagtgctgctggttcttgcttgctgagcaggtgcaattatcttggctctcctttagcaccttaacctgcttctggagatccttgatgtagtcgacagccaaatccagcatgtcagatgtgttggtttgcttgtccatatttggaacgagttcttgcagctttcggattcgctcactgatctttgttctcctc

SEQ ID NO: 8447 - DNA, 665 bp, Zea mays
  misc_feature (248)..(252): n is a, c, g, or t
  misc_feature (351)..(372): n is a, c, g, or t
  misc_feature (464)..(485): n is a, c, g, or t
  Predicted polypeptide sequence is orthologous to G597
tatctaatgggaccctgcgtcaaggagagtcttctggtggaacagtaacttatgagggccgttttgagattctctctttggctgggtcatatcttctgtctgaaagtactggcatgagcagtcgaacgggtggacttagtgtttctcttgctagtcctgatgggcatgttttaggtggtgctgtcgcaggacctctaaccgcagcttcgccagttcaggtggtcattgggagctttctggctgatacnnnnntggagcttgaccctggatcagcacctgagaaacatgttttcagcaggtttcaaactaccagcagtccatctaggggtaccgaatcctcgggtgggcatnnnnnnnnnnnnnnnnnnnnnngctccttcagcaccagcacacagccaggcttcccaagctttcccacatggaaatgagtttacctgctatggtggagtgggaccgtggcctcnnnnnnnnnnnnnnnnnnnnnntggaactgacagtcctcgagcgtcgtcgctgtagtttcatgagatgttatgagagtcaatcctatttaggtacttctaactggttacaatgaagttccggtttgctgcttgtcttgacattttgcatcattgaggcacttcaaactccaaagtggtggtaacatacagtatattagatga

SEQ ID NO: 8448 - DNA, 1303 bp, Zea mays
  misc_feature (182)..(211): n is a, c, g, or t
  misc_feature (456)..(461): n is a, c, g, or t
  misc_feature (519)..(548): n is a, c, g, or t
  misc_feature (844)..(848): n is a, c, g, or t
  misc_feature (945)..(949): n is a, c, g, or t
  misc_feature (1039)..(1043): n is a, c, g, or t
  misc_feature (1090)..(1122): n is a, c, g, or t
  misc_feature (1183)..(1196): n is a, c, g, or t
  Predicted polypeptide sequence is orthologous to G597
cgatgatgtggggtgagcaataccaatccatggatgagaattgttgcactacgtggatacagatggaaaccagaaggaatgctgcatagactttctgacagtgaaaccatacaaatacaaactgctaactacgatataacaagacaaaggcatgcactggtactaattattactcgtgatcnnnnnnnnnnnnnnnnnnnnnnnnnnnnnngtattccttagttattgagcctactcagctaagtcaactgctaacaaggaagctgcgaaacggcacccatcagtcggtcatcatctttagatctggatcataacggctttggtcctctgatagtgaccaaccaactgcagcatatgtggagtgcaggggaagccccgcgctggtgaatgcactgccgtttggtcccatggggctcccgggatcatcggagtgctcacttgatgtgccatccgatnnnnnnctggcagtcgaggccgccccaaagacagctgtgtgcggtggcaccgatgttggctcannnnnnnnnnnnnnnnnnnnnnnnnnnnnngcttcagcaatgaaactgccaactacaacctgcacaggtgtcgctgccatcagcattccagcaacacaacctccaactatgcgtccatcacttccagccagtgccacgctcaaaccacctgttctgctgcgagtgtcaccatcctctgcaagcaagaatgagcccgaaagagagagtatatcgaagtggccctcatatgtcactatcccaccagaggttgctggttgccgcagtgttgccgtgcacagagcaccatttgccgaaattatgcatgtagtgcgcgggccttgttgggnnnnngccattattttggacgcaacatcctcattgggcttcacagttattatgtggggagtaaacgacgtccccgaagatcccaaagcatccagctgtttcnnnnngcctgacccaggaggacgccctctacgcttgccgtcggggttaggggtagacccgcctccaccggactgggcacccgtcgcttcagtgannnnngccgcggcggtcttgagtcccaagccgatgctcccatctggaccgtnnnnnnnnnnnnnnnnnnnnnnnnnnnnnnnnnggtccccgacaatgacggcgacgatagcaccaccgctggcaccaacgccaccggagccggnnnnnnnnnnnnnnaagcccgtcgcgccggaatcagggcggtacatagaccccagcggcatgtccacaatcttcatgctgcttatgggtgacgaggcgtccggcgaagccatagggttaaa

SEQ ID NO: 8449 - DNA, 805 bp, Zea mays
  Predicted polypeptide sequence is orthologous to G597
gcattgggggcacaggttcagtacacggcatccattccagacgacaataagcaaccacctcacaatcacaacgcacgattgacacctacagcaacagcaagagctacacagtcttgacaccacctacaagctaccgctgcttctcagttctcaccgagtgccagttctaccacggtcagacggtgtccaggggtctcgtcatttccagaacagaccggagaagccacctggctgctgctgctgcccatggccgccaccgccgccgctggctcctgcgtgcggcgggctcggcggggcgccactggacgactcgcttaggctcaatgtgcctctggacggcgggctgctcggccctgccgccacgcccgtcggcgcgagatttagtggcgccggtgacggagcaagctgctgctgctgctgcttcggctgcttctttccaccggcgtcgaagctccccactacgatctgtaccggtgaagcagccgtcaggagtccggcaacacagccacccaggacacggccgtcggggcctgctagcgaaacgctgagcccaccagttcgactgcgctggccaccgttctctgacagaagaaacgacccggacagagacagtatctcgaaacgaccctcgtatgtcaccgttccacccgaagtagcagattgccgaagcgtcacatttgatatggcgccgtttgctgaaaggatgcagaccgcgcgtgtcccgtgctgcgagaacgacatgatctttgccgatacgtcctctccggcttttacaaaataagatgaggcgtaaaacctgcccccg

SEQ ID NO: 8450 - DNA, 709 bp, Zea mays
  Predicted polypeptide sequence is orthologous to G597
gacaaaaggcatttgatagggggaatcatctaatatactgtatgttaccaccactttggagtttgaagtgcctcaatgatgcaaaatgtcaagacaagcagcaaaccggaacttcattgtaaccagttagaagtacctaaataggattgactctcataacatctcatgaaactacagcgacgacgctcgaggactgtcagttccaaattcctccctcctcatccccagaggccacggtcccactccaccatagcaggtaaactcatttccatgtgggaaagcttgggaagcctggctgtgtgctggtgctgaaggagcctgtggtgtttggtgggcttgcatgcccacccgaggattcggtacccctagatggactgctggtagtttgaaacctgctgaaaacatgtttctcaggtgctgatccagggtcaagctccatttttgtatcagccagaaagctcccaatgaccacctgaactggcgaagctgcggttagaggtcctgcgacagcaccacctaaaacatgcccatcaggactagcaagagaaacactaagtccacccgttcgactgctcatgccagtactttcagacagaagatatgacccagccaaagagagaatctcaaaacggccctcataagttactgttccaccagaagactctccttgacgcagggtcacattagatacagtgccattggctgtcag

SEQ ID NO: 8451 - DNA, 835 bp, Zea mays
  Predicted polypeptide sequence is orthologous to G597
gaatctttggagtgcctggctccgacgagatcgaaaggagggacctttccttggttcctctgctggagctgtgattgcagaggtgaaccatgtcagcgatggcggcggcgggtgaagcggagtatggtgaatgcgtgcagaaggggtccctgcagcagcaccaggcgcctcaacccagccccggcgctctattctacacccatgatggcgtcgccgtctacaggaatccggtcatgccggcgttctaccaacagcccgcgggcagcaatgtcgtcgtgccggcggctccagggccagctcattcccctgccagctctgagcccttcaagcgcaagcgcgggcgcccccgcaagtacgcccccgcagacggcgccgtgccgctggctatcgtgcccccatcgcagccacccactgctcgtgccccagctacctctgaggcctcacccacggttcctcctggcttctctccaagtccgcagagtggtggcgtggtgagtcggcaggcctcgccggcgccggcgccggcgtcaggtgctcccgatgtcaagaagcggggccggccgtcgggcccctccagcaagaagcagcagccgcaggcggcagcgcctggaccaggctggactggattgaagcctcatattttcacagttcaagctggagaggatgtagcatcaagagccatgtcattttctgggaatggatgggctgtttgtatcctgacagccaatggcactgtatctaatgtgaccctgcgtcagggagagtcttctggtggaacagtaacttatgagggccgttttgagattctctctttggctgggtcatatcttctgtc

SEQ ID NO: 8452 - DNA, 906 bp, Zea mays
  Predicted polypeptide sequence is orthologous to G598
gcggccgcgatgtcgaggtcaccacgttccgcgacatccaccctctgacgcccgacgcgccgccgcccgcctccgcgtcctgggacaccgccagccaccgctccttgtcgtcgtccgacgaccagcagtacatgacgatgagccgcgagttcacggccatggtcgccgccggggcgaccatgcagcccggcggctacgacggcgccgccgaccagctcaccagcatcggcgaggacgagctggaggagaccaacccgctggccatcgtccccgacagccaccccatcgccacgcccgccaggtccagggcgtccgccgccgggctggaggtcgtgcccgcgggcccggcgccggcgccgcagccgcagccgcagccgcccgcgcacctggaggccagccaggtcaagaaggaggaggtggagaccaaggtcacggcctggcagacggccgaggtcgccaagatcaacaaccgcttcaagagggaggatgtggtcatcaacggctgggagaccgagcaggtggagaaggcctccgcgtggctcaagaagatcgagaggaagctggacgagcaacgcgccaaggcgctggagaagacgcagaacgacatcgccaaggcgcggcgcaaggcggaggagaagcgggcgtcggcggaggccaagcggggcctcaagctggccaaggtgctggagctcgccaacttcatgaaggccgtcggcagggtgcccaccaagcgctccttcttctagccagccgactaccgctaccacctccgtctctccctgcctgcgtgtgatcgatgtacgctcgctgctgcatccgagaacctaactgtaaagaaaaaaattgtaagctgtatacgtactactgcctgctatggtcccctgtgatgtctgtcatccatcacag

SEQ ID NO: 8453 - DNA, 834 bp, Zea mays
  Predicted polypeptide sequence is orthologous to G598
ggtctctcccggccgctactagaggcttagcgttgagagccacatgttgagtgaacagacggcggctagcactagcagcggcgagcatcaggagaggagcgtcgtcgaggacaggcggctacagccggtgggggagaacgaggaggcggagttcagggacatccacgcgctgagcccgccgccgagccagccttcgtcgtaccgccggagcaggcacgcgtccgtcgggagcgacaccgcgtccagcgagcccttcccgaccatgagcagggagttctcggccatggtcgccgccgcagcagccatcgccaacggtgccgccgccgacaggctcggggaggccgaggacgaggagaccaacccgctggccatcgtgccggacagcaaccccatcccgtcgccgcgccgggcccggggcccgcccaccccaggcgccggcgccgcccacgccaacggcgacggtggggtgtccgtggggcaggtcaggaaggaggaggtggagtccaagatcgccgcgtggcagatcgccgaggtggccaaggtcaacaaccggttcaagcgcgaggaggtcgtcatcaacggctgggagggcgaccaggtggagaaggccggcgcctggctcaacaagtacgagaggaagctcgaggagaagcgcgccaaggcgatggagaaggcgcagaacgaggtggccagggcgcggcacaaggcggaggcgaagcgcgcgtcggcggaggccaagcggggcaccaaggtcgcgcgggtgctggagctcgccaacttcatgaggggcgtggggagggcgccctccgccaagcgctccttcttctgaaccct

SEQ ID NO: 8454 - DNA, 520 bp, Zea mays
  Predicted polypeptide sequence is orthologous to G600
ttttttttttttttttcgaacaaactgctgatgcattgaactgacagcaagtaacttttgctgggacttacatctctatctcagtatctcactatctcttgagttgagaacccatgggaggctcaaagcgaaagccaaaaaaaaagagatatatggagaggtaaacaaaccaaagaacccctagctacaaacaattactccaaggtttcaactttgacccttgcggtacgtgttcagtcttcagtgccccgcgcctccgtcgctaggcccctccgggagcatcgccatcagcgtggacacgagcgactcgtagtacgcggggctcggcggcacgggcctcgcggcgtccgcgcaccgcgccgccaggctcagcgccgcgacggcggcgagaaggacggcgacggcgacgagcgttgcacggtggcccatatggctgctggtgacttaatctctgccggctcagctcgctgtacgcgtctcgatcaggcaggctccttgacgacgacgaacagagtgcgcc

SEQ ID NO: 8455 - DNA, 720 bp, Zea mays
  Predicted polypeptide sequence is orthologous to G600, G2768
gtcgaagtgcatttgtggagtcgagacaccagcagatgacctcattccaaatcaaacacttcggagcacaatcagcaatatgttgggaacacagacaagcagtggtggtagtggtacaacaagacacagaagttcgtcaggcagcaatcctcacccaaaaatacagagccacactgcttctgctgcgtcagcaagggaggtgaagcggtctatagaccatcagctaccagcggtatctgcacctgattatgtgctccaggttgccacagaaggtgatctggtgaaccagcctctagagaaattaacagccactgctgaaatccttagcaaatatgaaggcaattctgcagaagtgtcagcagagaaggcggtagcaaatgctgaagcccacatagtgaaggatggaagtgaaaggagttcgaaggccaccactgtttcagggtcccgagaatatgatgtcacaaggacagatcaaccaaagaagaagcggaagaaggcagacttaaccaagaacgttcagcctaacaatgttggctatggttacaatgtttcatttgaccctgcatattacaatcccttcgttaatggacatccttgggcaactgaaccttacatgtatagctcaatgggtgatgccgtacgctggttatccgatggatccatattgtgcaaatccaatggatccatattgtgtgaatccatgggatccatattgtgtaa

SEQ ID NO: 8456 - DNA, 861 bp, Zea mays
  Predicted polypeptide sequence is orthologous to G600, G2768
caccgccctcgtcgccaaaatccccccaatcccaccgccagtctccgcccgcgcctcagaagtcagaaccctagccccggcgacgccttcagatccggcgcccttatccggcggaatcgctcgctcctaccaccggttgccgcgtcccggcatctcggctacccggcgtcctgtacccgacttctacgccctcgatctcccccagccgtcgtcacgaggaatcgtttgctccacaggctacgtctccaccaagcctgcatcgacgactcgaaggatccgtgccgtcgtcgatcgccgatcgcctcttcgtagatcgaatctgttcagtgttctgctattcgttgtatttcatctgagatctgaaaaaagtattcgggccatctcgagatagagaggccttcataggcggagaaaaagaaacaggactcgccatccatcatgggtgttgtctattaccaatataagagtgaaaaggaaatctgttctatgcccgtgccccatgcttttatttctgtgtctgaactcaagcagcttatcatgacgagcggtaggcacggccgtggtcgaacccgcggtcgtgccacagaggatattgtcatctccaacgcccaaactggcgaagaatatgcagatgaaagagcatccataccacagaacacaactgtgttggtccgcagaatttccattcctgggcaactgtcagagaagattgttttgtcccctaggccggaagtcacagaagaatgttctgtaccttgccagtcggtggttactgactcaagctcaaagtcatgttcttccacagtagtgcaagatgaagatgctgtaattgcagcagtaattgatgctgctgaactcaaa

SEQ ID NO: 8457 - DNA, 728 bp, Zea mays
  Predicted polypeptide sequence is orthologous to G600, G2768
gaagatacacacaaatgaaatatatgaaaaattgaaaaccacttacatctatcacaaaaactatcaaaacagcatttgcttgtcaatactgcatctctcatcacttttttacatagcctgcagtggagctctgctggcaagtcatcaacagcactaacgggggaagccgggacaagtgaatccaaaatgccattgacaggtgtaactactgggacaagagaacaaagcattttattgttgtcgcacttgggatcaccaatgcttgggcaacgatggataaaatgccctggaattcggcatctgtagcaaatgtatccaggtggaggtatcttgttttcctgtgagcagtgttgaatgaaatggcctggaacaccgcaagagcgacagacatagcctggtggaggtgcctccccttccaatgacccatagttacgtcctgacgtaaaccttccactgccttgtccttttttagacgggagttgttccgatttgagttcagcggcatcaatcactgcagcaattgcagcatcttcatcttgcactaccgtggaagaacatgactttgagcttgagtcagtaaccactgacttgcaaggcacagaaaattcttctgtgactttccgcgtgggggacaaaacgatcttctctgacagttgcccggcaatggaaattctgcggaccagcacagttgtgttctgaggtatggatgctctttcatctgcatattc

SEQ ID NO: 8458 - DNA, 848 bp, Zea mays
  Predicted polypeptide sequence is orthologous to G605, G1944
acgaaaagaaaatgaagaaggaagtagaagaggtggagggccacggttatggcgccgccactcccatgacgccgccgccgtcgtcgctcggtcttccttccccctcggtctcgacattgacctccgccgctgccgctagggttttggcgcggccaatgcccgcctcggtcccaagcttgcgggcgccttcccccttcgtgcgggccatgcgcacccgcgttgatccgccgccgccacagccgctcacggcccctcctcttcttcgtcctcgtccggtgctaccgccgccgccgataccagagaagcagcggcgggggcgcccgcgcaactgcgaccgactcctcccgccgccgccgggcttccaccttgctccgtccgcacgggcaccgctgcctgcccgcggccaaccttcatctagggggcatccctttcgcggtcaattcggtgggctccagttgcacgtgctcaaaatacatgtgggagaggatatcgtatcaaagattgtgcaggtctcgaaaataactgggaaggctgtctgtgttctctcagtgtttggggccgttcaggattgctatctgctccactctgctgtcatcttaaatcacaagggtcctttagaaatcattcatgtgtttggatccattttgacatctgatagtcctggatttgggtgcttatctgcgactcttgcttgtggtgattgttctcttgtcggtggcattgcagttggacctctcatagctgcaacaccggtgcaggcaattgttgggagcttccacaatgatgctttccaggcaaacaagaaacctaagctcgttgcatgttaccccagttctcatgttaccgct

SEQ ID NO: 8459 - DNA, 3149 bp, Zea mays
  Predicted polypeptide sequence is orthologous to G611
gagacggaagccaagcctccaagggggccgtcgcagaactcgcgccaccgcccgccatggcttcgtcatctaaggcctccgactcctcctcccaacgatccaagcggtcggatcaagggacgggcagggaagccgctcccgcctctgttgtcccgatccacgggaacctgacgcagttgatacgccaaatcaaatcgaggcgcctcttgtacatcaaggagaaattggaggctaacaggaagacgctgcagaggcactcctgctcgctgttcgacgtggcagcggcggcggaggtggcgtcgaggggcagcgatggcggcaacgctttgtcgcagcgagcggcggagggacagttcaggctcgctgggtcagacctggcacacgggataggggagagggacgtggtgtacatgcaggaggagaacctggcgtccgggacgctcgtgctctcgagctcgggcgctgccgcgcagcggacagtcgtgcggttcgtgaagctgccgttggttgagaggatccctccgtacaccacttggatcttcctggacaaaaatcaaagaatggctgatgatcagtcagttgttggtaggagaagaatttactatgatccagtcggaaacgaggctctgatctgcagtgacagcgatgaagaaattccagaaccagaggaagagaaacactttttcacagagggagaagatcaattgatatggagagctactcaagagcatgggttaaaccgagaggttgttaatgtcctctgccagtttattgattcaactccatcagaaattgaggaaagatctgaagtcctatttgagaaaaatgagaaaaactctggatcttcagataagatagagaggcaactttctcttgacaaaactatggatgccgttctggattcttttgataatctcttctgccgcagatgcttggtttttgattgtcgcctccatggttgctcacagaatttggtattcccaactgagaagcaaccctacagctttgagcctgatgaaaacaagaagccatgtggtcgtcagtgctaccttcgatggagaggaggatttcaagagattcatgatgttggtcttagtggctgtgcaacatataatatggaatcaggaactgtctcacacaaagttgatgttagtattatgtctgaatcagaagattcaaaccgagagaaaggcaacattaggtccatgacactagttggaaccagtggatcaaaaataatttcttctgttagtgctgaagaaagcactactccgccttcagcagatacctctgaaacagagaatgcatcctctgatatgcctcccagtagtttaaggaaatacaagatttcaaaacgtggacctaggtacagggagcgttctcctggcaaaaggcagaaggtttttacttctgacatttcttttgcaagcaatatactgaataaactttcgattccggagattcgcgacacaagactagagtctagagaacctggaggtgataaactacaaattcttgacgagtccactaagaaaacttcaagcaaagatatctgtggagaaagcccaattactactactgaaaatatgggaatagagagtaaaaaagtatcttcaacaaagaatttcttggagcacactctttcatgttggagtgccttagagcgagatctatacttgaagggcatagagatatttggaaagaacagctgtctcattgccagaaatttactatctggtatgaagacctgcatggaagtggccaactacatgtataacaatggtgcagcaatggcgaagagacctctcttgaataaatccatctcaggcgactttgcagaaactgaacaagactacatggagcaagacatggttgccagaacaagaatctatcgtcggaggggccgcaatcgaaagctgaaatatacttggaagtctgcagggcatccaactgttagaaaaagaattggtgatgggaagcaatggtacacacaatataacccatgcgtgtgccagcaaatgtgtggtaaagattgcccctgtgtggaaaatggaacttgctgtgaaaagtactgtgggtgttcgaagagctgcaaaaacaagtttagaggctgtcattgtgcaaaaagtcaatgcagaagcagacagtgcccctgttttgcagccagtcgtgaatgtgatccagatgtttgtaggaattgttgggtgagctgtggagatggttcactaggtgagccacctgccagaggtgatggttatcagtgtggaaatatgaagctccttttgaaacaacaacaaaggattttgttaggaagatctgatgttgcaggttggggtgcattcatcaagaatcctgtaaataaaaatgattatcttggagaatatactggtgaattgatctctcacaaggaagcagacaaacgtggcaaaatttatgaccgggcaaactcatcatttctgtttgatttaaatgaccagtatgtgttggatgcttatcgcaagggggacaaattaaagtttgcaaatcactcatctaaccccaactgctatgcaaaggtgatgctggtggctggcgaccatcgggttggtatctatgcgaaggagcatattgaggctagtgaggaactcttctatgattatcgttatgggcctgaccaggctccagcttgggctaggagacccgaagggtcaaagaaggacgaagcatccgtctctcaccatcgagcacacaaagttgctcgatagctgaagagcagctccggatgatacaatatgcagtaaattatatatttaatacatgatttagtcctagttcattatacgaggacttcgttggtagataagcatattgtatattcattagtgaataaactcccatacatcaagttggggaataagtgcatataaatattttttaccttaggtcggaaggtgacaaactgacaaccttgttaggttgagtaaagttagtgcttacaggttttcaaactggtgtggctattgctagagtatcaaatagctgagatggctacaactatagccttatttgtatttttttttggcaagagggatggaatttatttgccaaatgtacacattgttgctggaagtatttaatgattcaggtgttcttcaaaaaaaaaaaaaaaa

SEQ ID NO: 8460 - DNA, 3047 bp, Zea mays
  Predicted polypeptide sequence is orthologous to G611
ccgtcgcagaattcgcgccaccgcccgcgatggcttcgtcctcgaaggcctccgattcctcccaacgatccaagcggtcggatcaggggatgggcaaggacgccgctgccgcctctgttgtcccgatccacgcgaacctgacgcagctgatacggcaagtccaatcggggcgcctcgcgtacatcaaggagaaattggaggtgaacaggaaaacgctgcagaggcactcctgctcgctgttcgacgtggcagcggcggcggaggtggcgtcgaggggcaccgatggcggcaacgcgctgtcacagcgcgcggcggagagacagtgtgggtcagacctggcaaacgggataggggagagggacgtggtttccgttcaggaggagaacctggctaccggtacgctcgcgctctccagctcgggcgctaccgcgcagcggacaattgtgcggttcgtgaagctgccgctggttgagaagatccctccgtacaccacttggatcttcctggacaaaaaccaaagaatggctgacgatcagtcagttgttggtaggagaaggatatactatgatacagttggaaacgaggctctgatctgcagtgacagtgatgaagaaattccagaaccagaggaagagaaacactttttcacaaagggagaagatcatttgatatggagagctactcaagaccatgggttaaaccaagaggttgttaatgtcctttgccagtttattggtgcaaccccatcagaaattgaggaaagatctgaagtcctatttgagaaaaatgagaagcactcaggatcttcagataagatagagagccgactttctcttgacaaaactatggatgccgttctggattcttttgataatctcttctgccgcagatgcttggtttttgattgccgccttcatggttgttcacagaatttggtatttccatgtgagaagcaaccctacagctttgaccctgatgaaaacaagaagccatgtggtcatttgtgctaccttcgatttccccagtggagagaaggatttaaagagatgcatgatgatggtcttgctggtggtgcaacatatactatggaatcgggaactgcctcacagagagttgatgttaatgttatgtatgaatcagaagattcaaaccgacagaaaggcaacattaggtccatgacactagttggaaccagtggatcaaaaataatttcttctgtcagtgcggaagaaagcactactactccttcagcagatatctctgaaacagagaatgtatcctctgatttgcctcccagtagtttaaggaaacacaagatttcaaaacatggacctaggtacagggagcattctcctggcaaaaggcagaaggttttcacttctgacatttcttttgaaggcaatataatgaataaactttccattccggagattcgtgacacaagactagagtccagagaatctggtggtgataaactacgaattcttgacgagtccactaagaagacttcaaggaaagatatgtgtggggaaagcccagctactaccatggaaaatgtgggaagacagagtaataaagtgtcttcaacaaagaatttcttggagtccactctttcttgttggagtgccttagagcgagatctatacttgaagggcatagagatatttggaaagaacagctgtctcatcgccagaaacttactatctggtcttaagacctgcatagaagtggcaaactacatgtataacaatggtgcagcgatggcgaagagacctctcttgaataaatccatctcaggcgactttgcagaaaatgaacaagactacatggagcaagacatggctgccagaacaagaatctatcgtcggaggggccgcaatcgaaagctgaaatatacttggaaatctgcagggcatccaactgttagaaaaagaactgatgacgggaagcaatgttacacacaatatagcccatgtgcgtgccagcaaatgtgtggtaaagattgcccctgtgcggacaagggaacttgctgtgagaagtactgtgggtgttcgaagagctgcaaaaacaagtttagaggctgtcattgtgcaaaaagccaatgcagaagcagacagtgcccctgttttgcagccagtcgtgaatgtgatccagatgtttgtaggaattgctgggtgagctgtggagatggttcactaggtgagccacttgcaagaggtgatggttatcagtgtggaaatatgaagctccttttgaaacaacagcaaaggattttgttaggaagatctgatgttgcaggttggggtgcattcattaagaatcctgtaaataaaaatgattatcttggagaatatactggtgaattgatctctcacaaggaagcagacaaacgcggcaaaatttatgaccgggcaaactcatcttttctgttcgatttaaatgaccagtatgtgttggatgcttatcgcaagggggacaaattgaagttcgcaaatcactcatctaaccccaactgctatgcaaaggtgatgctggtggctggcgaccatcgggttggtatatatgcgaaggagcatattgaggctagcgaggaactcttttatgattatcgttatggacctgaccaggctccagcttgggctaggagacccgaaggatcaaagaaggacgaggcatccgtctctcaccgtcgagcacacaaagtggctcgatagctgaagagtcgctccggatgatacaatatgcagtaaacttaatacttaatacatgattcagtcctagttcattggtagataaacatgctatatactatccattagtaaataaactctcattcatcgagttggagaataaatgcgtataaacatatgtggacctcaggtcgggaaggtggcaaccttgttagtttgagcaccaacaggttctcaaacttgagtggctattgctagagtatcaaataatggctgcgactatagccttgtttgtatattttcttggtgagatgaaataatttgtcaaatgtacacttaaaaaaaaaaaaaaaaaaa

SEQ ID NO: 8461 - DNA, 3180 bp, Zea mays
  Predicted polypeptide sequence is orthologous to G611
cgcgtgtgagggcgggagagcgcgcggggctagggtttccacgggtgatggaagcagaggctgccgcggcggtagtggcgtcgtccgcatctgcctcggcttccgcgggccggtctcgcccatctagcagcgccgcccaggtcaccagtaattcggctgtgcgagctggagaagaaaatgctgcctccctctatgttttatctgttattgactcgttaaaaaagaggattaccgcagatcgtttgacttacattaagaataggataggggagaacaagactaatatcagcagctatacacagaggacttacaatttatcaaaaaataggcaaattagtacatcaaagggtactgattcagcatcaaatttgctcacaaaaaggcaagatgatgcgctatgcaccctgcatagtcttgatattattccggttgacaaagatggtggtacttttcaagacgaaagtcctttctcttcatctaatgttatgtttggtggaaatcttggtcccaagaatgctattattagaccaattaaactaccagaagtgccaaagcttccaccttatacaacatggatatttttggacaggaaccaaaggatgacagaagaccaatctgtacttggtcgacggaggatttactatgataccagttgtggtgaagctctaatttgcagtgatagtgaagatgaagccattgaagatgaggaggaaaaaaaggaatttaaacattctgaagatcacattattcggatgacagttcaagaatgtggcatgtctgatgctgtactgcaaacgctagctcgacacatggagcgggctgctgatgacataaaggccaggtatgaaattctgcatggtgagaaaactaaggattcttgcaagaaagggactgagcataatgtcaaagtggaagatttgtactgtgacaaagatttggatgcagcattggattcttttgacaatctcttctgtcgacgatgtctagtgtttgattgcaagctacatgggtgttctcaagatttagtatttcctacagaaaaacaaccagcttggagtggcgttgatgacagtgtaccctgtggtattcattgccataaactggcatctgaaccagatgctgctgctggtgctgatcacatgctttttgatgttgaggagccaactcactcatcagacaatgtgatgaaccagccaggttcaaataggaaaaagaacggctccagtggaaggaagactaaatctcaacaaagtgaaagctcttcaactgcaagagttatctcagaaagcagtgattcggaagtacatccaataagcaataaatctccacaacactcccctagtccctcaaaagttaaaattgggccgaaaggtggaatcagaaagattaccaatagacgaatcgctgagagaattcttatgagtgtgaagaaaggacaaagggaaatggcatcatctgattctaattttgttagtggatatcttttggcaagggacatgaagcttaggtctgatacacgaaatggaaataaggaattaattgtatcctcacaacagagttctccaagcacaagaagttccaaaaagaagagtacacctcaaattgggaacagctcagcttttgctgaggctcataatgattcaacagaggaagcaaataaccgtcattcagcaacagatggttacgatagttcaaggaaagaagaattcgtcaatgagaatttatgcaagcaggaggtgtacttgagatcatggaaggcaattgagcagggacttcttgtgaaaggattagagatttttggaaggaacagttgtttaattgctcggaaccttcttggtggaatgaagacgtgcaaagatgtttttcaatatatgaattatattgaaaacaacagtgcctctggagctcttagtggtgttgattctcttgttaaaggatatattaagggtactgagttgcgcacaagatcaagatattttagaaggcgaggtaaagtccgtcgtttgaagtacacctggaaatctgcaggttacaatttcaaaaggattaccgaaaggaaggatcagccttgtcgacaatataatccttgtggttgtcaatctacatgcggaaagcagtgtccatgtctttcaaatgggacatgttgtgagaaatactgtgggtgtccaaaaatttgcaagaatcgttttcgaggatgtcactgtgcaaagagccagtgtcgcagccgccaatgtccatgttttgcagctgacagggaatgcgatccggatgtttgcagaaactgttgggttgggtgtggtgatggtacattgggagttccaaaccagagaggagataattatgaatgccggaacatgaaactgcttcttaaacaacaacaaagggtcttacttggaagatcagatgtctctggctggggagcattcctcaagaatagtgttagcaaacatgaataccttggtgagtacactggggaactaatctcacacaaagaagcagataagcgtggaaagatatatgatcgtgagaactcatcgttccttttcaacctgaacaatgagtatgttcttgacgcatacagaatgggtgacaagctgaaatttgccaaccatgcccctgacccgaattgctatgccaaggttatcatggtaactggtgatcatagagtgggcatattcgccaaagaaagaatcctcgctggtgaagagttattctacgattaccgctatgagcctgacagagctcctgcttgggcccgtaagcctgaggcgtcgggagcaaaggatgatgggcaaccgttcaatgggcgtgcaaagaagctcgcccaaaacaaccgaggctgaatctgatttgattctttcattgttaggacaaatttggcagccattcaactaatacaaggaacctgtcattcataggccccaatttatttgaactcgtcattgtaactcgtatgtgcttgaattctccatggcatctggtcctgccatccgtagagttaggtcccgtttgttttgaggaactaaaaattaatccctctattttagtcacattgagtcttagattgttaaacggcgggactaaaacaaaagactaaactatttgtctctagtacctcaagccatgactaaaagggaataaatcatataaattttatttttatccttcctttaaaaaaaa

SEQ ID NO: 8462 - DNA, 901 bp, Zea mays
  Predicted polypeptide sequence is orthologous to G616
gcacgcggtggggctccggcggcaaggaccgccacagcaaggtgtcctcggccaagggcatccgggaccgccgcgtccgcctctccgtcgccaccgccatccagttctacgacctgcaggaccgcctcggctacgaccagcccagcaaggccatcgagtggctcatcagggccgccgccgacgccatcgacaagctcccctcgctcgacaccgccgcaggcttccccgcgcacccggcctccgccaaggaccacgccccgcctgctggtgacaacgacgaccaccaccaccagcagcagctcacgaggtccggatgcagcagcacgtccgagaccagcaagggctccgtcctctccctctcccgctccgagagccgggtcaaggcgcgggaccgcgccagggagcggagcgccgttgccagggacaaggacaaggaccccgccgctgactccaggcgcgccgcggctacaagctcagcgcaggcggcatccttcaccgagctgctcacggggatggctgcggccagcagcgccgcccccgccgaacacaagcaccaccagcagtcgttggtgtcctggcagccgccgtccgtctccgccaccaccgactacatcgggttcgcgcagccccggaagggcgggggacacgcgatggcgcacacttttgcctcccccgctccccacctcggcaacattgcgtccatcgccatggccccggcgcagcactaccaccacttggccagcggtgccgtcactgtcgcctctggcggcggcgagccgcacgccgatatgacgcacttctcgttcttgcaggaccacttcatgcccgtccacgcgatgccggcgtcggctcccgccggagaatacaacctcaacttctccatgtcctcgggtcttttggg

SEQ ID NO: 8463 - DNA, 767 bp, Zea mays
  Predicted polypeptide sequence is orthologous to G616
gccagcctatgagcagcgcttgcggcggcggcggttgtagggaatggaggcagcagccgtgggcgacggcgcgccagcgggccgctcccatcagggcgcctgtcggcgcccaccgccatccagttctacgacctgcaggaccgcctcggcttcgaccagcccagcaaggccatcgaatggctcatcaacgccgccgcctccgccatcgagaagctcccggagctcgacccggccgccttcgccgcccttcccgcgccgggcggcgcggatgccgccggcaatgataagcagcagcagcaggggagcaagtccgcgggcagcagcacgtcggagacgagcaaggggtccgagctctcgctctcgcgctccgacggccgtgggggcgccgccgcgcaggacagggtggtcaccgtggccagcacctcggcgcaggccgcgtccttcaccgagctgctcaccggggtggcgtcggccggcgccattagcgccggcgaacataggcagtcgtggcatcagcagcccaacgtctccgccggcgccggcgccgaccgcgtcggcattgcgcacaacgggaaaggcgcgcacgggctgtcgacggcgacgcacgccttttctggccccgccgccgccaagtttggcaatgcgcctccgttcggcctggtgccggcacagcctttcgacttcaccatccccatcgagatgcctcacttctcgctcggtcaggacacttcggcggcgtcctcgtctggcgccggggactacagcct

SEQ ID NO: 8464 - DNA, 878 bp, Zea mays
  misc_feature (123)..(127): n is a, c, g, or t
  misc_feature (319)..(340): n is a, c, g, or t
  misc_feature (354)..(358): n is a, c, g, or t
  misc_feature (403)..(440): n is a, c, g, or t
  misc_feature (443)..(447): n is a, c, g, or t
  misc_feature (562)..(606): n is a, c, g, or t
  Predicted polypeptide sequence is orthologous to G618, G2057
aaccaaagactcctgtccccatccgcttaattatcaggctaacaacaacaacatccgctggctggcactgctctgccgcttatagctcctccctgaaccccaggaggaagcacactagctaannnnnatcgatccgtgcagagcgccagcgagaacaacagcaaaattaagatgcaaaagcttgagaactactacagcaactagaacatcaactaaacctactgtaacaacgcagcaaacggacaagcagcaagagatctagtgaagaagccaatgtgctgcgttctcacatgcctaatttctaagaagagaagctccnnnnnnnnnnnnnnnnnnnnnntcgttcttggagcnnnnnccagtgacgtacacaaagcagcgagagatgtagagaaaccgaccnnnnnnnnnnnnnnnnnnnnnnnnnnnnnnnnnnnnnntcnnnnngagtgcttcgctcccaaccttgctcctccattttgctgcagccatccgttgtcgtaggaagcagcagcaaagtaactacctgggcggtgcatgttgaggagctagctgacggtgnnnnnnnnnnnnnnnnnnnnnnnnnnnnnnnnnnnnnnnnnnnnntcgtgatggtggttggtggcatgttgggcgcgcggagtaatctgcgctccactgctctgccgtcgtcagtggtgagaagccgaggacacggacgacgagcggcggcttgtcgccattgccgccgttgtgctcctcgtcgccctgcatcctggtggggatgcggatcccggagaagccgacgccgggcgagaacccgatggccgacacagcggggctgagcccgccgtgctgcatcgggttgtcggcttcgacgctctccggccatcctcgct

SEQ ID NO: 8465 - DNA, 1173 bp, Zea mays
  Predicted polypeptide sequence is orthologous to G620, G1821
ccacgcgtccgccaccacaccacgagcgcgcgataaccctagctagcttcaggtagtagcgagagccaatggactccagcagcttcctccctgccgccggcgcggagaatggctcggcggcgggcggcgccaacaatggcggcgctgctcagcagcatgcggcgccggcgatccgcgagcaggaccggctgatgccgatcgcgaacgtgatccgcatcatgcggcgcgtgctgccggcgcacgccaagatctcggacgacgccaaggagacgatccaggagtgcgtgtcggagtacatcagcttcatcacgggggaggccaacgagcggtgccagcgggagcagcgcaagaccatcaccgccgaggacgtgctgtgggccatgagccgcctcggcttcgacgactacgtcgagccgctcggcgcctacctccaccgctaccgcgagttcgagggcgacgcgcgcggcgtcgggctcgtcccgggggccgccccatcgcgcggcggcgaccaccacccgcactccatgtcgccagcggcgatgctcaagtcccgcgggccagtctccggagccgccatgctaccgcaccaccaccaccaccacgacatgcagatgcacgccgccatgtacgggggaacggccgtgcccccgccggccgggcctcctcaccacggcgggttcctcatgccacacccacagggtagtagccactacctgccttacgcgtacgagcccacgtacggcggtgagcacgccatggctgcatactatggaggcgccgcgtacgcgcccggcaacggcgggagcggcgacggcagtggcagtggcggcggtggcgggagcgcgtcgcacacaccgcagggcagcggcggcttggagcacccgcacccgttcgcgtacaagtagctagttcgtacgtcgttcgacttgagcaagccatcgatctgctgatctgaacgtacgctgtattgtacacgcatgcacgtacgtatcggcggctagctctcctgtttaagttgtactgtgattctgtcccggccggctagcaacttagtatcttccttcagtctctagtttcttagcagtcgtagaagtgttcaatgcttgccagtgtgttgttttagggccggggtaaaccatccgatgagattatttcaaaaaaaaaaaaaaaaaa

SEQ ID NO: 8466 - DNA, 1081 bp, Zea mays
  Predicted polypeptide sequence is orthologous to G620, G1821
ccacgcgtccgcatgaataatccccaaaaccctaaagccagtgctccttgcaccttgccaccggagcttcccaaagaagcagtggcgaccgacgaagcaccgccgccaatgggcaacaacaacaacacggaatcggcgacggcgacgatggtccgggagcaggaccggctgatgcccgtggccaacgtgtcccgcatcatgcgccaagtgctgcctccgtacgccaagatctccgacgacgccaaggaggtgatccaggagtgcgtgtcggagttcatcagcttcgtcactggcgaggcgaacgagcggtgccacaccgagcgccgcaagaccgtcacctccgaggacatcgtgtgggccatgagccgcctcggcttcgacgactacgtcgcgcccctcggcgccttcctccagcgcatgcgcgacgacagcgaccacggcggtgaagagcgcggcggccctgcagggcgtggtggctcgcgccgcggctcgtcgtccttgccgctccactgcccgcagcagatgcaccacctgcacccagccgtctgccggcgtccgcaccagagcgtgtcgcctgctgcaggatacgccgtccggcccgttccccgcccgatgccagcccgtgggtaccgcatgcagggcggagaccaccgcagcgtgggcggcgtggctccctgcagctacggaggggcgctcgtccaggccggtggaacccaacacgttgttggattccacgacgacgaggcaagctcttcgagtgaaaatccgccgccggaggggcgtgccgctggctcgaactagcctagcttctcagttccccgtgtacaataagaggggcggtcgcggcgccgcgccgcgcccttgggttgggccgggcgctatgctgcagtttggtttgtaaactaacgagcctagggtagctggtgcacgcgcgccacctcgccggacgtcgccgtcgtcgtcggcatggacttaaccggcgggccctgttgttatttctcaagtttgtagccaacgcactgttcggtgcgttccataatttaatttaccatgttgctctcgaaaaaaaaaaaaaaaaaaa

SEQ ID NO: 8467 - DNA, 2326 bp, Zea mays
  Predicted polypeptide sequence is orthologous to G622
gcacgaggagatggatcgcatccaaataatcttcatgattctaatcaccattgtggagaaaatgactctttgtcttctaggaaagtggcaatgccagaagcttctacaagtgtggatgctggtttcaagcttgattcacatcatacatctaatttaaaggatgatccaccatccctttcagttggtctggcttctaattttgcaccacagaatggaccgaaagaccatatcagaattgcacctactcagcagcaatcacaaatgacttcctcctcattgcagaaacaattctattctcatgctgtaactggttataatgaattccaagcacagatgcgcaatggaagacccagaatggattcaaaggctagatcacaattacttccccgctattggcctagaataacagatcaagagctacaacacttatctagcgattcaaattctgttattactcctttgtttgaaaagatgctaagtgctagtgatgctgggcggattggtcgtttagttttgccaaagaagtgtgctgagacatacttccttcaaatctcccaacctgaagggttccctttaaaggttcaggttgccagtgttaaagaatggatattccaattccgtttctggccaaataataatagcaggatgtatgtattggagggtgtcacaccttgcattcagtcaatgcagttacaagcaggcgacacagtaacctttagtcgaatagacccagaagggaaattgatcatgggcttcaggaaggcaactaacaattctttcgaacaggagcaagctacaaagcctgccaatggcgccctagcaacttcagaagcaaatggtaaagtttctgccccagattccagtccaaatgctgcagtttcccgtcaaaacaagctcaacacagagaccaaaagttctagtcctgtggaacaagccactgcattgaaaatggacaaggatggattaacacagaaggaagggcctggaactggtagttcttccccaggttctgtcaagagaaaaacaactattcttggtcaaaagaataaaagattacggatggataatgaggaatcaatggagttgaagataacatgggaggaagctcaagaattgcttcgccctcctcctaaggccccatccattgttattgttgatggccatgagtttgaggaatatgaggagccgccggtacttggaaggaagacttattttgtagcagataaatcaggttcgaaccatcaatgggcccaatgtgaagattgttccaaatggaggaaacttccaatagatgctctgttgccctccaaatggacctgctctgacaacaaatgggatccagagaggtgttcttgcgaatctgcacaggaaataagtatagaggagcttgcagaattcattcctataaaacctgccaaaaagcccaaattgaagatagaatctgatgctatcgatgcttcagatgggctggacacgcttgcaaaccttgcgattcttggtgaaggtgaagctctcccttcacagccaacaacaaaacatccccgccatcgtccgggctgctcatgcatcgtctgcatccaaccaccaagcgggaagggtccaaagcacaagcaaacttgcacctgtaacgtttgtatgacggttcgccgccgtttcaggacactcatgcttcgacgcgagaagaaggcgacaaaggatccgtctcgcaagaaagagacaggccaatccagtgagaaggccacacaacaagctgtgtccggtcctccaggagccaatgccactgcaaccagatctgcccagaaagcagatggaaacgccgatggacctgaagacatggccgtcgatcacaaggtgacaacatcctctcccgtcaagaaccatattgacctgaacatccaacctgaacgggacgatgagcagtcaccgaaatctggtgcggctggtttgttgagccgagacaatgcaacttagagagtggatagcgttgtttgattgatcataccaatgagtggacatagataaccgatcgaacatatccttccgaatgtctatacccttgttttttttaagatagatgtggcgtgaggcgtggggtcttgtagtgtagctgttaccttcccataccatagagccggtttccttttaccctgagactccagtggtaatgttatcgtgtataccaaagggcaggacacccgtaggtgttgcgtggggacttgcataaccctgtatgcatgtatattgcaagaccagctcgttttggctgaatgtgaaccgtaagttgctactgtacccctgcacatatttcccccgaaaaaaaaaaaaa

SEQ ID NO: 8468 - DNA, 864 bp, Zea mays
  misc_feature (781)..(781): n is a, c, g, or t
  misc_feature (805)..(805): n is a, c, g, or t
  misc_feature (833)..(833): n is a, c, g, or t
  misc_feature (860)..(861): n is a, c, g, or t
  Predicted polypeptide sequence is orthologous to G622
caggcgttaccgtaaccttcagtcgaatagatcctgaagggaaattgatcatgggctttcggaaggcaactaataattcttttgaacaggagcaagctacaaagcctgccaatggtgcaccagcaacttcagaagtaaatggtaaagtttctgccccagattgcagtccaaatgctgcagtttcccgtcagaacatggtcgagacagagaccaaaagttctagccctgtggaacaagccactgcatcaaaaatggataaggacagattaacacagaaggaaggacctggaattgctagttcttccccaggttctttaaagagaaaaacaactaatcttggtcaaaagaataaaagattacggatggataatgaggaatcaatggagttgaagataacatgggaggaagctcaagaattgcttcgccctcctcctaaggtcccatccattgttattgttgatggccatgagtttgaggaatatgaggagccacctatacttggaaggaagacttattttgtagcagataaatcaggtgtgaagattgttccaaatggagaaaacttccaatagatgccctgttgccctccaaatggacctgctttgacaataaatgggatccagaaaggtcttcttgcgaacctgcacaggaaataagtttggaggagcttgcagaactcattcctataaaacctggaaaaaagcccagattgaagatagaatctgatgctattgatgcttcagatgggctggacacgcttgcaaacccttgcattcttggncgaagtgaagcgctcccttcgcangcacaacaaaacatccccgcaccgtccnggctgctcatgcatcgtctgcatcaanncac

SEQ ID NO: 8469 - DNA, 697 bp, Zea mays
  Predicted polypeptide sequence is orthologous to G624
gtgcaggggtacagtagcaacttacggttcacattcagccgaaacgagctggtcttgcaatatacatggttatgcaagtccccacgcaacacctacgggtgtcctgccctatggtatacacgataacattaccactggagtctcagggtaaaaggaaaccggctctatggtatgggaaggtaacagctacactacaaggccccacgcctcacgccacatctatcttaaaaaaaaaacaagggtatagacattcggaaggatatgttcgatcggttatctatgtccactcattggtatggtatgatcaatcaatccacgctatccactctctaagttgcattgtctcggctcaacaaaccagccgcaccagatttcggtgactgctcatcgtcccgttcaggttggatgttcaggtcaatatggttcttgacgggagaggatgttgtcaccttgtgatcgacggccatgtcttcaggtccatcggtgtttccatctgctttctgggcagatctggttgcagtggcattggctcctggaggtccggacacagcttgttgtgtggccttctcactggattggcccgtctctttcttgcgagacagatcctttgtcgccttcttctcgcgtcgaagcatgagtgtcctgaaacggcggcgaaccgtcatacaaacgttacaggtgcaagtttgcttgtgct

SEQ ID NO: 8470 - DNA, 880 bp, Zea mays
  Predicted polypeptide sequence is orthologous to G634
gtggcgccgaggcgacggaggggcgcagtccggcataggcggcgggggcacgacgccggcgccgtgcggagggagccgcgcgggctcgccctgccccccgccgacacgctggaggaacgcgatcagcgcggcgtcgcgggaggccgcggcggcgcgctccctggcgagctgctcgcgctcgcggttcatgcgggcgacctcctggcgccgccacgcctcctcgcgcgccgtgcgctctgcctcgcaccgctccagcgtctccaggaacacgcgctgcatggcgtcttgcttctccgtgaactgcttcatcatcctctcgaaggtggccatcatctccctgtcgcactcgcccccgctgaggccctcctcccccgcaccagagtcgtcgtcgtcgtcgtccgagtcgtactctgagtcggactcggacatcgacgagaagctgaggtccggcaggccggcgacggcggcagggcccagcaccgtagggcccgccgtccatgccatttccatcggctgatgagggccagcttgcaccgtggtcatgcccgagggcgggggcggcagaggcggcgccgaggcgtgcagcgcctcgagctgcgagaagaagcggtagctcttgccgtcctggcgcccggcgcgggcgtccttggtgcgcctgtagtacttgtccacgttctcgaacttctccttgcacttcttggcgctccggtggtaacccagccctgcaagcttccttgcgacgttctcccagagcggcgctttgagcggggagctccggaagtcggcgtccatctccgtccggatcctgatgagcgccagcgtctcctcgcgcggccaccggttgccggacgctcccgcgccgctggcgcccagtcggcct

SEQ ID NO: 8471 - DNA, 899 bp, Zea mays
  Predicted polypeptide sequence is orthologous to G634
caagtactacaagcgcacaaaggaaggccgcgccggcaggcaggacggcaagagctaccgcttcttcgaggagctggaggcgttgcacgcagccgcgccgcagccgccaccacagcacttgccggcagccagcaccgccccgcagttgcacgccctcgccgcgccagtatccccgacgccccagcagcagttgccggcatccagcgccgccccgccgttgcacgccttccccgcgccagtatccgcgccgccgccgttgagttcaatgccactgctgacagggccgatgcagccagcgcccatatcatcggcggccccagccccggcaccggtggatctgctcgtggcccaccagcccctcaacctgcaaggcttcagcttctcttccatgtcggactcggagtccgacgacgagtccgaggacgacgacatgacggcggagacaggcggaaaccaggaccgcctcggcaagcggaagcgcggcgacggcggcggcagcagcagcaacaagatgatgtctttcttcgaggggctcatgcagcaggtcgtcgacaggcaggaggaaatgcagcggcggttcctggagaccatggagaagcgggaggccgagcgcacggctcgggaggaggcgtggcgcaggcaggaggtcgcccgcctcaaccgcgagcaggagcagctcgctcaggagcgcgccgccgcggcctccagggacgccgccatcatcgccttcctccagcgcatcggcgggcagtccgtgcagccccctgctaccgccgttgttgtcccaatgccagcaccggtgtcagtccataccacgccgccgaaacaaccttctcgccagcagcagcaaccgccgccgccgtcgccccagggccggccggcgacaccgcagtcgaagc

SEQ ID NO: 8472 - DNA, 1931 bp, Zea mays
  misc_feature (95)..(99): n is a, c, g, or t
  misc_feature (285)..(289): n is a, c, g, or t
  misc_feature (301)..(342): n is a, c, g, or t
  misc_feature (404)..(408): n is a, c, g, or t
  misc_feature (587)..(592): n is a, c, g, or t
  misc_feature (713)..(809): n is a, c, g, or t
  misc_feature (1154)..(1179): n is a, c, g, or t
  misc_feature (1353)..(1358): n is a, c, g, or t
  misc_feature (1439)..(1444): n is a, c, g, or t
  Predicted polypeptide sequence is orthologous to G635
ccacgcgtccgaaaggaagagtaattacgacacagtttgcctcaaacatacatcgaattgggagcatcaaagctgctgcagatttaactggtcgnnnnntggtatttgttggaatgtcactcaggacataccttgaagctgctttcaaggatggaaaggcaccactggatccatcaaccttgatcaaggtagaggatatggatgcgtatgcccctaaagatcttttggttgtcactacaggttcacaaggagagccacgtgcagctctgaatcttgcatcttatnnnnnaagtcacgctcnnnnnnnnnnnnnnnnnnnnnnnnnnnnnnnnnnnnnnnnnnttattcctggaaatgagacacgggtaatgaagatgatgaatcgtctcactgatcttggcccnnnnnttatcatgggtaaagattctggcctgcatacctctgggcatgcctaccgagaggagctggaggaagttcttcggattgttaaaccacaacatttcttgcctgttcatggagaactcctatttctcaaagaacatgaatcacttggaagatcaactggcatacggcacacaactgtaatnnnnnntggagaaatgcttggtgtatcgcatctaagaaacagaagagttttgtccaatgggtttgtttcattagggaaggaggatcttcagctcatgtatagtgatggtgataaagcttttggtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagcgcagtctggtttgaaaggaaaatttaagattacgacaagatgtctatggcttgataatggaagattgttagacgcactctacaaagcagctcatgctgcattgtcaagctgtcctgtgaattgtccacttagtcacatggagaggatggtagctgaaatcttgaggaaaatggtacggaagtatagtgggaagaggcctgacgtcattgcggttgctatggagaacaccacagcaagtatctcagaacacctcgatgctaaatcatctggaaattttggaccttcctcagctactagccatctgagcaggagtccagctatgactcttgaaggcagttannnnnnnnnnnnnnnnnnnnnnnnnntggatgctgaagaaacccttcctgaggccgcgagaacagcaccagatgatgcaaccacaagttccaatggtgaagcattcttctcttcagatttacatcagcctaaaacattggagcacttctgggagtcattcaaatctcctacagctgttaaaattgcacggattgtcaatnnnnnnaagaagcaaaatctcggcaagattggcataatgggtaaggactcatcaatccagtcagctccggctccagctaaatcttcnnnnnngaacaagtggaaacctgaggaaatcaagagcttaatacagatgcgtggcgagatgaatgagagatttcagagcgtgaaaggaagaatggtcctgtgggaggagatttccgacaacatgttgaagcaaggaataagtcgtactccggcacagtgcaaatcgctttggacatcgttagttcagaaatacgaggaaagcaagaaggacgcggagagcatgaagacgtggccgtatttctcggccatagataggatcctttcgcagcaaggggaaatggcaaccaaaggatagagaaggctgtagcttagtggtagaagtttagaacatttgatatgttgtagcagagcccagtcagtgtagtgaggatataagatgaaatgtactgtgtacaggtactgaggtacagcacctggcaatttattgggaccggattcccttgttctaagtaaggtcgacgatcggtagcacgagatctagatggcaatttat

SEQ ID NO: 8473 - DNA, 1458 bp, Zea mays
  Predicted polypeptide sequence is orthologous to G635
ggtttgtttcattagggaaggaggatctccttctcatgtatagtgatggtgataaggcttttggtacatccactgatctctgcgttgatgagagactaagaattgcatctgatggcattatttttgtaagtatggagatcttccgacctcagaaggaacatgggttagcgcagtcaggtttgaaaggaaaatttaagattaccacaagatgtctatggcttgataatggaagattattggacgcgctctacaaagcagctcatgctgcattgtcaagctgtcctgtgaattgtccacatagtcacatggagaggatggtagctgaaatcttgaggaaaatggtacggaagtatagtggaaagaggcctgacgtcattgctgttgctacagagaacaccacagcaggtttctcagaacacctcgacactaaagcatctggaaattttggaccgtcctcagctactagccacctgagcaggagtccagctacgagtcttgaaggcagttataaaacacacccagacaacccagaggtggatgctgaagaaatccttcccgagactgtgagaacaacacccgacgatgcaaccacaagctccaatggcgaagcattattctcttcagatttacatcagcctaaaacattggagcacttttgggagtcattcaaatcccctacagctgtcaaaattgcacggatcgtcaatgggggggacaaacaaaatttcggcaagattggcataatgggtcaggactcattaatccagtcagctcctgctccagttaaatcctcaaaacggaacaagtggaaacctgaggaaattaagagcttaatacagatgcgtggcgaaatgaatgagaaatttcagagcgtgaaaggaagaatggtactgtggaaggagatttctgataccatgttgaaccaaggagtaagtcgtactccggcacagtgcaaatctctatggacatcgctagttcagaaatatgaggaaagcaaggatacggaaagcatgaagacttggccgtatttctcggccatggataagattctatcgcagcaaggggagatggcaaccaaaggatagaaaaaggcttgtagcttagtggtagaaatttagaatattgattggtatgttgcagcagagcccagtcagtctagtaatataaagatgaaatgtctgtctacagtgcctggtgatctattgggatcggattcttttgttttgtgtaagacatgcagtagcacaagatcgagatgcatcgactggcttgaaattaagcttcagggcccgtggactcagagcggggtagccaggagcgctctattcttagcaacaggcagacatgtgtggttttatctgccagataacgtttgtaactcctataatgtaataggctacacggtaggcgaacggcgaacccctaaaaggcaactgatgtatcatatgttttgaggag

SEQ ID NO: 8474 - DNA, 967 bp, Zea mays
  misc_feature (805)..(805): n is a, c, g, or t
  Predicted polypeptide sequence is orthologous to G636
caagaagcgccccgaggactccaaaacgtgcccctacttccaccagctcgacgcgctctaccgcaacaaggcagcgctgagctcctcctccggcgtcggagccccggtgcacgccaacgcattgccggcaccgcaggagacggtcacggtcgtcacggccgcggcgcccatctcacagacgccgccgccgacacagccttctcagtcccaccactacgctgccaagaacggaggcaccgggaacgggaacggcggcggcgcatcagagcacggctccagaggcatgcaaacgcaggcgagcaacggcagcgttggagccagcaggttcgtcggcgaaggcggcggcgcggcctcggcggcgaagaagaggacattatgaaggagatgatggagcagaggcaggcgccgcagcagcagcagcagacgcaggcggtggtcagtggctacaacagaatcgacgacgacgaagatgtcgacggcaacaaaatgcagtacgagatccagttccagcgccagcaaccgcaccatcaccagcagcatccgaatgccgtcaggccgaacgccggcgccggcggtggaaacccgcccggcaccgccgccgctcccagcacggctgcggccccgacaacaacagccggatcgtctttcctgggcatggtccagtgatcgatccgtccgcgcgcacccaggcattatcccccggtgactctcatcctcctccacttctccatggcttcttttctttctctcgctcgcatgtgacatttgtgtctacccacctgtcgcctccatgcatgctcgtccnaatctctagttctctacacctctaaaccaaaaatcacaagaactatctctctcagcatctccatgctccggcaattcttcattcctcatatatgcacctagcaacacctcgatccatgtcgggtcgtcgtcgctgctgcatgcccccccccccctttttttg

SEQ ID NO: 8475 - DNA, 477 bp, Zea mays
  Predicted polypeptide sequence is orthologous to G638
atacgctttttttttttttttttttttttttttttttaacgtggaaaacccctctaaagcgaaggggaaaaaccacgggcgccggccagcaacttttcactattttcgggtggttatagatcgcaggagatttacaattgagataattatctcctacggcttacaaagatatttatagaggtgaaaccctaaaatgagtagggaaacgatctgtatggcccaggcctcccggcgacgggcctccgcttcgctcgccaacttggtcgccttcttcagaatttggatcacaaactcaacagaagtcgcttgccgctttctcaaacacggcccgccggagggcgaatagcgcgagccgcttctcgggcggctcccggccgtcgccccctccggagctgccgcgcccgcttccgctgctgcccggcgtccgctcacgccacgactcgaagaaggacgccgagtcggcggtgcctccggtcc

SEQ ID NO: 8476 - DNA, 836 bp, Zea mays
  Predicted polypeptide sequence is orthologous to G643
cgacagtcgacagcagcacacacactcgggtctcgagctccctccccccgcgtgtcgccctcgacggcgtcgccgcgccgtgcccagccccatggatcccgccgctgcggaccggccgtgtgtcatccagtcgctcccggcgaactgcaacaccctaccgccgcccctggtccaggcactcccggcgaactgcaacaccctaccgccgcccctggtccaggcgctcccggccaagaccaaccccagccagccttcctcccccaccgccaaacgccgccacgcgcctcctgcgccgggctcgggcccggcgcccccgagcccgcgccgcacccgctcgggtggcgcgccggagtggacgcccgccgagacgcttgcgctcgtcgccgaggtggcggccgtggacgacggctggtcccgctccgtatccgcgttccagaagtgggccatggtcgccgaaaacctcgccgcctccgaggccctcttgtcggggcccgggagccgccggagagggcgcgggagcaagaggactgccggggagtgccggcgccgctgggaggcgctggcggccgagtacggggccgtgcgccgctgggaggtgcgcaccggggcgacgtactgggagatgggcgcggcggcgcggaggaaggctggccttcctgccgagttcgacgacgaggtgtatggggctatggacgcgctcatacgggtcgaggaggcgctgcttgcggatgctgctggcggtggtgcgggtggggaggatgtagagggcttggttggcggcggcgccggctgcgttggcgtcgaggtgggtaagcaggatggcggcgactccgttg

SEQ ID NO: 8477 - DNA, 637 bp, Zea mays
  Predicted polypeptide sequence is orthologous to G646
actcgcgacgacgacggcgagaaaagacgaagaacaccaccaggacccagtactaggaaagagatcaaacactcccatgtcagggcaaccaccaccaatgccaacctcttattgaacccttgtctctactgcatgcccatgcacgctcgcagggagcctttgcatgagccatgcatggcgccgccccccggccgtgcatgtttctccattaccaagaagcgccactgccgccgatcatgccgctccagaaccccggcgtgtcgtgcccggcacccgtgccgccgccgccttgctccttgttgttgtggtcaaactgagtatggctgctatttccatcgctggcgccaccggttgcaccacccccaccttcagagccaaccggcggcttcaagtcttcgaaggggaacaataacctgcccgcgttctccggcacgccctgcaaccccgcgctggaaccgtaccccgccgcggtagcaccggaccccggcccgtgcgcgtcgagagagaacccgagcacgctctgtgacggtggaggcggcggcgtgcggtactctccgagcgcgaaccctgccgccgggtaatctcctggcatcgccatcggcatcggcatctgcagcggcatgtagcagccggagct

SEQ ID NO: 8478 - DNA, 673 bp, Zea mays
  Predicted polypeptide sequence is orthologous to G646
ttttttttttttttttttagctgtaaatcaccggttcaccaccttaacaatctgtatatcctgctgtgttagcccccccaagtcgatttacacacaagaacacgaagatccgagaaaaattaaacaaccagagaaaaatcaaacgccatatatgtgaacactaatcacctcctccaccgtaccctcttgataacttggatccttgtctctatgactctatccctatctccgcatgctgacaacggcgcgcgcgtgcatgagccatgcatgccgcgccgccttaccaagggcctccaccaccattgctgctgccatttccgatcaagctattgctccagaaccctggagtctcgtggccaccggtgacgctgctgccgtcgcctgcagcttgatctttcctgtggtcgttttgacgatgatcagctccgtcgttgcttgcaccgccgccagctgtggtcaccgccggcttcaagtcctcgaaggggaagagcatcctgcccaccgcgctctcctgcaacccgccggcgctgtaaccccccgtgccgtgcgtgtccagcgagaacccgagcacactctgagactgcggcggcggcggcgggggaatgcggaactcgccaagcgtgaatcccgcgggtgctgcgtactcggcgggcatccctagctgaacgtgctg

SEQ ID NO: 8479 - DNA, 739 bp, Zea mays
  Predicted polypeptide sequence is orthologous to G646
cgcggtagcttcccgtgtaccgtacacagcaggatcctccgccttccttgtgttccgcgcttccacaacagtttaccgcaaggaaggaaccatggacatgaactccaacgccaacaacagcactgccgcagcagcatcggctcccatcaacaaccagcaggaggctgtggtgtcatccccaaccagaaaggagcaagccaggaaccccaagaaggcgcgggcggcgccgcagcaggcgggcggcagcggggagcctaggccgcggcctccgccggacgcggcgcacagctgcccgcgctgctcctccaccaacacaaagttctgctactacaacaactacaacctgacgcagccgcgctacttctgcaagacgtgccgccgctactggacacacggcggcaccctccgcaacgtccccgtcggcggcggctgccgcaggaacaagcgcgcctccagctcctcgtccccgtttccgggcccctccagcaccgccgccaccagcgccgcgatggagaagaccgtcagcacgcggctgatgctgatggcgaccagcaccatggcgatgccctccccgacggcaggcctgtttgttcccgatgacatgtccccggcattcacgccgacgacgggcggtagcggcttcgacgacctcgccggcatggacgagcagcaccagcagggcttcctgcccttctcgccgctgtccctgtccgaccaggcgccggagctggctcctgga

SEQ ID NO: 8480 - DNA, 300 bp, Zea mays
  Predicted polypeptide sequence is orthologous to G651
ttttttttttttttttcgcgaatgtgatacgccaggcacgagacgggcgaacgcaagcgcgccggacatcgagtgtctgaacgaaaaaaagcaacgccaaccgacgaaatgactatgaaaaatacaaagaaatttcggcacaaaagctttgcgccgggacggcatcatcaagggatgccaggggcggggggcttttacggggaacttgtcgttatgacaggtaaggcttgcgaagctgcttgggcgaatctggctggaaatcctggaaaccagggttcacgtccgattcgcctgtgcatc

SEQ ID NO: 8481 - DNA, 938 bp, Zea mays
  misc_feature (345)..(345): n is a, c, g, or t
  misc_feature (348)..(348): n is a, c, g, or t
  misc_feature (351)..(351): n is a, c, g, or t
  misc_feature (582)..(582): n is a, c, g, or t
  Predicted polypeptide sequence is orthologous to G652, G1335
cccgggctgcaggaattcggcacgagcagggggagaggggaaaaaaaaaaatctaaccctagcatccgcagcgctagggttcgggggttgcgatggcggcggcggcgagacagcgggggacggtgaagtggttcaacgacaccaagggcttcgggttcatctcccccgaggacggcagcgaagatctcttcgtgcaccagtcgtcgatcaagtcggagggcttccgctcgctcgcggagggcgaggaggtggagttttccgtctcggagggtgacgacggccgcactaaggccgtcgacgtgaccggccccgacggatccttcgtcaggggcggcggaggcggangangangcggcggcggctacggctcccgcggcggtggcggatctggcggcggcggtcgcagctacggtggtagctggggcggcggccggagatccggcggcgggggcggtcccggcgcgtgctacaagtgcggcgagcccggccacatggcaagggactgccctatcgccgacggcggatgcggctacggcggaggcggctacggcggcggcggctacggatgaagaagctgttaancgttgtggttgctttcaattgtggtgagccttgacacatggccacggcactgctccaccagcccgccgcggctttccgtcgtgacccgccctcgctggtccgtatctttttctcttacaagtcgcaccgccctgcttctctttctttgtatcctcccaccactcctcttgttccttatccccccgtgttatttcccccccgtcgcactccgcttgtacccccgaccttcctcgcttctctcattccttcttttccccgctgcccgttgtttgttattctgtcacctccttgcgattcttctccgccttctgtcccttcttattttttcgtcgctctccttctctgggtgcctagaa

SEQ ID NO: 8482 - DNA, 638 bp, Zea mays
  Predicted polypeptide sequence is orthologous to G652, G1335
ggtaaccaaatcaagcacaagcaggcaggattataatctgggagaataatcatctcatctccttcctcagtctgatggaacaaaccacaaaaaagaaaagaaaagcagattggacttcccctcggcaacacaggaccaaatcatctcttaaaaccttaacgacgacgacgaacgacggacgacgaccaagcacacaccatgataacttaacttaacttgagagttcttctacgaaccgaacgaaatctgaaaacggcggacgggatcctcttacgaaagaggcagcgggcactcgtgcccggatcggcaaaactaaagcggtactccgacacacagcgagagggggatgtttttttaagcgagatctagaagggggcggcgccatcagaccagcaggtggtggagcgatccgatccgatctggctggctggacggacgcggacacacctcacgtgggacagtcgcgggcgatgtggccggcctcgccgcagttgtagcaggagcggtcgcctccacccccgccgccggcgaacctccctccgccaccgccgccaccgcttgggcagtccctggccatgtggccggcctggccgcagttgtagcagccgacaccaccaccgccgccgccccaacacaat

SEQ ID NO: 8483 - DNA, 1039 bp, Zea mays
  Predicted polypeptide sequence is orthologous to G652, G1335
gcacgacctttgtccgcctcccctaccatctagggtttctagggttatccaggaggaggaaatggcgtctgatagggtgctcgggactgtgaagtggttcaacggaaccaagggcttcggtttcatcacccccgacgatgggagtgaggacctgttcgtccaccagtcatccatcaagtccgacggctaccgcagtcttaacgacggcgatgccgtcgaatacaccgtcggcagtggcaacgacggccgcgccaaggccctggatgtcaccgcgcccggcggcggcccgcttgccggcggggaacgtcccgacggcggcaacggcggtgggcgaggcggatacggcggcggcgaccgcggttacggcggcggcggtgaccgcggctacgggggaggaggcgaccgtggctacggcggcggcgaccgtggttacggtggaggtggcgaccgcggctacggcggcgaccgtggctacgggggaggcggcggctatggcggtgggtacggtggaggcggcggtggaggcggccgcggctgcttcaagtgcggcgaggagggccacatggcaagggactgctcccagggcggcggctacggagggggaggcggcggcggccgcggcagcgagtgctacaactgcggccaggagggccacatctcccgcgactgccccaacaaaaggcgttaggcgcggcgccaccgtcgcctcggatccggcgggagtcccatgtcgcctctcgccgcatccctacccctccaaaggtatcgctcggctgactctcgcgtgaagtcgtcggagcaaactatctatcagtagtactagcagtgtcgtttcgttttggtctgtcgtggtagtaagaaatgcaagtgagcagcaccaatatctttccgtttaaatcagttgtaaggcacccatggtcatggttgcctctcccggatctatctgtcatgaactatctataataaatcgttatcaatgttatgcaaagagtctttggcattgagcaaaaaaaaaaaaaaaaaaaaaaaaaaaaaaaaa

SEQ ID NO: 8484 - DNA, 1188 bp, Zea mays
  Predicted polypeptide sequence is orthologous to G653
ccacgcgtccgccgcggcaaaagtgaggagcgcgcgggcgagctgggggagacgaacccgtcataactccctcgcttaatcgcgtctcgtgctcctgcctcctgcgtatataaacgcggcaatcgggacgcccggggaggcgttcgttctccttctccatcccacgcgcgcgcaggccaaggccggatcggcggcctctcagatctcgccggccgccgtgagacagagaccgaagggggggttgaccggtgctcgggaggaagatgtttagcgggacgcagcagaagtgcaaggtgtgcaccaagacggtgtacccgatggaccagctctccaccgacggcgtcgtcttccaccgctcctgcttcaagtgccagcactgcaagtctaccctctcactgagcaactattcctcgttcgaaggagtgccgtactgcaagacccatttcgagcagctgttcaaggagaccgggagttacaacaagagcttccaatcacagtcacctgcaaagattactccggaaaagttggcccctgagctgaccagatcaccaagcaaagctgcaaggatgttttcaggaacacaagacaagtgtgcgacttgtggtaaaactgcgtatcctcttgagaaggtaacagtcgaagagaagtcctaccataagtcatgcttcaaatgctcccacgggggctgcgcgattacaccttccaactatgcagccttggagggcatcctctactgcaaacaccatttctcccaacttttcaaggagaagggaagctacaaccacttgatcaagtgcgcgtccgtcaagcgcgctgctgaagcacagccagaacaaccggcctctgattcctcctcctgaccacgccatttaaacagtgggggtttggaggcgagagagttgggaagcctcctgtttctacttaaaaccgcgtgatgtatgttattccatctatgccccgaggatactagactactactctattttggtatcctctgctgtgctagctggatcatatcagcgaaccatggaattgctgtcattttcaatgaaactgttgtgcatcaagtagtgaaatcttcactgaaatcgggtatcttgcctttattgatcaatatattatctatgttgttttgttgtttttaaaaaaaaaaaaaaaaaaaaacctcgcgactagttctcctcgtgc

SEQ ID NO: 8485 - DNA, 1321 bp, Zea mays
  Predicted polypeptide sequence is orthologous to G657
gcacgcggtcagaatatagtcctcttggcattcgagagttgatgcctacatccttgaacttccctaccccagtaagattgtggggctcccctactagggatgggagccctgatgctgtgctaaagaatgctgccaaaagattcatgtgcaccccgtccataatgaaaaaaaggcacagagatcttttatctccagttcctgatataagaactgacaagaaaccaaatactgaaagggattttatgagctcaggcatatcctctacaagagttgggaaatcttgcatggatagcgttgatgattcagctgatttagtttcaccgaaagagagtgcatttcaaaagaagctgaagctttgtcacgaaaacaaagaaaatttgaatgaaattgctgatcaaggagaaaatgaagccaatgcaaagcattcttcagggattcttactccgagcagtgttgacaaccataatacacataagaatggtccaaattttcgaattccggagctaaataccactgtacaggctttgtctaactctaaagacataatattttctagatcaaagccatcagaacatgttgaaaaatctgcagcctgcattgatgcagattacgagtatttgaacatattggctgatactccaggtattaaaagaggcttagaatctccttctgcctggaagtctcctgtgttcacaccattccaggatgcatacttcatgagcccagcaagcagagcttttgatgccttaggattggtgaagcagattaatgagcagagtgcttctgctgtggaggaagcacatgaagttctggcaaatggaagcccatggaaacaacataacaaggaaaactctgacaaagaaaatatagaaaatacagctttgaagcatgagcatgtcacaagcaaacctccatcgatactcatggtagaggcacgggtgctcgatttcaatgaatgctccacacctgtgaggaagaaagacgataagaaagtggaaatggttttaggaggacctgcaacatcccctgttacttcctcgcatctttggataaatatgcggtagccctttgaggtgagtgggagtggggatgcttcgcctatgctgttcagtatgtacatgtctgttattcccataatttccaccgttttgaaatacacattccaattagtactttattctttgtgcttggtaccctaaatgtcaattctaaatggaaatacatttttttgtagagttaagatttgtaatgtgtcatttgattatgttaaataaagaacaaggcaatatatttaaattcagagtaaaaaaaaaaaaaaaaa

SEQ ID NO: 8486 - DNA, 720 bp, Zea mays
  Predicted polypeptide sequence is orthologous to G657
ccaaatttgaaacctccgaggcggacgcgaggcgaagccgtgcgtcggtcatcgagacggccggctgggcgaccgcgccgccgcctctctcctctcgttgcgtgccgcgggggttgcccgcacttgggcgcgcgctcgggcgcggggttggatgcagctccgccgacgtaggtgctcgtcgatcgcgtcggccacaccgggacggtggtaatcatgccgagtgataaagcaaaagctccaaagaagaagggcgaagaggatcctggaatcccgccagctccctgtgaaggagaaattagccatgagccacatagacaacggtcactcaatgggaggaccactggtccgacccggcgttcaaccaaaggaaattggacacccgaagaggatgctatattgtcccgtgcggttcagacataccaagggaaaaactggaaaaagatagcggaaagttttccagacagaaccgatgtacaatgtttgcacaggtggcaaaaggttctaaaccctgaattggtcaaagggccatggtccaaagaagaagacgaaatcatagttcagatggtaaacaaatacgggccaaagaaatggtcggccatcgctcaagctttgcctggacgcataggaaagcaatgccgggagcggtggcacaatcatcttaacccagccataaacaaggaggcatggacgcaagaagaggagattactcttattcatgct

SEQ ID NO: 8487 - DNA, 829 bp, Zea mays
  Predicted polypeptide sequence is orthologous to G657
gtttatcagttgcgatcttgtaacttctgctgatctgcaagaatttagtccccttggaattaggcagtggatgcggtcgaccatgaatgtcccaactcctttaagattatggggctctccaacacatgatgaaagcccagatgcactaaaaactgctgctgaaagcttcccatgcacaagttcaataatgaaaaaaagacagagaagtctattgtcccctactccagatgaaagaattgagaagaaatctgggattgcaaagggggtgacggacatctcctatatgataacggccacatgttccatgaatgcaaccaatgatgaagacattgttactgaatcagctgtgtgtgctaagcaaccttctttgaaacatctagacaagaagcttgagttctctgacattaacaaggaaaactctgatggagcatctgaacaggccaaagatgcacaaaacacacaactcgtggatgagcaacattcctcaccaaatgttgtgaatcctaacactgatctacaagacaatatacaacctgtacagattcttgtagagcaaagcagcaataaccttatttcctctgatcatggtgcaaagccatcctgtaaggaagtgattagttcaaaatcaaagcctacaaaactacttgttgaaaaatcatcaccatgtatcaacgtggattacgaatatgtgaatttattggctgataccccaggtatcaaaagaggactcgaatctccatctgcatggaagtctccttggtatatcgatatgcacatgcactttcagggttttgtcagcccagcagacagaacttatgacgcgttagga

SEQ ID NO: 8488 - DNA, 868 bp, Zea mays
  misc_feature (65)..(86): n is a, c, g, or t
  misc_feature (88)..(91): n is a, c, g, or t
  misc_feature (224)..(228): n is a, c, g, or t
  misc_feature (770)..(774): n is a, c, g, or t
  Predicted polypeptide sequence is orthologous to G670
actctcaggcaacattccaaatttcttcttacaaatatacaactgtcgtttgcggcaacttatcnnnnnnnnnnnnnnnnnnnnnntnnnngcaataattaatttgcatggacgtgcatggcagcagttgaaatgtttgggtctacttgcatgttgagagctaccgacacatgcagttttgcccatggctgcctatatttatttaatttccaccagagagaacnnnnnctcaaatatgcaaaagttcagtcgtgtacagaaggaaaacatcaattttcaagagaaaggaaaggagactctagaacatactttcctatgcatcctgctgcaacttctaatgccagggctgtcctttccttgatattgccagctcttcaactgaggaacagctgtggaggatgatttctgtatcaacttaacgtatctatgtgagcaattcagcataattctgcccacgaatctctgaaaatacgagtttctgcttcttctgatctgctctgttccatgtggtggaacataatgcctagatattctcaaaagatagttgcattctttgcaagtccttgtcatacatgtctggtgctacctgcagctgttgctgtggctgctgattctggaaccaagaagcacatatcccttctatgttgaattggctctctgccttgatcacatcatcataaagcgtttggctctggttctgcatgactgtggtcgtttcggcaaaggagtcaggccacttaagttccgctactaggtgagcccttgtatcnnnnncttgtccaatgtctgtccatgggaagacactgttctccagaattgtgctcgtgctctgtggttcaaatcccatactgttgctccctctgctcct

SEQ ID NO: 8489 - DNA, 875 bp, Zea mays
  Predicted polypeptide sequence is orthologous to G670
ctgtgatgccaccagtttcgccatcaactctctcaacatcaacagggctcaataggtcaccagacaacccacactcgggaggcactggtattcagagcacccagttctactgggacactgctaatcctagcagctgcagcagtagaggaagcagcggaagcaacggcttgggatttgagctgcaaagcacaagctcgcttctggagagtagtgttttcccatggacagaattaacaccagacaaaaatagccaagttcaccttggggaagaactcaagtggcccgacttgctccacggaacattcacggacacacctgcaaccatgcagaatcttagccagtcactgtacgaagatgttatcaaagccgagagccaattcaacatagagggcctctgtgcagcctggtctcaaaatctgcagccacagcaacatctgcaggtatcagatttgtatgacaaggatttgcaaaggatgtccttgtcttttgagaatatctagacagcatgtttcagcatgcagggaacagagaaacagcagaaagctgagtcaatgaagccttaaaaaatacaatatttcatcacagattcatttgaaggctatgtggaggtgtgttttacgtaggtacattcttatgatgaaacagagatcaatactgataactgttcaccagtgtacatgaaaaaagggaaaaaatgaatctatattacagcataatgtatagactagagaaagtacatcctaggagtttacctcctttcatttaaaagttgctgtctttatctgtacatgcatgtagctcggctttttttgtataagtgagtcatggttgatctttgtctacaaaaaaaaaaaaaaaaaaaaaaaaaaaaaaaa

SEQ ID NO: 8490 - DNA, 747 bp, Zea mays
  Predicted polypeptide sequence is orthologous to G670
gagagaaaaagagaggagtgccccccacaaacctttccttgcattccactgaaatcttcctatctgcaaccatgcagttgctcaattctggcctcagctgaagcccaaccatccattgttatataagtcgctgcagcctttgcaatttcccactccttcagccaccatcggtcattgaaggagcttcgtgccaccagagaaggtgttcgccgtgcataatcacagactatatacattccacagacctgtaaagctctgtgaatttggagctcccacaggttctgcattggcgttgagatggggaggcattcttgctgctacaagcaaaagttgagaaaggggctctggtcccccgaggaggatgagaaactcatgaaccacataacaaagcatgggcaaaactgcatgtgttggtagctctcaccatgcaagtagacccaaacatttcaactgctgccatgcacgtccatgcaaattaattattgcatgttgtattttctttttctttttttttgataagttgccgacaaacgacagttgtatatttgtaagaagaaatttggaatgttgacctgagagctattttcttccccctttcactttcccgtttctgtcgtaaacttttctgtgtggagaacccaagctacttgagcgctttctacttgaatacaggaatggaaaacgattggttgatttgatagggtccaaaggagcaatcattctcaagaagaagtaaacacattcagg

SEQ ID NO: 8491 - DNA, 900 bp, Zea mays
  Predicted polypeptide sequence is orthologous to G670
ctagcctttccttgctttccactgaaatctcctatctgcagccatgcagttgctcaatcctggcctcagatgaagcccaaccattcattggtatataagtcgctacaacctttgcaatttcccactacttcagaacatcgtcgaagaagctctgtgctaccggagaaggtgttcgtcgtcgtgcataattatacattccgcagacctgtaagctctgtgagtttggttggagctcccaggttctgcattgcgttgagatggggaggcattcttgctgctacaagcagaagctgagaaaggggctctggtcccctgaggaggatgagaaactcatgaatcacataacaaagcatggccatggctgctggagctctgttcccaaactcgctgggcttcaaaggtgcggaaagagttgtaggctgaggtggataaactatctgaggccagacctcaagagaggggcattcgcccaagacgaagaagacctcatcatcgagctgcacgctgtcctcgggaacaggtggtctcaaattgcagcgcagctgccagggaggactgataatgagatcaagaatctatggaactcgtgcatcaagaagaagctgaggcagaaaggcattgatcccaacacccacaagccacttactgaggctgatcgcggcggtgcagctcccaccatcagcaccgagagaacctcagggtccagcgacgtcaacccatcaagcactggtcctctggggaacttgagccctctcctcagcgagacggctcaatcatcaatgctgatgcccgtgtacgacaagaatcgtgctgaaacaccaaacttggcacgccctaagctgccaccaaaggagctgttcctggagcagcttactgctggacatgagagttcatcaacct

SEQ ID NO: 8492 - DNA, 867 bp, Zea mays
  Predicted polypeptide sequence is orthologous to G670
agtagtagccactagcgctgctgccgttctcttcccctacccgacacaagctccaccacctctatctaccacacgccaccactgtaggagctcctccacgatcatcccgccctagagccataataattcgttgaagaggagggggttcttagaaccagagggcggctacctgtgaaggatacccgtgctgctggctgctgctgctgctcctcaagctagagccgtgtgtgggctgtgcagattgcagagcgcagcttccagtctcagcattgctttcaatggggaggcactcctgctgttacaagcagaagctgaggaaggggctctggtctcctgaggaagatgagaagctcatgaaccacataaccaagcacgggcatggctgctggagcactgtccccaagcttgcagggcttcagaggtgtggcaagagctgcaggctgaggtggataaattacctgaggcctgaccttaaaagaggcgcattctctgaggaggaggaagacctcatcgtcgaacttcatgctgtactggggaacaggtggtctcagattgcaacaaggttgcctggaagaactgacaacgagattaagaatctctggaactcgagcatcaagaagaagctccggcagaaaggcattgaccccaacacccacaagccgctccttgtcgaggttgaacgcagcaaagcagctccaacgaccagtaccgagaggacctctgagtccagtgatgttgacccttcaagtggcggcgcacttggcaactcgagccatcttcttctcagcgagacagcacaatcaccacagctgccagcgctcggtaagcatcgcagagaaactactagcctcgcacatctaagggtgc

SEQ ID NO: 8493 - DNA, 781 bp, Zea mays
  Predicted polypeptide sequence is orthologous to G670
gcagttttgcccatggctgcctatatttatttaatttccaccagagagtgaacaaaaactcaaatatgcaaaagttgagtcgttgtgtacagaaggaaacatcatttttcaagataaagaaaaagagactctagaacgtacttttgtatgcattctgctgccacttctaatgccagggctgtcctttccttgatattgccaggtcttcaactgaggagcagctgtggaggatgatttctgtatcaacttaatgtatctatgtaagcaattcagcatagttctgcccacgaatctctgaaaattacaaatttctgcttctgctgatctgctctgttccatgtggaacataatgcctagatattctcaaaagacagttgcattctttgcaagtccttgtcatacatgtctggtgttgcctgaagctgttgctgtggctgctgattctggaaccaagaagcacatatcccttccatgctgaattggctctctgccttgatcacgtcatcatagagcgtctggctctggttctgcatggctgtggtcgtctcggcaaaggttccatggagcaagtcaggccacttaagttcctctaccaggtgagctcttgtatctttttcttgtccgatgtctgtccattggaagacactgttctccagaattgagctcgtgctctgtggttcaaatcccatactgttgcttcctctgctcccagtactgctactgctgctaggattagtaccatcccagtagaatgaatctactgcagtacttcccatgccag

SEQ ID NO: 8494 - DNA, 743 bp, Zea mays
  Predicted polypeptide sequence is orthologous to G670
gctggctgctggtgcatgctggcatccttttctctctctttctctttctctttctcctggcctctcttcaattcggctcctagtagcctgccgccatcacatctcgccttccatataacgagcgatcatcgtcaaggatcggtcggcgcgcgcgcgaggccaacggccggctggggttttagcttgctagctcctggcgccaggctatcccggcatggcgaagcagtcgtgctgccacaagaagaagcttaggagagggctctggtcccccgaggaggacgagaagctcatgaaccacattgccaagtacggccacggctgctggagctccgtacccaagcttgcaggcctcgacaggtgtggcaagagctgcaggctgaggtggataaactacctgaggccagacctcaagaggggcacattctcgcaagaggaggaggacctcatcatacacctccactccttgctgggaaacaagtggtctcagattgcggcccagctgcctggccggacggacaacgaggtcaagaacttctggaactcgtacatcaagaagaggctcagggagcgcggcatcgaccccgccacccaccagccgctcgccgagcctgccgccgcagccactgccaccaccaccaccacggtctcccgccgcgcggtgtttggggacgtcgacctcatcccgactactactactactacaatccaggtgccgcccgccgtcgttcgaggggcggcccaat

SEQ ID NO: 8495 - DNA, 129 bp, Zea mays
  Predicted polypeptide sequence is orthologous to G675
accaactacctgcggcccgacatcaagcggggcaagttctcgcaggaggaggagcagaccatcctccacctccactccgtcctcggcaacaagtggtccgccatcgccacgcacctccccggccgcacc

SEQ ID NO: 8496 - DNA, 860 bp, Zea mays
  Predicted polypeptide sequence is orthologous to G707
tacaaagacggcgcgtccggtgcagattcccatctgtttcgtttgattgatgagttgacgacgcatcggctcgaagcgagactaggctgcatggtttttgtgcctggaggtttctgatccgcgtggttaaggaaactgggtgctacaatttgttgctacaagtgcccgatccgtcgaattgatgtctgccgaccttcagagctgcgacgttccgggaatctggggggatctggatcttggcggactggacaattgggaggcgtctaaagcatggctggacaattgttttatgtgacatcttgaaggcctttgccatgttgggtgcgctcgcatggcaggcatcataataaagatgttggttttgtgtgctgggtgggagatcgcacggggaattgttttttcatccctgggttctcccgccctttgtgtccccgtgccctgcttcgtgttgtttggcttctcgttctatgcttcatcaccggtgctgctgcaaattgaacggatcttctcgtctcgcggcgtgctgcaaattgaacggggctacatcgcaacgcaacacaacacgcaaggtacaaatcggatctaaacattttcaatttacagcaaagttagcaagttactgaaatcaccatcaatcgttcaaaacttcgcgcaccacaaacttatacgcctatgctaggtcatccatatgcacttcattcacccaacgcttatcccgtaaggctataaagcacatgcgaaaggcgttcagtcactctgtaaggcgttcttcacccaacgcttctcgcacgggggtcttctattgaccattgaagataaacttttgaatatatgaatcagctgtgtatatttgctgtagc

SEQ ID NO: 8497 - DNA, 680 bp, Zea mays
  Predicted polypeptide sequence is orthologous to G715, G1646
tcagcatcctcccccgggatgggcgcggcggtggcgtaccctccggcggccggcgccgcgtactccgccgggcgtacgcgcacgcgcacgcggcgttgggcgcgctgtacccgcctcccccggcgccgggtcccccctcctcgcaccagggcggcgcggcggcggcgcagctgcagctgttctgggcggagcagtaccgcgagatcgaggcgacgacggacttcaagaaccacaacctgccgctggcccgcatcaagaagatcatgaaggcggacgaggacgtgcgcatgatcgccgcggaggcgccggtggtgttcgcccgcgcctgcgagatgttcatcctggagctgacccaccgcggctgggcgcacgcggaggagaacaagcggcgcacgctgcagaagtcggacatcgcggccgccgtggcgcgcaccgaggtcttcgacttcctcgtggacatcgtgccgcgggacgagcccagggacggccgaccccgccgccgccgccatgggggcagcagcgcccgggatcccgcagcaccccgccgccgccgaccccaccaccatgggctactactacgtccagccgcagtaaccgatctgccctgttggtatttggtacccacgttcttgtgttgttgcccttggcaaccaataactcttaagatggcgttccatcgc

SEQ ID NO: 8498 - DNA, 1060 bp, Zea mays
  Predicted polypeptide sequence is orthologous to G715, G1646
gcacgagaagcaccttcctcttcctcttcctccgccccccaatccccctcgtctcacaaccctagctgcccccgaatccatggatcccaacaaatccagcaccccgccgccgcctccagtcatgggtgcccccgttgcctaccctccgccggcgtaccctcccggtgtggccgccggcgccggcgcctacccgccgcagctctacgcgccgccggctgctgccgcggcccagcaggcggcggccgcgcagcagcagcagctgcagatattctgggcggagcagtaccgcgagatcgaggccactaccgacttcaagaatcacaacctcccgctcgcccgcatcaagaagatcatgaaagccgacgaggacgtccgcatgatcgccgccgaggctcccgtggtgttcgcccgggcctgcgagatgttcatcctcgagctcacccatcgcggctgggcgcacgccgaagagaacaagcgccgcacgctccagaaatccgacattgccgctgccatcgcccgcaccgaggtattcgacttccttgtggacatcgttccgcgcgacgacggtaaagacgctgatgcggcggccgccgcagctgccgcggctgccgggatcccgcgccccgccgccggagtaccagccaccgaccctctcgcctactactacgtgcctcagcagtaatgtatcatcatcacgttattgttccgtctatgtgcctgagcaataatgtatcatcattgccttattgttccggggcagttgtgttatttgtgtctgtttagttgctgctgctgttaccgcgtaatagcatatgtgttatctgtgtctgtttagttgctgctgctgttgccgcgtaataaaacttggtcgtttacggggctccctcaagattaagaattgagttgtttgatggtagaatcctggtaaggttgttgtaactggggggcgcctttgtttgggctggtagtgtatgcctaggcctcacttatctgatgctgtaatgcgacaagtattatgtggttgtctggtaattattgtgcaaaaaaaaaaaaaaaaaaa

SEQ ID NO: 8499 - DNA, 896 bp, Zea mays
  Predicted polypeptide sequence is orthologous to G718
gaccaacccaaagccgtcgccccgcatggagtggacggccccgaagcgcgccgcctcgccgccctcgcctccgctcctctgggactggggaggagaccacgccggcgccacgggctcgggctcgggctcctccggcgacgccccggcgcggcgcggcgggagggagcgggaggcgaagcgcgccagggccgacgacggcgaggtgaggtgccaggtggaggggtgcgggctggacctcagcagggtcaaggagtaccaccggaagcaccgcgtctgcgaggcccacaccaagtccccccgcgtcgtcgtcgccggtcaggagcggcgcttctgccagcagtgcagccgatttcatgccctgtcagagtttgatcagaagaagaggagctgcaggaggcgtctgtctgatcacaatgcccgccgccggaagcctcagccagatgcattcgcctttgcctctgcaaggctgccttcgtcgtcgttcggtaatgtgttcatatcttaacttaagtagtgcttgaaatttgctagcagtggacactggcaaaatggtggtgatgggctcttagccagctgcatgtacagcaacgccaatagatgtcttgttgcgcaaatggcaagctttctatcttttatacttggcaataagttgctgttgcgtttcttcatggaaatatatacaaactaaactagacattttttttgacgggcaaaagctgtagggggaacccctacagcagcaataaatatactccctccgttcttttttacttgtcgcgttttagttcaaaaataaactagcggccagcaaatattcaaaaacggaggtagtatatattaaaaaagaaagagaacttgtactgagagaaggtgaaacaccaaaaaggcaagaaaaa

SEQ ID NO: 8500 - DNA, 870 bp, Zea mays
  Predicted polypeptide sequence is orthologous to G718
ctgttcaccacctctcccatcctctcttcgatccccaaatcccgaattgaccagcccaaatcgtcgccgcggcgcatggagtggacggccccgaagcccgcctcatcgcctcccctcctctgggactggggagaccacgccgccacgggctcgggctcctccagcgacgccccggcgcggcgcggcgggaaggagcgggaggcgaagcgtgccagggccggcgaggaccgcgggggaggtgagctgaggtgccaggtcgaggggtgcggattggacctcagcagggtcaaggactaccaccgtaagcaccgcgtctgcgaggcccacaccaagtccccccgcgtcatcgtcgccggccaggagcgccggttctgccagcagtgcagccgattccatgcgctgtcagagtttgatcagaagaagaggagctgcaggaggcgtctgtctgatcacaatgcccgccgccggaagcctcagccagatgcattcaccttcgcctctgcaaagctgccttcgacattgtttgatgataggcggcaaataagttttgtctggaataaagctcctgttagccatgtaagacccttcacttctccatgggacagctcatctgacttaaagcccccttatgcaaaggaaataagtgatgtatcaacaaaagttgggacaattactggacaagttcatttggataaatctcacatgttcaatgctattcccacacttagccatggcaaagatgagccttggccaatgaaaggtctggacatgtctatatctgcttcaaaattcgatggagcagcggatcttcagcatgctctctctcttctgtcagccggcgcttgtggactgcctgattctgtacatcaa

SEQ ID NO: 8501 - DNA, 973 bp, Zea mays
  Predicted polypeptide sequence is orthologous to G718
ctgcaaagatcaccctggattcctggagcacggagagagagccgagcgagcagctgtcggcacttgggagtggcactgtggaatctggagaacctaggtagaaaatcaagcaaagcatctcccactccaagcagtagcaccaacacccccctgcattcagcgctgccagctttcacataaacaagttggggaagcagttgaggttttctaattcttcttggaaggattgagatctccagttctgataatgggttcttttgggatgaactggaatcagaaggaccccatggtgtgggattgggaacatctagtaccgtctgtctcaaatgcagttacaaggcacggatctgctaattcatctggtggtactcttacttctaactcagagctagggcatggttcatccaagagctctatttcagcgtccattgattcaccctctggagtagggaacagcttagagttcaacttcgccgctgttgagaggcatgttaagaacacgggcacgaacggcagagtcgatgactcggggaattctccatcgtcaatgatagctttcaaccaaggagagccattaatcagcctgaaacttgggaagagggcttacttcgaaaacgcctgcggaggacaggatgccaaggtttctgcagcttcagacgttacttctgcagccagcgtggtcaagaagactaaggtgtctcagcagaatgcaaagaactggtactgtcaggttgaagggtgcaaagttgacctgtcttctgctaaagattacaatcgcaagcacaaggtctgtgtagtccattctaaagctaccaaggtggttgttgctggtctagagcgtcggttttgtcaacagtgtagcccgtgagattttcttccattaaaactgagttctcccttcattctacgatattcatatttgtatttgccaagttacttttttttttggcttctttaatgagggaaggagctt

SEQ ID NO: 8502 - DNA, 729 bp, Zea mays
  Predicted polypeptide sequence is orthologous to G718
cgcagccgcaaacgggagcgagagccacaggacgaccgctgccgcgcctcagttcgcgggccttgaggccacagggcatgaaccggcgccttcttccgtatcctcgtcaatccattctctgcccagtgccaaggggaacaagaacaagaacaacatggagctcatcagtttcgcacctgccaaagcgcccgacaaggacactggttcggtgctcagcagcggagagccggtggtgctaggcctgaagcttggcaagagaacgtatttcgaagatggttgtggactagggcagagcggcaagagttcggcggcgttaggcactgccagtgcagcgacccctccgggtcctgcgaagaaggcgaaggcggcggcggcggctccaaccgcgcagcagcagaaatcgtactgccaggttgaaggctgcaggaccgatctgtcctctgctaaagactatcatcgcaagcacagagtctgcgagccccattccaaggcgcccaaggtggtcgtcgctggcctggagcggcgcttctgccagcagtgcagccggttccatggactggccgagttcgaccagaagaagaagagctgccgcaggcgactcaacgaccacaacgcgcgcaggcggaagccccagcccgaagcgctccctttcggctcatcgaggctgtcggcgatgttctatgacacgaggcgccaggcgagcctcctgtttggtgaaagtccctacgg

SEQ ID NO: 8503 - DNA, 658 bp, Zea mays
  Predicted polypeptide sequence is orthologous to G729, G730, G1040
atgacctaataactctaccccagcccactactacctcttcctgctgcaggttctcctttccatcctttcctctaactttggaaccaccaagaagctcagctcaccgtctgcaaacccgttgggagctaccatgagccgaggctgctgctggggcgtttccaccggcggcggcgtgggtgtgcagacgacggcggcggcggttcctgatctctcactccacataagccctccgtcgccaccggccggcggcgtcgaggtgctgccggagccgaggctgctgctggggctggggctggggccggggccggggctggagctcgacgacgacgacgccgccgtggcgacgaagaaggtggacgacgacgacgacgcggccgcggcggcgcgggagcacaaccttcacgcgcagcggctccggctgcagttgcaccagccgagccagacggcccacgggttcaagaagagctcgtcgggcaccgctgccggcggcgggaggagaagctccagggcgccgcggatgaggtggaccaccgcgctgcacgcgcacttcgtgcacgccgtcgagctcctgggcggccacgagagagcaacaccgaagtcagtactggaactgatgaacgtgaaggatcttacactagcgcacgtcaagagccacctg

SEQ ID NO: 8504 - DNA, 751 bp, Zea mays
  Predicted polypeptide sequence is orthologous to G729, G730, G1040
gcaccatcagatcataattaaatatggctggtcgttacaatgcaagcaaatcaatctatatatgcagctagctagctcgatctagcctgtcgatctcttatccgcatgcatggtccagcttcatcgatcaactcatccatatgtagatggcgcgcgcgcggcggattattatatccgtcctagggtgaagtcgaggttcggtttgttgcctccgccaaacatcgtcgcagcagctacttggaacggcgccgacaagttcaggtcagaaacatcgtcatcaaggctctcgaaggatttgatgtcgcccggagtggcatctcttgatttgtcacggacgaaccagcaggcggcccctcttatcgaggcgttgcaccagaaagcacacgtgctggcgccattatgctcgctgccgtcaggcggattggagtgctgggcggacgactcggacccgctggtggtggtggtggtattggtgaggtcgaacaggctgctgtcgtcgtcggggatgtcgatgatcgtcttcgcaccacccgcttgcccgtaggatgaagcagaggctggcctgtggtcagtagtcttgatggtccgatacatctgcaagtgcgacttgacatgggccaacgtcagatccttcacgtccattagctcaagaaccgacttgggtgtagctctctcgtggcccccgagcagctcgacggcgtggacgaagcgcgcgtgcagcgacgtggtccaccgcatccggggggcgcgc

SEQ ID NO: 8505 - DNA, 478 bp, Zea mays
  Predicted polypeptide sequence is orthologous to G729
tttttttttttttttttttttttttaaagagagtataatactttattacatcatctgacacattgtatctttaacaagtatcacatcaaagtaaagcggaaataaacaactgggcaatctcccacaggaagatgaccggcgcatcgttagacttaaaaatcatcgtcgtcgataaaatctccatcaaagtctccagcatcaccctcttgctcaaaagcgtcttgcgggtcgtcctcgaacatattcgaatcgcctaccgcacaatcggcttcttaggttcgcgcgtgtgatggggatggatcgacgggtttcaaccggacggagagcagggctcgactacggacagcgagtgcgtggctccgatgaactccggcgacaaacggcacactccggcgaacaccacgggctccggcgacgaacggcaacgaactacggcaacgtcactagcgatgagcgaggagtgctagagctcgtgccg

SEQ ID NO: 8506 - DNA, 898 bp, Zea mays
  Predicted polypeptide sequence is orthologous to G732
gtccatggcgccgttgcgggcgcgcagcgcggccacctgcgccgtgaggtcgtccagctgccgctgcttgcgcgcgcgggaccgctgcgcggacagccggttcgactccttgcgcttgcgcttcctctcggcggccagctgcgggtcgggccccagctcggacccgccggtcgacgacggcgacgtggtcacggtcgtagacaccgtgctgggagtgggaggagaggccatcatatgcacacactgttcttttttcttttcccttctttttatgcgtctcgacgacgattaattacctggttaacgatcgatcgagatggagcagctagtttgttgctgtgttttactactaagccggactatagctatagctacaagctaagttgccgacagggattcagaacttggatctggaagagcgcgcgagcagtcgatggacacgggggtgtggtttaattaattatgagaagacgtagaaccagtagaggaagacgacggagaaggactggacgagcacagtggatgttatcataaacacgacagcagcggcaccatcaaataaagcctagaggctgttgcttggttgcacaaaacgcatgcaaagcaaatcacggaagcaacgctgtgtgtgccgcgaaagaaagaacaaaaatccagcagagttttcccttgaacaggcaaggtgaaatcttttgacagggtgccgcgcgccctggacgtacaagcaggttttggagcgccggaaatttcggcagagtgacgccctagacagcagtgtttctggcgaaaaatttcggcagagtgacggtcctgaaagctagctaggttcttcttgtaaaaaaatccggcagaggcttgccctgatcagcaaagctaagctggtttgtgacggcaaaag

SEQ ID NO: 8507 - DNA, 969 bp, Zea mays
  Predicted polypeptide sequence is orthologous to G732
cggtggggcctcgtctgggtctagtcatgggacccgtagcttggggtcagagggtgacatggtgcaccggatggagctcatgcgcaagagaaggatggagtcaaaccgggagtccgcgaagcgatcgaggcagcggaagcagcaacatctcgacgacctcaactcgcaggttcgtacgttgtttgtgaacagctcttgtttacctctgtgtctctttctgcatgcatgtttgatctgaacatattttaatcgaaatggtgaatttgctgctgtgctctgtatatatataggccacttttgctttttatgtattgaagcttgcactcatgtgcaggtgaatttgacacaaagcaaaagtcagatgaaaaaaacgagacttgtgcttcaggatatgctgaagcaagcaaactccgataatgcgcggtgccccttaatttctcagggtccaccacccaataaaattgattcaaagtaggccattccaacctaagcaaagaacgatgcacgacgtgccaccgtcgaaatctttctcaaaaaaagggaaaaaagggaaaaaaattccacaccaattcattggctgtctcggcaaaatcaacacggtcatatatatatcaatcattttttttcttcttcttctacccgacgtcgcgtttatatcggaataattgaatcgtcttctgtataaaataaaacaaaacaaaacaaacaggtggacaagttgaggacgacgaaacagcaactcatggtagcactgaacatgaccagccagaactacgcggcagcagcagctcagaactcggtgctgcgcacccagatgatggagctgcagagcaggctctgcgcactgcgtgagatcatatgccatatgtacgcaacacaacgaatgtccatccagcaactgtcatggggcgtgctgctacctaccatacttttggcgaaactgcgtggaactctggcagctgcagcatg

SEQ ID NO: 8508 - DNA, 725 bp, Zea mays
  Predicted polypeptide sequence is orthologous to G732
gacatcttaatgagcattttatcatcatcattacgcatataatttcccttatacatatatatgaagagctttcaaatcacctacctctctttcactatctggcccaatattattatttcctatatatatactcctcaactacaaaaaaacaactgcgctgcattcacgtcacagaaagccaagggaaagttgccattgtccgtcctttaggctcctccgctctaccaacaaaacgtcgccgtcgcctccaaaacaaacgatggggaagcaacaagcctcctttcctcctggccctaccaccgccttctctctagctagcttggagagctagctaataatagcaccggtacgcgtctatgggctgctgctgctgggggttccatgcgctggcgccaagaatatcaccagaggcgtcgctccagctccatgtcgtcgtgacgccgccgttcaccatggctgggtttgtaggaggagcagcagtgccggtgcttgagctgatgcaccagaggatctcggtcagggcgcccagcctgctggccagctccatcctctgggtctgcaggacagagttctgcgcttgcactgccacgaggttttggctggtcgtgctcagcgccaagttgagctgcttgttctggcccttcagctggtctacctgtgacgtgaggtcgtcgtggtgttgctgcttccttagcctagacctccgagccgactctcggttggac

SEQ ID NO: 8509 - DNA, 900 bp, Zea mays
  Predicted polypeptide sequence is orthologous to G732
cgtccacgcccgcccgcccgccttgccaccagccagcacccccctcaacccccggcctcgccgccgccgccgcaccccccaccccccgctgccgcgcaggccggttgctccgattgggctggagtgccaatcggagccaacatcagggggaagcacatgctgccgttcgcgcgccctagagttcctcattgatgtcgcctgtgatcagtgagatcctcctctcggggtttatgatcaactccacactccggcgccgcacccacctcgtccagtccttctccgtcgtcttcctctactggttctatgtcttctcataaactactcgcccccgtcaccgccacgcccctctcctcctccccgtccctgccttcttctcctccttcttcccgttccatctagtagcatccaccgtcaccctcttctcgtttcttctgcccagtctctgccttcttcttcgtcgtcgtcgtctcggtttcagtcgtttcctaaaactttaccttgcatgcacttccctactactgctgctgctagcgaagacctttattagttattagtagtgttaagttattaccaacaagaagcagaaagaaagaaagaaaaaagggatcaagaagcagagagctgttctgttcttttttccccctctcttgcaagaaagggcggttcttgcgcggacggaacgcaggaacaatggcttcctccagcgggagcgggagcgggagctcgggcttcctctcggcggcgctggacttggcggcggcgggaacggaggaggagctgcgcgcgctcatggcgcagcgccgcgccaagcggatgctgtcgaaccgcgagtcggcgcggcggtcgcggatgcgcaagcagcgccacctggacgagctcacggcgcagggcgcgcacctg

SEQ ID NO: 8510 - DNA, 1479 bp, Zea mays
  Predicted polypeptide sequence is orthologous to G735
tccctccccttgcactggatcttcttcttcctcctcctcgacctccttcaattattcctagtgtttgcttctcccttccttgacctttgcttggaaccattgatagttacttattgggcaatggagcacgtcatctcaatggaggagatcctcgggcccttctgggagctgctgccagcgccagcgccagagccagagccggagcagcctccggtaaccggcatcgtcgtcggcagtgtcatagacgttgctgctgctggtcacggtgacggggagggtggcggcgacatgatggatcagcagcacgccacagagtggacctttgagaggttactggaagaggaggctctgtcgacaagcacaccgccgccggtggtggtggtgccgaactcttgttgctcagccgccctaaatgttgaccggccgccggtgatggaagaggcggcaacgacgatggcgcatgcggcggtgagtagtgccgtagtaggtgaccccatggagtacaatgccatactgaggaggaagctggaggaggacctcgaggccttcaaaatgtggagggcggcctcctccagtgttgtgacctcagaacgttctcaaggctcaaacaatcacactggaggtagcagcatcaggaataatccagtgcagaacaagctgatgaacggcgaagatccaatcaacaataaccacgctcaaactgcaggccttggcgtgaggcttgctactagttcttcctcgagagatccttcaccatcagacgaagacatggacggagaagttgagattctggggttcaagatgcctaccgaggaaagagtgaggaaaagaatagagaatcagccagacgctcgagatacaggaaagccgctcacctgaaagaactggaggaccaggtagcacagctaaaagccgagaattcttgcctgctgaggcgcattgccgctctgaaccagaagtacaacgacgctaacgtcgacaacagggtgctgagagcggacatggagaccctaagagctaaggtgaagatgggagaggactctctgaagcgggtgatagagatgagctcatcagtgccgtcgtccatgcccatctcggcgccgacacccagctccgacgctccagtgccgccgccgccgcctatccgagacagcatcgtcggctacttctccgccccagccgcagacgacgatgcttcggtcggcaacggtttcttgcgactgcaagctcaagagcctgcgtccatggtcggcggtggaactctgtgcgccacagagatgaaccgagtagcagcagccacgcattgcgcgggggccatggagctcatccagacggcgatgggatccatgccgccgacctccgcctccggatctacaccgccgccgcgggattatgagctgctgggtccaaatggggccatacacatggacatgtattaggcactgcatgcatgcgggtttcgtgatcgctgggaacatt

SEQ ID NO: 8511 - DNA, 792 bp, Zea mays
  misc_feature (416)..(416): n is a, c, g, or t
  Predicted polypeptide sequence is orthologous to G736, G2432
caacaaaccatggcttggctgaaatctgccaactgacctgaccgaccccaggcaccaattcaccgctgccgaattttgcatcagcattcagcagcagcactaccagtctactactactactactctagtacgactaccactttttgactggcctaccaaactgaactctcgctcgcagcaggccggcagcatcttttttggccaccaaaagaatcctaaaatggtatatagaaaacagaatctaacaaaccaaaaggagaggaccagtaggtgtgaaaagggcgacgaggcgcggggtccccaccgcgaaccggccggcccgtgcccgtcactgaggcttggggcccgggcgcgcggcatcacgtcacggcgtcacgcgggaaggaagcccccggccccgtgcgaacgaaagkdgncggacaacmccgsgccacccgccgcccctacgaccgccgacgagtcaacgctccccgcccacctccctggcggatgcggaggcggacggcgcggcggcggcggcggccgatcggggcgttcgggcgcggcctgcggcggcccggggacgcggaggccacgcggcggasgcaaccgccggccgtccagtagcggcggcaggcgcggcagaggtggcgcggctgccgcacgttgtagttgttgaagtagcagaacttggtctcccggctgccgcaccgsgggcacggcagcggctcgccgcsggtgcccccggccccggccgcctgctgcaggggcagaggctgcggcgggggcggaggaggaggaggaggagraaga

SEQ ID NO: 8512 - DNA, 761 bp, Zea mays
  Predicted polypeptide sequence is orthologous to G736, G2432
ggcgacgacccgacgccacagacggcccttcctcctcctcctccccctcccccgcccccgcccccgcagcaggcgcccgcggctgggggtcccggcgccgagccgctgccgtgcccgcggtgcggcagccgggagaccaagttctgctacttcaacaactacaacgtgcggcagccgcgccacctctgccgcgcctgccgccgctactggacggccggcggcgcgctccgccgcgtggcctccgcgtccccgggccgccgcaggccgcgccccaccgcccgatcggcgcccgtcgctgccgccgcgtcgtccgcccccgcagccgccgaggaggattcttttggtggccaaaaggatgctgccggcctgctctgcgaccgcgagagagttcagtttggtaggcagtcaaaaaggccgccactccagcacgccagggtgacagagcagtgcagatgcaggagctctaaaaaaacatgcttcatcaccgcttccaacgagctcgtcagggtcctggccaaccccacaggcgtcctcaacccgtcggcagcgtccctcctcgcgccgcgctgcgctgcgctccgagctggaagctagcggaggcgtcgctgcgggtggccacgcggggctgggtgttagccgctgcacaggcaactaccgtgctggcatcagacgacgccgctgtagcagctgtaagcagatgttcaagagtgttccaagcagaaaaacgaagtgcggctgcgttcgcagaggcacgacaatgt

SEQ ID NO: 8513 - DNA, 816 bp, Zea mays
  Predicted polypeptide sequence is orthologous to G740
aaccaaatcaagcacaagcaggcaggattataatctgggagaataatcatctcatctccttcctcagtctggtggaacaaaccacaaaaaaagaaaaaagcagattcgacttcccctcggcaacacaggaccaaatcatctcttaaaaccttaacgacgacgacgaacaacgaccaagcacacaccatgataacttaacttaacttgagagttcttctacgaaccgaacgaaatctgaaaacggcggacgggatcctcttacgcatgagaggaaagaggcagcgggcactcgtgcccggatcggcaaaactaaagcggtactccgacacacagcgagaggggggtgttttttaagcgagatctagaagggggcggcgccatcagaccagcaggtggtggagcgatccgatctgatctggctggacggacggacgcggacacacctcacgtggggcagtcgcgggcgatgtggccggcctcgccgcagttgtagcaggagcggtcgccgccacccccgccgccgccgccgaacctccctccgccaccgccgccaccgctggggcagtccctggccatgtggccggcctggccgcagttgtagcagccgcctccaccgccgccgccgccaccgccgtagccgccgccgccgctggagcagtccctggccatgtggccaggctcgccacacttgaagcagccaccgccgccgccgcctcctcctccgtagccgctgccgccgtagccgcctccgccgtagccgcctccgccgtcggcgctagggcagtcccttgccatgtggccgggctcgccgcactt

SEQ ID NO: 8514 - DNA, 873 bp, Zea mays
  Predicted polypeptide sequence is orthologous to G744
ccacgcgtccgttcgtcaggggcgaggtttcatcaacctcagtacctcaccctcctctcccggagagcctctcgcctccgctccgctcctctgccctgccctgcccttccccgccacaccaaccaaggcgccaaaaataaacgccgcgccactgcgtggcgagggagcctgtcacattgcttgccgctgcgccctgccgcctcgtcttcgcggaggcctcgtcgcgcgacgatatggagctcgccgaggcgccggcgcccgtgcccgacgaggacgggctggacgaacgcggcgtggcgctgcacctcccgaggctgctggccggcgtcgtctccggcgccctcactggcatcttcgctctcgctggagctctgaccggggcagtcaccggcgcggtggcgggcagggcttccgacagcggcggcgtcctgcggggagctggactgggggcggtcgccggagctgtcctctccattgaggtccttgaggcttctcgcgcttactggtgctcgtcggaccggctgggctcgcacggcggagcatcgtccatggctgatttcattgagcagcttcttcgtgcccggtttgtgcaagagcaatttactgcttcaggatatgcatcatatcgctggcaggatgacctatacgacatctttggggacatttcatctgaagggctctcgcaagagtcactgaagaaactaccacatcatgtggtcagtgaccaccagacgcgggacttactcggcgaaatcctgtgttgtcctatctgtctacaggtacggtctgagcaagcgcgatcctaccactacagagtaactgtcaaagaaaccttttgccacaatgcatgtatacagtatgcactttggttac

SEQ ID NO: 8515 - DNA, 657 bp, Zea mays
  Predicted polypeptide sequence is orthologous to G744
gatgtgtaaaccatttttcataataggaacaagtgcaggactttttacatgctacgtactgtattttcttctatatgacgagggtagcaactttacaaaggcatgataacccagaatcgatcatgatctacctacacatcctgtctacatactgggcatgaaccatggtcaatgaaccatctgtccacacaaggctgatggaaggtgtgagagcactttggcaacttcctcgctgtctctccgctaataacatcctgcaggcaaatagcgcaagacaagctttcaccaattggtgcaggaaccacatgatgtggcaacttctttagagtatcttgtgagagcccttcggataaaacatcttcaaggacatcaaacatatcatcattgtcggcaatgccaacctgccaacgataggccatatatgccgatggctcatactggtcttgcacaaatcgagcatgaaggagctgttctatgaaatcccccatggaggacgtgctctgcgggctcgatcggtccgcgctccagtaggcgcgcgaagcctcgagaacctcgatggatagtaccgcccccgcaaaggcccccaggccggctccccggaggacgccgctgtcggaagctcggccggccaatgcgccggtgaacgcccccgtcagg

SEQ ID NO: 8516 - DNA, 933 bp, Zea mays
  Predicted polypeptide sequence is orthologous to G744
gatttcacaaggcgtccgtccgctgaaacccacagccttttgcactctctcaccagggcttgctgctgcttgcaacctcaccctcctctccgggagagcctctcgcctacagctccccagctgcccttccacgccacgccgaccaaggcgccaaaagcaaacgctacgccagtacgtggtgagggagcttgtcacggctgcgttgcttgccacctcgtcttcgcggaggtcctcgccgcgacgacgacgatggaggttgccgaggcgcccgacgaggacggcctggacgagcgtggcgtggcgctgcacctgcacctcccgaggctgctggccggcgtcgtctccggcgccctcactggcctcttcgctctcggtactttacttgcactgtcgcacatgctcctcacgcctcttgccccgttttagccgtcctgaggctgagagctcgacgttggctttgtggtgcatgtgccgcgcccccccgcgcgcgcgtaaagctggagctctgacgggggcggtcaccggcgcggtggcgggcagggcttccgacagcggcggcgttctgcggggagctgggctgggggcggtcgccggagccgtcctctccatcgaggttctcgaggcttctcgcgcctactggtgctcggaccggctgcggctgggctcgcacggcgcgtcgtccatggctaatttcattgagcagcttcttcgtgcccggtttgtgcaagagcagtttacaacttcaggatatgcatcatatcgctggcaggtgagcatatcggattttggtcacgatgacctatacgacatattcggggacatctcatcgaaagggctcccacaagagtcgctgaagaaactaccacactatgtggtcactgaccagacgcgcgcggactcgttccgccagatcctgtcctgccctatctgtct

SEQ ID NO: 8517 - DNA, 861 bp, Zea mays
  Predicted polypeptide sequence is orthologous to G748, G1900
gaggaagggagctagagatgggggagggcagagcaggagacggcctcatcaagctgttcgggaagaccatccccgtgccggagacggccgccgtcggcgaggctgccaaggacatgcaacaaagcggcggcagcggcagcggtacgactgatccgaaagggcaagagaacaacgttcaggactccacaggctcgcctccgcagcaggaggtcgcggacaccgaagactcgtcggcagacaaacagcagggcgaggcgggcaacccaaaggagaagctcaagaagcccgacaagatcctgccgtgcccgcggtgcaacagcatggacaccaagttctgctactacaacaactacaacatcaaccagccgcgccacttctgcaagaactgccagaggtactggactgccggcggtgccatgcgcaacgtgcccgtgggcgcaggccggcgcaagagcaagagcgcgtcggccacttcccacttcctccagagggtcagggccggtctgcccgtcgacccgctcgtctgcgcggcagccaagactaacggcacggtgctcagcttcggctctgccatgtccagcttagacctcacggagcagatgaaacagctcaaggaaaagctcgtcccgatagcgggggacgagcgctcagttgggtctcgcactcaaggaccttctgccaaggcagaagacccggaccggaaggagaatgttacagcagataaatctgcgagagttgttcagcatccatgcatgacgaacggggtggccatgtggccatttagctgtgcgccacccagtaccggcctctgcctgttacggcccaggcagcatcgcaatcccgttcttaccggcagcagct

SEQ ID NO: 8518 - DNA, 895 bp, Zea mays
  Predicted polypeptide sequence is orthologous to G752
ttttttttttttttttttgaatctggaaaaatttcttgagaaccaccgtttttttcgagtttctgacccgtactgctgtcaagcccctagggtgtgctaagaagataaaagatgcagtaacaaaaggttccaggcgttcgaccgttcgggagagactatcgtatccacatattggggtgaactgcgtcagcatctacaatgtctaataataaatccacgctatttacaagtttgggccaagattcatgcgtctcccttggtcatctctgaaggtatagctgaagctttgcatattggacaccaattcttctgcttaagccattcgtgaatgcagcgcacatggtactgatgttcacattgcattgtaccaatctcttcaccatcaacgtattcctcctgacatacgctacatttcacatcatctgctgcgatcttgcttacatctctataagaatttcttgcttcatacacactttggtttacacacttggtaaattgctcttcagtaagggcagtagtcactgagccaatatgctcttccaaagcaagcagttcctcataagacatattgtcgatatccaatctcatatcttcatgttgatcgtgcaaatcaaggccacttaagagcagattagtttctagcagaagcagttgctcataagtcaattcaacatcatgttcaatcctatccaatgctagcaacgcctgtgcaattccttccatgtttatccccctgtagccatctctctcccaaaacataccatgaaacatccgttgagggctttcttcagtacgagacgtagatcttctccttgctgtctgactacttgatccttgacgattagatgaataaattgcatgaggtagttctgcataaaagggtcttcctaatctc

SEQ ID NO: 8519 - DNA, 1697 bp, Zea mays
  Predicted polypeptide sequence is orthologous to G760
caggtaccggtccggaattcccgggtcgacccacgcttcttccagaagcatgggtctggaccacagaacggtgcgcagtatggtgcaccatacatggaagaggaatgggaagaagatgatgatgctattgagaatggttctacccacggcgcatctggtcaaattcctgcaaccacctgtgctgtagatgaggagtcaaatgaggacgatgagaatgcatattgtgaaacaaacagacctgctcgagtagaaccatctcatctgccttcggttcatgaaatgctcaatccaccagagatgactcctctccaaggtcaagattctaaagagacaagcgatggaagttgttctgatgttgctatttctctggaagagattttgcaggaacctttgtcaaatattagtgtggagaatatgcatagacttgaagggcagaatgccactgatgataacatcagtgttgataacttgttatcagcatatcccacgaaagataatggctacgtaggccagtataacactatgaatgggagtgctccagcagatgaagctcacgcacgctggcctttgagaacatatagtaatcagaattatgtcaatggccctcttgctgatgagttctttgacacagggaatgataccaatggggttgcatattccaggcagcagcaagctgatggcttcccagcacctcgccaagttgatgaaagtatggtattttatgatgccccatctgattacaacttggtggatggaaaagatgacttcgtatatctgaacgacattctgaatgagccacttggaaatgaatcgctctttgatggagatgatatgatggcttactttgatgccacagagaatgatttcaagtatgacattttgggctctggtcagggtttggattatccacttgcagacatgccgttgaactttgcccaaaagagtgacaaggaagacaagtttacattcgaagggatctctgaggttccggaagcaaatcctcagtacggtgcatcctcatctggttcacatgaagatctgtatactgatactgaatttctaggtgtaccaacagatgacactgctgataaaacttacggaaatcgcctggccagcatgttaggctctatcccagctccacctgcaatggcctcagaattcccgccgtcaacagggaaatctgctgggatgctttcggctgtcagctcgagctcaattcgttttactgctggtatcatccaacttgatggcctcactttcagcagcggctccggtcagtggcccttgcagaagaatggagacttgagtttgcttgtctcttttgctgtggagggcgacgtggcatccaagctccctgttggtcttgggcgtgctactcggattagcaccgttcccatggtgctgcgcagtggtttttaccttttctttatgtcggccatgattctcttgtttagctacaaagtagggtcgtgtatctacagcaggtaagttgaagttgatggcgcctcttgtccggccagacctgtgggctgtttattttagttcaacacgtggatcattccctcagtgatgggggtatagcagtcgttcgacaccttttttacacatttaccattttgacctgtcaaaacatacagcaataaactttcgaactggtggtggtgatcaaaaaaaaaaaaaaaaaaaaaaaaaaaaaa

SEQ ID NO: 8520 - DNA, 1365 bp, Zea mays
  Predicted polypeptide sequence is orthologous to G760
acccacgcgtccgaaagatcttgaatggttctttttttgtcctcgtgacaagaagtatcctaacgggtctaggacaaatcgtgccacaccaaatggttactggaagactagtggaaaggatagaataattatgcttaactcccgcaccgttgggatgaagaaaacattgatatttcatgaaggcaaggcccctaagggcgacagaactgattgggtgatgtatgaatacagaatggaagatgaggatttggtttctgctggtttctcaaaggatgcttatgtactctgcaaaattttcaagaaaagtggccttggtccaagaatcggagagcaatatggggctccatttaatgaagacgaatgggataatgcagaagtcgaaacttctctgtttcctttgacttgttcagaagtgaatccaacagagggacaacgtgctcagcctactgtcctggctggtgctcttctggaacccgaaccacctctacataattcatcttctacatgtgctggagaggaatcatcatttggtcatgccactgctgaggacttaacttttagccatagtgttgctagctctgctatccaagatacacctgctcggatgtcaggagacggtgtggtttctgtgaacaacatatccaatgtggccaatgacatgcgtagtcctcgtgactgtgatgaatttctatcggagttgtctagatttatgaatgattctcctctgcgtaacactcctcttggagagtgctctggtcttcctccgatgtctgaagctgaggctcatgcttttgaagtcaactcttttggcctctacaatgaattatcagagcttgttgggttaggatgcgcggataacaacttaaacaccagcaatgtggaaactacggattatctcatgttgccacctgacagagaactgtcggctaatgattacatggaactaaacgatctccttgctcctgacccaagcttccccagtgaattttctgctcaggacaatcaatatatgcagcatcctcttgctcagtacaatggacattatgatctgtcaggtccttcggagccaacaatgcctagcattttcgatgtttttcctcccaataatggagtcctcgcaacagatgatccagccaactacttggacccagccatgcagttccctttctcatgattggttaccatttgtcatggagctcgctgttgctacaactctatccaccctgaacgtcaaggacgtcattgatgtcatgcctgggctcatgaaatcgtctgttgctcttctgaaccaagccgaccttggctggtatttcttggaagcacggtgcttggaacaatctgcatcgactgctgtatgctcccaac

SEQ ID NO: 8521 - DNA, 867 bp, Zea mays
  Predicted polypeptide sequence is orthologous to G760
actggacgcctgcggtacggtccggattcttcgtcgacccacgcgtccgggacctgctcgcccgctcccgcctccgctcccgcgactcccagtggtatttcttcagccgcctcgaccgcaagcacgccaaccgcgcccgcaccaaccgcgccacgtcgggagggtactggaagaccaccgggaaggacagggaggtgcgccatgggcccagacttgtcgggatgaagaagacgctcgtcttccacgcgggacgcgcccccaagggcgaacgcaccaactgggtcatgcacgaataccgcctcgagggcgatgacgccgcagggataccgcaggactcatttgtggtgtgccggatcttccagaaagctggaccaggtcctcagaatggcgcacagtatggagcgcctttcgttgaggaggaatgggaggaggatgacacagatgatggtttgcttccagtggagggtgttgctgctgctgaccctgaggttccccttgcttctgtggagatccctggtgctttggatagaggctatcttcaaatgagtgatctcattcagggtttggatgatcaaaatggaaatggtacacctagtttgccagtttctgatacttcaaataatagcaaccattctgaagacgtagatggaaattctggggacattttaagtgacccaaaccttggctctaattttcttcagtatgctgaacctggggagcaaaatagcttaatgcttaatggaactatcatatcaaatgcaaatgctggagatttttttgataattccagccacagtgatgggtttctagagctgaaggattttggagatgctgcaaatctggatttcccctttgggcaatggatct

SEQ ID NO: 8522 - DNA, 819 bp, Zea mays
  Predicted polypeptide sequence is orthologous to G772, G776
gcgaaatgcgaaaggcagccgaggccgcgagccgacgcacgcggctcgttgcttcctccatcccctttcctcacgccgacgccaaagtataccaacgaattcctcctcgggctcccacctaatcgtgttcgccgcctgcctctcccaaaccctagcaacccacgatcgaacccaaatccgctcctcccacccgaggaattatgcgaaattccccgagatcctagcccagcactagcagatcgatccatcgcttgcccacctgccggccaccaacccttgtagtctcagtcaatctgtagattgagactacgatgagcctgtcaccgctcgactcctcctccccgccggccgcggctgcggctgctgctacggaggtgcccctcgccccgggcttccgcttccaccccaccgacgaggagctcgtctcctactaccttcgccgccgcgtcctcggccgccgcctccgcgtcgacgccatcgccgagatcgacctctaccgcctcgagccctgggacctcccctccctctcccgcatccgcagccgcgacgcccagtggtacttcttcgcccgtctcgaccgcaaggtcgccggcgctggcgccgggggccggggcggtcccggcaacaggaccaaccgcgctacgccgagggggtactggaagaccacgggcaaggaccgcgaggtgcaccaccgcggcaagcccgtcgggatgaagaagacgctcgtcttccacgccgggagggcgcctaagggcgagaggaccaactgggtcatgcacgagtaccgcctcctcgatgcagacggacctcaggatctgc

SEQ ID NO: 8523 - DNA, 564 bp, Zea mays
  misc_feature (453)..(453): n is a, c, g, or t
  Predicted polypeptide sequence is orthologous to G778
tttttttttttttttttttgagagaaactgttggccgtcctaaatacggatacggagagagagtctgctggagttggtctccgctcaacggttgcgcaacgtctggtctccttatatacaaggatagagtggtcaagaaccaaaacaaatacatgatgctacaggtaccgcgtcgacgggtttcacacctctgttacacagttccaggcctcatcaattgagaggaaagaatgtcatgctcactgcttggacgggttgctgggcgcgctctgctgcgtttggttcatcttctggtacagcgccaccattctattgtacgcctccatgctacccggttgctgcccgttctgctgcgcttggcaagctaggaaggcggagaaggcgtccgctggcaccgtgccgctgccggcctgcggggcgagggaggtggtggcggtggcggtggtgtcccangacacggggacgaaggggggcgggtgcatcatgggcggcgtgaggcctgcgtatcccggctggccgagggagcccatgttcatctgggccatttgcgccatctgcgccatc

SEQ ID NO: 8524 - DNA, 895 bp, Zea mays
  Predicted polypeptide sequence is orthologous to G779
gcacgaggtctggtggcgcaccttgagcgtggagtcggtggccagcgctggcgctggcgctggcgctgcgccgccgccggcagccaagaagagaaggctcagctcctgcaccgaccaattcgtccgttgacacggccagttcagcagcaaggcctcctgagcgttccatggagcaggagcagagggttgaacttgcgaacgaccgcgacgcgcagtcgtgctgcgttggggaggtggaaagcgggcgcaggtttgctctgggggaggcggaagcggaagcggcagagggcgacagcccgacgagcagaggcggaggagggagaggatccaggagactgttgccgcgctcaggaacatggtccccgggggcatcgcgaaagacgccgcggctgttctggacgaagcgatctgctacttgcagtacctgaagctgaaagtgaagacgctgggagctgtctccctctagctaagcctatctagccctctctcctcgtcgtggtggctttgttgtcgaaggccgaagccactggcttctggtgagaggagagctagcctatatcacccatctgttcagttcagtcccagaggagctcggatcttctcctacccgactcactgtcggtggctgcatcacccatcttcctcatcgtgggttggtatgcaaaagctagaaacatctttccgctgagcgtgatccaaagcgaagcccccattccatgcaaagcgctgggtcgtgccgtgcgtggggtggctcctgctttatatacgcgttgtgctcctgctttggctgatgtttgctttggtagttatatatagttctgtgtactacaaagtaaagtaagtcttgtaaaacgtgcacatcctccaggcgggtttgtttctctgctgcccgtct

SEQ ID NO: 8525 - DNA, 851 bp, Zea mays
  Predicted polypeptide sequence is orthologous to G782
tttcaccccgagcgcgagaactagggcgaccgcagcactacgcccctgctgcccatgtcttcgtcggggcctttgccggcgaccggaacccaccacggcagtcaaagggcagagtgtaaatcccagggttccacttctgcacgcaaggtacaaaaggctgatcgtgagaagatgcgaagagataaattaaacgagcagttccaggacttgggaaatgcacttgatccagaccgtcccaggaacgataaggcaactatacttggtgacacaatccagatgctgaaagatttgactactcaggtgaacaagctgaaagctgaatacacgtcactttctgaagaagcgtgtgagttaacacaagaaaagaatgagcttagagatgagaaagcttcactgaaatctgaggttgataatttgaataatcagtatcagcaacgaatgcgggtgctatacccatgggttggaatggagccttctgttgtcatggggccacctcctgcatatccctacccagtcccagttccaataccctctggtgctgtacccatgcatccgcagttgcaaacataccacttcttccacagtcaagcttctggaaccatccaaaacacatgcatcccttacatggcatatacacaaccctgccatcctcccactgatcagccgtctaaccaacttaatactccagttgcccattcaagtagtcataggtctaactctccagctcaagactgtagaagcaagtcatctacattgcagcaaccaagctgtggagtgagaagcagtgatgctggtgatattgctactgatctggaattgaagactcctggttcttcatgtcaatcacatgc

SEQ ID NO: 8526 - DNA, 1141 bp, Zea mays
  Predicted polypeptide sequence is orthologous to G783
gcacgaggccacacgctcgctgcgcctgcgtgcgtgtgctcgcctcccaccctccccgcactagctctgcactttccctggcagtcgtcccttgttcctgacttcctgcctgagcgcatccggccaccttctatccgcccgccagtccccgccggcctccgcggatcatctgcctgggatcaagatccgtcgaggccgaggcacccgcgcgccaaagatcgtttcttgatctaaatttgggtggtcgtagggatcaaagctcggttctctgcggtgcagttgagagggcaccaatattcttggcatggtggctgacacggaaagctcagattcactgcctggcagttcaaatgctgcttctgagatgcctgctaatgggtctattcaccgaaagtctcaggaaaagccccccaaaaaaacacataaagctgaacgagagaagcttaaacgtgatcagttgaatgacctttttgttgagctcggcagtatgctagatcttgatcgacaaaacactggaaaggctacagtgctaggtgatgctgcgcgagtactgcgagatctaatcactcaagtggaatctctcaggcaggaacaatctgctcttgtatcggagcgccaatatgtcagttccgagaagaatgagctgcaagaggagaacagttcgctcaagtcccaaatatcggaactacaaaccgagctctgcgcaaggatgaggagcagcagcctgagccaaaccagcatcgggatgtcggatccggcaactcaccagcagatgcagatgtggagcagcattccccacttaagctccgtggccatggcggcgcgcccagcaagtgcagcgtccccgttgcacggccaggagggctactctgctgacgccggtcaagcgggctacgcgccgcagccgcaacctcgggagctgcagctctttccggggtcatcggcatcgtcttcaccggagcgtgaacgttcttcccggctcggaagcggccaggccacgccgccgagcctgacagattccttgccgggtcagctctgcctgagcctcctacagccatctcaggaagcaagcggcggcggcggcggcggcgtcatgtcgcgcagcagagaggaacggcgggacgggtagccaacctcgtgc

SEQ ID NO: 8527 - DNA, 911 bp, Zea mays
  Predicted polypeptide sequence is orthologous to G783
gcacgaggtagctctctccgtctccctcatcctgacctcgattcgagctagtttcgggaagcaaaggtatcggatcaacccccttgatcacccatggtgcccagggatagggcgcacagcgccgccgctgccaccgcgcccccgacggagaagcccgttcaagggcctatccagaacaacaagtgcgaaaagaaggctccaaagaaggtgcataaatctgagagagagaaacgtaagcgggacaagcagaatgatctctttggtgagctgggaaacatgctagaacctgatagacagaacaatggaaaggcatgcatattaagtgacactacacgaatacttaaagatctactttcacaagtagaatctcttcgaaaggagaacaacacgctgaagaatgagtctcattatgtcgctttggagagaaatgaactactggatgaaaccaatatgatccgtggcgaaatatcagaccttcaaaacgagatgaggatgcggctagaagacaactctatctggagtcatgacacttctagaccaaatcttacagcaccccatccagcgaccacagtatttacattgcagcattcaccacatccacaagtcattgcaacaatgacacttcctctgcaacagccagcagtcgttgagcaatcttacgctgccccacggcgggagctacagctattccctgaagctgcacccactgaagatactgagccaccacaaaacgaggggacctctaatcatgtgatgcggccgcaggcgaggtacccaccagcaatgaccactttgcctgggcatgtatatccagtccttccaagagtggaagatgagcaacgcagcagcggcactactggtagcagagaggaaggcggggtaggcaaccgttaacagctcgagggggggcc

SEQ ID NO: 8528 - DNA, 837 bp, Zea mays
  misc_feature (646)..(646): n is a, c, g, or t
  Predicted polypeptide sequence is orthologous to G783
cgcgcttgcaccgttacgcagtgcgacctctgcgtcttcgaatccaggaaggtagagaggaggaggaggtttgtggcaggatttgaccagcccaatggttccatccgagatggggagcgtcgccaccgccgtcagcacgcctgctgcggacaagctgctccatgggcctatctctggcaagaagtgcaagaaaccaggcccgaggaagattcataaggctgagagggagaagcttaaacgagaccacctaaatgatctctttgttgagctgggtaatatgctagaagcagatagacagaacaatgggaaagcatgcatactgactgacactactcggatactaagagacctgcttgttcaagtagactctcttcgaaaggaacatagcgacctacaaaacgaatctcattatgtaacaatggagagggatgagatgcaggatgaaaacggcgtgctccgcaaagaaatttcagagcttcaaaacgagttgacaatgcgggtttcaggcagtccagcaggttggggccatggcaccgccagatcacatccccctcttcctcactcaaccgcagtgttctcgtcggagcaggcgatgcaaccacccaccattgcaagcgttgtattcccgttgcagcagccactggcnaccatcagcatgaccaaaccacctcatgctgcaccaccactcgaactgaagctctttccagaagtggcatctgccgaaggccatgagccgtgtgaagaccacaaagctcccaaccatgtggcacgaccacaggcaaggtacccaacgcaatcagcctcatggcccgtaaacctgttctctggccttcccga

SEQ ID NO: 8529 - DNA, 795 bp, Zea mays
  Predicted polypeptide sequence is orthologous to G783
aatgggttaaaaaatctgtacattgcacaactgtcatgacaaggctatcgcaacagcattacgctacaggcgtacagcactggttaaaaatcagatgggctcgcgttggttaagttcagcatcatcaccttgtaaactggcaacacagcaggcggagtccctcattaccgggagcaccctgtgcacaatcaccaggctggaaaaccaggtgatatttcgggtgctacctcatgaaacatcatttcccatcaagtacatacaatgagtgctggcgaaggggaaaaaatccttcctttctttgggtgagaagttaaggcagacaatatcaggcctgccaactaccagtgcagtaggtgtaccattgttatttgcagctctgcagccaatgtgaagctaccaacacattagtagaacatccattatgtcattttgcatgcctaaaaagacttggtcagcaaataaaaaaaactaaatagcttgtaccaaaaggacaggtgagtaatgagtaaatgatgcagccatggttttattgtaaaacattaaaaatgacacatattgttgttcatggcgagacagaaatactttgttctgtactgcagtaccatcctaacagtaggtaccagtcagcggtaatccaatgtgccagcacccaatgtgaatggaaatgttagagagccatcagtggagccactaagaaaattagtatgactttgaatgccttcagcgacaatattgtcaactggattttgtgttcgatcacaattagcaccaataagatcagctatgtcagggggg

SEQ ID NO: 8530 - DNA, 1244 bp, Zea mays
  misc_feature (1103)..(1103): n is a, c, g, or t
  misc_feature (1166)..(1166): n is a, c, g, or t
  misc_feature (1181)..(1181): n is a, c, g, or t
  misc_feature (1184)..(1184): n is a, c, g, or t
  misc_feature (1187)..(1187): n is a, c, g, or t
  misc_feature (1192)..(1192): n is a, c, g, or t
  Predicted polypeptide sequence is orthologous to G791
ccacgcgtccgggctacacggcctatattccgtactcgtgaacctcgtgctgacgtgctcacacagtcactccgtttagctcaaatccttatcggcgactcggcgtcggagctcacgaccacgaccgcttccacgccctcgaccccgaacccccaatcccggacgcgaccgctgaaccctagcatactccggccatctgccgccggccccggcgatcccccgccatggcctcccccgagggcacaacgtgggtcttcgactgtccccttatggacgacctcgcggtcgccgccgacttcgcggcagcccccgcgggaggatttttctgggcagcgccgccgtcgctgcagccgcaggcgccagtgcagtctgtcgttgccgcgtcggctcccaacccatgtatggaaatcagtagctctgtggactgtggtcaggaaaaagaacagccaacaaataaacgtccaaggtcagaaagtactacagaatcaagcacaaaagcatccagggagaaaattagaagggacaagctgaacgagagattcttggaattgggtgccattttggagccagggaaaactcctaaaatggacaaaacagctatattgagtgatgctattcgtgtagtaggtgaattgcgtagtgaagcaaaaaagctcaaggattcaaatgagaatctccaagagaagattaaagagctgaaggccgagaagaatgagctgcgagacgagaagccaaaggctgaaggccgaggaaggagagcctggagcatcagatcaagttcctgaatgcccggccaagcctcgtaccacaccacccagtgatcccagcctctgcgttccctgctccccaggggccagcaaccgccaggcacaagctgatgatgcctgtgattggctaccctggattcccgatgtggcagttcatgccgccttcagatgttgacacctctgatgaccctaggtcttgtcctcctgtggcgtagaagccgtgcgaaatcctgttggaaagaggcgatgctgccctccattgattcaaatcttgatcggtccgcatgttgttggtgtagttgaattccagaactgaaggggatgttacatgtgtcnggacggtgacatggggtgatctgatgatccctttgtatattatatatggtatgggtataaatnaattccgcgaaccanaanctnatgtngatcggtggattaacttatgttctattcttgcctgtttgtcctataacccac

SEQ ID NO: 8531 - DNA, 1244 bp, Zea mays
  Predicted polypeptide sequence is orthologous to G791
gcacgagaagagatccacgaatatacccatcccattccccacaaggctccgtcccttcggcggcggcggcgatgtctctcccccctggcccggcggacagtggcaccggcaccggagacgactggttcctcgactgcggcatcctcgacgacctgcccgccgcggcctgcggagccttcccgtgggacgcgtccccgtcgtcttccaaccccagtgtggaagtgggcagctatgtaaacgccaatgatgcattcaaggagcccaatgatgtcttcaaggagcctggcagcagtaaacgtttacggtcaggatccagtgatatgccaacatctaaagcttgcagggaaagaatgaggaggaacaagctgaatgacaggtttcttgaactggggtctgcattagaacctgggaagccagtgaaagctgacaaagctgccatcctaagcgatgctactcgcatggttattcagctccgttcagaatcacagcaactgaaggagactaatggcagcctcgaagaaaagattaaagaactaaaggccgagaaggacgagcttcgcgacgagaagcagaaactgaaactggagaaggagagtctagagcaccagatgaagctgatggcatcggctccagcctacatgccccatccgaccctgatgccggcgcctttcgcccaggcgcccctagctccattccatgcccagggccaagctgcagggcagaagctgatgatgcccttcgtcggctacccagggtacccaatgtggcagttcatgccgccttcagaggtcgacacctcgaaggacagcgaggcatgccctcctgtcgcatgatcaccttgatggggctggtcctgctcacaccatgtggattagccgcaactagttgtcgttgtcgatccattgatggggtataactgatgttcttaggctatctccagcagcctctctatcctattctctatcttactccctattttaaattttactctgtaaacagtacagtctatagtgtaagacaatgttttgcatgtttatatccacgcttcgctggagatgggcatggtagtctgttggtgaccaaggaagctgtgatatctgtggcgaggtgccctgctagaggctcctttaatgggtgtacaattttcgtggtggaaagaagaatgttcgttcttgttctccatagcaacagtgtcatattatctatctatgccatatatattttataaaaaaaaaaaaaaaaaa

SEQ ID NO: 8532 - DNA, 1144 bp, Zea mays
  Predicted polypeptide sequence is orthologous to G791
gcacgaggaacttttactctagccctcccagggtctctcttcggcggcggcgatgtctctcgccccggacccggcggacggcggcgccggcaccggcaccggcgacgactggttcctcgactgcggcatcctcgacgacctcccggccgcggcctgcggggccttcccgtgggacgcgtccccgtcttcttccaaccccagtgtggaagtgggcagctatgtgaataccaatgatgttttcaaggagcccaatgatgtcttcaaggagcctggcagcaataagcgtttgaggtcaggattcaatgatgtgcatgtgccaacatctaaagcttctagggaaaaaatgaggaggaacaagctgaatgacaggtttcttgaattggggtctacattagaaccagggaagccagtaaaagctgacaaagctgctatcctaagtgatgctactcgcatggttattcagcttcgttcagaagcacagcagctgaaggaaactaatggtagtcttgaagaaaagatcaaagaactcaaggccgagaaggatgaacttcgtgatgagaagcagaagctgaaattggagaaggagagtttagaacaccagatgaagctgatgacatcgactccaacctacatgcctcatccgaccctgatgccggcgcctttccctcaggcacccctagcgccgttccatgcccaggggcaagctgcagggcagaagctgatgatgccctttgtcagctatccggggtacccaatgtggcagttcatgccgccttcagaggtcgacacctcgaaggacagtgaagcgtgccctcctgttgcataatcgcttcgattggcggctggtcgtgctcacaccatgcgaattagtcgcaactgaagccccccctagctgtcgattcattgattggctataactgctgttgttatatttgtagttcgttggtgaccaagtaagctgctgatatctgtggcggggcgccctactatagaggctactgataccccttcaatggctgtacatttttttactgttattctttttgcggagaaaagaagaatgtttgttcttgttctccacagcaacaatgtcacataccctattattctatatatatgtcgtgtattttatatttaaaaaaaa

SEQ ID NO: 8533 - DNA, 1186 bp, Zea mays
  Predicted polypeptide sequence is orthologous to G791
ttcggacgagcgctgagccctagcctagccttgcccccgaccgcggattccctctcggccgccgcgcgcccgcacccgcacccgcgatgatgaactgcgccggaggcggagaccccgtggaggacttcctgatctccggcgccgtcgacgacgaagatctagccatcttctgcgacggaggacttgggattgagggtgtcaatggagatgcttgtggatttgagcagtctaatttgggcaaaaggagtagagatgaaccatgttcatctggtctaaaatccaaagcttgtcgtgaaaaaatgaggagggacaagctgaatgacaggttcctggaattaagttcggttatgaatcctggaaaacaagcaaagttggataaagccaatatcttgagcgacgcagcccgtatggtggcacaacttagaggtgaggcagaaaagcttaaagaatcaaatgagaagctgcgggagaatatcaaggacctgaaggaggagaagaatgagctccgcgaagagaaagtgaggctgaaggtagagaaagataggctggagcagcaagtcaaagccatgagtgtagctcctacaggatatgttccccatctccctcatccagcttcataccacccggctgcatttgctccatttgtgccgccacagcaagctgcaggcaacaaaagtgctccaatccctgcacctttccctgggatggcaatgtggcagtggctgcctccgaccatcgtggacacaactcaagacccaaagctctggccgcctaatgcttaggggcagctagctgccttggggtgttgactcgccaatcgccatgccgtttcatgcattgggcggcagatcagagtatcagttagtaggtccctggagaggaggaatcaagtttcgcaactcgcgtcatgtttatgctgtaacagttgcttccagcagtcgtcatcaacttgctttgttctattgaagggtgatgcatgtaattaatatgtggatcttaaccctctagctggcaaatgtgtcctttgctgccttgtgccctttgccccgttcgtgagtggcctgtggaggccgttcctgttcttggtgtccgagattttgccattagctttgtgagacacatacatagcaggaaaagaattcgatgaactaaatctttaaaccgtctcaaaaaaaaaaaaaaaaaa

SEQ ID NO: 8534 - DNA, 889 bp, Zea mays
  misc_feature (837)..(837): n is a, c, g, or t
  Predicted polypeptide sequence is orthologous to G791
actggacgcctgcagtacggtccggaattttcaaagaggccgcgtccgctcgcgtcttcccaaattcgaaaaccccccgcgcctcggcgtggcgaggaccttgctaacagccatggggcactctgcaaagcgcgcgaccggacggcccggttcgttctcgacctctcgtctcgctcacccgcccgccccccgaggaaggaaccctagcctagccttgctccgaccggtcgccgcggcgactgcgacggtgatggactgcgctggaggccgagaccccgtggaggacttcctcctcggcggcgccggcgccggcgacgacggagatctcgtcgccgtcttctgcgacggaggacttgggattgagggtatccatggagatgcttgtggatttgagcaatctaatttggggaaaaggggtagagatgaaccatgttcatctggcccaacatccaaagcttgtcgtgaaaaaatgaggagggacaagctgaatgacaggttcctggaattaagttcagttatgagtcatagtaaggaagcaaagttagataaagcaaatatattgagtgatgcagcccgtatggtggcacaacttagaggtgaggcagaaaagcttaaggaatcaaatgagaagctgcgggagaatatcaaggatctgaaggaggagaagaacgagctccgtgaagagaaagtgagactaaaggtagaaaaggataggctggagcagcaagtcaaagctatgagtgtagctcctacaggatatgtaccccatctccctcatccagcttcataccatcctgctgcgttcactccatttgcgctgccacagcaagctccagncaacaaaagtgctccaatcccagcaccgttccctgggatggcgatgttgcag

SEQ ID NO: 8535 - DNA, 924 bp, Zea mays
  Predicted polypeptide sequence is orthologous to G791
gatccacacacggcaagcaacgcccagggctcgtgctcgccccgcgacccgcgaaagatctgtgctggttcgctcgctcgctcgcgccgcgccgccgcgtgggggtgccgatgagctgcgcggggcaggccggcgggtggctgctcgactacgcgctggtggaggaggagatccagggctccgagttcatctacatggtcgacgacccggccgtctccagcgtgatactggggtttgatgctcccaggaaggaggacggcgtccaggacaaccccggcgccaagaagagatcccggccggagtccagcgcgccacccggcaccaaggcttgccgtgagaagctccggcgagacaggctcaacgaaaggttcaacgagctctgtgccatcttggaacccggcaagccacccaaggccgacaaagtcgctatcctaagcgacgctgcccgtctcctgaaccagctgcagggcgaggcccagaagcttaagcaatcgaacgaatcgctccaggagtccatcaagagtcttaaggctgagaagtccgagctgcgagacgagaagacgaggctcaaggctgagaaggagaggttggagcagatgctcaagggcgtcgtcagccacgccgcggtggctgctccggggcccttcgtcccgcaccctgctgcggtcgctccatctttccaccaccacccggcggcgtttgctcaggctggaaagttcgtcccgtaccccagctacccgccgccggctgcgttctggcagtggataccgccgacgtccctcgacacgaccaaggaccccgcacactggccgccggtcgcctagccgacctaccacctcaccgtggcatcattcatcggtgatgcgttgccgtgtgtactgaacttgatcgaagcattgctggaaaaaagaaaccttggctgct

SEQ ID NO: 8536 - DNA, 726 bp, Zea mays
  Predicted polypeptide sequence is orthologous to G791
ttttttttttttttttttttttttttttactgggaaatggttatggattccttgaataacacagggggcatgttcgcaccatagaagtacaatgtattatctgtgggttaacagtgttcaaaagaaaaggctgaataaccttgagttctttgatcttttcttcaagactaccattagtttctttcagctgctgtgcttctgaacgaagctgaataaccatgagagtaacatcacttaggatagcagctttgtcagcttttactggcttccctggttctaatgtagaccccaattcaaggaacctgtcattcaacttgttcctcctcaatttttccctagaagctttagatgttggcacatgcacatcattggatcctgacctcaaacgtttattgctgccaggctccttgaagacatcattgggctccttgaaaacatcattggtgttcacatagctgcccacttccacatatgagtagacgagcttttctttgctacttgtggactgagttgctcctcttgcggaagtcttgaaggacgaaggcaaagtattggatagaggttgtgttgtatcacttggattgctcatcacaaattcacacagcaccagcttggtttgcacatttgcttccatcatttcatcgccattgtcgtatatgttatatctgtaaaagaaaaaaaaagaaatgtggtttgggtatcaaaagcattacaaaaatgaatctt

SEQ ID NO: 8537 - DNA, 718 bp, Zea mays
  Predicted polypeptide sequence is orthologous to G793
tttttttttttttttttcgacatattgcggttggagttataagacaacatcacgacgtccagagaggggggtgtgtggaaacatcggcatacatgtggagaacaaaatattcgagcccgaacagggaaatacagtgtaagaaatgggatgcaaaggagaacttgctaggagaacacgagcctagcctcggcagggcacaggagctggtgacaatcatgcataatgtccaagcacctgttccagctcagctgtagctgtcgccgacagggccaccgtgccagcgagcgcccttagatcagcagcattcaaagtacggttgcgcagcagaccacggcgcttaacctgaaccttgagttccttggagcagtttgctagttcatccttcagagatttcagccgcgatgctttggtggacatatcgacatagtgagcaggctccttcgcgcgcaagcgctcgctgtggcgagaagcaaggagttggccagcacccttgtatttggctgcatgatcagccgaacgcttggcgcggacacggatcttccgagcagaggcctcgtgaatagggtcaggttcaagggaggacatggggataggcgatttacactccgcgacaggggagttttgcgcagcggccatgtcaggaagaggggggagggcggcatcaagggggtctgcaacagcaagcatggggagatgacatagctttatgataatgggg

SEQ ID NO: 8538 - DNA, 692 bp, Zea mays
  Predicted polypeptide sequence is orthologous to G798, G1897
cgcacgactcctccgcgccccaccaccatgtgcaggtcgacgagcccgcgcgcaagggccagcaaccgcggcagcagcagcttgagtgcccgcgctgccgctccaccaacaccaagttctgctactacaacaactacagcacggcgcagccgcgccacttctgccgcgcgtgccgccgctactggacgcacgggggcacgctgcgcgacgtccccgtcggcggcgcctcgcgccgcgccgccactggcggcggcggcaagcggcgcagggtctccgccgagccctcatccccgccgccgtcggtcgcggacgcgtgcctgccgtccgccttcccgttcctcagcgacggcagcttcttcccgcagctcgacctcgtcggcggcgttgcgcttgcacccccggccttctcctcctcgtggcagtcggtgctggtcccggacttgtacgacgggctcgcgccgtgggacgacggagcaacggcgggcacgtggggcgacatcggtggcctcgacctcagctggacactgccggggaactgagtgccagccgccgtcgcgcgtcttgaggggctccggttttagcagtgcggcctcgtcaggttcagttcagttcagttcctagcatgcagagctctcacaattctcctatgtcgcctccactgtttcttctcgtccttactgcgaatgaaatgg

SEQ ID NO: 8539 - DNA, 434 bp, Zea mays
  Predicted polypeptide sequence is orthologous to G798, G1897
gaattcattgtgttgggaaccgcccccctcctttcaactcgctcgctcgctcgccttccatcattctccctctctcggcagtctgcagcagcccagcgccgtcgcgcatgcacgaggcgtcatcggcggcggaggcgggggcgggggccgagcccggccgtcgggcggcgcagcatcagttcgccggcgtggacctccggcggcccaaggggtacgcgccgccggcgccggcggtgggcgagggggacccgtgcccgcagtgctcgtcgcgggacaccaagttctgctactacgacaactaccacacctcccagccgcgccacttctgcaagggctgccgacgctactggaccaagggcggcacgctgcgcaacgtccccgtcggcggcggcacccgcaagaagccctcctcctcctcctcgtcgtcgtcctac

SEQ ID NO: 8540 - DNA, 846 bp, Zea mays
  Predicted polypeptide sequence is orthologous to G798, G1897
ccaacttcgatctccaatccccagctagctaactatccaatggcgggccaagtgatggaagctcaggcgtgccggctgcagcctcccaccatggcgccgttcgcgccactacctcatcagtacaacaacacctgcaagcacctcaacacgacgatggccgccacttccggcaacaacaacagcaacggcagcaccgctaccgcggctggcggtgcggcggccgacggcatggccgcctacctccagcacctgcagcaggcgggcgccgaggcggcggccaagagcggcggcggcggcggcgcggcgcgcggggagcagtgcccgcggtgcgcgtcgcgcgacaccaagttctgctactacaacaactacaacacgtcccagccgcgccacttctgccgcgcctgccgacgctactggacgctgggcgggtccctccgcaacgtccccgtcggcgggtccacgcgcaagcgcccgcgcctggcgcaccaccaccagcacgccaggctcgctcctccggcgccgcacgtcttcggcctcacgccgatgatgcctcctcccttgcaaccgtcgtcgtcgacatcgtcgtcgcagggacagggacagggacagggacagagcggcggcctcctcggctcactgttcgcgctcggcgccgcgggcgcggggccgccgctgctcgaaggccgcggcgcagggtcgtcgttcgacttcgacctcgggctcggactcccgacgggggccttacacctgggcgcggccggacaaatgcaaggcctcgggctcatggggggaggaggtgcctccgcagccgggtcgtcgtccttcctctggcccgccgcggggctg

SEQ ID NO: 8541 - DNA, 885 bp, Zea mays
  Predicted polypeptide sequence is orthologous to G802
ctctccaccacgtccctctctctttctctttcgcctcccagccccacacctctgatctccactccccacacccacatccgcgtctgccacgcacgtgcaacggtgcacacacgccgccgccgccgcgtcctcttccgctccgctcccctccgtccaacgccgtcgctcgtgctgcatgaaggcgcacaccacgcggccgggagagagcaagcgtagctagctagctccgaagggatcggaggttcttttgctcaaggaagacagaagcacgacgaggcatggacgcgccgtcgagcagcacgagcacgagcaccaacagcagcaggagcgcctccgagcagcagcatcatcaccagcagcaacagcagcgctaccaccaccatcaccaagcggcggggcaccagccgttctactacgccgctgccagcgcggccgggatggcgcagttcatggggtcgcgggccatcgcgcccgccgtcccggtggatgtgcagctggcgcagcagcagcagcagtcgtcggcggcggcggcagcagcgcctgcaggatcgtccggcgctgctgcggacaagacgaaggccgtggtgcccgcggctgctgcggggagcaaacggcccaccaaggaccgccacaccaaggtggagggccgcgggcgccggatacggatgccggcgctgtgcgcggcgcgggtgttccagctcacgcgggagctgggccacaagaccgacggcgagaccatcgagtggctgctgcagcaggccgagcccgccatcgtcgccgccaccggcaccgggaccatcccggcgaacttctcctcgctcgccgtctccctccgcctcgcccgcggcgcgtcccacccgtcttccgcctcccgcgccgtcgcct

SEQ ID NO: 8542 - DNA, 861 bp, Zea mays
  Predicted polypeptide sequence is orthologous to G802
cgcggcccctggaagcgaaaggcgccgcctttccttccggcttcctcgctgtaacggaaggttcttcggcgcttcctttgtcagccggccccaggaaggggaagcatctcgggagcatggaccatggcggcgggggaggagggggtggggcgccgtcgagcagcaacagcgccggaggggccgccgccggcggcggcgccaccgctggcggcgcgagcggcggtcgcggtagcgagcaccacccgttctactacgccgggcccgcggcgtccaactccggagtgccacaggcccagcagcagccgtcgccgttcgctggcgcgctcgctatcgcgcccgtgcccgagcagccgcagccgtcgtccgccgacaagaaggcgctcgtgcctgcggcccccgcggcggcggggcccgtagtagccaagcggccgtccaaggaccggcacaccaaggtggacgggcgggggcggcggattcggatgccggcgctgtgcgcggcgcgggtgttccagctgacccgcgagctcggccacaagtccgacggcgagaccatcgagtggctgctgcagcaggcggagccggccatcctggcggctaccggcaccggcaccatcccggccaactactcctcgcttaacatctccatccgctccggcgccgccgcccccgccgcccgcgccgcgccgttcccggcgctcgcgctccacccgcaccaccaccaccaggcggcccccgcgcacgacatgtccgccatgatggctgggtaccatcaccaccttctcccgccgcagccgcagccgcaggaggaccccagcgccggcgacgcctacatgcggaagcgctaccgggagggactgttca

SEQ ID NO: 8543 - DNA, 265 bp, Zea mays
  Predicted polypeptide sequence is orthologous to G805
taacgcttagatagtgtttgctgggtggcactcgcttggcaagcatccactggttatgttcatcgttccttaggttgtccatcatctgcatcttgtggttggcaccacatcagttgctcgatcatcatctctcggtcctggccgaaatccgatcggagtcgcacatgcatgccatcagactgggctctttgccgacgagcaacgcgcgaggcgtgacgatgacacggcggagtttgacaacatcgcgtcgggactggcatagatc

SEQ ID NO: 8544 - DNA, 889 bp, Zea mays
  Predicted polypeptide sequence is orthologous to G805
ctctctttcactctttttctctctccaagaaataattgactccaacgccaagcgccacaagcacaagcccttgcttgcttgatgtcactctttcgctctcgctagctctaacgccaccgctgacggcgctgccgagcctccagtccaccgcccaacgtcatacaccaagtcaggtcagcagccccacaagaacacttcgtaggtcagcaaatccattattagtaccgatatttctccaggtccctgaagagaaagcatcgtcttgtgtatttatatataccatggcctgatcggctatggacgtcaccggagatgccggcggaggtcgccgccccaacttccctttgcagctgctggaaaagaaagaggaacagccctgctctacgtccccagcggttgctgtgggtgctggggctaatgggtcgggagagatgcagatgaagaaggtggcggcgccgaagcgcacatcctccaaggacaggcacacgaaggtggacgggcgcgggaggcgcatccggatgcctgcaatttgcgcggctcgggtgttccagctgacaagggagctggggcacaagacggacggcgagacgatcgagtggctgctgcagcaggcggagcccgcggtggtggcggccacgggcacgggcaccatcccggccaacttcacctcgctcaacatctctctccgctcctcgggctcttccttctccatcccagcgcacctccgtgcggccggcccacgcttcggcggcgcgcggggggacccgtgggagcgcgtcgtgggagtgggactcgggttcggcgccgccgccgaagaccctcccgtcgctacgtcctcggcgtcgtctcctctgctgctgagttttcactccggcagcgtcggtcttga

SEQ ID NO: 8545 - DNA, 846 bp, Zea mays
  Predicted polypeptide sequence is orthologous to G807
gcgaaaagggggaaaataattaaataagaaaagagcatgcaacacttattaccagaatcctcagtctactgtattaattaagatactagtacagcccattccctgagtcccggtgatttgttgatgatacaagtcccatctgttctgtaagattagcgatgttccccactttgctccatccatcctcctgcgcatatagtccgcctgctgaatcaacttcctcattatcggtagatagagggctgcctaccaggaactgctcccagatggagttgacgatgcctggaaggctctgagcctcctcgtcgttgttgttgtacatggtggtcccatcatcaccttcttctggcagggggaactcaggaccaggcatcatctcaaaggcccctccaagaatatccacagagaccaagtctgccagatctgagaattccggaataatacccatgtcacttgaaacaggaggcacagcactcatgctggccacttgcttgtacgccttgttatccagcaccactgggcactgcatttcaggggccgctggaggagaacagatagccgagctcgtgccgacatacgccaagcctgagtttgctggaacctctgcaagggtgaccccagaatttcttgtcgacgaagagctctcaaaagcttggccggccggcatataatcctccagcagattattattattattattactattatctgaattgcccatagattcaaacatatgcgaagaatctacgtttaggatcttccttagcattgctttggctgcttcgttgatcgaggctgatacttgatgatttgacgtctacgagcagcagactttcgrctcgagtc

SEQ ID NO: 8546 - DNA, 861 bp, Zea mays
  misc_feature (789)..(789): n is a, c, g, or t
  Predicted polypeptide sequence is orthologous to G807
actggtcgcctgcggtacggtccggatttttcgacgaccccgcgtccggaattttttcccagggttttctgagaggacagaagcatctgctgaagactatcaacagaaggaaaccatccttgcaggggaacagccaaccacagcaacctcagtcgcagaacgctcctgtgccttcctgtgtagaggttggtaagtttgggttggaggaagagattgaacggctgaagagggataagaatgttcttatgcaagagcttgtcaggctgagacagcaacagcaaacaactgaccatcagctgcagactttgggcaagcgtcttcaagggatggagtcacggcagcaacagatgatgtctttcctggctaaagcaatgcaaagtcctggtttcctagcgcagtttgtacagcaaaatgagaagagcagaagaagaatagtagcggcgaacaagaaaaggcggctgcccaggcaagatggtggcctagactccgaaagtgctgctgcttcgttggacggtcaaatcatcaagtatcagcctctgatcaacgaagcagccaaagcaatgctaaggaagatactaaagctagattcttcgcataggttggaatctatgggcaattcagagaatggcaattttctgctggagaattatatgccaggcgctcaagcctttgagagctcttcgtcaacaagaaactctggggtcaccctttcagaggtttcacctaccccaggtttgccgtatggcggcggcggcggcacgagctctgggctgtcagccatctgccctnctggaatccagtgcccagttgtgatggacacatgtcgtctaaccagtgcccagcatgagtgcttgcctcctg

SEQ ID NO: 8547 - DNA, 736 bp, Zea mays
  Predicted polypeptide sequence is orthologous to G807
cagcaactagagtgggaataagcatacagatttaacaagtcacagtggtgttctcaagactgccaacatcataaattgatacaagcaggtggctgtggcattcaaagctcagctggaaaactgcccctcccgcgcatataggtcgagcgagtggttgatataccggcatatcattttttggccaaaaggaaaaataacaaaaactgcaggcgacgcttattaccgataatcccagtctaccgtatattaattaaaatacactacagcccattccctgagtcgcggtgatttgttgatgacagaaggcccatctgttctgtaaaatcaccgatgttccccactttgctccatccgttctcctgtggcgaccccgaatcaacttcatcgttatcggcagaaagagggctgcctaccaggaactgctcccaaaaggagtcgatgatgcctggaaggctctgagtctcgtcgttgttgttgtacatggtctcatcggtctcgatggggacactgtcatcgccttctggcaaaggaaactcaggaccaggcatctcaaaggcccctccagggatatcgacggagccttcattcaccaagtctgccagagctgagaattcaggaatacccatgtcaattgtagccttcgaaacaggaggcacagcactcatgctgggcacttggttagacgacatgttgtccatcacaactgggcactggatttcaggagggcagatggctg

SEQ ID NO: 8548 - DNA, 594 bp, Zea mays
  Predicted polypeptide sequence is orthologous to G811
tttttttttttttaatagcaagcaaaactgaataaaccgtctaagccaaagcatattcgtacatagcgtgcctatagacactatacgcgtcgtcttgaacatcatctcatggtgatcttctcttttacccatacaactataatgctcgtctttcaaatacaatgccattccaaactcaaatcaataaagattcttattacgccaggttccgtgtcgtgctctgctcgccgatcggtagtattgttacagagcgatcgcgcctcgacggctttctcgagtatggaggaatccttggaagccacaaaagacgaagaaagcgacgtagacgaggacagcaacgaagatggtgtctgaaactgccttgccatcttcgggatcatccacgccacccgtgaattcttcatggttgcttcggtagagacctgcgagggcgctgaggatgacaatggcgaaaacggagagaacggtgcatgaccacgcgttaaaggcgctgacgacgggcttcattatgggcgtatgtgggaagagttcgagtatggttgaccaaccgatgtatcacgatgtgtgtggtggtaatggattattacttgcgac

SEQ ID NO: 8549 - DNA, 781 bp, Zea mays
  misc_feature (661)..(661): n is a, c, g, or t
  misc_feature (752)..(752): n is a, c, g, or t
  Predicted polypeptide sequence is orthologous to G811
tgtttcctcagtggactagtgtgaagctgtgcttagcgtagcggaagggaggaaggacaaggcaaggcaactgatggcggcgggcggcggaggcggctcgccggcgccgttcgtgtggaagacgtacacgatggtggaggaccccgggacggcaggggtgatcggctggggcagcggcaacaacagcttcgtcgtcgccgaccccttcgtcttctcgcagacgctgctccccgcgcacttcaagcacaacaacttctccagcttcgtccgccagctcaacacctatgtcagttaaatcacacactccagctagctaaattgattgccgtctctcttctacgagctgaaccctgctcttgggagagcgctggatctgtataaactttggcgtgtgtaccgaatgctcttgctgtgctgtaccaacacaaatttgtaaattggtttttgttggagaaaaaaaaggaaatatgtaagcttgctacctgcagcgacgaaattcttcaaaacatctttggagatcgaccattcaaaattcgtagacaaacatatggacagagatggagccgcgtatatatatgcaacgaaattctgcagacagttcggtgaatatatgcacggagaaaaattggtttttttgcgcaatttacctatggatttctgncagaaccgaacacaccgccgtgagaactttataaatcgcgagagccaagagctgcacagctagtactagtacttcccttgtcctgacttgntattttcagggcttccgcaaggttgatcc

SEQ ID NO: 8550 - DNA, 876 bp, Zea mays
  Predicted polypeptide sequence is orthologous to G811
cgatgttgccgtcgacaccctgccaccaacgacaggttaccttcttcgggcccttctcaccatttcctcatttaagccccgtgtgccttgctcctcggtgtttcctccagatagtagtgtttcctcagtggactagtgtgaagctgtgcttagcgtagcggaagggaggaaggacaaggcaaggcaactgatggcggcgggcggcggaggcggctcgccggcgccgttcgtgtggaagacgtacacgatggtggaggaccccgggacggcaggggtgatcggctggggcagcggcaacaacagcttcgtcgtcgccgaccccttcgtcttctcgcagacgctgctccccgcgcacttcaagcacaacaacttctccagcttcgtccgccagctcaacacctatggcttccgcaaggttgatccggaccggtgggagttcgcccacgcgtcgttcctgcgcggccagacgcacctcctgcgcaacatcgtccgccgcggcagcagcgccgccggtgccggaggcggaaagaggaaggacgccagccccacggagctggcctccggggacgacatgaccatggtggccacggaggtggtgcgcctcaagcaagagcagcgcgccatcgacgaccgcgtcgcctccatgtggcgccgcgtgcaggagacggagcgcaggcccaagcagatgctcgcgttcctcctcaaggtcgtcggcgaccgcgacaggctgcaccgcctcgtcggcgacgcccccgtgccagataacgggttcgcctcccggcgtgccgccgagccgcccgccgcggaggtcggcgagaagcgggccaggctgctgctcgacggtgacagcatggtggcgctcggtcccgaggccgt

SEQ ID NO: 8551 - DNA, 733 bp, Zea mays
  Predicted polypeptide sequence is orthologous to G831, G1202
ttttttttttttttttgaagggaaggatttttattcatcaagaacagtacatcgagatgatacaattccttgaaagtcacttccggcctctgcccataggagcacacagcccaacagaatctaaaaacacacactagtggctatcaatccgaagactagaccgccaactatgctcccgggaaaaaaactgagttctgcatgagtcctgcctctgtagcatagcccatgcgcgaagcctctgggctacagtaaaaatgaccaattcattcctggcaccattcaggcgtctcgactgttggaccctttctctccataatttgggaccagaagcagtgttctttcatatcattaatagatttgacagtcctgctactgatcttggtcatggcctcatgggtagtccaatacgtcttgacaaccaggaggatcttctccctgttcctgtacagggtgaacaccgagtccgcatggatgagatcgtaggtcctcgggtaggtagacatgccctcgcaccggcgctgagtgtggcggcggaggaagatggagcggacacagcacggtgcgggatcaccaggaggagcagacacagcgcggtgcggcgaggactggctccgggatcaccaggaggagcggacacagcttttgctccgagaggcgagagcgagtcaagaggcgagagccgcggcggcggctgcgatgggcgaaaaaaaccctagcacttttaccaggcgag

SEQ ID NO: 8552 - DNA, 1572 bp, Zea mays
  Predicted polypeptide sequence is orthologous to G831, G1202
gcacgagggcaagcttatccccctccacgacggatccatccggaccgctcttgacaccggctgcggggtggcgagctggggagcctacttgctgtcacgcaacatccttgccatgtccttcgccccgcgagactcccacgaggcgcaggttcagtttgcactagagcgtggtgtgccggcgatgattggggtccttgcctccaatcaactcacttatccggcacgttcctttgacatggcgcattgctctcgttgcctcatcccatggcagctttacgacgggctgtacttgatagaggttgatcgtatcctgcgtcctggaggttattggattttgtctggaccaccaataaactggaagaaacactggaaggggtgggacaggactaaagaagacctggacgcagagcagaaagccatcgaggcagttgccaggagcctatgttggaagaagatcaaggaggagggcgacattgctatctggcagaaaccaactaaccacattcattgcaaggccatccacaaagttatcaagtcaccgcccttctgttctaacaaaaacccagatgctgcctggtacgacaagatggaggcttgcataactccactaccagaggtcagtgacttaaaggaggttgctggcggctcgttgaagaaatggccggagcggctcactgcagtgccgcccaggattgccagtggcagcatcgagggggtcacggaagagatgtttgtggaagatactgagttatggaagaagagagttgggcactacaagtccgtgattgctcaactcggccagaaaggccggtaccgcaacctactcgatatgaatgcaaagtttggcggcttcgctgcggcattggtgaatgatcccttgtgggtcatgaacatggtccctactgtggggaactcaacaacccttggggcaatatacgagcggggcctcattggaagctaccaggactggtgtgagggcatgtccacttatccccggacctacgacctcattcatgcggattcactgtttacactgtacaatggcagatgtgaggcggacaacattctgctcgaaatggacagaattctgaggccagagggcacggtcatcatcagagatgacgtggacatgttagtgaagataaagagcatcacggacgggatgagatggaatagccagatcgtggatcacgaagatggtccgctcgtccgggagaagctcctccttgctgtgaagacatactggactctggacgacagcaaacaatagcaataacgtggaatagagagttagaatgattattgacgtgatcggcaaatcttgcgactgccttaccgtttgccctgtgaatctggtggactttgggttccattttctttttgggtattcattggggggagatagttcacataatggagatataatctccttgttaagatataagactgaacccagcacagattttgacataaaaaacatacattgtgcaaagtgggtaaatagaaagtacaatattgggactacctttttctccggatgcacattgtctggttatggctatgaaaaaaaaa

SEQ ID NO: 8553 - DNA, 830 bp, Zea mays
  Predicted polypeptide sequence is orthologous to G831, G1202
ggactgtacctgatcgaggtcgaccgggtgctgcgtcccggagggtactggatcctgtccgggccgccgatcaactggaacaagtactggaaggggtgggagcggaccaaggaggacctcaacgccgagcagcaggccatcgaggccgtcgccaggagcctctgctggaccaaggtcaaggaggccggcgacatcgccgtctggcagaagccctacaaccacgccggctgcaaggcctccaagtcgtcccggcccttctgctcgcgcaagaaccctgacgcggcatggtacgacaagatggaggcctgcataacgccgctgccggagatctccaaggccagcgacgtcgccggcggcgcggtgaagagatggccgcagcggctcacggccgtgccgcccagggtctcccgcggcactgtcaggggcgtcacggccaggtcgttcgcgcaggacacggagctgtggcggaggagggtccggcactacaagtcggtggccagccagctcgagcagaaggggcggtaccgcaacgtgctggacatgaacgcgcgcctgggcgggttcgccgcggcgctggcgctggccggcgacccgctgtgggtcatgaacatggtcccgaccgtggcgaacgcgaccacgctcggggccatctacgagcgcggcctcatcggaagctaccaggactggtgcgagggcatgtctacctacccgaggacctacgacctcatccatgcggattcggtgttcaccctgtacaaggacaggtgtgagatggaccgcatcctcctggagatggacaggatcctgaggcccaggggcacggtgatcgt

SEQ ID NO: 8554 - DNA, 924 bp, Zea mays
  Predicted polypeptide sequence is orthologous to G831, G1202
ctagggttcttctcgcccatcgcagccgccgccgcggctctcgcctcttgactcgctctcgcctctcggagcaaaagctgtgtccgctcctcctggtgatcccggagccagtcctcgccgcaccgcgctgtgtctgctcctcctggtgatcccgcaccgtgctgtgtccgctccatcttcctccgccgccacactcagcgccggtgaggactaccctcttcctcttcctctccttctccctcaccctctccctctccctgtggttcactaccgggtcgtcggcgaagggcgaacgacgccatgccggcggatccatgcagggctccacaaaagctggatccgtggagggttggattctctttgtagggctggatccatggagggagtgcacggcgctcgtcgcccagctcgaggtccacgtccaccaccgcgctcgtcggtttaggtttcgtgatctcactactgcattcactgcaggtgcgagggcatgtctacctacccgaggacctacgatctcatccatgcggactcggtgttcaccctgtacaggaacagggagaagatcctcctggttgtcaagacgtattggactacccatgaggccatgaccaagatcagtagcaggactgtcaagtaaaattctcaatgttgataagaatttttcatgtttggagttgtaccaccgtttctagctccttgaactagtgatctcttgacggtttgtgcttgctgttctttctggacagtacttgctcggataggaaatttaacatgtggggggaaggaagggtaggtagtaagacccctggcccctgcaaagttttctttcattccgaatttgtgtcaaatggtaaatagaagtcattgttgcgagtcaccccgaccccggataagcataatcacaactgggatcaatctagcatt

SEQ ID NO: 8555 - DNA, 804 bp, Zea mays
  Predicted polypeptide sequence is orthologous to G837
ggaagactgtcataatatccaacaatgaacagagtaccatgtcgagattaataaccgtacagaaatattgactcaagtacaacttgacgagaaatcatgccataagcaataagcatagcagacaaccaatcttgcgatctgcacaattatacttcggcagtatcgactaaaatctcgataaaccacagtgaacagtttttctatgtgcactatcccctcttcaatctccagaaaacaaacctgtatactaaattcgtgtctcgaactctcgatggtggaaatcactggctttcagatttaccggtttgttcagggccgttaccatttgatccagagctgccatcagccccttgagattcattatgctcggcattggtggatgtgctagtttcaatcttgggatccacctgctcacccttgttagacgtttctgtagctccatcacccttgttagatgtctcttctgaagaaccattcactccgctggaagaatccccttgggaattctctgcctcagctgagacactgctgttctcagagttctgttgtatggaatatgacgcttcagtggttgtacctgttcccatgcccttctcatcatcaccagatacagtctcagtattttcttctgcagaggcgctatcagatgagttaccgttgtcatcacagatccagtcccagatgatgctgttgcactttcatcttccaatccagtttcaatatggacagcctcaacaatgccatgctcagaagaatccgaggtagtgtaagttgcatcaccttggttttcactggcatcatttt

SEQ ID NO: 8556 - DNA, 785 bp, Zea mays
  Predicted polypeptide sequence is orthologous to G839, G1196
ggcacgagggaagttggacaagtacgaggagaaaagtaaggcttacttgtgtatcgacattttggagcaagaactcaagaggaaatccttcgttttggaccccatctctatctctatagaggagtcgattgccacgcctttgctggtcgataattttcacatgaggctcataaacttggaaaacagagttgcgtttgctcggatattcttcccttctgaagccaagcttgtcatgcgcatcgcacaagccgattcaacccaagagtttgccggcatcaccaacttcagcagactcaaggaagttgatctaaacgaaaccccaacgatgcagaataggaggcttcgcgaacgccttgatgccttaacaaagacagttgagctagggagacgatacttcccacactgttcggacgttctggataagttcctcaacgaagaatccactgatccgatcttccttgagactgggaccccggaggatcagcaagtcaagaggatgcgtttctctgagctcagagaggacgtgcgcaaggcgttcacgaaagataaggcagcagtggctgcaatagcttcctcggcgtcctcgtcttcgtctccgaggtgcagacgacccaataggaaatcacggtgatgtcagtctgttcaggacacctgcactgggttgtgtgtgttttgacatgtaacactgtttcagtagataatgctgattgtcagatttgctgccgctctacagaagattaagcgaccgtctgtttcaagaattattcagacagttaaaaaaaaaa

SEQ ID NO: 8557 - DNA, 842 bp, Zea mays
  Predicted polypeptide sequence is orthologous to G839, G1196
cgacgatatatctttggataaggagctccctccagaagcagttgatgagataaaaaatttgcgcaagaagtcacaaactgctgatggtgatacgttcatttcggaccctgtgcatgagaaaagagtcagaagaatccacagggcacttgactctgatgatgttgagcttgtgaagttgcttcttaatgagtccgacatcacattagatgatgccaacgcattacactatgctgcttcttactgtgatcctaaagttgtctcagagctgttagatttggcaatggctaacttaaatttgaagaatagccgtgggtacacagcactccacttggctgctatgaggagagaaccagctataatcatgtgtctccttaacaaaggggcaaatgtgtcacaactgacagctgatggcaggagcgcaattggtatttgtcggaggttaacaagagcaaaagactacaatacaaagatggagcagggtcaagaatcaaataaagataggctgtgtatagatattctagagagggagatgatgcggaatcctatggcggtggaagatgccgtcacctcgcctttgttggcagatgatcttcacatgaagcttctctacctggaaaacagagttgcatttgctagattgttctttcctgctgaagccaaggtcgccatgcaaatcgcacaagcagacaccacagaagaattcggcggtatagttgcagttgcagcaagcacttctggtaaactgagggaggtggaccttaatgagacgccagtgacacaaaacaaaaggctccgttcaagggtagatgcactgatgaaaacagtggagctgggccgtcggt

SEQ ID NO: 8558 - DNA, 809 bp, Zea mays
  Predicted polypeptide sequence is orthologous to G839, G1196
cgaagaggtcgtagaagaagtcgctgcgtgcggcaaggatgcagcggtggatgggtacgggcggcccaccgtcgggcacatcgacgtcggcgtcgctgcagtctaggtccgggtcgaggagcagccgctcgaggtttttgctgagccggttcaggctcacggcctccacgctgcctccgctccctgcggcagcgactccaccaccccacccctggccggcaggcaacgggggagtctggggcggccctggcggcggcagcgcgacggaacaggggctcgagccgttggacaggtacgacgacgacgacgcgaacgtgatggacgacgacggctccatggcttcccacaactgccaagcgcaagacgcgagcccctacttgtgccggacccggaccactacgaccatgagatggtggtcgcctcaagcggtttcggcagccaaaccgagaactttctggctttgcacggccaaacacccccaattctgcgctctgcttggctggctccaggcaaatccgcgtcggcaaaagcctcctcgacgtgacccttcctagagcggcacggaagtcggcgtaaatcacacgcgagtcctcccagcgttgccgatcccggactgaaatctcaccggcgctgcgtcaggccaggaacagaaaatatggtgcttctccttcttcttcctaccgggcggtggctaaatctcagacaagtgaaaaagggatccaagagggcagcatagtagctacagggaataacgtgagggattgttggctcgtgctgggaggggcgaggactgactgaggagcggtagg

SEQ ID NO: 8559 - DNA, 863 bp, Zea mays
  Predicted polypeptide sequence is orthologous to G846
ttgatgctggaagaacgctctcggcaacaattcaaggcatttgctgcggctgggacactcaaacaaaactatgccaacatccttttaatgttgctgcgacttcggcaagcctgtgatcatcctattcttgtaaagggcaatcagtcagaatatggaggtgatggttctatagaaatggcaaagaaacttcctaaggaagtggtgatagatttgcttgcaaaactggaagtggggtcaacactttgtggcttatgcaatgatacacctgaggatgctattgtgacaatttgtggtcatgttttctgctatcaatgtatacatgaacgaataacgactgatgagaatatgtgccctgcccctaattgcagtagaacattaggtcttgaattgttattttcgtcaggagctttaaagatttgcatctctggcaaatcgagttctgcagtagctagttcatcatcagataacgagtcatcttcaatcagtcaaagcagctttgtctcatccaagatacaagcagccattgatatactgaattcaatcattgtcatggatcctcttactgaaagttatacaatggaatcaagcagaagtggactaggccctgtgaaagccattgtcttttcccaatggactggcatgctggatttgctggagctttcactgaatatcaactgtatacagtacaggagactagatggaacaatgtctctcaatttaagagaaaaaaatgtgaaggattttaacactgacccagaggttagagttatgattatgtcactgaaagctggtaatcttggtctcaacatggtttctgcttgccatgtaattctccttgatctctggtggaccccttatgctga

SEQ ID NO: 8560 - DNA, 1079 bp, Zea mays
  Predicted polypeptide sequence is orthologous to G852, G2633
ggtatagatractcaaattctgcttatgccagrgraggcgmgcttgatatagttgggaggacgttgtgtgatgttgctaattcatgtggtcttccttttgagttcaatgccgttccagctgctagccatgaggttgagcttcagcatcttgctataagacatggggagattattgctgtgaattttgcctatcagctacatcatgttcctgacgaaagtgtaagtacagaaaatcatcgggataggattataagaatgatcaagagcatcaatcctagggttgttactctcgttgaacaggagtcaaatacaaacacagctccattcttcccaaggtacatggaaactctcaactactatacagccatgtttgagtcgatagatgttgctctcccaagggatgataggaggcggatgagcgcagaacaacactgtgttgcaagggatattgttaatttaatcgcatgcgagggtgctgaaagggttgagaggcacgagctgtttggaaaatggaagtcaagatttgcaatggctggatttagaccgtacccactgagttcagttgtgaacagcactatcaacacattgttgcatacctacaacagctactacaggcttgaggagagagatggtgtcctttaccttggatggaaaaacagagtattggttgtatcttcggcatggtgttgacatttcctctgcaggttccatcgcactttggcctccatctgacgtttctaaggcaccattatgcttgtctggtatactcagtatatgcttgtatgtaatttgcaaccataccttacccaatggttatcttaccaactagatcttcatggcaaggtgaagtgtcacttaaaatctagaagttgtaactgtcgtgttgacgctagatatagatagttctgctttggtttgacatatgcagatgtgctgtaatgctcaggggttatgctaggcaggcccaagagggtgcctgtttgttatctatcaggctactgtgttgccgcctgctttgtgtgtgcatatatatttggaatgctactgtcctttctctgggatgaagtggattgctaaag

SEQ ID NO: 8561 - DNA, 777 bp, Zea mays
  misc_feature (3)..(25): n is a, c, g, or t
  misc_feature (27)..(59): n is a, c, g, or t
  misc_feature (195)..(216): n is a, c, g, or t
  misc_feature (363)..(451): n is a, c, g, or t
  Predicted polypeptide sequence is orthologous to G852, G2633
agnnnnnnnnnnnnnnnnnnnnnnncnnnnnnnnnnnnnnnnnnnnnnnnnnnnnnnnncagcacactttgcctgcccaaactgggatctcgcagatggaagacttgagatccatcttccctcggaggggcatcagggcatgttaacttgttgacatcattgcacgctcaagagcatgaaagaaagactaagaannnnnnnnnnnnnnnnnnnnnntgattagctaagaatacgctgggagaagtccatgacaggggtgaatacatgagagcaaaagaaaactgtaattaccatacagcttagcagctacaatctaatgtcaatgttctcttctctggtctgcacttcaggaaaactaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaagagttgacgtgtacttccggtcttctgaaaacgttactgtcagtgccaagcagaagcagatatcaacttcctgttcttccagccgagcagcatcgcgccatccttctcttccagggtgtacttgtccgagtagcaggcaaggagcttcctgatcaccgagttcacgtacgagctcagcgggtatggtctgaacccggccatggtcagcctcgaccgccatttgcccaggagctcgtgacgctccacccggtccttcccctcgcaggcgatgatgttcacgatgtccttggcaagacctcgctggtccacgttgatccggttc

SEQ ID NO: 8562 - DNA, 2341 bp, Zea mays
  misc_feature (29)..(66): n is a, c, g, or t
  misc_feature (86)..(108): n is a, c, g, or t
  misc_feature (425)..(429): n is a, c, g, or t
  misc_feature (1147)..(1151): n is a, c, g, or t
  misc_feature (2067)..(2072): n is a, c, g, or t
  Predicted polypeptide sequence is orthologous to G852, G2633
ccacgcgtccgcgacgattcagtgaggcnnnnnnnnnnnnnnnnnnnnnnnnnnnnnnnnnnnnnncgaacccagctgcctcgtannnnnnnnnnnnnnnnnnnnnnncggtctcccgcgccgccttccacccaagcgaagctacccctactcgacccagaattatcttctaccagcgctagtccgctccgcctctctactggctgccgtggagtggggatccgtccggacttccttctttcgctgttgatgtcatcatgctgagcattttgtggtagagacgatcatctctttgggttccagcatataactcatgcccataaaatttgcactagaaaatatgtcgacacaagcctctaaccggtcatacagatatccagacagaacccaactgccgtaccacaatggcaatccaatgcatgttnnnnncaatggtaattactgtgtgcaacaaaatcacgatgatgttaactacatttcctctgatgatggatcacagagcagtagttctagagttcaagattttcaagcacagttttgcaccctagattcgtcttcggccaattgtgtttatcctgcacatagttctacctcttctcagagcataagtggaagccctctgtctcagcaggagagccactctgatcatgcatatggttcctctccaagtgcatcgtgcatcactcaggttcccacctggacacttaaggatctagaaaatgtgatgcttggacccgattctgacataggtagccctgacagttcctttctgcttgacactgccttgcatggaaataactggagagaacttttgggaattcaaactggggatttgaggcaggtaattgtagcatgtggtaaggctgttgacgagaatgctgtctatatggatgcattgatgtctgagttaagggagatggtttctgtctctggtgaaccgatgcaacgtctgggagcttacatgttggaaggcctcattgcgaggctttctttcactggacatgccttgtataaatctctgaagtgcaaagagcctgtggctacgagttctgagctcttgtcctatatgcatcttctttatgagatctgtccattcttcaagttcggttacatgtctgccaatggtcccatagctgaagcggttaannnnnaagacattattcacatcatcgattttcaaatcgctcagggtagtcagtggatgactatgatacaggcccttgcttcaaggcctgggaggcgaccatacctaaggatcactggcatagatgactcgaattctgctcatgcccgaggtggtggactggatatggttggacagaggttgcacagaatggcccagtcatgtggtctgcccttcgagttcaatgctgtgccagcagctagtcatgaggttgtgtttgaagatctttgtctaagatctggggaggccatcgttgtcaattttgcttatcagctgcatcatactcctgatgagagcgtgggcatagaaaaccatcgtgatagaatactgagaatggtcaagagcctctctcctaaggtggtaactcttgtagagcaggaggcaaacacaaacacagcacctttctttcttagatacatggagactcttgattattacacagcgatgtttgaggcaatagatgttgcttgccccagggatgataagaagcgcattagcacagagcaacactgtgttgcaagggatattgtcaatttaattgcttgtgaaggtgcggaaaggatagagagacatgagccttttggaaagtggagggcaagacttgtaatggctggttttagaccatacccgttaagtccagtggtgaacagaaccatcaaaacactgcttgacagttaccacagccattacaggcttgaggagagagatggcatcctttatcttggctggaagaacagaaagctggtcgtatcttctgcctggtgctgatatttccaacttcttctaagaagcattgttaagattctttcgtggcttggggttcaggcgttcagcacatgaatccaaggtggaacctaaacttcagtatgaagactgcacaatcnnnnnnacaagctggttgcttccttactatttgttgcccagccttgaaactctcccacgctcactatcatcgctgatgtacttaccatgactcagttccatccttatatataggtgcaaacaatggtcttaatattgtatattggtagaatctggtggtattagcttccaaatctggattgctgaatcgtttgtgttactacatttagccaggatttgacagtagacacaaggagtgctgtaagatcctgtatgtacaacgtgcttcagttggtg

SEQ ID NO: 8563 - DNA, 796 bp, Zea mays
  misc_feature (694)..(694): n is a, c, g, or t
  misc_feature (737)..(737): n is a, c, g, or t
  misc_feature (739)..(739): n is a, c, g, or t
  misc_feature (742)..(742): n is a, c, g, or t
  misc_feature (752)..(752): n is a, c, g, or t
  misc_feature (764)..(764): n is a, c, g, or t
  Predicted polypeptide sequence is orthologous to G852, G2633
ggccctgaggtgcaaggaggccctcattgttaactttgcattcctgctgcaccaccttcctgatgaaagtgtctcaattatgaaccaaagggatcggcttctccgtatggtgaagggtctccgaccaaaactagtgacgttggtggagcaggacgcgaatactaacaccacccttccaagggaaagcccagatagaatgaacgtggagcgccagtgcctcgcacgggaaatcgtcaacatcttagcttgtgaaggtcctgaccgtgtggaaaggtatgaagtggctgggaaatggagtgctagaatggcaatggcgggctttgtgtcgtccccatttaacagcggcgcgattgatggcataagatctctactgaaatcgtactgcgataagtacaggttcgagaaggtccaggacggcctccacttcggctggggcgacaagactctcgtcttctcttcggcgtggcaatagaagcttgcttgtactattgcctatctgagcactttccagcgttttaggagcatctggtgcaagggctgtaaagagatttctgtcgccgtattgttgaagtacactcgtagctaaccttagcgtgctgcctgcctgtaggcttgtgaggtctacggtttacctagtttcatagatgaagtatgttgtgcattgtacacctactgaactacatgtagactgtanagtcgcgggtgtatttaattctgcccttcttttggaggggtanantcncaatatgtcnacattgtttcgngtaaaaaaaaaaaaaaaaaaaaaaaaaaaaaa

SEQ ID NO: 8564 - DNA, 904 bp, Zea mays
  Predicted polypeptide sequence is orthologous to G852, G2633
ctactatttggcactttttgattcactgggtgccacccttccaagggaaagcccagatagaatgaacgtggagcgccagtgcctcgcacgggaaatcgtcaacatcttagcttgtgaaggtcctgaccgtgtggaaaggtatgaagtggctgggaaatggagagctagaatggcaatggcgggctttgtgtcgtccccatttaacagcggcgcgattgatggcataagatctctactgaaatcgtactgcgataagtacaggttcgagaaggtccaggacggtctccactttggctggggcgacaagacgctcgtcttctcttcggcgtggcaatagaagcttgcttgtactattgcctatctgagcactttccagcgtttttaggagcatctggggcaagggctgtaaagagatttctgtcgccgtattgttgacctaccatataagtacactcgtagctaaccttatcgtgctgcctgcctgttggcttgtgacttgtgaggtctacggtttacctaatttcttagatgaaagtattgtgtgcattggacacctactgaacttcctgtaaactgtagagttccgggtggttttaattttgcccttttttttgaaggggctctatccctattccctttattggatacctggcctgcttgcttttgggctctccacattcccgttgacgcctttaacccatgatttgggggggttgttccctctccgcctccttcctttcttttttctttttccttcttcccagctcctgccccctctctctcctcctcactcccattttaataaagggcggcccttttcttggttctttctttcccccgtcgcggtccacttcaattttttttaattgctccccatcacattgtgggcctcctccaaaacttt

SEQ ID NO: 8565 - DNA, 772 bp, Zea mays
  Predicted polypeptide sequence is orthologous to G852, G2633
actacaactcagtatctatcaccataggcttcctatagatagttccagtgaccagccaaacatatctaaaccactaagaggtacttcgaaggttacaagaaacattctccatcaggtcaacattctctgaagtcaacactagtgccatgccgatgagacgatcaggggcctgttcttccagccgaggtagagcacgccgtccctctcggcgagcttgtagtccggcgagtagctctgcagcagcgtcttgatggtggcgttcaccagcgcgctgagcggggacgggctgaacccggccatcatcagccgcgccttccacttgccgaacacctcgtgccgctccacccgctcctcgccctcgcaggccaccaggttcacgatctcccgggccaggcagtgctgctcgatgttgatccgctccctgtcgtccctcggcagcgccaggtcgatggactcgaagatggccgtgcagtagtccagcgtctctgcgaaccgctgcgcgaagggggccgtgttggtgttggactcctgctccaccagcgtgagcaccttgggcgacaggcccttcaccagcctcaggatccggtcccggtggttcgccgtgctcacggtctcgtcggggatgtggtgcagctcaagggtgaagttgacggcgacggcttcgcctgggacgacgcccagatgctcctcctccacctcactgcctgagatagcgactgcgtcgaactgaaagggcaccttgtagagggcagcaatatgtgtcaacctcctg

SEQ ID NO: 8566 - DNA, 922 bp, Zea mays
  Predicted polypeptide sequence is orthologous to G852, G2633
ggacacaaacgctagagagagagagagagaggtggtggccggtgggacgtccgtggtggtggtggagttagatcggctgtgcttgttcctcgctcctcgctggttcagaggaggtcatgatcaactaatgcctattcatttattatggacttgcaccagttgttaaagtacagattaactggtgctaacgtctactacgaatttcctacagagaacaacttagcaaacactccttggccagctagtccactgaagtctgagttcagcagctcatcatacactcctctttcatcccagcttgagtgtgataatttgtctgcactcagcaatactccagataaccagagctccacagaaaccatttcagcacaatcaatatcaccactggaagtagacagctcatacaaacaggcagctatccttcgggagaacacccaagtgagacctgatccattgtacacaacatcaaggcataatatgcaacacgctttacgagaaatagagactgttctgatggcacctgatgctgatgatgcagctactagcaccaagcatgaatttgaggaacataaacctgctcagctgatgaggcagcggtcaaggacatggagtcatgaatctaggcagccatcaccaggagttgtacggacacaacttgcatctggataccccacagcaagctatgagttccgcccagagaaacggctaagggagttaagggaggatccgcagagcatggtgaagcagctattaaccaagtgtgctgaagcattaagtgaggagaggatagaggagttccttaaccttgttcagcaagctcgtggagttgtatcaattactggggagccaatccagcggttaggtgcttacctccttgagggtttggttgctagacatgcaaactcaggtacaaacatatatc

SEQ ID NO: 8567 - DNA, 781 bp, Zea mays
  Predicted polypeptide sequence is orthologous to G852, G2633
ggtagtgactgccatcacaattcacaacatcaggttattaggttataggtgttgtacaactcagtaccaccacaggcttcctatatatagttttagtgctcagccaagcatatctatactaacaacgaggtagaaagtcacaagaaacattctccacgaggccaacattctccacgaggccaacactagtgccatgccgatgaaacaatgaggggcctgttcttccagccgaagtagagcacgccttccctctcggcgagcttgtagtccggcgagtagctctgcagcagcgtcttgatggtggcgttgaccagcgcgctgagcggggacggcctgaacccggccatcatgaggcgcgccttccacttgccgaacacctcgtgccgctccacccgctcctcgccctcgcaggccaccaggttgacgatctcccgagccaggcagtgctgctcgatgttgatccgctccctgtcgcccctgggcagcgccaggtcgatggactcgaagatggccgcgtaatagtccagcgtctccgcgaaccgctgcgcgaagggggccgtgttggtgttggactcctgctccaccagcgtgagcaccctgggcgacaggcccttgaccagcctcaggacccggtccctgtggttcgccgtgctcacggtctcgtcggggatatggtgcagctctagagtaaagttgacggcgacggcttcgccagggacgacgcccagatgcccctcctccacctcgctgccggagatggcgaccgcgtcgaactgaaagg

SEQ ID NO: 8568 - DNA, 1072 bp, Zea mays
  Predicted polypeptide sequence is orthologous to G861, G1140
cgatggcgagggagaggcgggagataaagaggatagagagcgcggcagcgaggcaggtcacgttctccaagcgccgccgcggcctcttcaagaaggcccaggagctctccgtgctgtgcgatgccgacgtcgcgctcatcgtcttctcctccacggggaagctctcccagttcgccagctccagtatgaatgagataattgacaagtacaacacgcattctaaaaacctggggaaaacagaacagccttcgctggacttgaacttagagcatagcaaatatgcaaatttgaatgagcaacttgcggaagcaagccttcgactcaggcagatgagaggtgaagaacttgagggattgaatgttgaagaactccagcagttggagaagaacctggaatctggtctgcatagggtgcttcaaacaaaggattctcaattcttggaacagatcaatgacctcgagcgtaagagtacgcagctggcagaggagaacatgcaactgagaaatcaagtatcccagatacccccagctggcaagcaagcagttgctgatactgaaaatgttattgctgaagaagggcaatcctctgaatcagtgatgactgcgttgcactctgggagttcacaggataatgatggtggttcggatgtatctctaaagttagggctgccttgcgttgcatggaagtaaacaggaaatgaggctccttgtcgattctgggtgtggatgtgggtgtgggtggagctgcggcctcagcggataggcacttgtgtatggttttatggacgaccggcccccgactacgtactgcaataatcttgcattggaagcgagatcggttaacctgatttgtcatccttgtggcttcatgatgcgatgttccgcttgtaccgtttgctagcatgttaactgaatttttagaatcgcatatacttttgttcttatatatcactgtcgtactgctcgtaagatgtatctactttattctatccaatgttgtaacctatcacctaccaacttccctactgttttggcgcgccgcaagctttgctcaagcatgcttcatgtttgtt

SEQ ID NO: 8569 - DNA, 1036 bp, Zea mays
  Predicted polypeptide sequence is orthologous to G861, G1140
tcgtgggcgtaggacgagagagaggatcggcggcggcgtgtgggagatggcgcgcgagaggcgggagatacggcggatagagagcgcggcggcgcggcaggtgaccttctccaagcgccggcgcgggctgttcaagaaggcggaggagctcgccgtgctgtgcgacgccgacgtcgcgctcgtcgtgttctccgccaccggcaggctctcgcagttcgcgagctccagtgtgaatgacatcgttgacaagtacagtacacattctaagaatctggggaaatcacatcagcagccttctattgatttgaatgtagagcagagcaaatacagcggcttgaacgagcaacttgctgaagaaactaatggacttagacagatgagaggtgaagaccttgagggattgagtgtagaggaattgcaccgaatggaaaggaaacttgaagcaggactgcatagagtgattagtacaaaggaccagctattcatgcaacaaatcggcgaattactgcaaaagggcacacagctagaagatgagaacaggcgtctaaaagaacaaatgcctcaggtgctaacggctggcacaatggtggttgctgctgctgcagaaaatatcctcactgaagacgggcagtcgtctgaatctgtaatgactgcattgcattcaggaagctcgctcgactgtgatgatggttccgatatatccttgaagttgtcgttgccttgaaaggaaggaccatcgcatcgcatgttatctgcatgagtggggctgacaccagtgcttctaagaagacaaagactgggatagtcccattcgcggcattatattggtttaaccagatgtgctgtccttgtgcatgtctgtacttcaaagtggctaacgcgaaatttgtatatataatagtgtatgcgctgcgttatcttcgttctaaaaatctgtattgtttcgttgctggtgctatatttgttggtgtattatatatatgcacttaactgttatctctattctattaagaacataatatagacacatgatgct

SEQ ID NO: 8570 - DNA, 1167 bp, Zea mays
  Predicted polypeptide sequence is orthologous to G861, G1140
cctctcctctccttccgcatcacacaccacgactcccaaccgccggttggctttgctgctccgagctcttcctcttccacacccgccctctctcttgggtcggcggccgagtgtctgcgtcgtccacggagatcagggatcggcggcggggtatggcgagggagcgacgggagataaagaggatagagagcgcggcggcgcggcaggtcacgttctccaagcgccgccgcggcctcttcaagaaggctgaggagctctccgtgctgtgcgatgccgacgtcgcgctcatcgtcttctcctccacgggaaagctctcccagttcgccagctccagtatgaatgagatcattgacaagtacagcacacattctaaaaacctggggaaagcagaacagccttcacttgacttgaacttagaacatagcaaatatgcaaatttgaatgagcaacttgtggaagcaagccttcgactcaggcagatgagaggtgaagaacttgagggattgagtgttgaagaactccagcaattggagaagaatctggaatctggtctgcatagggtgcttcaaacaaaggatcaacaattcttggaacagatcagcgacctcgaacaaaagagtacacaactggcagaggagaacaggcaactgaggaatcaagtatcccacatacccccagttggcaagcaatcagttgctgatactgaaaatgttatcgctgaagatgggcaatcctctgaatcagtcatgactgcgttgcattctgggagttcacaggataatgatgatggttcggatgtctctctaaaattagggctgccttgtgttgcatggaagtgaaaaaacaagatggtctgtgttgatctgggtggagctgcggcttcagcagataggcacttgtgttattgtcttatggacgacccccgactactgcaataatcttgcatcggaagcgagatcagttaacctgatttgtcatccttgtggcttcatgatgcgatgttgcgcttgtaccgtttgctaggatgttaactggactagaatcgtgtctacttttgtactgctcgtgaatcctatctactttgtgctatccaaagttatgacctaccacttgcatcggcatggcgcgccggccgtaagctgtgctcaagcatgcatgcttcgtgtt

SEQ ID NO: 8571 - DNA, 754 bp, Zea mays
  misc_feature (24)..(24): n is a, c, g, or t
  Predicted polypeptide sequence is orthologous to G861, G1140
ttttttataacagaaacaccaccnttcgggttttaccggctcatatattaccagtataaatacaatccgggtactcctacaataccactgctactatctttaataaaaagctgtacaggaggggagtatctgcatgctaactactcagtgaccattagcgcctgctatctaaccgcattttgcttcgttttctgtcggttaaacgcaggaatcagtgtccaaaggcggactaatcaaggttgtcccggttgcagtagcagcaactatgtgaaattgtgagtggaacttcagagagatgggcatgaagttgaagggacatctgagaaataagctctggcctgcatgaaagcggctactcgtctcaggaaaggtttttgctatagcgcctgacttgccatcttttcttggcagatccttgacagtgcttctacatggaagttttgtagttcttcaagaactttaacatctaggcccctgaggtcctcaccctttagtttggacacgatgctttccaattccttgcagcgcattctttcaaaattgtatgcagctcttgcttcttcaaaagtactgaggccatcccagcacccattatccgatgcttgcatttcacttaccagtctaccactatcagtcttggatgagtgaaagccgttttgctttgcttttaaattcaaatacatcctgttgagagttttctttctttatcttcaaaagaagggccccccatgcttgccagttcatttttcaactc

SEQ ID NO: 8572 - DNA, 893 bp, Zea mays
  Predicted polypeptide sequence is orthologous to G861, G1140
caaaagagtactctctccctcctaccacacacagcctccggactgctccggacgcgcgcctcagatctactccaacacctccgcagcggcggcgcccgcgggtggaggagcaggagaggcggcgccatggtcgggaccgggaagagggagcggatagcgatacggaggatcgacaacctggcggccaggcaggtgaccttctccaagaggcggcggggcctgttcaagaaggccgaggagctctccatcctctgcgacgccgaggtcggccttgtcgtcttctccgccaccggcaaactcttccacttcgccagctccagcatgaagcaggtaatcgatcggtacgactctcattccaagactctccagaggtccgaaccgcagtcgtctcaactgcagtcacatatggatgacggcacttgtgcaaggctaaaggaggaacttgctgaaacaagccttaagctcaggcagatgagaggagaggagctccagaggctgagcgtcgaacagctgcaggagctcgagaagaccctcgaatccggcctcggctctgtactcaaaaccaagagccaaaaaatccttgacgagatcagcggtctggaaagaaagagaacgcagctgatcgaggagaactcaaggctgaaggagcaagtgacacggatgtcgaggatggagacgcagcttggcgccgatccagagttcgtgtacgaggaagggcagtcgtctgaatccgtgacgaacacgtcctatccgcgcccgtccaccgacaccgacgactgctccgacacatcgctcaggctcgggctaccactcttcagctccaagtgacggagatttgacatgtccggtagcggagcggtgccgattgcttgcccttctccactctagatagg

SEQ ID NO: 8573 - DNA, 636 bp, Zea mays
  misc_feature (22)..(22): n is a, c, g, or t
  Predicted polypeptide sequence is orthologous to G864
gaatcgaattcgaatagactcncaattttggttcggtctattcagtccaccgaatagactcgaattgtaaagagactagtatatttggttaaaatatatacaatgaataattaattgaaagtaatattactacaacaagtgattataaaaattagcatagatatatatattatcgttaagatgatatcattatttctagctaataagttcataaatcatataataataccatcacatattaagagcttttttatatttcgggttattaggtctattcgggttttaaaggttagaaactgaaccgaacccataacccgaacccgaaaatccgaataacccgaacccgaaaatccgaatagaccgacaatttggtttatttgggttcgattttcggttttaaaatgcccatgcatgtggtcccgctctcgggcccatccgcctccagcgtggctgcccggcgcccaatagaggtagagagtgtgatgaaatgagaagccgccgtggaaagcgatggaaaagtagcgttccagtcaactgtcatgccattactctcttctccctgacaccctccatggccaatgtactcctactcccacctacccacacaaaaaaaaaaaaaaaaaaaaaaaaaaaaaa

SEQ ID NO: 8574 - DNA, 1129 bp, Zea mays
  Predicted polypeptide sequence is orthologous to G866, G883
gcacgagccccaagccaagatccgcgcgaagcaagtcacccggcgaagcaccggctcccatggccgtggacctgatgggctgctacgccccgcgccgcgccaacgaccagctcgccatccaggaggcggcggcggccgggctccgcaacctggagctgctggtgacgtccctgtccacgcaggccgccgcgccgcacagagccgctgatcagccgttcggcgagatcgccggccaggccgtctccaagttccgcaaggtcatctccatcctcgaccgcacggggcacgcccgcttccgccgcgggcccgtcgagccgccgccgccgacgccgccgccgcctcctgtcgtccccggtcctgcccccctggcggccgtcagcgtggcgcagccgccgcagagcctgacgctggacttcacgaagccgaacctggccgtgtcggccgccacgtccgtcacctccacgtccttcttctcgtcggtcacggccggcgagggcagcgtctccaagggccggagcctcatgtcctccgggaagccgccgctgtctggccacaagcggaagccctgcgccggcgcccactccgaggccaccaccaacggcagccggtgccactgctccaagagaaggaagaaccgcgtgaagaggagcatcagagtgccggcgatcagctcgaaggtcgccgacatcccgccggacgagtactcgtggaggaagtacggccagaagcctatcaagggctccccttacccacgtggctactacaagtgcagcactgtgcggggatgcccggcgaggaagcacgtggagcgggccaccgacgacccggccatgctggtggtgacgtacgagggcgagcaccgccacacgccgggcgcggtccaggggccgagccccctggcgaccgcgtcgccggtgcccgtcgccgtctccgccggcaacgggctcgttgtctagtctactaaaagctaggattagcttctcgtcttctttgttttttttttgtttgagctgatgtccgtgtaaaacaaggaagaaggttgtagaaagagggagaggaggacaccggaatttcgatgccgcaaaactcaaacctttgtgtcgtgtcctaaaaaaaaaaaaaaaaaaaa

SEQ ID NO: 8575 - DNA, 878 bp, Zea mays
  Predicted polypeptide sequence is orthologous to G866, G883
cccctgttttttcttcttccgctgttctactccggcgtgttggtcgacggcggcgcagatgacgaccctcgatctgatgggagggtacgggcgggtggacgagcaggtggccatccaggaggccgccacggcggggctgcgcgggatggagcgtctcatcttgcagctctcccaggctggcaccggggagcggtcgttgtccccaccggcggtacaggcgcagcgccagcagcagaagcagctggagcagatccagcagcaggttgactgccgggagctcacggacatgacggtgtccaagttcaagaaggtgatctccaccctgaaccgcacggggcacgcgcggttccggcgtggccccgtggcggcgcggtcgcagtcgcagtcgcagggacctgcctcccccgagcccgcgcaatcggcgccggctcccgccgcgaggcccctgacgctggacttcaccaagtcggtgtccggttacagcagggactccgggttcagcgtgtccggcgcgagctcgtcgttcctgtcgtcggtgacgaccggggacgggagcgtgtcgaacgggcgcgcgggaggctcgtcgttcctcatgttcccaccggcgcccggcgcggccagctgcgcgaagccgccgcccgccggtgcggcgcagaagcgcaagtgccacgaccacgcgcactcggagaacgtcgccggcggcaagtacggggctaacggcgggcgctgccactgctcgaagcgcaggaagcaccgtgtgaagcgcacgatccgcgtgccggcgatcagccccaaagtggcggacatccccgccgacgagtactcgtggcgcaagtacggtcagaaaacccatcaaggggtcgccctacccacgcggc

SEQ ID NO: 8576 - DNA, 920 bp, Zea mays
  Predicted polypeptide sequence is orthologous to G866, G883
cccaattctcctcaatcaaagaaagtccccacgcagagcaagccaagatctgcgccgcggcgaagcaaatcaaagcaaagcaaagcaaagcaccggctggctcccatggccgtggacctgatggggtgctacgccccgcgccgcgccaacgaccagctcgccatccaggaggcggcggcggcggggctccgcagcctggagctcctcgtgtcgtcgctgtccacgcaggccgccgcgccgcacagggccgcggctcaccagctgcagaagccgccttcgcagccgccgatcggcgagatcgccgaccaggccgtctccaggttccgcaaggtcatctccatcctggaccgcaccggccacgcccgcttccggcgcgggcccgtggtcgaggcgccgccaccggtgcctcctccggccgtctccgctcccgctctccccgtggcgcacgtggtggctcccgtcggcgcggcgcagccccagagcctgaccctggacttcacgaagccgaacctggccgtgtcgggcggcgccacgtccgtcacctccacgtccttcttctcctcggtcacggccggcgagggcagcgtgtccaagggccgcagcctggtgtcctccggcaagccgccgctgtccggccacaagcggaagccctgcgccggcgcgcactccgaggccaccaccaacggcagccgctgccactgctccaagagaaggaaaaaccgcgtgaagaggaccatcagagtgccggcgatcagcgccaagatcgcggacatcccgccggacgagtactcgtggaggaagtacggccagaagcccatcaagggctccccctactcacggggctactacaagtgcagcaccgtgcgcgggtgcccggcgaggaagcacgtggagcgcgccaccgacgacccgggcatgct

SEQ ID NO: 8577 - DNA, 535 bp, Zea mays
  Predicted polypeptide sequence is orthologous to G878, G884
gcacgagtggatgatggctatcggtggcgcaagtatggacagaaagtggtaaaagggaatccctacccgagaacccacaagttatggaactataacagccttccatgaatccacccacagttttagcaacaaatcaaatcattcgatacccatgtaaatcccaaacatggacatcagacacatcactgctctatggtgcagctcttagggtctggcacaatgtcacatcaatcctttatatcttttgaaaggtactccataacccattaaagtcctggcgatgttgcagttgctgagaaaaactgacactttctctgatattcactacattcaccttcagttcatttctttggtgttcagttagaacctttcagattcctttttctttgggaccagaaaggatctttcagaaattgataagctttagtatctctgatccaagatatgtaattttagtacctgtgttatcaaacaattttaactttggccatcagtaaaaactacttttcacgaaaaaaaaaaaaaaaaaaaaaaa

SEQ ID NO: 8578 - DNA, 833 bp, Zea mays
  Predicted polypeptide sequence is orthologous to G878, G884
ctctccctctctattgcatcccgcgaccatgtccgcgcgtccgccgcctcaaccgcgaccgcgcctggcgctgccgccgcgctcgacggcggaatcgctcttcacgggcgccggggacaccagccccggcccgctcacgctcgcctcagcgctcttcccctctgacgccgacggcggcggtggccccggaggcgcgtcctcctccgccgccggggccgcgaccttcacgcagctcctcaccggctcccttgcgcctcctcctcctccgcagcagcggcatgacgcggagaggggacgaggcggcggggtcgccagggccgggccggcgctctcggtggcgccgccggcatcggcgtccgctggcgcgtccgtgttcacggtgccgcccggcctcagcccctccggtttgttcgactcccctgggctgctcttctcgcccgccatgggcggttttggaatgtcgcaccagcaggctttggctcaagttacagcccaagcaacccattctccactcagaatgtttgatcaccttgaacagccatctttctccacagctgcaacaatgtctggagctctacagcacatgaattctgcagccagtatggcaggaatttcagatatgacaatggcaacagcaaacaatgagaacacgtcctttcagtctgctgaggcgtctcagaggtatcaagttaatgcccctgttgataagcctgctgatgatggctataactggcggaaatatggtcagaaggtggtaaagggcagtgattgtccaaggagctactacaaatgcactcatccccattgcccggtcaagaaaaggtagagcatgc

SEQ ID NO: 8579 - DNA, 741 bp, Zea mays
  misc_feature (9)..(30): n is a, c, g, or t
  misc_feature (661)..(661): n is a, c, g, or t
  Predicted polypeptide sequence is orthologous to G892
ttttttttnnnnnnnnnnnnnnnnnnnnnngattttattaaacataagctgtcaaaatatgaaccggatgaaacagaaaactagaaggattaataattttcttcttggtctgtccaccagagccaaataggacatctaaagaaaaacagtgagccataacgtccagccaccttttcctccatgagcagctatggaagcaacaggggctcgagcagcagccgaacacgcacacttgtgcttgccatcactatataaaaaaattactctgtcacagaaccaaatccaatagatatgcaatcaggacctaacattaggctataaatttcctgcacatacaatttacagagcgtgagcaacggtatctttcagagatcttaataattctgtgaaaggcaaatatagtaattggaacgcactagtttcaatcaggatcggtaaagacagcagtaatcacacagaaacatgtatttgcataagagggtgtgcattgatgcatatgcatctaaactggcccacaggaagacataacttagaagcggttcttttcaatgttgcatcttatggtgcatcacatagacccgcttccaccgagcaaatgcagttttagaggaagtcttaacagcatcaaatctcggaacatcattgcatcagcatgacgcanaattttatcataggagtggaacacaaaataactgcttgaattgtgtaaagacctaaatatctggctgtttatcatgaatg

SEQ ID NO: 8580 - DNA, 995 bp, Zea mays
  Predicted polypeptide sequence is orthologous to G896
tgctcactgacgaccagaaggacccgttccgggtgcccaccaaggacaacatccggatggcgatgcagtggctggtgcaggggtgcagcagcggcgactccctggtgttccacttctctgggctgggcgcgcaggtcgccgacgcggactgcgacgagcaggacgggtacgacgaggccatctgcccggtggactcgttccagaagggccccatcctggacgacgagatcaacgagaccatcgtccggccgctggtgcccggcgccaagctccacgccgtcgtcgacgcgtgccacagcgattccgtcctcgacctccccttcctctgcaacatgtccaggaccgggaactggcagtgggaggatcaccgtccaccgtcgggcgtctgcaagggcacgagcggcggccaggcggtgcttatcagcggctacagcgacggcaaaagcaagttcagcatgacgccggaggcctgcgcggcggtgggggccatgacccacagcttcatcaaggcggtggaatgcgagccccagggggtcacctacggccgcctgctcacctccatgaaagccatcatgaccaacgccggcggctgcaaccagcagctgcagggcgcctgcgcacccgcccgcaaggtcgtcaacttcagcggcgtgcaggaacctaacctgtcttgctcggagatgttcgacgtctaccgcaagccctttgcgctgtgaacctcctctgcattgccattgcctttgcagactaccacagattcccgtctggactctatatataaattaccgtgacggaataataaaccagacggatttatattatatatgatgatatgtcataatgtgtgccttaattgtcttgcggccaataatgtgtgtccatgtgtcgatcggttaccggccctgagccaagcttatagcctgtggaccgacgactttgttgaccattataaatacaatgttgataatgtttaaaaaaaaaaaaaaaaaaaaaaa

SEQ ID NO: 8581 - DNA, 836 bp, Zea mays
  Predicted polypeptide sequence is orthologous to G896
ggcaagaggcccctcaccctcaggtgatcaggtcgctagctcccggcttaactagtaggcagccatgaatttcggtgggaatggcaacgcgacgatccggtgcaagtactgcagggcgagcctgagcgtgatccccggcgagcgcgccatccagtgcgtgcaatgcaactgcgtgacccgcatccggcgggccgaccgcatcccgctggcgcggccggcgcacgtgccgccggcgttccagcgcgcccggggcaagaagcgcgccgtcctggtcggcatcacgtacgccggcgcgcgccggggctgcggcgacctgaggggccccgtcaacgacgtcaagtgcatgaggaacctcctctgccagcgcttcggcttccccggcgagtgcatcatcatgctcactgacgaccagagggacccgttcaggctgcccacgaaggagaacatccggatggcgatgcactggctggtgcagggctgcagctacggcgactccctggtgttccacttctcgggcatcggcgcgcaggtggcggacgacgacggcgacgaggcggacgggtacgacgaggccatctgcccgctggacgcgttccagagcgggcccatcctggacgacgagatcaacgaggtcatcgtgcgcccgctggtgcacggcgccaggctgcacgccgtggtggacgcctgctacagcgccacggtcctggacctcccctaccagtgccgcatgtccaggaacgggttctggcagtgggaggacgagagcccgccgtcgggcgcctggaagggcaccagcggaggccacgccgtgctcatcagcggatacagcgagggca

SEQ ID NO: 8582 - DNA, 881 bp, Zea mays
  Predicted polypeptide sequence is orthologous to G896
caacgtcaaacgaccgcaccaaccaatccacttcgccggcgatccgtctcatctcgtcgcgtctccggcgccggcagacacgggtaacgcggctccgagatcggcgggcaggatgatgatgctgatcgattgctcggggtgccgtaccccgttgcagctgccgcacggggcgccctgcatccgatgcgccatctgtggggccgtcacgcacatcgcccccgcccctcccgccgagcccaaccgcggcgccgtacaaccggcgccggggtgggcgccgccgccgccgccggtgcacggacggaagcgcgccgtggtgtgcgggatttcgtatcggtactcgcggcatgagctgaagggctgcatcaacgacgccaagtgcatgcgccacctgctcatgacgcgcttcaacttccccgacgactccatcatcatgctcaacgaagaacaaacggacccctacaaaatcccaacaaagcataacataaggatggccatgtattggcttgtgcaaggttgtcaacctggagattcattggtgttccattattctgggcatggatcacaacaaagaaattacagtggagatgaggttgatgggttcgatgaaaccctctgcccgttggattttgagacacaagggatgattttggatgatgagataaatacagcattagttcgaccacttcctcatggagttaaacttcatgcactcattgatgcttgtcatagtgggactgcacttgatttgccttatctctgcagaatgaacaggagtgggcaatatgtatgggaagatcaccgaccgcgatctggtgtctggaaaggcactagtggtggggaagctatttcctttagtggttgtgatgatgatcagacctctg

SEQ ID NO: 8583 - DNA, 465 bp, Zea mays
  Predicted polypeptide sequence is orthologous to G905
ttttttttttttttacttcttttttttttttttttggcccctcctgaattttcgtcctgcgtccgccactgtatacgaaacatttagctgccgtgtatactcaatcctatagaaacatttaactgcttatttagctgtcataatatcgactgtcagacaccaagccaatccgctgctaattaagcccgctggttgattatgcggttggcaagtggcagagcagatttaagaccactccggcggcccggtcgccgtcgctaacgtgtccgcgccgttccggcaccaccgggatgggctgcgaccgcggcctggccaccgaaaaggtaaaagtggcctccgagacggtcctcaccaaacgcgaacgcgcgtgagacggctggcgagccggcccagcccgagcagcccggcccggccccgggggcttggcaggaggtcggagcggcacagcgggcacgtcgtccggcc

SEQ ID NO: 8584 - DNA, 1085 bp, Zea mays
  Predicted polypeptide sequence is orthologous to G912, G2107, G2513
gctcaagctcgagacaagaaaccagaaccagctcactcctcactccacttccactcccaacagcaagctcaagcagtcagtcaccggcaggggtcagggtcacagtcacagcagcagccatggacacggccggcctcgtccagcacgcgacctcctcgtcttccacctccacctcggcgtcgtcgtcctcgtccgagcagcagagccgcaaggcggcgtggccgccgtcgaccgcttcctcaccacagcagccgcccaagaagcgccccgcggggcgcacaaagttccgggagacgcggcacccggtgttccgcggcgtgcggcggcggggcgccgcgggccggtgggtgtgcgaggtgcgcgtcccggggaggcgcggcgcgcggctgtggctcggcacctacctcgccgccgaggcggcggcgcgcgcgcacgacgccgcgatactcgccctgcagggccgcggcgcggggcgcctcaacttcccggactccgcgcggctgctcgccgtgccgcccccgtccgcgctcccgggcctggacgacgcccgccgcgcggcgctcgaggccgtcgcggagttccagcgccgctctgggtccgggtccggggccgccgacgaagcgacctcgggcgcgtctcctccctcctcgtcgccgtcgctgccggacgtttctgcggctggctcgccggcggcggcgcttgagcacgtgcctgtgaaggccgacgaagcagtggcgttggacttggacggcgacgtgttcgggcccgactggttcggggacatgggcctggagttggatgcgtactacgccagcctcgcggaagggttgctcgtggagccgccgccgccgccggcggcctgggatcatggagactgctgtgactccggagctgcggacgtcgcgctctggagctactactagcaaagttaacaataataagcttgacagccaaccccaaaagccccccaactgattgtattcacctctgtaacaaaattcaaattgatttcccagcaaatgaacttcaaaagaagtctttggttccgatttaaaaaaaaaaaaaaaaaaaaaaaaaaaaaaaaa

SEQ ID NO: 8585 - DNA, 700 bp, Zea mays
  Predicted polypeptide sequence is orthologous to G912, G2107, G2513
agtactaatgccttcattgttggtctttttattattctcccagcacccaaaaagggagggaaatagcgctcgcccttgcgtggcgcgttccccgcgtgtgccagtgccagtacagagtttctgaattcaaattcgaactcgctcccggcacccccactttcttcccagtccagtagtagctccatagcgtggtctctcctctcccaacctcctgcgctggagacagactctacagctcagtagctccagagcgtcatgtcgctggcgccgtcgtcgtcgtcgccgtccacgatgctatgccatccgccggcgccggcgccgctttgccagcagtcgctgctcccgctcaccatcccgtcgtcgtagcaatacgagtggtcgaactccatgccgccgccgtacatcgccgccgcggcggcggcggcggcggcgacgtcgtccgcctgcgagggcgcgaccacgtcagcggcaacggcggcagtctcatcctgctgcgaggcggcgtcggcgagctggatggcggcgcggcggatgtcgtcgggggtggcgagcgtggcggggtcgacctggagcaggcgcgccgagtcggcgaagttgaggcacgcggcgcggccccgcagggccagcgcggccacgtcgtgcgcgcgcgcggcggcctcgggggtggcgaaggtgccgagccagatgcgcgacttcttgt

SEQ ID NO: 8586 - DNA, 594 bp, Zea mays
  Predicted polypeptide sequence is orthologous to G921
tttttttttttttttttttttggatgataatggcgtacgtgctagagctagcttgaataattgacagcttcaatggcactggccaacagagcagggtgaaataaaaatgtctgtatcaattaatcgtcgtgttcgtctattattaggctataatccctggtcaaggatccggccggagagcgcgctgactttctccgccttgaacccgggatcccgcgtgagcgtgaccgccatgtgctccgcgaggttcttcctcgcgacctccgacgacggcccggcctcttgcttctgcagcggcagtggcgccggcggtcgcgcggcctcgcccgccggcggcgcggacgacctcttggcgccgccgtcgtgctgcggcgggcgggcgtggttgtgctcgccctcgtacgtggccaccaggacggcgctgtcgtccgcgctgcgctgcaccttcttcttcaccgggcacgacggcgcgagcgagcaccggaagtaggcgcgcgggcacgggttgtccttggtcaccttctgcccgtacttgcgccactggtacccgtccttcaccacctgtttcgtcgaacgcgagcgggacgacgaatt

SEQ ID NO: 8587 - DNA, 818 bp, Zea mays
  Predicted polypeptide sequence is orthologous to G921
tccgagagtcctgcagagcccatcctgttcctgtccccctcgagcaatcgagctctacagctgcacgctcgcttacgcggagacacagacgctgagacacacgcaggtcatgatgctgctcatggactcggggagccgcggtgactgctccccggtctgcttggacctcagcgtcggcctttcgccgccgtcgccggggagcggcccggaaacgacagctgacgctgagagactcgaccgtcccgccactggctgctgggggccacggacatcgtccctcgctgacgggaaggacgaggccaagaccctggaggccaggctcacccaggtcagcgaggagaaccggcgtctcaccgagatcatcgcctacatgtacgccagccaggtcgccgcgcggcggagtcccgacggcaggaagaggagcagggacagcctggagccgtcgaattcgggcgacgccaacgctgccgtcgagagcgccgccctcagcgacgagggcacgtgcaggcggatcaagctcaccagggtctgcaccaagatcgacccctccgacaccacgctcaccgtcaaagacggctaccagtggcgcaagtacggccagaaggtgacgcgcgacaacccgtccccgagagcctacttccgctgcgcatacgcaccatcctgccccgtcaagaagaaggtgcagaggagcgcggaggacagcgccatgctggtggccacgtacgagggcgagcacaaccactcgagcccgacgcgcgccggcgagctccccagctccacctccatcaactccctccgcccggccatcacgctggacc

SEQ ID NO: 8588 - DNA, 889 bp, Zea mays
  Predicted polypeptide sequence is orthologous to G921
cgtctctactcctcttcctcctctctctactctccaagttctcttctccgtcgaccgctctacacgtctcttgtcgacctggacaccgaggtggaagaaggaagcagtcagcagatggatccatggatcagcagccagccttctctgagccttgacctgcgcgtcggcctgccgccgctcagcctccaccaccaggcgccggtggccgtcgccttgcccaggcccaagctgctcgtcgaggagaacttcctcctgccgcctccaaagaaagaaccagaggtcgcggctctcgagacggagctgcagcggatgggcgaggagaaccggcgcctggcggaggcgctggccgaggtggcctccaagtacgaggcgctgcgggggcagtacacggagatggtggccgcggcggccacggcctgcgggaaccacccgtcgtccacgtcggagggcgggtccgtgtcgccgtcgcggaagcgcaagagcgagagcacggacaccgcgccgcccgcgcagcagctactgcaccagcactacccggcggtggcgccggaccagacggagtgcacctcgggcgagccgtgcaagcgcatccgggaggcggagtgcaagcccagggtgtcgaagctgcacgtgcacgccgacccggccgacctcagcctggtggtcaaggacgggtaccagtggcgcaagtacgggcagaaggttaccaaggacaacccctgcccgcgggcctacttccgctgctccttcgccccggcctgcccagtcaagaagaaagtgcagcgcagcgccgacgaccccaccatcctggtcgccacgtacgagggcgaccacaaccacggccagcccccgccacaggcgcaggcgccgcacgacggctccagccctg

SEQ ID NO: 8589 - DNA, 820 bp, Zea mays
  Predicted polypeptide sequence is orthologous to G921
gggtttttagtcgagatggtaaataatgtatgacgcgcgtgtggaccaagagtcatggcttgctgtacttgtggtttctgagctgcaacactcaatcgactactaaactaaggtaataactaggttagtgcccgtgcgttgcaacggaaacatataatatcatgataatttaaagagaacccagagaacaatcctgattgtactattgtatatattggcaaccttggacatgaggtagaaccaaattactgcataaccatgttcatcgttccaatttgttctagctctccgtggagcacattgtcccttcgtatcggaggacggagaaccggctgattctcagagaacgccggtggggcagaggaaaaaggacggagggagaactcacctcgacgaaaaccaatgtgacgagggcggacgcgaggtgacggtggagtagatgaacagtcagggtgcgagcacgcctcatttacaaatctctcattaccgatttgggatcctacaggcctcaaattctctcccggcaggtagattcccgtactttggtatttttgtttgatagatacatgccagctgcatgctggcgctatatgacaaccatacaatgtttctggtatcaacctgttagtgttttaggcaacgacaaaagcaacggtgctagcgttcataaatattcttcagtacatggctcttctccaattcttaactctttgatcccaagcctaaacccaacaataacggtttgcgtccctatcaacagttcgtgcaaaattttggatccaatgcccacatgtcatcggttctactcttaatgagacat

SEQ ID NO: 8590 - DNA, 820 bp, Zea mays
  Predicted polypeptide sequence is orthologous to G922
gacatcggcttagcccttgccgcacatgcgtccactcctgcctcgtcgcttctgcgctccatgacaaggtcacccacctcggaacgtatgaactcgagacccctgcaggcttgccaacacgtttgtcgccacgccaaggtccagtgtccaagcccagcaatggcgtgcggtgccttcatatccagcgcagcagcagcgacggtccattaattgaccacaagcccccgcccgtccgaagcaaccgacatggacatgttccaggaggacacgctgtcgtcggccacgtcgtctccggcgtcgtcgctgtgcacgccgtcgccgcacccgcacgggtcgtcgtgggtgcaggagctgagccacgaccagcagggcctgcgcctcatcagcctgctgtaccagtgcgcggcggaggtggcggcgggcgccttcgaccgcgccaacttctaccttgagcagatcacgcagctggcgtcgctggacgcgccgcacacgctgcagcgcctcgccgccgtcttcgccgacgcgctggcgcggaagctgctcaacctggtgccaggcctgtcgcgggcgctgctgcccacggggccgggcagccccgcggaggcgcacctggtgcccgccgcgcggcgccacctcttcgacgtgctgcccttcatgaagctggcctacctcaccaccaaccacgccgtcctggaggccatggagggggagaggttcgtgcacgtcgtcgacctctccggccccgccgccaacccggtgcagtggatcgcgctgttccacgccttccgcagccgccgcggggggcccccgcacctccgcg

SEQ ID NO: 8591 - DNA, 852 bp, Zea mays
  Predicted polypeptide sequence is orthologous to G922
tgcgatctcagctagtattatttggctacgccgccggcctccaggcggagacggagtagagcggcttgcggtgccagcagaagaagaaggccttcccgctggcgtcgtgcgccacctggtacgcggagtcgtccccgccgccgccccacccgcagctctgcagcagcttccgcgcctccatcatgccgtcgtagctaagcccgacgcgctccatcccggcggcctccatccggcgcgcccaccgcgccagccgctcgtgccgctccttgcgctccgcgccctcccgcgccaccacgccgcggatctcctccccgagcaccagccgctcggcgcgcgcccgctcccccgcgcaccggtgcgcctgcgccgccgacgcgcgctccaggcagtcgaacagcgacgcgtagtagttgagcgcctcctcgaaccgctccatgaacgtgggcgcgttgtggttcgcctccggctccgccaccaccatgatcttgggcgacagcgcccgcaccgcgcgcaggaagctccccagcttcggcgccttttccctctgctgctgctgcccaggcaccggcgacgactgcggcgagatagagagcaccggcgagtagtccgggctcagctgcagccgcgtgttgagctcccgctccagcagctcgccgaagctgctggggctggagcgcgcgatgatctgcaccggggtgaggcagctgctgcccgggacgtgcacgtgcctgctgctcctgccgccgccggcgtcgtcggccgccaggaggcggtgcagctgccccaccacgctgacggccagcgcctcgccggagcgcacgcggaggaagtgccgcagcgcgtccgcgtccc

SEQ ID NO: 8592 - DNA, 765 bp, Zea mays
  Predicted polypeptide sequence is orthologous to G922
gatccaaacaagcatgagattccatccatccaaattggagagcggcaggggtacactatgaacaaacctgattgaaatctaactagatacggcgtaaactgaacacacaaaacgaccaaaagaagccccaacgtgcgtgacggccacctgacgcgcaacgccacgacgggcggcccgtctcctcctccgcacaaatacgggaaggcgtcgacgcgttcctccatcagtcgaagcgacggccgcgccaggcggagacggagaagatggcgcgctcctgccagcagaggaagaaggcgcccttctcctcccgcaccttgaacccgtcgcagcccagcccctgcgccgcccgccgggcctgcagcagcgcgtagtagctgagcgggacgcgggcgaagccggcgccctccatccgcgccgcccagcggtccaggcgctcgtgccgctcccgccggtccgcgccgtcgcaggccacgatgttcttcacctcctccccgaggagccagcgctcgacgcgcgcgcgctccaccgacccgcggggcgccgccgactccaggcagtcgaacagcgccgcgtagtagttgagcgcctccacgaaccgctccgtcagcggcgccgcgttgtgcgacgcctcctgctccgtcaccaccacccccttgggcgacaggccccacagcgcgcccaggaacgcgtccgcgcgcgacgtggacggggacaccccggactccgggctccccctgcctcttgtggtcccccctgccctggggg

SEQ ID NO: 8593 - DNA, 592 bp, Zea mays
  Predicted polypeptide sequence is orthologous to G922
cttcttggctacccgcaggccgcaggcggtgtctctaaagaggaaggaaaaacctcaccgccgccacgacttcctcctcgggccataccatttcggcggtcgtataaatccacaccaccccgagcacacaaaagctctagagttttgcgtgtttcacagaccacccaaactaaagcagcgggggtcgcgtcgccgccgcgtactcgcgtgcgtgccaagaaaaaaaaccaccagccagcccaggccccaggccaacacgcacgccgtcgctacgtggagaggagggctgcctgcctgatggtccaggaagagggctcgtcgtcgtcggtcacatcgtccccgctgcacaatttctccaccatgccgctccacgcgtcgcccgggggcgcgccggcccagacgccgccgtgggtggtgcgcgagctccgctccgaagagcgcggggtgtgtctcatccacctcctcctcaactgcgccgcgggggggggcgcgggccgcctggaccccgccaacgccgcgctggagcacatcgcgtcgctggcgtcccccgacggagacgccatgcagcgcgtgggcgccgccttcgcggagg

SEQ ID NO: 8594 - DNA, 611 bp, Zea mays
  Predicted polypeptide sequence is orthologous to G926, G2632
ttttttttttttttttttccgagggatttatatgatttggtgcagttaatcagagccacatagagctaggtcacaggaaacttaggttgtgtatagcaatcggacacaagctcagttttccacttacaagttacaacacagcagctacacaagtgtgcacgagatggatgggctgcgcatatgctgtgttttggagctacggatccggtctcagatgcacgtgcctgtggacagaaaccgctgctctaggatgccagccagaccgctacctcttcaagcctcgttgtgtcgtcgtagctgtatcaagtcatcaggagggacacggtcactcttcttcgtgtttaggaagcgtccaccgttccctctcgccctcctcgtcatcgcgtgctgatgacggggactcgtgaagatacggctttcttgctttgaccagcgctttctctcaagctcggccttggcacgtgactgccgccgtcttagaatgccgcggtactgcttggcgttcacatagacaggctcctcggacacacatcttgacttccatagggagcaacaacgcctgcgtagtaagggtctgagtactgctatgctgcatgatattgatatgctgc

SEQ ID NO: 8595 - DNA, 872 bp, Zea mays
  Predicted polypeptide sequence is orthologous to G926, G2632
cgacgacctctgcgcagagcgtgctgcgattggccggccttcctgggatcctccccgcgcccgacacccggaaacgcgcgcgcgcgcgagggagagacagagtgaggaaacgagggaaggagacgacgcgctcgcctattggccgccggctccgctccttcgcgcccagtgcgacggccacggcctgagcggcgctgccagcaaggcggctagtatgagcagcatggagtcgcggccgggccgaacgaacctggtggagcccatagggcacggcgccgcgctgccgtccggcggccaggcagtgcagccgtggtggacgagctccggggctgtgctcggtgcagtctcgccagccgtcgtggcggtggcgcccgggagcgggacggggattagcctgtcgagcagcccggcaggtggtagtggtggtggcggcgcggctaaaggagccgcgagtgacgagagcagcgaggattcacggagatctggggaaccaaaagatggaagcgctagtcaagaaaagaaccatgccacatcgcagatacccgctctggcgccagagtatttggcaccatactcgcagctggaactgaaccaatcaattgcttctgcagcatatcagtacccagatccttactatgcaggcatggttgctccctatggaagtcatgctgtggctcattttcagctacctggactaactcaatctcgaatgccattacctcttgaagtatccgaggagcctgtttatgtaaatgccaagcagtaccatggtatcttaagacgacggcagtcccgtgctaaggctgaacttgagaaaaaggtggtcaaagccagaaagccatactttcacgagtctcgtcatcagcacgcga

SEQ ID NO: 8596 - DNA, 922 bp, Zea mays
  Predicted polypeptide sequence is orthologous to G927, G1334
cgccttcttcatatcatatcctccctcctgctctgctctgctcgggctctttgccaccccggccgaatcttgagttcctgacgcagggtagggagccccgtgttcctcgattgcttccaccccgtgctgctgcctggattccgagcggctggtgcctggtggttcggttaggtgcttccctcgtcaacgtcagacgcccccacttccgccagcaacaacaccagcagcagcacgatgatgagcttcaggagcagcagccacgagggcttcggcttcggccacgccgccgccgcggccagcggagcgccgctgccgtggtgggcagggccggccccgatgctgagcggcgagccgctggccctgtcgccggaggcccactgccgggacggccgcatccaggccccccagggacctcccgtgccgtcggtcaaggctcctgtactggcaccccagcagccgcctccgctgccggagagggggatccctgagctcctcaacctctccgtggatcctcaaggtaaagggaagaaaggatctgatcactctgccactattgctttgcaatcaccatttgcaatatacaatgctcattttgagctgggccttggtcaatcaatgatttccgctgataattcttatgctgatcaacactatggcctgctttctccttatccagtgggtgcaacgcctggaggtcgtctgcttataccactgaataggccaacagaagcaccaatttatgtgaacgctaagcaatatgacgccatcatgcgtcggcgctgtgcccgtgccaaagcagagagggaaaataggctggtcaaaggcagggagccatatctccatgagtcacgccatcagcatgcactgcgtcgcccgcgaggctctggcggacgcttcttgaacacaaaaaaagaatccagcg

SEQ ID NO: 8597 - DNA, 925 bp, Zea mays
  misc_feature (808)..(808): n is a, c, g, or t
  Predicted polypeptide sequence is orthologous to G927, G1334
cccatgctgatctcggcgcgcttctcttcctcctcccccagagccgggcactgatttcccttggctgctgctgctggattctttggtgttccatcaggccaaggatcccgcaaagagctccggagccaagcctgctgcagccgtcgcgtcgggtgaggcaggcttcagcttcagtctcctactcgacgaggcaagcggatcggagcgggcctccgctccgccatgatgagcttcaagggccacgaggggtttggccaggtggccgccgccggtgccgggagccaggctgcctcccatggtggagcaggcccgctgccatggtgggcggggccccagctgctgttcggcgagccggcgcccccgtcaccggaggagacgcgccgggacgcccagttccaggtcgtgccgggggttcagggcacgccggatccagcgccgcccaagacagggacacctgaggtcctcaaattctctgtctttcaagggaatttggagtcgggtggtaaaggagagaaaaccccaaagaactctaccactattgctcttcagtcaccgttcccagaatacaatggccgtttcgagattggtcttggtcaatctatgctggccccttccaattatccttgtgctgaccagtgctatggcatgcttgcggcttatggaatgagatcgatgtctggtgggagaatgctgttgccactaaatgcgacagctgatgcacccatctatgtgaatccgaagcagtacgaaggcatcctccgccgtcgccgtgctcgcgccaaggcggagagcgagaacaggctcgccnaaggcagaaagccctatctccacgagtcgcgccacctccacgcgatgcgtcgggtaagaggcaccggcgggcgcttcgtcaacacgaagaaagaagggcgtggcacgggcgttgctt

SEQ ID NO: 8598 - DNA, 1528 bp, Zea mays
  misc_feature (79)..(102): n is a, c, g, or t
  misc_feature (120)..(121): n is a, c, g, or t
  misc_feature (477)..(481): n is a, c, g, or t
  misc_feature (861)..(863): n is a, c, g, or t
  misc_feature (1511)..(1527): n is a, c, g, or t
  Predicted polypeptide sequence is orthologous to G928, G931
gcacgagctcacttgcttcgacgtatttctctctctatctatacggttcaagggaccgaagaaggtagagagagaaacnnnnnnnnnnnnnnnnnnnnnnnnaggttacaggttcatttnnaggtgccagttcatctgatttctcagaagcaaaatgttgtttggagctcagtgacaccatcttgtaatgcctgtgccttttacgggaaatggaggatcattctgtccatcccatgtctaagtctaaccatggctccttgtcaggaaatggttatgagatgaaacatccaggccatgaagtttgcgatagggattcatcatcggagtctgatcggtctcaccaagaagcatcagcagcgagtgaaagcagtccagatgaacacacatcaactcaatcagacaatgatgaagatcatgggaaggataatcaggacacattgaagccagtattgtccttggggaaggaaggctctgccnnnnnggccccaaaattacattacagcccatcttttgcttgtattccttatactgctgacgcttactatggtgccgttggggtcttgacaggatatcctccacatgccattgtccatccccagcaaaatgatacaacgaacactccgggtatgttacctgtggaacctgcagaagaaccaatatatgttaatgcaaaacaataccatgcaatccttaggaggaggcaaacacgtgctaaattggaggcccagaacaagatggtgaaaggtcggaagccataccttcatgagtcccgacatcgtcatgccatgaaacgggcccgtggctcaggagggcggttcctcaacacaaagcagctccaggaccaaaaccagcagtttcagnnngcgtcgagtggttcaatgtgctcaaagatcattggcaacagcataatctcccaaagtggccccacctgcacgccctcttctggcactgcaggtgcttcaacagccagccaggaccgcagctgcttgccctcagttggcttccgccccacaaccaacttcagtgaccaaggtcgaggaggcttgaagctggccgtgatcggcatgcagcagcgtgtttccaccataaggtgaagagaagtgggcacaacaccattcccaggcgcactgcctgtggcaactcatccttggctcttgaaactttgaatatgcaatcgacatgtagcttgagatcctcagaataaaccaaaccttcagttatatgcaagccccttttgaggttgctgttgctgtacctgagaactgtggttaggttatgagtttgttcctgaagactgacccatacatgacatgctaccttgtgctgagtttctgagacaaagccatcgaaacatgatcttgtggttcagtacttgctgccttcagtgtctgataagctagctctccagtttgcagtttctctgaattccagcatgtctagtctctgcttatcttttgcatgtaacgtgatggtgacttagcatacacatctattcatccatctatgttctnnnnnnnnnnnnnnnnng

SEQ ID NO: 8599 - DNA, 1367 bp, Zea mays
  misc_feature (783)..(783): n is a, c, g, or t
  Predicted polypeptide sequence is orthologous to G928, G931
gcacccgttataatctatacggttcaagggaccgaagaaggtagcttgagaaacttgaaggggagaggaaggagatacaggttcatgttcatttaggtgtcagttcatctgatttctcagaagcaaaatgttgtttggagctcagtgacaccatcttgtaatgcatgtgccttttacgggaaatggaggatcattctgtccatcccaagtctaagtctaaccatggctccttgtcaggaaatggttatgagatgaaaaatccaggccatgaagtttgtgatagggattcatcatcagagtctgatcgatctcacccagaagcatcagcagtgagtgaaagcagtctagatgaacacacatcaactcaatcagacaatgatgaagatcatgggaaggataatcaggacacattgaagccagtattgtccttggggaaggaagggtctgcctttttggccccaaaaatagattacaacccatcttttgcttatattccttatactgctgatgcttactatggtggcgttggggtcttgacaggatatgctccacataccattgtccatccccagcaaaatgatacaacaaatagtccggttatgttgcctgcggaacctgcagaagaagaaccaatatatgtcaatgcaaaacaataccatgcaatccttaggaggaggcagacacgtgctaaactggaggcgcagaacaagatggtgaaaggccggaagccataccttcatgagtctcgacaccgtcatgccatgaagcgggcccgtggctcangagggcggttccctcacacaaagcagcagccccaggagcagaaccagcagtaccaggcgtcaagtggttcaatgtgctcaaagaccattggcaacagcgtaatctcccaaagtggccccatttgcacgcccccttttgacgctgcaggtgcttcagcagccagccaggaccgcttctgcttgccctcggtgggcttccgccccacagccaacttcagtgagcaaggtggaggcggctcgaagctggtcgtgaacggcatgcagcagcgtgtttccaccataaggtgaagagaagtgggcacgacaccattcccaggcgcgcactgcctgtggcaactcatccttggcttttgaaactatggatatgcacacggacatgtagattcgagttcctcagaataaccaaacgtgaagaatatgcaaagtccttttgagatttgctgtagctgaaagaactgtggttaggttgagtttcttcctggagactgatccatacatgacatgctacctcgtgctgagtttctgaggtgaagccatcgaaacatgaccgtgtggttcagtaccaaaaaaaaaaaaaaaaaaaat

SEQ ID NO: 8600 - DNA, 882 bp, Zea mays
  misc_feature (7)..(7): n is a, c, g, or t
  misc_feature (785)..(785): n is a, c, g, or t
  Predicted polypeptide sequence is orthologous to G928, G931
gtccggnattaaccgctcgaccccgcgtccggagaatttaaaaagggactggatgacgcgaagaggagacaagaatcaaatgtttttggagattgagtgatgcgatctgatagtgaaaatgcttctgcgagaaatggatggtgatccattccatcccatgcccagctatgatttcctgtctgggaacggttattcattaaagcagttagtgcgcagcaactctgatatagactcttcatcatccaagtctaagcagtcttggcaagacttatctgacagcagcctcagtggacaacacacaccaacgcaatctgataacaacgatatttgtggaaagcgggaccagggcatggtgaagtctgtattgtcctttagtagcccggaagctgcctttccccctcacaaggcttgtgcttcttatagtgctgatccatattatggcggggtgtgggcaggatacgcttcaaatggaattgtccatccccaaattagtggtgcagcaaacactagggtaccattgccagttgggcctgcagcagaggaacccatatttgtcaatgcaaagcaatacaatgctatcctccggaggaggcaaaaacgcgcaaaactggaggctcaaaataaactggtgaaaggtcggaagccatatctccatgaatctcggcatcgtcatgcaatgaagcgagtccgtggaccaggggggcgtttcctcaacaaaaagagctccaggagcagcagctgaaggccctgccttcacttcagactccaacaggtggggtcagcanaatggccttttgcaggaaccctatgccctgaaacagcacatctcactcgccttcgacgagctctacaatctcgagtgctacaaactggagtggcacg

SEQ ID NO: 8601 - DNA, 1239 bp, Zea mays
  misc_feature (6)..(97): n is a, c, g, or t
  misc_feature (101)..(123): n is a, c, g, or t
  misc_feature (967)..(986): n is a, c, g, or t
  misc_feature (1007)..(1011): n is a, c, g, or t
  Predicted polypeptide sequence is orthologous to G929, G2344
gcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgnnnnnnnnnnnnnnnnnnnnnnncgtcggacagtttaagtgtggcttcattgcatgagtagttgcagttagcgtggcttttctccgtgcttgctcctggtcgtgctttgccttgcaaaggaaggaatcatgacatctgttgttcacagtgtttcaggtgaccacagggctgaggatcaaaatcaacagaagaagcaagctgaacctggggaccagcaagaagccccagttactagttcagatagccaaccaacagtaggcacaccatcaacagattatgtggcaccctatgcccctcatgacatgagccatgcaatgggtcaatacgcttatccaaatattgacccatactatggaagcctttatgcagcagcttacggtggacagccattgatgcatccaccgttagttggaatgcatccggctggcttacctttgcctaccgatgcaattgaagagcctgtgtatgtaaatgcaaagcaatacaatgccatattaagacggcgtcaatctcgggctaaagctgaatcagaacgaaagcttatcaaggggcgtaagccctatctccatgagtcacgtcatcagcatgccttgaaaagggccaggggagctggaggtcggtttctcaactcaaagtcagatgacaaggaagagaactccgactcgagtcacaaagagaatcagaacggagttgcgccccacaggagcggccaaccgtcaacccctccgtctcccaacggtgcatcgtcagctaatcagggcaggcagtcgtgaatgatggatgattcaaaactcacagctgaagagatttcagcccctgagctagatatggcagcagttttgtacagaaaacgctagcaacatggtnnnnnnnnnnnnnnnnnnnnttgtaggacatgttccatagnnnnngcatagacgagtctacaggttttggagccttggtttggtcctctgtgtattcacctttctgtacaatcttagtagcgttgtgtaccttcccctggaaggaaggatagcttcagttagcgcttcagaaagtcaagtgtgtagcatattggcttattgtttgctttgcttggacaatggagatttgggagtggagttcataaccctgctgaataaatactcttagctggc

SEQ ID NO: 8602 - DNA, 620 bp, Zea mays
  Predicted polypeptide sequence is orthologous to G937
ttttttttttttttttctggcccctgctgagaaatcaggctgcacacgcggcgcgcgtcgtcggacggcggcgaccagcacgcgggcgggctgtggtcgtcggcgccggagcagcagtacacgacgtcgcagcacagcacgtcgcagtcgcagtcgcagtccgggtcgccgcaggggccgctgcagctggcggtgtcgagcagggccatgtcggccaccgccggggacagctgcgacgccggcgacgaggcccacggcggccggtcggagagctacggctgggagatgccgcagcacgggacgaaggcgtcgtcgtcttgatgatccttgtccttggacgggatcacaattcacaacagtatagaagacggtgcggcgtggggcatggtactgaggacaactgcggaagaggcggcattttttgtacaggcgttgagatgatttcatttttcccccttccttttttttctggtagagggaggaggatgtgatggtgaagatgaactgatctggtgttgttgatcgagagtgaggcatatgagatgagatgttattttttacatcccattgtacaatctggaggctggatcgcgttgttttaacggggatggatcggtttt

SEQ ID NO: 8603 - DNA, 602 bp, Zea mays
  Predicted polypeptide sequence is orthologous to G937
ggtatgtatgtatgttatctatataatatctcattctcagggcgaaaattttgggacctgcccagaaattaaaagtcaggaagccatcagctttccatgtacgtacatgacaaacaaacaatccaacccatgatcagttgagctcttgggcgcacgcactacaacctctctcaagactgatgaatctgttattgccacagacgggcaagcagaagccgcgacgctatctctacactctcatccgtcgaacgcggcctttacacgtatttccggctgtagccttcggacttgtcgtcctcgtcgctgctgctgctatcgccgccgacggtggccgctacaccggatccagagaactgaagcgggccctggggagacccggactgcgagctgctttgctcctgatgaggaggagcccagaggccgcccgccagcatgaccgactggctcaccggagccacgacgccgggggatcttctgttgtgcagccggtacttctgaaatacgaacacgacacgccgatcgaatcagtttccaaaacaagatgctatatcatcgccttcgtctgaaataggcaccggcgcggcgctactagaaggaaataa

SEQ ID NO: 8604 - DNA, 760 bp, Zea mays
  misc_feature (643)..(643): n is a, c, g, or t
  misc_feature (691)..(691): n is a, c, g, or t
  Predicted polypeptide sequence is orthologous to G937
tctaaaacggcgcgtccgacgtcgccgtttccaagttgctcggtggcgcacccatgcccataagggccgttgcggcggtgccatccctgccgccgagcggcagattctgtgccactatgccaccgtctggctctggggccaacttgcactctcaggctcagcagcaagccaggaaggcgaggcggtgctggtcgccggagcttcaccggctctttgttgccgccttgcatcaactcggcggccctcaagttgctactccgaagcagatcagggaggtgatgaaggtggacgggcttacaaacgatgaagtgaaaagccatctccagaagtaccggctgcacaacagaagatcccccggcgtcgtggctccggtgagccagtcggtcatgctggcgggcgggctctgggctcctcgtcaggagcaaagcagctcgcagtccgggtctccccagggcccgcttcagttctctggatccggtgtggcggccaccgtctgtggcgacagcagcagcagcgacgaggacgacgacaagtccgaaggctacagccggaaatgcgtgtaaggccgcgttcgacggatgagagtgtagagatagcgtcgcggcttctgcttgcccgtctgtggcaacaacagattcatcantcttgagagaggttggttgtagtgcgtgcgcccaagcccaaggagctncactgatcatgggttggattgtttgtttgtcatgtacgtacatggaaagctgatggcttcctgactttt

SEQ ID NO: 8605 - DNA, 1619 bp, Zea mays
  Predicted polypeptide sequence is orthologous to G938
ccacgcgtctgcgctacccccgttcttatccccacctcgtgcctcccctcctccccccttcccctctctcgcccctcctccctccgtctcgtctcccaggtcatggcaaaagctggagcaccgggaaaaataacaagtgggagataaacaggaagagctaggtgaatacttggagaaaaaggtcccccacaccccccacgcaggtgaatactacaagtagcagtacaaggaagagagccaatctgcccgtgactgcgagtgaattgctagggtgtggtggttagttgaggtcacgatgatgggaggcgggctgatgatggatcagagcgtggtgttccctggcgtccacaacttcgtggatctcctgcagcagaacggcgacaagaacctgggcttcgcctcactcatgccgcagacgtcctccggcgaccagtgcgtgatgggggagggtgatcttgtggacccaccgccagacagcttcccggacgccgtggaggacgacagcgatgacgacgttgaggacatcgaggagctggagcgccgcatgtggcgcgaccgcatgaagctgaagcggctcagggagctgcagcagagccgcggcaaggatcccatggctagcggtgggggcctggccgacggctcatccaagccaaggcagtcgcaggagcaggcccggcgcaagaagatgtcgcgcgcgcaggacggcatcctcaagtacatgctcaagatgatggaggtgtgccgcgcgcaggggtttgtgtatgggatcattccggagaagggcaagccagtgagtggtgcctccgacaacctccgtgcgtggtggaaggagaaggtccgcttcgaccgcaacggaccggccgccattgccaagtaccaggccgacaacgccgtccctggcgccgagaacgagctcgcctcgggcgctgccagcccccattccttgcaggagctgcaggacactacgctgggctcactgctctcagcgcttatgcagcactgcgagcccccacagcggcgctacccgctcgagaagggcgttcctccaccgtggtggcctaccggcgacgaggagtggtggccggaactcggcattcccaaggaccagggcccacccccgtacaagaagcctcatgaccttaagaaggcctggaaggtgagcgtgctcaccgctgtcatcaagcacatgtcaccggacatagagaagatccgtcgcctggttcgccagtccaagtgcctccaggacaagatgactgccaaggagatctcaacctggctggcggtcgtcaagcaggaagaggagctgtaccagaagctgaacccgggcgcacgcccaccggcgtctactggtggcatcgcaagtgccatatccttcaacaccagctcgagcgagtatgatgtggacatcatcgatgagtgcaagggggacgaggccggtaaccagaggacggcagtcactgacccaaccgcgttcaaccttggtgccgctatcctaagcgacaagttcctcgtgccgacgccgatgaaggaggagaccgccgacgtggagttcatccagaagaggacacccccgctgcagccgagccagagctgatgctaaacaaccgattgtacacctg

SEQ ID NO: 8606 - DNA, 706 bp, Zea mays
  Predicted polypeptide sequence is orthologous to G938
tttttttttttttttagtattttatgagactttttatttagttctaataggttgagcaagatggaagctcccattacgattttgtggttcatggctgggtctggacggcggcatcagccattgcccattatatttgcaggcttatacaaatacttaaatacgagactggagaaaactcacgacgatctcgtcgtctactcgtgaattctaatatccaacctccattgtccattccatccatgattctgccgcatgcgcagtcagtagaaccaactgccgttggatcccgtggacttgtgcggctgctgcaacccgccgcctcccgccacgtccaggcctgagccgaacctcagccccggtgacgcggcggcgatgtcgcctccgaactgcgcgtcgtcgtcacggacgtagaccgccgccgctgcgctctgctgtatcacattgctgatgatgtcgccaaatcggcacggcgtcgggaacggaccgggcagctgcacttcggggccgggggcggccgtgtccacgttgcccacgttggcctcgtacatgtccatcagctccccgagcgacctctggccgtccaggggcaaatccaagtccaagccgccaagcgccgccgtctggccgacgctgttgttgaacatgcacgagtactggtgcgcgttgcgcgtgttgcggtccaggaacccatgcgcgctgctgctgt

SEQ ID NO: 8607 - DNA, 808 bp, Zea mays
  misc_feature (760)..(760): n is a, c, g, or t
  Predicted polypeptide sequence is orthologous to G938
tccaaataaaaaccagccgcagcgggaggtggcgcgacgcgaacccacccaccctgcgaacccggccgcgaaattctcctctcggattccgccgccgcgaaccgtcccctcgacgaggctgctgccgtagaattttcttatcattcgaatagttgatgagcgagaatacagagcaagaatcttgatggtgcgtgtggtacaacttggttaaggaaagctgactgcttgaagtgaccatgttggaccatcttgctatcattgcgtctgagttaggggacgacgcaacggattttgaggttgatggcatcgacaacctcagcgagaacgatgtcagcgacgaggagatcgatgccgacgagctcgcccgacgaatgtggaaggacaaggtcaagctcaagaggatcagggagaggcagcagaagcttgccctgcagcggctggagctggagaagaccaagacaaagaagatttcagaccaagccctccggaagaagatgacgagggcccaggacgggatcctcaagtacatgctcaagctgatggaggtgtgcaatgcccgagggttcgtgtacgggatcattcctgagaaaggtaagcctgtcagtggtgcgtccgataacatcagggcctggtggaaggacaaggtgaagtttgacaagaatgggccagcagcgatcgtgaaatacgagcttgagaactcgatgctgagcaaccctaagggcggcggagccatggaccagcatagcttgatggacctccnagacggcactctgggctcattgctttcagcgctgatgcaacactgcag

SEQ ID NO: 8608 - DNA, 888 bp, Zea mays
  misc_feature (884)..(884): n is a, c, g, or t
  Predicted polypeptide sequence is orthologous to G938
caagcacatgtctcccaattttgataagataaggaatcatgtacggaaatcaaagtgtttgcaggataaaatgactgcaaaagaaagcctgatttggctgggagttctacagagagaagaaagccttgttcacagaatcgacaatggcgtatcggagattactcagcgcagtatgccagaggagaggattgcagacacaaatagcagcagtaatgagtatgatgtgtatggttttgaggatgctcctgtttctacatcatctaaagatgatgaacaagatctgtctccagttgcacaatctgctgtggagcatgttccgaaaagaggaagggaaagagcttacaataaacgccctaatcaaatcgttcctggtaaggcaaaagaaccaccaaagagaaaaagaacacgccacagctccactgttaccgagccagatgcacacagagttgttgatgcaccagaaaactcaagaaatttgatccctgatatgaatagattggatcaagtagaaatcccaggcacgtcaaaccagattgtcacctttgaccatgggggcaccacaactgaagctttacaacacagaggagatgctcaagtacaggtccatcctcctggtgctgaggttaatagcttctatagtgctccaactgcaaaccctactcctataagcatatatatgggtgaccagcctataccttatcaaaataatgacagcacaaggccgagatctgaaaatagttttcctgtagatgctcatactggtttaaataatcttcccagcagttatcagaacttacctcccgaaacatcactacccacttccatgatggatcatcatgtggttcccatgggtatcagggcacctactgatagcattccctacngtga

SEQ ID NO: 8609 - DNA, 678 bp, Zea mays
  misc_feature (183)..(183): n is a, c, g, or t
  misc_feature (674)..(675): n is a, c, g, or t
  misc_feature (677)..(677): n is a, c, g, or t
  Predicted polypeptide sequence is orthologous to G956
tgagtcggaagggaagcttctggcccctaagatactgtactgctttgcccgtggctttgtcgacgacaacagcttccctatctggatctcgcatttcctaccccagcagcaagctacgtttgtcgatcactgcgtgtctcaacggcggcaaagttttttttgcacccggactttcggcggcgntccatttgattctcggtttcgctccctcttcctgccagatgcgggatcgttaaattaactgctatccgagattcagatgcttccctgcctagacaacgtgaatgacagcctaactgccaacagaagtgatgaagtccaaagccctgatagaccgctcaacagtgtaagagctgtctctcgagttaccagcatgtatggaaaagtaagtttatatccagcgaccatgggagtatcaagatttgagatagcagtcactggattgacccgtgacattggaagacagatgcttatctttggaattccttaatcggttcgtccgtctcgacatcttgtcgagtttcattaaaagaaaaaactgtacataactgctactcccagataaaacctttagttcatcatggtgctatatatgcattgaatctgtacatcatggtcctgacatgtgcatcgcattaacggttatcaagaccactacgcatcactcttaaaannant

SEQ ID NO: 8610 - DNA, 521 bp, Zea mays
  Predicted polypeptide sequence is orthologous to G956
gagtaacccttctgttgtgcgcgcggcctccatcccaaaaaattccctgtctgtggcccaaattttttaacaggcccattaaccttgctaacatctatgctccgcaaagtatgcagcacgtatcatgtatggactatataccaagcaaaacaagggacatcccaacgaacagaaaatctgttcatgattggacgtgcagaagatctgttctatgcctaaagctctggttctccagttttaggctctggatcttgtggaggttcgctacggactgcagaaggtccgacatcgtgctctggtagtctggttcatctcaatggccctgaccacgagcaccctgagctcactcaacccaacttgcccagttcatccatgttgaacaggcagtcgtcaagctcgtcgacgtcacattgtaccagcagctgtagatcctctagggacgttagacaccactgcctagatcatgcttctgttgacaaggtcattgaattgaagtacccgtccggccgtcccccccgcgt

SEQ ID NO: 8611 - DNA, 716 bp, Zea mays
  Predicted polypeptide sequence is orthologous to G956
caccgaatctacacttgtattctgggttcgcttgatgtacaaaaagttagctgaatgttacgtacaaagaagaatcctagtcaacggaaaaatttacagaatgtacagcaaaagctaatattttcagctctcgaaaaaagtgtcaacttgtcaagcacccactcctgtggctgtctgcgcatagcaatgcagtcttgtactcttgtttcaattctggcacctggtgttgttggacaagaacaggtaccggaacctcgagtcgaacgggatgacgctgaagctgcgcactccaagaagccgctgcttatgcgacgacaacaacgacgtgtcctggatcgcggcgacttggtctagtgtcagatggcggcagatccagtcggcgagcagggagtcctccacgatgcccttggcgtagctctgcagtagcttggggactacgagctctcccttgtcgtttatgccaactgacgctcggatgtagtctctcatggactcctgaagctcagctcgaacgttttcagcaaagaagatccttaccgcaggagaagagaacatcccacagcagagcgcgaagaggacgcgaggctcagtgccatcgattgaatatctcctgaggttctctgacgttttaaacttgtgaagggccagcatcaaggagagctgtggccggtgcaccggtgtcttcatcttcagaatcacaaactctatttcggctg

SEQ ID NO: 8612 - DNA, 774 bp, Zea mays
  Predicted polypeptide sequence is orthologous to G956
cgccctcctcgccagtcgcctccctgctcctgctgccggcagtggcggtggtgtcgcctctcctcagtcctcactcctcctcaccccagcggaagcgcgggcccgactccgtccgacctcgccgtctcggccccgagggcggggagaagccggcagggtgagcccgacgctacgccacgccgcgccaccatgccgctgccgctggccaaggcgaggagggggtcctccccgcagccgtcaccgcagcccgcgcggtcctcctgcaggtcgcagctggagcaggacgtgaagaggctgcgcaaggcgctgcaggacgagacggcgctgcacgccgtgctcgagggcgccctgggccgcgccgccgtcacgctcgccgacatggcctacctccccaccaacgcgcaggagctgctctcgaccatctgcatcctcgagacggcggtcacgaagctggaggaggagatggtctccctgcatttccagctcacccaggagaggaacgagagacggctcgtcgagtaccgcctcaagcacctgcccccgccgccgtccgcttgctcctgccactccgggaaactcggaccagacgaccccacaggcgaaaaatgcagtagccaaacggaggaggtttaccctcgcgccgtcttgcatgaacaggctgtgaaactgcagaggcagatctctgtcaagagcttcgtcgatcctaaccagctttccgaggacatcgtccgctgcatgaggaacatctttatttcgctgtcagattcctgcagg

SEQ ID NO: 8613 - DNA, 813 bp, Zea mays
  Predicted polypeptide sequence is orthologous to G956
caaattgcaaaggcaactccaagaagagattgatttgcacatggcgttgacagatgccattacatataatgcggcgctgatacttaaggcatctatgaagcttcctgacaaggcacacgagctattgattagcatatcctctctggaaaccgctatcacaaagcttgaagaggatctacatcacctgcactaccagttatgtgatgcgaggaatgaaaggctacttgcagaaaataagccagaatgcttgctacctacagcgtcagattgccaaccttctacagcttgcgattgtacaagggaagagcctgaacaaacattaagatattcgagattcaaagattatcaccaagtggaggacggtttgtcaactgaacctgaagatcaacaagatgacgaaaaagacgccgaagatggagaacatgtatctctaaatatgctgatgcaagaggcatgctctatggaaaatgaaggcaaagaagatcagaagatagatgcattaacatttagtcagcccaatttcaagaaaagcgacatgagtggaaatttgtggaataatccaaaccagctctctgaagagatggtgcgctcgatgaaagatatcttccttcatttatctgcatctcccaagatatcacgagaggagccttttgctaattcatcttcatcagcagaacgtctatctggttcaacattgactactttgtcagattcatctataatcgcctcagtgctgcggagtccttcgattgactggaacaacggcgatggtattattgatgatgttagaaactttgacccgtacaacgttaa

SEQ ID NO: 8614 - DNA, 741 bp, Zea mays
  Predicted polypeptide sequence is orthologous to G956
gcaaacacagcaattcaagcttcctcaaaatttacatcatatacaactgccaatcacatggcccgctatgcaaaagaatgtatgatggtccaaatataccaaactgagctcttattatctattctgattctgaacacggctcaggaagtttgtaagattgctttgcctctggcttctggctctgggagccacagctgtctggcaagaagaggtaccggaacttggagtcgaaggcgagaacggtgaagcttcgagctccgagtagccgctgcttccactgcgaggaagagtcccggatgaccgtggcttgatcaggtgcaaggtggtggcagatccagtctgcgagcagagagtcctcgacagctcccttggcgtagctctgcactagcttcgggatcagcagcttccctttgccatttgtaccgacagtcgcctgaatatagtctctcaaagattcctggagctcctgcctaacatttgcagcggaaaatatgcgtacagcaagagaagagaacattccacagctaagtccgaacaaaagaaggggttcgaattcatcgattgagtacttcttgtgatcctcagtaatcttgaacttattcagagtcaacatcaaagaaagttggggccgatgaactggagtcttcatctttagaatcacaaactctatttctgctgcgctgaaggactggccgccaactgtgtaacaagccttttgcatcagagaaaaaagcttgatgt

SEQ ID NO: 8615 - DNA, 740 bp, Zea mays
  Predicted polypeptide sequence is orthologous to G957, G961, G2535
ctcctagctcttctctttcctcatcatcgtcttcctcccctcacatcctctggcctctggtcctccaccgtcctgctagccagagctgctcttgtacgcgcagctggcctctgtgcatatcaccagcacaccgcgcaggggaaggaaattaacaagagaaaaggcaaggagagcaggcaggcaaggaagctgcagaagccaaggaaggagaaggaggatcatcaatgagcatctcggtgaacgggcagtcgtgcgtgccgccggggttccgcttccaccccacggaggaggagctgctcaactactacctccgcaagaaggtggcctcccaggagatcgacctcgacgtcatccgcgacgtcgacctcaacaagctcgagccatgggacatccaaggtacgtacgtacgcacggccggtccggtccgatccggtaccactgccttcttcaacttcaagttcaagcacgcgcgcgcgcagtagcagagcagctcgtggtcgtggatcagatcggatcggagctggtgcacgaccatgagagcacggacatgaacatgaacagaccttgttgtgaatgcaactgccttagctagctaccaagcaagtactctcgttcgtacagcagcatgtatagcttatgttcgttgatcgacaaaactagctagcaaacaatcaaacgcgatcgaattcatcgcgcgctaactactggctaacaactgctactactactaaagccgctag

SEQ ID NO: 8616 - DNA, 664 bp, Zea mays
  misc_feature (358)..(358): n is a, c, g, or t
  Predicted polypeptide sequence is orthologous to G958
gcacccggttcatttgagctcttgcgcttggattgcttctttttctcattctttcttgcgatcatctcaattgtaatcaaggcaagagacaccaattatgtggtggtccttgtgggggaagtttggttcccggttgattgagaagagaagctcactcggtccgagcgaccgtttgagagagggaaagggttgtaagagacccggtctttgtgaccacctctacgggggggaggtttgagagaaccgaacctcggtaaaacaaatccttgtgtctcacttctttattcgcttgcgatttgtttttacaccctctctcggactcaattatatttctaacgctaacccggcttgtagttgngattaactttgtaaattttagtttcgccctattcacccccctctaggtgactttcaattggtatcggagcccggtgcttcattagagcctaaccgctcgaagtgatgtcgggagatcacgccaagagggagatggagaccggcgacaagccacggtaaaacttcatcggaagagtcccacaacaaggggaaggggaaggaaaagaaatcctcttcccacaaatcgcatcggagtggtgacaaaaagaagttgaggaaggtggtctactacgagaccgacacttcatcaccatcgacctccggctcc

SEQ ID NO: 8617 - DNA, 724 bp, Zea mays
  Predicted polypeptide sequence is orthologous to G958
tttttttttttttttttttgaatcgaatgtcacatctttactatataatccggagttttgtacaaaataaacaaataattacattatatggagacaacggtccagcaacccaaagttgactgggagacgacgacctagaccactcacgaacagcatcctccatgcgcctcatcttgcggttacctgttcttgacctgggacttgagatttcaggtaccaacttgctcttcagatgacacgtgtcctcaccgggacgattcagcatattggtcagtcagagacacatcagcagaacgagtatcagctacaaggttaaatgaaggtgaaggatccaacagttcttccagccatacttccagttctttaccaccgtttggaggtgatgaatcaggagtgataggttcctgaccaacatcattagatagttcatcactgccaactggtgtagcagcacgattagattcttctggacagataactgtggcaaccgcatcttctggctttacagtgctggcaactgatgcagcagcagcatctagttgttccagatgagggtacctgttgcccacctcattatccagttcccagtcacttctcttagtaacacggcagaggacaaaagcatccttcatatcagggctgactttacattcgttctcatctatgtaatactcatgcataatccactcagtgcgtctgccagagggaggccgaccctcatgaa

SEQ ID NO: 8618 - DNA, 965 bp, Zea mays
  Predicted polypeptide sequence is orthologous to G962
ggagtggtayttctacgtgccgagagaccgcaagtacsgcmacggcgaccgccccaaaccgggtaacgccgtccggctactggaaggcaacgggcgccgcccgcacggtctacgtcgaggtcaagcggccgatcgggctcaagaagavgctggtgttctacgtggggaaggcacccaagggactcaggagcrgctggatcatgaacgagtaccgccttccttcaggcgaggccgaccgctaccaaaaggctgcagcaaccatggaaaagaagcaccaccggacatcggcgtcgccccgcatggcgccagtgttcgacggtgacmactcatcaggttacatgaacaagccatacagtggagcaaacaccaccatgctgggcatggcatcwtcagccgcagctcgrgcagcaaaactggcacwacagacgtcaatgttcctatcaaccccctaacttagctccaccacgtcgacggaggaggacggtacatmactctacmacatgaagggtgttaacccaccaatgctgccttcttcaacacacgccctgcttaatgcaaactccgctacaatggcaacaattccaatagatgagctgagtagggcaattggatgccaaggagaccctaaccagaccttgccaamacamgctccattgcttccttttcctaacttggaaaagatttgggattggaatccactcctagamtctcccaaggtttgcacaagcttcaagtgactttcaagtggctcgaagcatatatgtgcatgcttgcatgcgtgcacctattatttatgaatacaagtgtgtatatgtgcagacacataatttttatttgggctagaatgtggttgagatgtaatggaatatataggatgagatagttctagtcctatctaatgctccactatattaatcaattcaccrtcacaaatatgtactatgttgcagtgatcatttgaactt

SEQ ID NO: 8619 - DNA, 669 bp, Zea mays
  Predicted polypeptide sequence is orthologous to G977
cagctccctgtcgcacacaccttacgccgggtaggcaggagcaggactcccactgtcccaccgagccagaggccctccgatccgagcgagcaggggcgccaccgtctccaatggctcggccacagcaacggtaccgcggcgtgcggcaacgccactggggctcctgggtctccgagatccgccaccctctcctgaagacgaggatctggctgggcaccttcgagacggccgaggacgcggcgcgcgcctacgacgaggcggcgcgcatcatgtgcggccctcgcgtgcgcaccaacttccccgaggacgccgccgccgacggacaggggcagccggccgcgacggcgcttctctcccccgcgctcgtcgccaagctccaccgcttcaaccttgcgtccgtgcaggcggcgcgcggcagggccgatgactccgcggcagccgccgcctcggcgcccgccgtgctcgcacgcatcgcgccgatgcctgccagcaatgccagcatgcgaatcgcccccttgacgtcggcggctgtggctgccgggcactggagcggcgactttctcgaggagcagtacgtggaccagatgatcgaggagcttctagactccaacttctctgtggagatcttactagttttcccccgacccctctgctccgtctcatctctct

SEQ ID NO: 8620 - DNA, 1897 bp, Zea mays
  Predicted polypeptide sequence is orthologous to G979, G2106, G2131
gtgaggcgccacgcaacaacaatggcagttggcacagaggcgcaacgcaaaaaccccccaccgccaccgctctataaaaaccccgtcctcctcctcctcctcctcctcccccgcctcgccgccagtcagattcaccaccggctcccctgcacaaccgcgtccgcgctgcaccaccaccgttcatcgaggaggaggggggacggagaccacggacatggagagatctcaacggcagtctcctccgccaccgtcgccgtcctcctcctcgtcctccgtctccgcggacaccgtcctcgtccctcccggaaagaggcggagggcggcgacggccaaggccggcgccgagcctaataagaggatccgcaaggaccccgccgccgccgccgcggggaagaggagctccgtctacaggggagtcaccaggcacaggtggacgggcaggttcgaggcgcatctctgggacaagcactgcctcgccgcgctccacaacaagaagaaaggcaggcaagtctacctgggggcgtatgacagcgaggaggcagctgctcgtgcctatgacctcgcagctctcaagtactggggtcctgagactctgctcaacttccctgtggaggattactccagcgagatgccggagatggaggccgtgtcccgggaggagtacctggcctccctccgccgcaggagcagcggcttctccaggggcgtctccaagtacagaggcgtcgccaggcatcaccacaacgggaggtgggaggcacggattgggcgagtctttgggaacaagtacctctacttgggaacatttgacactcaagaagaggcagccaaggcctatgaccttgcggccattgaataccgtggcgtcaatgctgtaaccaacttcgacatcagctgctacctggaccacccgctgttcctggcacagctccaacaggagccacaggtggtgccggcactcaaccaagaacctcaacctgatcagagcgaaaccggaactacagagcaagagccggagtcaagcgaagccaagacaccggatggcagtgcagaacccgatgagaacgcggtgcctgacgacaccgcggagcccctcaccacagtcgacgacagcatcgaagagggcttgtggagcccttgcatggattacgagctagacaccatgtcgagaccaaactttggcagctcaatcaatctgagcgagtggttcgctgacgcagacttcgactgcaacatcggatgcctgttcgatgggtgttctgcggctgacgaaggaagcaaggatggtgtaggtctggcagatttcagtctgtttgaggcaggtgatgtccagctgaaggatgttctttcggatatggaagaggggatacaacctccagcgatgatcagtgtgtgcaactaattctggaacccgaggaggttttcgctttccaggtgtcctgtcttgggtaatccttgatctgtctaatgccacagtgccactgcaccagagcagctgagaaccttcttgtagaaagcccatggcagtttggcgttagacaagtgtgtcgatgttctttaattctttgaatttgcccctaggctgcttggctaacgttaagggtttgtcattgtctcacttagcctagattcaactaatcacatcctgaatctgaagtggttgtgcttgtgcagtttatcactgagtttacatggcatgatcatggtaacgcagccagtgcagcatagatttgttcgtttgaacagtttaccaaggctgtaaccctagtaagctccagattaaggaacctttgttttcaccattctatatttactagatgaatgcccgtatgttgcaacgggaatatataatattagtatactacaataacttatatacaaaaaaaaaaaaaaaaaa

SEQ ID NO: 8621 - DNA, 1441 bp, Zea mays
  Predicted polypeptide sequence is orthologous to G979, G2106, G2131
gcacgaggctcaattagcacatgcactgaccatggaacaccacctggcattctggcgctgattgtgaaatgggggtcccaggcttcacactgactcggaccaatgtcctctagttgggtgacacggtgcaagatgaggcccacctgtaacgtcagatcaggcatgcatcacctgggcctgtgacacgtcacacacgccacgccagccattgtgctgttgcatgactcatcaccaggcattgtgcttgtgcacctagaaaatgccagctctgaactgcaagcaccacagagtacttacatcatctttgaaaatgaaaccagtgcatcattttcagctcatttcggtctgaaaccagctaaaaaggatgaaacttttgatgttcttgttgcttccatggtctaggcatcaccacaacgggaggtgggaggcacggatcgggcgagttttagggaacaagtacctctacttgggaacattcgacactcaagaagaggcagccaaggcctatgatcttgcggccattgaataccgaggtgccaatgctgtaaccaacttcgacatcagctgctacctggaccacccactgttcctggcgcagctccagcaggagcggccacaggtggtgccagcgctcgaccaagaacctcagcctgatcagagagaacctgaaaccacagcccaagagcctgtgtcaagccaagccaagacaccggcggatgacaatgcagcgcctgatgacatcgcggagcccctcgtcacggtcgacaacagcatcgaggagagcttatgggagcccttgcatggattatgagctagacaccatgtcgagatctaactttggcagctcgatcaacctgaacgagtggttcactgacgcagacttcgacagcgacatgggatgcctgttcgacgggcgctctgcagttgatggaggaagcaagggtggcgtaggtgtggcggatttcagtttgtttgaagcaggtgatggtcagctgaaggatgttctttcggatatggaagaggggatacaacctccaacgataatcagtgtgtgcaattgattctgagacctatgcgtggcgtgcgacaagtgtcctgtctttgggtatacttggtttgtccaatgccacggtgccactgctgcgagtcagctgaacttcttgtagaaagcacatggcagcttggcattagacaagtgtgttggtgttccttaattctttggatatgctttaggcattgactaaccttaagggttcgtcactgtctcgcttagcttagattagactaatcacatccttgaatctgaagtagttgtgcagtatcacagtttcacatggcaattctgccaatgcagcatagatttgttcgtttgaacagctgtaactgtaaccctatagctccagattaaggaacagtttgtttttcatcaaaaaaaaaaaaa

SEQ ID NO: 8622 - DNA, 858 bp, Zea mays
  Predicted polypeptide sequence is orthologous to G979, G2106, G2131
gctctccggtagaggaagggtgggtggacacgacggcggtgtgcttcaactgtcgcaacactggaatgcggttgcacggcgtccaaaatcctccacacgccgtgttccgggcagtcacttttggatggaacgagggggaaaaattagcaattttacctgcagaattttcatataagatatatatacgtagttcctatcggggaaaaagaaaatcattccatgcaaagaaaaattcaaattcctgcgaaagatggcgtgtttttttggtgctgatcagcctgttgcgtttgcgtgtggaccgtgctgtgcgcgccagggacgcaggaggaggcggcgatggcgtacgacatggcggcgatcgagtaccggggcctgaacgccgtcactaacttcgacctcagccgctacatcaagtggctccgcccgggcgccggcgccgcgcagaacccgcacccgatgctggacggcctggcgcagcagctgctgctgtcgccggagggcaccatcgacggcgccgcgttccaccagcagcagcacgaccaccgccagcagggcgccgccgagctcccgctgccgcccagggcgtcgctgggccacacgcccaccacgtcggcgctcggcctgctgctgcagtcgtccaagttcaaggagatgatccagcgggcgtcggcggccgagagcggcaccaccaccgtcaccaccacgtcgtcgtcgtcgtcgcagccgcccacgccgacgccgacgccgtcgccatcgccacctccgacgcccgcagtgcagccggccagggacgcctcgccacagtgcagcttccccgaggacatacagaacttcttcggctgcaaggacgtcgcgggc

SEQ ID NO: 8623 - DNA, 836 bp, Zea mays
  Predicted polypeptide sequence is orthologous to G979, G2106, G2131
cccacctctccctcctcctttcttctgtcgtctctctctccgcacgcgcaatggcgaggcctcgcaagaacagcgccgccgccgccaacaacaacaacagcaacaccaccaacgccggcaacgccgccgtcgacctcgcggcgcgcgtcaagccgaagcgcacgcggaagagcgtgccccgggagtccccctcgcagcgcagctccgtctaccgcggcgtcacacggcaccggtggacggggaggttcgaggctcacctgtgggacaagaacagctggaacgagtcccagaacaagaagggcaagcaagtttacctcggcgcgtacgacgacgaggacgcagcggcgcgcgcgtatgacttggcggcattgaagtactggggccccgacaccatcctcaacttcccggcgtctgcatatgaagcagagttgaaagaaatggaggggcagtccagggaagagtatattgggtccttaaggaggaaaagcagtgggttctccagaggtgtttccaaataccgaggtgtcgcaaggcatcaccacaacgggagatgggaggcgaggattggtcgcgtcttcggaaacaagtatctctacctcgggacttacgggacgcaggaggaggcggcgatggcgtacgacatggcggcgatcgagtaccggggcctgaacgccgtcactaacttcgacctcagccgctacatcaagtggctctgcccgggcgccggcgttgcgcagaacccgcacccgatgctggacggcctggcgcagcagctgctgctgtcgccggagggcattatcgacggcgcctgcgtccatcagcagcagcacgaccac

SEQ ID NO: 8624 - DNA, 763 bp, Zea mays
  misc_feature (31)..(51): n is a, c, g, or t
  misc_feature (285)..(289): n is a, c, g, or t
  Predicted polypeptide sequence is orthologous to G987
aaccagagaggaccaagggtcaattacaacnnnnnnnnnnnnnnnnnnnnntcaaacacggcagatgctgcagaggacattgcccagacccaggacctagatctaatcatgtttagcactatgcaacaacatggttgagtgataagcatctagttcgcattaccatcaatcacaagtgagtccatgtaacccactgaacgcacttgtcactagatatatccagatgacatacctaaacctaaaatttgtagacaagtgagtcaacagaacagctagatgtaagannnnncatcattttgccacccatgttgagatggcatagaggatgcggcctttccatccctgcaagagccagcggtgatcgacgtcgatcacaaagtccttgtggtagcaatccttgaccttgttccgcactacctgcacgacatcagggttcaatggctgctgcttcaagcctgctcgttggttccgcacctgcccattgctgtacgtctcgggccgctccactcggtctgtgccctcacacgcaatgacattcagggcagccctcccgaagaggttctcctcgatcagcatcctctggttgctgtctcttggggtggtcgcgtccagcgcatcaaacaaggccgagtagaagaacagagcctcccggaatcttgtcacgaagaaaggcgcactgaaggagccattcacaattgcgtgtatgaatgtatgaggccgcatatttctgatgttgttgagcccaatgtcccttgggctttcg

SEQ ID NO: 8625 - DNA, 894 bp, Zea mays
  Predicted polypeptide sequence is orthologous to G987
ggctacagcgcgcgctcttgcacctgcgccaccgccacggcggcgtccgacgcctttggcgccgtgctgacgccggcgctcgacttcccgtcggccgcgttcctgcagccaccacagctgtaccaggatctaagccctgagggcagcgtggtggatgcaggcggcgcgtggccgtacgactcgacggaattctaccagctgcacagcaacccgtcgtcgttcgcgtcatccaacggcagctgtgctacaatatcagacggctttgagtcgttgctgagctcgcctggtgtcatgccagatgttggcttcgccgattttgcggtgcagagccagcaggctatgcagttctgccgtgggttcgaagaagcaagcaagtttctgcctgacgagagtaagcttgtgattgatcttgagaagccagcatctgttacaagcttggtggctaacatcaaaggggagaacaggtttgcagaggtcaaggcagagaaggccgatgttcaggcagaaattcacagaggaaagaagcatttctatggtgatgacttggatgcagaggaagggaggcgcagtaaacattcagcacccgctatcgacactgatcaccttgtgcgggagatgatggacaaggtcttgttgtgcaatggcgagacatgttcaaaaggcgtcaaggaactccgtgaagccctgcagcatgacgtggcaaagaattcacacggggttcatggaaaagggtccggacatggcaagggccgtggcaagaaacagccgaagaaggaggtggttgacttggagactctcctcgtccactgtgctcagtctgtggccaccgatgatcgacgtggtgcaactgagctcctgaagcagatcagacagcatgcatcgcccaatggcgac

SEQ ID NO: 8626 - DNA, 847 bp, Zea mays
  Predicted polypeptide sequence is orthologous to G987
tgatttcccaccctaggcggcggcgtagtgctccctccatctgctagacttttgatgcacccacatcacacccacacccaccagcgcgagactgccatggccccaacgccggaggatccagccgccgacgactccgagcccttctcgccgtccatcttcctcgacctgcctccgacaccccaccctggtgacgatggcaaggactcgatgatagacctccatttcatcaggcgcttgctcatggaggacgacgacgtccagttccagtatgccgaccaccacgcgctccttcaggccgctgaggagcccttcgctcagatcctcgcgggctcggctggatcctctgtttccggctcggcaacagccgacacgacagcaatttactacccagacggtacgggattccatttccatcagcagactgcaggccctacgagtacgactggagatgacggggtagtaaccatggacatgctcaaccgggcgttcctcaagggtatggaagaggccaacaagttcttgcccgtcgtcgccagcagcacccacaccagcctgctgtgtcgtgactatgcctccaaacacagagtggtggatgggattgggatgccattattcttccaggagagtagtggtaataaccgtagaggcaggggctgccaccatgatgatgacggcgacgacgaggccgacactagaagcgccaagctgattgcaccagagctggaggaaagcggcgaggtgaccgacggcgtatttctcagaggctacgaggtggccctggagaaaatgaacggcttgagcaccaacgtgcctggtgccatgtcacggcagggacaggggaggcagc

SEQ ID NO: 8627 - DNA, 625 bp, Zea mays
  Predicted polypeptide sequence is orthologous to G987
cctcttaacacaagtttgttgtacatttccacaggaaagctaatctcaaatcctatgcagcatctactagggtaggagtattacatcattagaagacatcatctagatgaagggggctgagcgacataccataccacataggcatatatctatctccgtagtatactatctagtatgtgtatgtggggggatgttctgagacagcatcgtcatctgcaacccatgtcgacatggcgtaaagtatgcgtcccttccatccttccaggagccaatcacgatccgtatcgatgacaaagtccctgtgatactgctccctcaccttctccctcaacgccctcacggggtccggatccagcggaagctgcctgagccccgcccgccggttccgcgcctgccactgcctgtacgtctcagggcgctccaccctgtccacgccctcgcaggcgacgacgttcagggcgcactgcctgaagaatccgcgctcgaccatgaagcgctgccggctgtcgcgcggagccgtggcgtccagcatgtcgaacatggcggagtaaaagaagagcgcctcccggaaccgcgtcacgaagaacggggcgccgtaggacacgttcatgacgtggaggatgaa

SEQ ID NO: 8628 - DNA, 586 bp, Zea mays
  Predicted polypeptide sequence is orthologous to G987
ttttttttttttttttttttcaggcagacacggacaagattctattattgcagtcaattcaaacatacaaaactttggtttctaaaagagggctagattcaacaacgtaaacataatacagcaaaatgaaatggtgaataatcaagaaattaatggaagaggtcagctaagcagctcagtagctcactaatatttacaagtctagctagtccatgctgaaagtgcatatatgatacgacccttccaaccttgtagcatccacttgttatcttcgtccacgaggaaatccccctgatagctcttgcttaccttgtaccttgctctcttcattatctccctgtccagagctagctgccggaagcctgccctgaggttcctcatctgccattgcttgtaggtctctggcctttcaatcctctctgtgccctcacaggcaatcacattgacagcttcccggccaaagaactctctctctatcagcagcctatgctcatccatccgtaaggcattcgcttcgagcatatcaaagatcgaagagaagaagaacatagcctccttaaaacgcgtcacgaagaagggtgcattg

SEQ ID NO: 8629 - DNA, 838 bp, Zea mays
  Predicted polypeptide sequence is orthologous to G988
gtctgccacccgagaaagcacgcgccgcgcgcctcctgcacgaggtagccctccgacgggtagtgcagccgcagcagcagccgcgcctgcgacacggcgaaagcgctgagaggccgcgccgcaaatccggcgccgcgcgccgcggctccccaccgctcgagtccgcgccaccacctcccaccggagggacccagcgcggcgtcgatctccctgccgagcacctcgtgctccaccgccagccgctcccggctccccggcggcacagtcgcctcgagcgcctcgaacacggccgagtagtgatccatggctaccgcggaccgctggggcaggtcgtcgatgcggtcgaaacccccgccgattgtctccctctccgcgatggtcaccacggcgggggccatggccttgacccacttcaagaaggcggcaagctcgtcgtgcccgcctagcttgtgcaaaaacatgacgcagttgacggctagcgtctcgtccgggtgcagctccagctggctcgtcgtggccgcgctcgaagtggtggtgttggtcgtggtgctcgcgctggtgacgacctgctgctgatgggtagcggcgcaggagagcaggagcggcgtgaagtggaaggggagctggatggagcgggcgaaggcgcggaggcggctgccggtgcggaggagggtgtcgcggtcggcgccggcgccggtgatgcgcacctccggcggtcccgcggccgggtcggcgcgctcggcgatcgcctgcagcagtggcggccactgcaccccgtgcgcggcgtccaggtcgaggatgtggatccggcgcgcgccctcgacggcgtcgaggatgg

SEQ ID NO: 8630 - DNA, 952 bp, Zea mays
  Predicted polypeptide sequence is orthologous to G989
gcggccgcgcagagccgccgcgtggcggtggcgttccaggcgtacaacgcgctgtcgccgctcgtcaagttctcgcacttcacggccaaccaggccatcctgcaggcgctcgacggcgaggactgcctccacgtgatcgacctggacatcatgcagggcctgcagtggccggggctcttccacatcctcgcgtcccgcccgcgcaagccgcggtcgctccggatcaccgggctcggcgcgtcgctcgacgtcctcgaggccactggccgccgcctcgccgacttcgcggcctcgctcggcctcccgttcgagttccgccccatcgaggggaagatcgggcacgtcgccgacgccgcggcgctcctcggctcgcgccagcggcggcgggatgacgaggccaccgtggtgcactggatgcaccactgcctctatgacgtgacggggtcggacgtgggcacggtgcggctgctccggagcctgcgcccgaagctgatcaccatcgtggagcaggacctgggccacagcggcgatttcctgggccggttcgtggaggcgctgcactactactcggcgctgttcgacgcgctgggagacggcgccggcgcggccgaggaggagtcggccgagcggtacgcggttgagcgacagctcctgggcgcggagatacgcaacatcgtggccgtaggggggcccaagcggacaggggaggtgcgcgtggagcggtggagccacgaactgcggcacgccgggttccggccagtgtccctggccgggagccctgccgcgcaggccaggctgctcctcggcatgtatccgtggaaggggtacacgctggtggaggaggacgcgtgccttaagctgggctggaaggacctctccctgctcaccgcgtcggcgtgggagccggcggacgacgctgccgcttctgcgcccaccggttaacgagtacgag

SEQ ID NO: 8631 - DNA, 611 bp, Zea mays
  Predicted polypeptide sequence is orthologous to G1011
ctagaagactctcgagttttttttttttttttttttttaagaattctaaagtaatcacaaaactttgaatgcacgcacaagttgatgcctgacatttcaaaacaatgcatggatgaaaaccctaaactgtgtatggaaggtagcagtacaggaaaataaatcagatctaattatatagtacaacgtacataaactggtcaacataattttcccgacactaggaaagtaggaacccaaagctaaactagaacacattgaagaatatagaaaatatctaaaacatcatgaatcgtctaatgaggatgccgttgcagatcatgggtgagaaattgacgggttgccctagtagctgaccaaaatattgcagactagagcatgcatggtgtcccctggtgaatttgagaagaagtgtttgatggtggaatgacaaaggcatgcatggacggatggttcttgaatgcgctggtgcgaaatgaatctgtgtgatgccgcaagttgtctaaaaaacctgaaacctgcgtgcatctctatccaactagctagtgctatttctgcaagtaatcgaagtgtaagaaaaagaatgagatcagcgcaaggtacttggatgtgct

SEQ ID NO: 8632 - DNA, 848 bp, Zea mays
  Predicted polypeptide sequence is orthologous to G1013
gtaactgcttgtctgccatggaggaagaggagggatcgtcgacatcatcagtcgctgtgcctgtgccgccgccgcctaataagtacgactcctggacgacagatccggaggagctgatgatgatgatggtcgacgaggcggcggtgcagcaggaagggccccgtcgccggcgggactccatgctcaacaagctcatctccacggtctactccggacccaccatcagcgacatagagagcgcgctctctttcaccggcggcggcgacgtggatgctcgcaactacaacaactcctccgccggcccaggggctttatcgtccccggagaaggtgctgatgagcaagatggagaacaagtacacgctcaagatcaagacctgtgggaacggcagcagccttgcggaggatggatacaaatggaggaaatacggccagaaatccatcaagaacagccccaacccaaggagctactaccggtgcacgaaccctcggtgcaacgccaagaagcaggtggagcggtcgacggacgagccggacacgctcgtcgtcacctacgagggcctccacctgcactacacctactcgcacttcctccaccaccagcaaccgccgccgcagcccaaaaagcccaagctcggcgccggcccaccacaacagcccatcgtcgtcatggacgacgaccttctccacggcccggcccaacaagacatcatcaccaccggcccactgggagctgctgtcatggctccagcaccagcaccaccaccagcagcagcatctttctgctacgaccttgacgacgatgtacctgcttttttcgacgaccacgacccccaccacaccagcagc

SEQ ID NO: 8633 - DNA, 776 bp, Zea mays
  Predicted polypeptide sequence is orthologous to G1017, G2567
gatagcttctgctcaggttgctgacccaatcagatggccaaattcaccgtggaggcttcttcaggtcgcatgggatgaaccggacttgctgcagaacgtgaaatgtgtgaacccatggctcgtggagatcgtatcaagcattccaccgatccacctgggaccattttctccacctaggaagaagctgcgggtgccccaccatccggacttcccgttcgacggccagctgttgaatccgattttccacggcaacccactcggtccgagcaacggcggcgctcttcgctgtttctcggacatcgctcctgcaggcatacagggagccaggcatgctcagttcggtctaccactaacagaccgccagcttaacaagctgcacctcggtctgttccaaggcggcggttttaaccggcggcttgacgctatcactccaccatgccctatatcgaggggctttgtgatcggcagtgcaccggtcgacgagagcgtctcttgcgtgctgacgatcggcacgccacgggccgcagagagatctgacgacaggaagaaaccacatctaatgctgttcggaaagcctatccttaccgagcagcagatgagctctagagggtcaagggaaacactctcccctgaggccactgggaacagttccgatggcagtgttcagaaaacgggaaacgtatccgatggctctggttcgtcgatctgcatcggttcctcgtcccgaggccgcgaggcttctaggctcgggttcgaatttgaagccgggcactgca

SEQ ID NO: 8634 - DNA, 914 bp, Zea mays
  misc_feature (734)..(734): n is a, c, g, or t
  Predicted polypeptide sequence is orthologous to G1017, G2567
atggacgcctgcagtccggtccggaattccctcaacaaacgggcgtccgctggaagttttccacattttccggggcacgccgcgccggcatttgctcaccacgggatggagcgctttcgccaaccagaagaagctcgtcgccggggactccatcgtcttcctgcgcaccgagcatggcgagctgtgcgtcgggatacgccgtgccaagcgggtgtcctgtggtggcatggagtgcatctctggctggaacgccccggtgtacggggccttgtcggcgttcttgaaggacgaggaaggtaagatcactaagggtcctggtgggtacatgagaggcagggggaaggtggagatcacggacgttgttgaggccgcaagcttagccgcgagcgggcagccatttgaggtggtgtactacccgagagctagcactccagagtttgttgtgaaggctgcatcggtacagaacgcgatgaggaaccagtggtgccctgggatgaggttcaagatggcatttgagacagaggattcgtcaaggatcagctggtttatggggacgatagcttctgctcaggttgctgacccaatcagatggccaaattcaccgtggaggcttcttcaggtgtcatgggatgaaccagacttgctgcagaatgtgaaatgtgtcaatccatggcttgtggagattgtatcaagcattccaccgattcacctagggacattttctccacctaganagaagttgcgggtggcccaacatccagactttccatttgagggtcagctggtgaatccaattttccatgggcacccactttggtccagcaacagcccacttcgctgtttctcggacatcgctcctgcaggcatacagggagccaggcatgctcatttgggttacccctacagactacagc

SEQ ID NO: 8635 - DNA, 858 bp, Zea mays
  misc_feature (792)..(792): n is a, c, g, or t
  Predicted polypeptide sequence is orthologous to G1017, G2567
ccgtcaacttctccccacctcgccgccgtctagatttcgtctcctgggctcgagcaaccgaagcaggcttggggtgttctcggagagaatcgttgcctcggccgatgccggccctgatgtaggtttctgctctgctttgcccggtgccaacgtctctcccggagtagcggttccgccgccccatgatctgccagttggaacacatgggcgttcacggaggaggttgctctgctggacagtgaccgcatttggtagcggtggaggaagacgacgaagaggaggaggagtaggccatgaaggaggtggccgaggaaaggtgccttgacccgcagctgtggcacgcgtgcgctggcggcatggtgcagatgccgcccgtgcgctcccgtgtctactacttcccgcagggtcacgcggagcacgcgcatggcggcggggccgcggacctcgccggggcgcgagcgctcccgtcgctcgtgctctgcagcgtcaccggggtgcgcttcctggccgatccggagaccgacgaggtcttcgccaagatccgcctggtgccggtcgcgcccggcgaggtggagttccgagagcccgatgagttcagcgtcgaccccgcggacgcccgggagaagctttcttccttcgccaagacgctgacgcagtccgacgccaacaacggtggcggcttctcggtgccgcgctactgcgccgagaccatcttccccaagctcgactaccgggccgacccgccggtgcagacggtgcttgccaaggacgtgcacggggaggtctggaagntccgccacatttaccggggcacgccgcgccggcatttgctcaccacgggatggagcacgttcgtca

SEQ ID NO: 8636 - DNA, 886 bp, Zea mays
  Predicted polypeptide sequence is orthologous to G1017, G2567
cccatgtcagctgaggtctgctcacctgtgtgagagagagtgtgtgagtgtgaccgtgggtggggtggggaggaagacgagcccgtcgagctgtgccgattttgcccccgaatccgtcgttacccctgctttggagggatctgaaggtgctggtggcctgctgctgcctgcctgtctgccaggagcccagaggccagagcagagactgtggtggtggtgatggcggctgtgcagcggaaaggcttctcgtcgtggtactagtggaggaggcgtgaaatttcatccataaaggctgtcgcggtggccggtgggtggagatcgcgctcaattcccgccgaaaccgcctccggggtagcgtggccgcgggaagtgggagtgggagatgattactttcgtggactcggcggccatggagctggagagggagagcggcaggtgcctggtggacccgcagctgtggcacgcctgcgccggcggcatggtccagatgccgccggtgcactccagggtgtactacttcccgcagggccacgccgagcacgcgcagggccacgcccacgccgacctccccgccggccgggtcccggccctcgtcctctgccgcgtcgacgccgtccggttcctggccgatccggacaccgacgaggtgctcgccagggtccgcctcgcccccgtccggcccaacgagccggaccacgccgacgccgcggcgccgggcgcgcgggaggacaagcccgcgtccttcgccaagacgctcacgcagtccgacgccaacaacggcgggggcttctccgtgccgcggtactgcgccgagaccatcttctcgcggctggactactccgccgacccgcccgtccagaccgtgctcgccaaggacgtgcacggc

SEQ ID NO: 8637 - DNA, 798 bp, Zea mays
  Predicted polypeptide sequence is orthologous to G1017, G2567
ggcgagttcaagaacagcccgaccggcaagaacacgtcgtcggagaggctgccgtggttcggggacggcagcagccagcaggcctccgagcccggtcttgagcccggacaatgcaaggtgttcgtcgagtccgacacggtcggccgcaacctcgacctgtcggcgctgggctcgttcgacgagctgtacggccgcctgtccgagatgttcggcgtcgagggcgcggagatgcggagccgcgtgctgtaccgcggcgccaccggtgaagtgaggcacgccggcgacgagcccttcagcgatttcgtcaagtcggcacggaggatcacgatattaaccgatgctgggagcgacaacctaggaagctaagtgaggagcagtgaaccaattccagccgcgagtactgactagccaagtagctagtgtttggttacaggaacagcataggatgaattttttgttgttgttgatgtttggatttggacaagagacaccaagagtcacggtcacgaacgtcccaagtagaataaatattcgcttgagacctgggccacgagcttcttcgcgtgaagaggagacagcaaccgcagtgagggaggagaaaaggtggccgtcggcgaggttgagtggccgcacgggggagcttcagccccccgccgtgcgggtgatctccggctggccgccacgcgggcgagcgtggggggagcttgggccctgctgccgcgcgggcaacctctggcggtctggcccacgcccaccatcgcgcaaggcgagcgcgggggaactccggcagtcaagccc

SEQ ID NO: 8638 - DNA, 650 bp, Zea mays
  Predicted polypeptide sequence is orthologous to G1017, G2567
tttttttttttttttttttggttcaaaagagacggaatgactatttttttatttggttttaagacaacaaaattaataatgagatcaaccatatgacatacggggtctaagcgacgaggctgggggcttgcctgccagagttccccgcgctcgccttgtgcgatggccgatggtaggccagaggttgcccgcgcggcagcaaggccgaagctcccccacgttcgccccgcgtggcggccagccggagatcacccgcacggcgggggggctgaagctcccccgtgcggccactcaacctcgccgacggccaccttttctcctctttcctccctactgcggttgctgtctcctcatagtctcaagcgaatatttattcgacttgagacgtccgtgaccgtgactcttggtgtctcttgtccaagtccaaacatcaacaacagcaaaaaaaattccatcctatgctgttcctgtaaccaaacactggctaattggctagtcagtactcgcggctggaatagcctcactgctcctcacttagcttcctaggttgtcgctcccagcatcggttaatatcgtgatcctccgtgccgacttgacgaaatcgctgaaacggcacagcaattgttcatgataagcacactgcgtcagct

SEQ ID NO: 8639 - DNA, 874 bp, Zea mays
  Predicted polypeptide sequence is orthologous to G1017, G2567
tgtgtgtgccgctgtagcagcacagcgcagcgcgcgcgccaccaccgtcaacctcctgatctccccgcctcgccgccgtcgattcttcgccgtcttcctggggctcgggggcagccggagcaagcttgggggggtggtgtcctcggaccgacgacagagtcgttgcccgcgaagatgccggccctggtgtacattcctactccgctttgcccggtgccagagcgtttctcccggagtagcggttgcgccgcctcatgatctgccaattggaacccctgggcgtgcgcagaggaggttgctctgcagctggacagtgatcgcgtttggtgggtgtggcggcggtggaggaagacgacacgacgaagacgaggaggtcaggaggccatgaaggaggcgggcgaggagaggtgccttgacccgcagctgtggcacgcgtgcgccggcggcatggtgcagatgccccccgtgcgctcccgtgtctactacttcccgcagggccacgcggaacacgcgcacggcggcggcggcgccacggacctcgccggggcgcgggcgcgacctctcccgccgctcgtgctctgcaccgtcgccggggtgcgcttcctggccgatccggagaccgacgaggtcttcgccaagatccgcctcgtgccggccgcgcccggcgaggtggagttcggagagccccgcgagttcggcatcgaccccgaggacgcccgggagaagctgtcctccttcgccaagacgctcacgcagtccgacgccaacaacggcggcggcttctccgtgccgcgctactgcgccgagaccatcttccccaagctcgactaccgggccgacccgtcggtgcagacggtgctcgccaaggacgtgc

SEQ ID NO: 8640 - DNA, 979 bp, Zea mays
  misc_feature (568)..(572): n is a, c, g, or t
  misc_feature (751)..(755): n is a, c, g, or t
  misc_feature (783)..(787): n is a, c, g, or t
  misc_feature (803)..(827): n is a, c, g, or t
  misc_feature (841)..(861): n is a, c, g, or t
  misc_feature (912)..(919): n is a, c, g, or t
  misc_feature (963)..(977): n is a, c, g, or t
  Predicted polypeptide sequence is orthologous to G1020
gcacgagaaccgcctcgctgaaccggaagacccgcacacacacgccacttgtagaccatggcgccccgggtggcggacaagtcgcctctaccgccggccaccggcctggggctgggcgttggcggaggagtcggaggcgtgggcatgggcccgcactacagaggcgtgaggaagcgtccatggggacgttacgccgccgagatccgcgaccctgccaagaaaagccgcgtgtggctcggcacgtacgacacggccgaggaggccgccaaggcgtacgattccgccgcccgcgagttccgaggcgccaaggccaagacgaacttcccgttcccgtcccagtgctccgtcgcctccggtgctgccggtagcgccagtagcaacagcaccgtggattcgagcggtggcggtagcggctgtggcatccaggcgcctatgcaggccatgccgcttcctccggctctcgacctcgacctcttccatcgggcggccgccgtgaacgcagtctccaccggcatgcggtttccgttcaagggctatcctgtcgcctgcccgacgccacagcagtacnnnnnctacgagcaggcggctgccgcggcatccggataccggatgctcaaggtcgctccaccggccgtgactgtggccgcggttgcgcagagcgactccgactcgtcgtctgtggttgatcactccccttcgcctcccgcggtgacggcaaacaaggtgggcttcgaactggatctgaactggnnnnngccggcagagaactaggcaggccggagnnnnnggctgacgacttagtnnnnnnnnnnnnnnnnnnnnnnnnntcaggaatgttacnnnnnnnnnnnnnnnnnnnnnatggctgtattcttgttctgtagactaagagatggggagtcttgtaaatannnnnnnnccgtcgagacggaaatgaactgagatctgttcgtctgtctgatnnnnnnnnnnnnnnntc

SEQ ID NO: 8641 - DNA, 493 bp, Zea mays
  Predicted polypeptide sequence is orthologous to G1020
acgcttccctttcggcagcatccccgttacgcacccgtattacttcttcgggcaggccgcagcagggtgccatatgctgaagctgccaccgacgacggtgactgtggctcagagcgactcagactcctcgtcggtcgaggatctgtcgccgtcgccgtcgccgtcgccgccggccgccgtgtcagcgacgagatccgccttttgatctcgacctcaactgcccaccgccggccgaggcggaggcatagtcgcggagttttgctgaatgactgcctgtagtttcttcctttctttcgtcttttatccgtagagagaatcggtaggcttaggacccctttgtattcacacggtgtcacggccacacctccgaactctggtactctgatatttagagtgaaactacgaacacgtggttcaaagttaactctatatggtttatagtcatgagaaacggctaaaaaattctgcagctaacagaaactatttatttcct

SEQ ID NO: 8642 - DNA, 455 bp, Zea mays
  Predicted polypeptide sequence is orthologous to G1020
tcggccgccggcgccgtgggagctgcggcggaggcggagggagccctgtgccgcggcgcacggaccgcagcgctggggaagttggtgcgggcggtgggcccgcggagagatcgggcagcggcgtcgtaggcgtgcgcggcggcctcggcgcagtcgtaggtgccgagccagatcggggtcttcttggccgggtcccggatctcggcggcgtagcgccccgacggccgcctccgcacgccgcggtaccgaatctccggcgacggcgagggctgctgcggcggcggcttcgcccggcgcatcgcggacggagagggggtggggcgctcggcggagagcgcaagcggggcgggtctcggctagggtttggccataaatttatttattttcttctctccagttctggtttctccccgattttttgatcttcttttccgcttcggttcccccaacacaat

SEQ ID NO: 8643 - DNA, 428 bp, Zea mays
  Predicted polypeptide sequence is orthologous to G1020
caaacatatcctgataatgagtcattacaatatttgctaagataaaatgaacgcactgtctcccagagttgatattacaaatagaaatcaaaaaaacctgaaatggattaacaagtccatgaacggagatgcatattcttcaatattctgcccgtgggagtaggatctcgtggcgtccagaatggattaataagcaaacaagggagtatttgacttcacttataacctcagcttgccgccgccgccgccaagggagtgagggcctgagggagagccggagagggtcggccgcctgcacggctgcactgccgacctggcctctggcggtctgccgccggccgtgagcccgtgagccgtgacggcctgcactgccgcctgccagtctggcgcctggcggtctgccgcccgccgtgagcacgagacaggga

SEQ ID NO: 8644 - DNA, 1002 bp, Zea mays
  Predicted polypeptide sequence is orthologous to G1020
gcacgccgtataagcacaaccaccaccaccaccgcctggccgtacctttacacgctcgcctccttccatggcgcccaggaacgctctccccgccgccagcgccgtggccaacggcatgttgatggagccgaggttccgcggcgtccggaagcgcccgtggggcaggttcgcggcggagatccgggacccggccaggaaggcgcgcgtgtggctcggcaccttcgacaccgccgaggccgcggcgcgcgcctacgacgccgccgcgctccacttccgcgggcccaaggccaagaccaacttccccgtcgcgttcgccgcgcttccgccgccgccgccgcccaagaagccggccgccgtgaccgtgagccccagcagcagcagcaccgtggagtcctcctcctcctcctcccgggactcgcccgccacgccgcccaggcccgcgtctccgtcccagcaggccccgtcgctcgacctcagcctaggcggcacaccggccatggtggccgcccagccgttcctcttcctggacccgaggctcgcggtgaccgtggccgtgccggcgcccgtgccctaccggccgaccgcggtcgccgccggtgccaacaagcatgctgcggcatcctgccgtgaagaggagcagagcgacaccgggtcgtcgtcatccgtggtggacgcctccccagcggtcggcgtggggttcgacctcaacatgccgccgccggccgaggtggcgtaggtggaccgaccgccgcagcgcccggtgacacgagacgagacggctccgagaggtcgcgtagatgattagaaacaagctgtattagtacgaggttgggttcaatttgccgcgatgggttactgctagccaggtgtacatagacctttttgcatcggcagctaatacctatttgccgatgttacaaaaaaaaaagagcgaaacgttttgtagttcgttgtaatataaaaaaaaaaaaaaaaaaactacgagggggggcccggtaccca

SEQ ID NO: 8645 - DNA, 1086 bp, Zea mays
  Predicted polypeptide sequence is orthologous to G1020
gcacgaggctccacgccacccaacacatacaaacacacgcacgcgcgcgcgcgcgcctcccgctgttccgcaaaacaaaggaaacgaaggagaggaggccatggcgccgagaacgtcagagaaaaccatggcaccggcggcggccgctgccacggggctcgcgctcagcgtcggcggcggcggcggggccggcggcccgcactacagaggcgtgaggaagcggccgtggggccggtacgcggcggagatccgcgacccggcgaagaagagccgggtgtggctcggcacctacgacacggccgaggacgccgcgcgggcctacgacgccgccgcgcgcgagtaccgcggcgccaaggccaagaccaacttcccttacccctcgtgcgtgcccctctccgcagccggttgccggagcagcaacagcagcaccgtcgagtccttcagcagcgacgcgcaggcgcccatgcaggccatgccgctcccgccgtcgctcgagctggacctgttccaccgcgcggcggccgcggccacgggcacgggcgctgccgccgtacgcttccctttcggcagcatccccgttacgcacccgtactacttcttcgggcaggccgcagccgcagccgcggaagcagggtgccgtgtgctcaagctggcgccggcggtcaccgtggcgcagagcgactccgactgttcgtcggtagtggatctgtcgccgtcgccaccggccgctgtgtcggcgaggaagcccgccgcgttcgatctcgacctgaactgctcaccgccgacggaggcggaagcctagtcgtcgaagcttttaatgactgtctgtcttcttagttctttcttctcctttttctcgaggaaaattcggtactactaagctgagagacgctctcctccgacagacgacgtcgacgacgggcatttttgtaaatagtttttgcgccgggacctttttagtttatgatgaaagctgtattgtcaccgaagacaggtcctgccggcgttgttatggcccggattactatattatattatgcactactagtaaaaaaaaaaaaaaaaaaaaaaactcgagggggggcc

SEQ ID NO: 8646 - DNA, 709 bp, Zea mays
  Predicted polypeptide sequence is orthologous to G1033
tttttttttttttaatgaccttcgtatccttttttttctactttatttcgtagccaatgaagaaaacaacaacaaatgtaatcaagaacagatagagtagcagtaatagtagtacacatttagaagaacaagacagaaacagttgtacacaaaaaaatagagagaaagagagagaaaaagagacaagcacgagttttatttgttcaaatatctcttttttcacatacaaaacaagaatgtcattctacaacaatataacaagtagtatatagaaaaaaaattctgaactcgacaaaggaaaaggataaggaacggttagagatttaattttattttagtttatttattcttcatcgtcttcatcttcatcatcgtcatcatcatcatcatcattatcttcatcggatgatttcgattttgctgcaggtttctttttaccacctttagctggtgcagcctttttgcttccacctttagcagcacctttaccgcctttggcaggtgaactactagcaccaccaccaccgcttttcttgtattcagcaacacgtacttcatacttttgcttttcaacagcggctttttgttcataacgttttctaacatcatcactaacttttttccatcttgcaccgatttcttttgaaatatcaccaacggataatgatggactttttttcttatatctggtcgtcatcttgtgaaaaga

SEQ ID NO: 8647 - DNA, 879 bp, Zea mays
  Predicted polypeptide sequence is orthologous to G1033
gcacgagccagcccaaccttcacgcaccgcatttcccaagggaaccataccagagcggcagagccttcccctccgctccccagtcccacccgcaccctagccctcagcaaaccctaaccgctcgtcgccatgaaggacacctcgttcaaggccaccggcgccaagcgcaagaaggtcggcggcgccaagcgcgggctcacccccttcttcgcgtttttggctgagtttaggccgcagtacctggagaagcaccctgagctcaagggcgtaaaggaggtgagcaaggcggctggggagaagtggcgctctatgtcggatgaggagaaggcgaagtatggcggtagcaagaagcaggatggcaaagcaagcaagaaggagaacactagctccaagaaggccaaagctgatgttcgggagggagatgaagcagaaggttctaacaagtcaaaatctgaggttgaggatgatgagcaggatggtaatgaggacgaggatgagtaaatagtacgatggggaacagcagctttgcaattgagtgtttgctgctttacttatttttctatatgctgttccttttgatgttatatgctgtaaggaaaatctgtacatgatggtaccttagggtatggcatgctggagttcccctttaacccgaagagccggatacttttgccagcctcgtcagcatgtgtaaacagttgttttcttgttttatcgacttattgggtgactacccaagagttggtttgtagtcaatgaggtatgctgccccctgtggtgctacgcagctgcagcaacatcagatggtcaggctaaaatcatgttgtgggatctgattctaatgatgcttatttagtactattacaaatatcctcgtgc

SEQ ID NO: 8648 - DNA, 748 bp, Zea mays
  Predicted polypeptide sequence is orthologous to G1033
ggcatcagagcggcgccggcctacaaccgttttcgtgctcacacacccaaaccttagtcgcgatcaggccccaaggactcgagatgaagtcgagggcacggtccaccgccggcgactccaggctctcggtgaggaagaccaaggctgagaaggacccaaacaagcccaagaggcctccgagcgcgttcttcgtcttcatggaggagttcaggaaggactacaaggagaagcaccccaatgtgaagcaagtctccctgattggcaaggctggtggtgacaagtggaagtccctgtctgatgccgagaaggctccctacgtgtctaaggcagagaagctcaaggctgagtacaccaagaagatcgacgcttacaacaacaagcagtctggagaccccacggcgtctggtgattccgacaagtccaagtccgagggtgacgagtgatgtatgacggatgaaactctgtccaagtgtttgcagtcagggaaaaaatctcgtcgttgtcggcctaaccgggttttctcgaaggactttctagatgcagtagattagtgccgtcttctgagtagtttccttgcaagtgtcgtcccgttcctggagtgaggcagtttagtttgtagtttcttcgcttcatcggcactcgaccgttgttggattgggatgtttagcctgcagtctgtacttaccccaagcatctatggtgcctgttttaaatctcacatcacaatagctcgtttgttttaaaaaaa

SEQ ID NO: 8649 - DNA, 769 bp, Zea mays
  Predicted polypeptide sequence is orthologous to G1033
ggcacgaggcacactcccgtttacgtgcacacctccaaaccctcatcacgatccggctccaaggtctcgagatgaagtcgagggcgaggtccggcggtggcgactccaggctctcggtgaggaagaccaaggttgagaaggacccaaacaagcccaagaggcctccgaccgcgttcttcgtcttcatggaggagttcaggaaggactacaaggagaagcaccccaatgtgaaacaagtctcagtgattggcaaggctggtggtgacatgtggaagtccttgtctgatgccgagaaggctccctacgtatctaaggccgagaagctgaaggttgagtacacaaagaagatggacgcctataacaacaagcagtctggaggaggacccacattgtctggtgattctgacaagtccaagtccgagggtgatgagtgatggatgacgggtgaaactctgggctgcccaagtgcttgcagtcagcagggaaatctcatcgtcgttgggcctaaccgggctttgctgctccgtagcgtctggaagctgtctgtcttttgagatgctgtagactagtagtgcctgctctgagttagtaattgaaagtgttgtccctgaagtgatgctgtttagttggtagtgtgttcgcttcttcggcacttatacttacccccaagcatcaacgctgccctgttttaaatctcaataggtgctgttttaaatctcagatctcaatatatgactactgatcgctgaataaaaaaaaaaaaaaaaaa

SEQ ID NO: 8650 - DNA, 1158 bp, Zea mays
  Predicted polypeptide sequence is orthologous to G1033
aacgcctccaagaaggatgagggcaggctccgggccggcggcggcggcgccggaaagctcaagaaggccgccgcgagcggcaagcccaagcgccctccctccgccttcttcgtcttcatgtctgaattcaggcaggagtaccaggcgcagcaccctagcaacaagagcgttgcggccgtgagccactttgcactctgttctccctttattttttttccatgttcgtctgcagatgatgtcttattttttcgtgttggtggatcaggtgagcaaggcagcaggggaaaagtggcgctctatgtcagagcaagagaagcaaccctatgtggaccaagctgggcagaagaagcaggactatgagaagactaaggcaaatattgagaaggagagcacaagctcaaagaaggctaagactgatgacgacgatggctcgaagtccgaggtcgatgatgaggatggcggtagtgacgaggaaaacgacgacgacgagtaaatagtatctccgctgtcgtgaggtagcaaatcgattgttaggtccccaattagctcactggtttgctatctttaatgttaagttgtttggaacaggtgtttatgaaggggatctattagtttcgtgaggttgttagtttagtgcattagcaaagaaaaagccgaatgctgctagctattacgttgcttttcttttgctaatcacttgtgtcacaactctctgtacctgtttcattgactaatctagtgactagtcagttatgggtttaatgtttggttttggttttatatatttctttgttgctttctgtgcggcctacggaagtcatctgtgctgtatgaatgatgaatatgtgcttgtggctcgtttcattttagtgagtttttgttttgtgactcaggttaatttacatgagtttgtttgtgactcaggttaatttacatgagtttgtttgtgactgttaatttgtgcgtttattggtgcagttagctttcttgtatataaatgcatggtggaaattctgttgatgatttctgagataaccaagctcacttgtttacatgataaactgctgcaaatttgttgctgttttctgagataatcaaattcacttgtttttgcattaaaaaaaaaaaaaaaaaaaaaactcgagggggggcccggta

SEQ ID NO: 8651 - DNA, 840 bp, Zea mays
  misc_feature (762)..(762): n is a, c, g, or t
  misc_feature (830)..(830): n is a, c, g, or t
  misc_feature (832)..(840): n is a, c, g, or t
  Predicted polypeptide sequence is orthologous to G1033
actggacgcctgcagtccggtccggattctttcgtagacgcacgcgtccgcgctacctctcccgtttacgtgcacacctccaaaccctcatcacgatccggctccaaggtctcgagatgaagtcgagggcgaggtccggcggtggcgactccaggctctcggtgaggaagaccaaggttgagaaggacccaaacaagcccaagaggcctccgaccgcgttcttcgtcttcatggaggagttcaggaaggactacaaggagaagcaccccaatgtgaagcaagtctcagtgattggcaaggctggtggtgacatgtggaagtccttgtctgatgccgagaaggctccctacgtatctaaggccgagaagctgaaggttgagtacacaaagaagatggacgcctataacaacaagcagtctggaggacccacagagtctggtgattctgacaagtccaagtccgaggtcaacgacggggacgaggagggtgatgagtgatggatgacgggtgaaactctcggctgcccaagtgcttaaagtcagcagggaaatctcatcgtcgttgggcctaaccgggctttgctgctccgtagcgtctggaagctgtctgtcttttgagatgcagtagactagtagtagtgcctgctctgagttagtaaccgaaagtgttgtccctgaagtgatgctgtttagttggtagtgtgttcgcttctttggcacttctacttacccccaagcatctacgcagcctgttttaaatctncataggtgctgttttaatctcagatctcatatatgactactgatcgctgaatagatttcatgctctanannnnnnnnn

SEQ ID NO: 8652 - DNA, 2262 bp, Zea mays
  Predicted polypeptide sequence is orthologous to G1037
cttgcttgggtgatccgggtgcctggtttctcggttccgcggcttccgctgctgttggattcgccgagccggagccggagccgccggagatgaccgtcgacgagctgaagctgcaggcgagggccagcggcggccacggcgccaaggaccagttccccgtcggcatgcgcgtgctcgccgtcgacgacgacccgacctgcctcaagatcctcgagaacctcttgctccgctgccagtaccatgtgacaacaacgggacaggcagccacggccctgaagctgctgagggagaagaaggaccagtttgaccttgtgatcagcgacgtccacatgccggacatggacggcttcaagctcctcgagcttgtgggcctcgagatggacctcccggtcattatgctgtctgcaaatggggagacacagacagtcatgaaggggattacccatggagcatgtgactacctgctgaagccagtgcgtattgagcagctgaggactatatggcagcatgtggttaggcggaggagttgtgacgccaagaacagtggcaatgacaacgatgattcgggtaaaaagttgcaggtggtgagcgttgaaggtgacaatggcggtgttaatcgcaacaagagaatttcacgcaagggtagggatgataatggtgatgacggtgatgattctgatgacaacagtaatgagaatggagactcgtcgagccagaagaagccaagggttgtgtggtctgttgaattgcaccgaaagtttgtggctgctgtcaaccagcttggcattgacaaggctgttccaaagaaaatattggatcttatgaatgttgagaacatcacaagggagaacgttgcaagtcatctgcagaagtatcggctgtatctgaaaagactcagcgcagatgcaagcaggcaggctaacctaactgctgcatttggaggaagaaaccctgcttatgtgaacatgggactagacgccttcaggcagtacaatgcatatgggagataccggccagttccaaccactaaccattcacagccaaacaacctccttgcaaggatgaactctcctgcatttggtatgcatggtctgctgccttcgcagccacttcagattggacacaaccagaacaatctgaacacttccctagggaatgtcggggggatgaacaacggcaacttgatcaggggtgcgcatatgccactgcaggatactagcaaatgctttcctactggcccttctggtaattcgttcgcgaacatatcaaacagcacacaactggttacgacaaacaacttgccattacagtctcttgagccaagcaaccaacaacaccttggtcggctgcattcctctgcagaccctttcaactcatttgttggtgagcccccccagtttgcagatcttggaaggtgcaacaccacctggccaaccgcggtctcatcatccaatgttcaggagattggccagaaggacaggatcgtgaataggcccaagcttgagcctctctcaagctttacagaagcatccagtcagatccctttgctgggaaatgaaatgcagagccaccaagtagcatcactagccagcaacggtcttccgatgccgttcactcaggaagcggtgcccttcgcttatggaagcagcacgaactcgagagagatgctgaataacaaccttgcgcttagtaattcaggcgtcaactctacattgccgaaccttcgcatagacggttctgttgttccagggcagacactgggtggtagcaattcaggtggttgtgttgtcccccctctgcaagatggcaggattgatcaccaagctgtcagcagtcatctaaactacagcaacgaactcatggggacaagtaggctgcaaaggggactcagtggtggtctggatgacattgtcgtggacatgtttaggccggaccgcgcagacgatggcgtccccttcattgatggggactgggaactggtctagcaggtttcagttctctacatcaagtctgccttcgtgtgagattttccgcatttgtggttgtggaggggttcggcgcttgattggtccaaagttgtttatagtagcaagattgcatcacaaatgccctttgcatttggtttttcagtttagcgaccaggttccagtgtcacgtccgaatatcaactatgtggtatttgctaccttaactcgtatggctatgttttcaagtcaggtgttaactgtggctatcgtgatatatacagcatggttatgagcc

SEQ ID NO: 8653 - DNA, 480 bp, Zea mays
  misc_feature (452)..(452): n is a, c, g, or t
  misc_feature (456)..(456): n is a, c, g, or t
  Predicted polypeptide sequence is orthologous to G1038
tgcagcgtgcccctgtattgagagagagagagaaggtcactctagtgcagggggacgaatagagggtaccgatgcagtggatagcagtctacagttacctctaaatggagggagggggaagcaaaccgcaaccgttgcagacagtcttatacggaaacaagggccccgtgacacaccgaagctgccaaaaccatgcgtgcgatgcacatgcaccacacacgagtgtcgtcacgtactgtgcacacgcactattctgtacccatatcacacagacacgcgcgcatcagcatcaccaccaccaacaggcagcacggtagtatcagctcttccctggtccatgatgcttttgctcttcgttttttttctccttccccgcatttccttttcctttttagaccatgtaaatgatgtttaatacagagactctagaattgtttaaaaatgtatttgcnaaanaaaaaaaaaaaaaaaaaaaaaaaa

SEQ ID NO: 8654 - DNA, 629 bp, Zea mays
  Predicted polypeptide sequence is orthologous to G1043
cgcgcgagtgagccatcactgagctgtggacgtgaattgcgatcatccgttctcgctttctggggctcggctgctgtggccatggcgccgccgccgccgccgtacgcgcgggtgatggaggacatggtcaagggccgggagtacgccacgcagctgcaggcgctgctccgggagtcgcccgaggccagccgcctcgtggaccggatcctgcacgccatatccctcaccatccagacggccaaggccgcggccgccgccgctgaggaggaggaggaggaggaggcgtccgaggtgcagagcgaggtcacctgcaccggcaagaggaaggccgctggcggagcgggcaagagggccgccgcgtgtcggaggagagcccagccatcgtcggttgtgacgaagagcgtgagggatctggaggacggacacgcgtggcgcaagtacgggcagaaggagatccagaactgcaagcacccaaaggcctacttccggtgcacgcacaagcacgaccagcagtgcgcggcgcagcggcaggtgcagcgccgcgacgacgacccggacgcctacacggtcacctacatcggcgcgcacacctgccgggacccggccaccgcagccgacgacgagctcca

SEQ ID NO: 8655 - DNA, 1162 bp, Zea mays
  Predicted polypeptide sequence is orthologous to G1048
gcacgagtggacatcgacctcttccccgacatcgaccttgacgccctcctcgcctccttctccggcgaccccgccgccgtctccggcctcatcatcccgtccccgcctccgccggcgccggcgacggcgcacgatgcggaggcggggtcgccggagtcggtgacctcccggacgaacccgctcggggaggtggcgctctcggagatcgagaggctcctgatgcaggagggggaggcggaactgggcggggaggtcgatgggatcagcgtggaccagttcttcgacgcgctgtacgacggcgaggaggcgaaaggtgagcgggaggcgggggcaagcgcggatgtggactccggcagggacgatgtgctggaagtcgtgacgccagaggcggggacggtggaggtggatggcgatgatcccatcagcaagaagaagatgaggcaaatgaggaacagagattccgccatgaaatccagggagaggaagaagtcgtacataaaggacttggagacaaagagcaagcacttggaggcagagtgccgtcgcctcagctacgcacttcagtgctacgcagctgaaaacatggcactgcgccagagcttgctgaaggataggcctcttggtgctcccacagccacgcaggagtctgccgtactcacggaaaccctgccgctggtttccctgctttggctggtgagcatcgtctgcctgttcctgatgcccgttctgcccaaccgaagcccagctgctccaagcagcggcggaagagacctcgtgatggcagccggaaagacaagcagtgagaccccagagatactggaactcatcctccatggaaggcgttgcaagagcacgagggcgaagattaagctatgtattttaccatttcatgcaggagctgcttgctagtagttgctaggctttgagcctcttgcaagcttacctctatatgtagtgtacccgcaaatcttaccgtgctcgctatgcgcctgtcttgcagagaagcctgtcgatatccatggagtagtaccttttttttgtttaatagctcctgtgctacccagaatatgtttaaaatctggattttgtgttattttctatttcttcaccttatctctagttgctcctgatataaagttccttcgctcgaaaaatcttagga

SEQ ID NO: 8656 - DNA, 610 bp, Zea mays
  Predicted polypeptide sequence is orthologous to G1049
ttttttttttttttttgtgacaacatattttatttcgtatactatagtaacagaagcaccgtatatatggaagctaaaatgcgaagataagaatgaatttattcagtagcggcgtcgtgttgcggttgcggctccgaggaggagcttggcagggcggcgttctgcggctgggtgaggcgctggagcttggtaccgatatcggtcttctccttctggagccgggccttctcgcggcgcatgtcgctgcagcccctcacggcgcggttcagctcgtcgaggaggcggcggttggcgccgcggaggtggacgacctgcgcccacagctcggtgagctggcgctgcttgcgcatgcgcgacctccgggcggactcccggttggaggccatcctccgccgcctccgctcagcctccgccgtgccgccgccgccgccgtcatcggcactgccggacccggctgggctgttgccggcggcgacggccgccggagcttcgtggacgacgggttgttcgaaggtttgggccgtagaaggccagatgtggtggaacgacggagtgggcggcatcggcgtggcgatgatgttgctgtggtggtagtagtgagcgtggaatg

SEQ ID NO: 8657 - DNA, 1111 bp, Zea mays
  Predicted polypeptide sequence is orthologous to G1050
ctcaacttcgccgcagggatgagtctccaaagctgccgctgccgtctcctcgtgccagtggcagcctcactaggagcgggagcggctcactggaaggtggtgctgtcgcgctgtttgacatggagttctccaatggagagtttactgagtccgagaagaagaaaatcatggcgaatgagcggcttgctgagatagctttgacggatcctaagagggtcaagaggattctggcaaatcggcagtcagcagcaaggtcaaaggagcgcaagatgaggtacattcaggagcttgagcataaggtgcaagtgctgcagacagaggctacgacactctcagcacagttgacaatgctgcagagggactcagctggactggctactcagaacaacgagttgaaaattaggctgcaagccatggagcaacaagcacagctgagagatgccctgaatgaagcgttaacgggcgaggtccagcgtctgaaactcgcaactggggagatgaccgatgggcctatgccgaagggcctgcagcagcagatgaactcccagatgctgcagctccagcagctgcagatccagcagcaggcgcccccacaacagacgcagcagcaaggccagcgacaacagccgcagaagtcggcgtaaagaccgtggctgagaggaggacgcggaagcgaattgagcattggccaaggccaactgaaggatgccgggtgggaaaagaaagaaccccaatcttttgccgtatatatatattatcagacaggttgtaggatagcagcaacagcagtagggcgggcgagggaccccgttggccccgcgcgatttgagttgttttcgccggataccgtaaccttagctggagtctgtcgtcgtcttggtgtcgtgcctgcctgcctagtgttgatgaggcgtcttggtagcgtcccttggaacgccctctcggagccggaggtgcttcttttgcttcttttgtctatatagataattatatgtgcatgggaacctgcgtagtactgcagttattattattatcattgttaatttattaaaaaaaaaaaaaaaaaaaaaaaaaaaaaaaaaaaaaaaaaaaaaaaaaaaaaaaaaaaaaa

SEQ ID NO: 8658 - DNA, 1705 bp, Zea mays
  Predicted polypeptide sequence is orthologous to G1050
gcacgaggcgccgacgagcggtcagccccaaacccagacacagtcacagcccccgctccccatggacctcgcctcccagtaccaacgcctctttgcaccgtcggtgttcctcccaccgatggcgcccccgccgccccgcctggcgtccagctcctgcttctcggccttcagcaactatcagagcctaccgacgctcgcgcccgcggtgggcgccggatcgcatctcgctcgctcggtacctaagccgccgctcttctcagtggactctctagctccgcttccgtactccaccggtccagcggcgagggcagcggcaggggcggcggtcccgcgttccccgccgtccccaggcagctccgagctgcaaggcccgtccgcgtccggcctgccgccgcgtggggcggggcaccggaggtcccgtagcgatttcctcgtcgggttctcgggggcgaaccagctgcccctgccgatgactcctgcggctggggcgtacaggccgagggacgcctccgcactggaggagctattccgctcatacagggatccgaatctcggctcccccggggataacaataatgaaaggaacgatcacttaagtagacaactgaccggccaacgcgcttggagccccggtgatagcagcgacaacgaggctgagagctgggcggtcagtggcagcgcagacaccagcgctagccatcctcgccattgccgcagcctgtcggtggacagcatcatggccaatctcaactttggaggcctggaccaggtttctctgagagtgccacctctgtctccagtggcaggcgccagtgccagcctctcgcgcactggaaccggagcatcgggcggtgcggttgcgcgctgcttcttctgaacttaccaacggagagttcagcgaggctgagatgaagaagatcatggccaatgatcgcctcgctgagatcgctctttctgatcctaagagggtcaagaggattctagctaatcggatctcggcagcaaagtctaaggagcgcaaggtgaagtacatgggtgagcttgagcgtaaagttcgtgtgctgcagacggaaactaatacattatcttcgaaagcagcattgtcgcagagggaatgcgaggcacttcgaactctgaacaatgagatgaagatcaggctgcaagcaatggagcagcaagcacagctgaaagatgctctgaatgaagcactgacagctgaagtgcagcgcctgaaacaaatggctggcgaggccagtgatcttcatgtgccgaacggttcgcatcatcatatgaaccgccagattctcgaacagctgcagcaggtacagaagcggccatcagaggcccagcaggctcagcagcagccacaggaaccagagcagttcaaagctcagtaaaagcagtggacccattaagacgaatgatttcccaaagcacatgcttgaaggtcaaattcatactgcagattcatgaagggataccttgtgttcccggatattcgttttttttcttaggttttagaacaacagcggttggatattcccccttttgcggtttattgctaagttatttggttggacgttggtagtaatgcctgggtggattcttgttgtacaaacttcccgtctctgtaatttttctgctagatttttttttaaaaaaaaacatttttaggtgcaaaaaaaaaaaaaaagaaaaaaaaaac

SEQ ID NO: 8659 - DNA, 831 bp, Zea mays
  Predicted polypeptide sequence is orthologous to G1050
cgatcgggagccaccgcccccgccactccaccgcacccacacgcagcttgtgcgcgcgcggcctcctcgactcgacatgaacaccacgaacgggcacgggctgatgcaccaccaccacgtccaggcgtccatggctccggcgcagcaccagaagcagcggccgggactgccgccgcccgcgcccgcgcccgcgggggcaggctcccactctctgcacgccgacatgtgcgtggacgacagctcggcgccggggcgcgcgcaggcgctgggaggcctgccaccgcgcaaggcgcaccgcaggtcccgcagcgacgtcgtcccctacgggtacttccagccgctgccaccgccgtcgccgtcgcccaaggtggaggccggaggctggggcctcgccagcggcggcggcggcggcgccggcgacgacctgctcaatgcgtacatgagcatggagggcatggacgggctgaaccactccgacggggatagccgcgggagcagcggcatgcgcaccaacggagccgacagcagcgagaacgagtccgaggactacggcgccggcgccgacagccagttcttcctctggggcgacggtggcaagaggaggaggaatgcctccggagagcccgccgcgccgccggcggcggcggcggcggcggcgaggcacgcccggagccactccatggacagcctcatggggaagctgagcttctccgccaatggggagcccggcaagttcagcctggacttcggtggcggcgagttcaccccggccgagatgaagcggatcatggcccgacgagaagctcgcggagatggccctcgccgacccca

SEQ ID NO: 8660 - DNA, 780 bp, Zea mays
  Predicted polypeptide sequence is orthologous to G1050
catggtgcagcaaacgctggggatgtcgctgccgatggcggcgttcgtgcccgagcagggcagcgccaataggctgaccaggccgccggggctgccgccgctgccgcaggcgttcgcggcccagcagcgcggggacgtgtgcatggaggccgtcgaccccgcggctggcccgcgcaaggcgcaccggcgctcccgcagcgacgtcccgttcggctacttcccgccggcgggccaccaccagctcccgccgcccaaggtggaggccggctggggcggccacctccccgccggcggcggcggcggcggcgacgacgacctgttcaacgcgtacctcaacctggaggggctggacgggctcaactcctccgacgaccgcctcgacgacggggacagccgcggcagcagcatgaggaccaacggcgccgacagcagcgagaacgagtcggaggagtgcgccgccgacagccgcgccgggatccgcctctgcgccgccgctgccgacaggcgggaggggctcaagagggccgccgctgcgcccgtggcgcgccacgccaggagcctgtccatggatagcctcatcggcaagctcaacttctccgccggcgcgacgggcgccgctagcggcgtcattccgggacccaacaggttcagcctcgagttcggcaccggcgagttttcgccggtcgagatgaagaagatcatggccgacgagaagctggccgagatggcgctcgccgaccccaagcgcgtcaagagggtgctggccaacaggcagtcggc

SEQ ID NO: 8661 - DNA, 1407 bp, Zea mays
  Predicted polypeptide sequence is orthologous to G1050
gcacgaggcgccgcgcgcagagcgacatcccgttcggcttcgcgcagctcagcccgccgctgcccccgccggcgccggtcaagcgcgaggtcaccgctgcggccgacggctgcagatcggacggcggcggcggtgatgacgccgccctctacgacctcgtcaacgcgtacatggacctggacgggctggacccgctcaactcgtctgaggaccgccacgacgaccgcgacagccgtgccagcggcacgcgcgcggggagcgcggccgagagcagcgagaacgaggcggagagccagtccacgtccgcggacaggaaggacgggggcaagtcccgccattgtcgcagcctgtccatagacagcttcatgggcaagctcagcttcgccgcaggggaggagtctccgaagctgccgctgccgtctcctggtggcagcctcaccaggagcgggagtggctcactggaaggtggtgctgttgcgctgttcaatatggagtttaccaacggagagtttaccgactccgagaagaagaaaatcctggcgaatgagcgacttgctgagatagctctgacggatcctaagagggtcaagaggattctggcgaatcggcagtcagcagccaggtcaaaggagcgcaagatgaggtacattcaggagcttgagcataaggtgcaagtgctgcagacagaggctacgacactctcagcacagttgacaatgctgcagagggactcagctggattggctactcagaacaacgagttgaaaatcaggcttcaagcaatggagcaacaagcacagctgagagatgccctgaacgaagcgttaaccgccgaggtccaacgtctgaaactcgcgactggggaggtaaccgatggtcggatgccgaagggcctacagcagcagatgaactcccagatgctccagatccagcagctgcaggttcagcagcaggcgccccaggcacagcagcagggccagcgacagcagcagcagcagcctcagaaatcggcatagatcaggtcaggtcgagagaaggacgctgaagctaattgagcttgagcatgcccaattgaaggatgctgggtggggagaaaaaacccgagtcttttgcgtatatcagacatgttgtaggatagctgcaatagtagggcgacaggcaccgttggtttcgccgagtcaagtccctccccccgagtatgtcgtcttggtgtcgtagtcccatacatgattgcctgcctgcctgcctattgttgaggcgtcttggtagcgtccctgaacgttctctcggaggtgcttcttgtgttcttttgtctaagagggctagggtgtcacaaatgtccccccgtcctagtgtaattattatctatagcgcaccttcagcgtcaaaaaaaaaagaaaaaaaaaa

SEQ ID NO: 8662 - DNA, 619 bp, Zea mays
  Predicted polypeptide sequence is orthologous to G1051, G1052
gcaaaagaatttcaatttaaaaaactccgatacaaatgttacattgttactacgttagagaacaaaaacggtagctgccctcactatttacttgggccaccttgctaattccactacactgaacctgccaatagtaagagatctggtcacaccgaaggaaaaagaaaaagaaaagaccctacgagatgtaattgttcaaaaatgatttacatgacagatgaattatcctggtgatttcaccacaacttgcacaattaatacaccaaatccagatcaacatacaaagaatcaatgcacatgttaatggaagaataagaagaccaaaaaaataaagaggaagaaaacatccacagaatctgggaaaaaaaatcatgatgcaatgttccctccatgttaatgataagtcggactgcacatcgggcacggatggactggctcgctagctcatgagctccttctcagcgcgcaccaccggtggtggcggcccatggtcagaagcggcggcgccgccggctgacatcctgaggttctgctggtcgtagacccggcgcagcctctcgatctccttcttcagctcctcttgatgagctgaagaacgaaatacatatcccaacacaat

SEQ ID NO: 8663 - DNA, 933 bp, Zea mays
  misc_feature (770)..(770): n is a, c, g, or t
  Predicted polypeptide sequence is orthologous to G1051, G1052
gctcgtctacgaccagctcatgtccatgttccccgacgaggccgccgccggcggcggcggcggcgggtcgtccgcggcagggtccgagaacaacggcggcagcagcgacagttacggcgataggcgcggcggcggtggccctgcggcgggaggcaccatcaccaccaccagctgcaatggcttcgatggtggcgagcacaacgaagccgcggacgcgcaggcgacggggcaagctgccgccgccgccgccgcctccactgagctgatccgggaccccaagagggtgaagaggatccttgccaaccggcagtcagctcataggtcgcgggtgaggaagctgcagtacatctccgagctcgagcgcagcgtcacaacactgcagaacgaggtgtccgcgctgtctccccgtgtggcatttctggatcagcagcggaccatactgaccgtcggcaacagccacctcaagcagcggatcgcagctcttgctcaggacaagattttcaaggatgctcatcaagaagcgttgaagaaggagatcgagaagctgcgcccggttttccagcagcagaaccttaagatgttagcccggcgctgctgcctctgaccatgggcccgccaccggtgcccgcggggaaagacctcttgagcttgcttcccattccatccccgcgctgccccctgtgcagtgccaccccccccgccttttttttattttacttggagggaacttggctcacgaattctctttttttcggattttggggaaggtncttcttctttctttcttcttccctggccaccggggccttaatcttttgtttttgattttgggaattgggtccctggccaattttggtaaatcctttggaacttttttgtgggaaaacaccttcttgacctccccttgtacattttcattactaataacaaaaa

SEQ ID NO: 8664 - DNA, 734 bp, Zea mays
  Predicted polypeptide sequence is orthologous to G1051, G1052
gcactccaccatccagcttcgcatcccgcaagttcccagtcagccgagcagccagcggcggtgccaagaaggccgagctgcgagctccactccccacacctcagaagaaaaaggtgatggcgcaactgccgccgcgggcgccgagcgccgcgccgcaggaccactggccgccggcggcgggggagttcctgggcttcgccgcggccaggcgcggcgcgcaccgccgctccgcgagcgactcggccgcgttcctcgaggccgtgcccattgacgacgacgtcgtcattggcggcggcggcggcggcggcgacgacttcgaccgcctcgaccacgaccagctcctgtccatgttctccgacgtcgacgtctccgtctccgtctccgtctccggcagcgccggggagagggcgcagctcatggacgcggggggtgcgggtgcggacgacggggtggcggactcgtcgccggctgccgcggacggcgtcgctgagcccaaaagggtcaagaggatattggcaaacaggccagtcggctcagaggtcacgagtgaggaagctgcagtacatctcggagcttgaacggagcgtcaccagtctcccagatggaggtgtcggcgctgtcccctcgcgtggccttcctcgaccaccaccgctcactgctcaccgtccgcaacagccatctcaagcaaagaatcgcggcgctcggcccaggaaaagatctttcaaagaccctca

SEQ ID NO: 8665 - DNA, 864 bp, Zea mays
  Predicted polypeptide sequence is orthologous to G1051, G1052
ggcgatgtcggcgccgccggtggtggccaccttgatctgctgctgctgctgctgctgctggtacacatggcgtagccgctcgatctccttcttcagcgcctcttgatgagcatccttgaagatcttgtcttgggcgagcgccgcgattcgttgcttgaggtggctgttgccgacggtgagcagcgatcgctggtggtcgaggaaggccacgcgaggggacagcgctgacacctccatctggagaccggtgacactccgttcgagctcggagatgtactgtagcttcctgactcgtgacctttgcgctgactgcctgtttgctaatatcctcttgacccttttggggtcagcggcgacgccgtccgcggcggcgcgcgacgaggcggccgacccgtcgtcgtccgcgtccgcgtcggcgtccgccacgtccatgagctgcgccgcgtccccggcggagacggccggcgcgtcgacgtcggagaacatggacatgagctggtcgtcgtcgaggcggtcgaagccgtcgccgccgatgacgtcttccatgggcagggcctcgaggaacgcggccgagtcgctcgccgagcggcggtgcgcgccgcgtctggccgcggcgaaccccaggaactcccccgccgccgaccagtggtcctgcggcgcggcgccccccggcgccctcggcggcagctgcgccatcacctttgtttcggccggggtcggagagtggagcgcgcggcctgcttcttgccggcaccgttgccgctgccgctggtcctgccgatctgggtgcttgcgatatgtgaagctagctagctgtgtgtatatggtttattggttgcaattgccaatgcaagcaggcaggca

SEQ ID NO: 8666 - DNA, 886 bp, Zea mays
  Predicted polypeptide sequence is orthologous to G1051, G1052
cgcgtgttgcgttgattcctcgggtcgaaccaacgcgcggcgcggggtcccggtcgcggccatggcgcagctgccgcccaagatccccaccgtggcgccggcgtggccggagttcgggggcgggcaccagcagcagcgcagcccctccgtgggcacgttcctcgccgccgcgcccatgcagccgtcgtgggtggacgagttcctcgacttctccgccgccaagcgcggcgcgcaccaccgctccgtcagcgactccgtggccttcctcgagcccgagcccggccccggcgacggcaatgccggggcgcatgacttcgaccgcctcgacgacgatcagctcctgtccatgttctccgacgacctccaaccgccgccgccgcagccgcagacgcaggccgcgcccgcgccggtggcgagctcgtcgtcgccgtccgaccacaacagcatcaacgacgagaagacggataggggcgacgccgaggaggcacagagcaagtgccacggcgccgccgccaccgccaccgcggtggatcctaagcgcgtcaagaggatcctggcgaaccggcagtccgcgcagcggtcgcgcgtgcgcaagctgcagtacatctcggagctggagcgcagcgtcacgtcgctccagacggaggtgtcggcgctgtccccgcgcgtggcgttcctcgaccaccagcgctcgctgctgacgctggggaacagccacctgaggcagcggatcgcggcgctcgcgcaggacaagatcttcaaagatgctcatcaggaggcactgaggagggagatcgagaggctgaggcaaatctaccaccagcagaggcttgagagcggcagggagcccgacgcggccccgtccgtccccgacgacaaagaaatg

SEQ ID NO: 8667 - DNA, 797 bp, Zea mays
  misc_feature (7)..(7): n is a, c, g, or t
  misc_feature (26)..(26): n is a, c, g, or t
  misc_feature (651)..(675): n is a, c, g, or t
  misc_feature (681)..(681): n is a, c, g, or t
  misc_feature (683)..(683): n is a, c, g, or t
  misc_feature (700)..(704): n is a, c, g, or t
  misc_feature (706)..(713): n is a, c, g, or t
  misc_feature (721)..(725): n is a, c, g, or t
  misc_feature (729)..(730): n is a, c, g, or t
  misc_feature (738)..(739): n is a, c, g, or t
  misc_feature (743)..(743): n is a, c, g, or t
  misc_feature (749)..(749): n is a, c, g, or t
  misc_feature (752)..(755): n is a, c, g, or t
  misc_feature (761)..(761): n is a, c, g, or t
  misc_feature (766)..(768): n is a, c, g, or t
  Predicted polypeptide sequence is orthologous to G1052
tactggncaccccagttccggtccgnattcccgcgtcgaccccgcgtccgttcggcatattaggtagatgcttccatgtgaataccttatggtggctgatagtttgtgcaattgaagattctggggagagcacccaggcatggtggacttactgataagctgcactgccatatgggcattgctgttgtcgttaaaaggcagcagatgctagaatgatttttttgtggaagattcgaaaatgattaatttggagagaaaaggtacaaaatagcattctagcgtgtgacaccggttcgataatggcaattgggcgaatcccaattgtgcgggatggtaaacaagcagaacctaagtttgcggtacaaaacacattctaaagagaaggatcagggactgctgacagcaaccttacccaggagggattcccctgttccggtcgcctacatcttcccccggcgatgctcaaggccaagcgagggagagacgaacgtgagaaagtctccagactctggtaggttttcagttgtgttcccattcatttagatatataccatggaccccacatgtcattgactcatgtggacccacatgtaagttagataataatggtatggatccaaagtggtgatcttttaatggtaaaaaaaaaannnnnnnnnnnnnnnnnnnnnnnnnaaaaananaaaaaaaaaaaaaaaannnnnannnnnnnnaaaagggnnnnngttnnaaaagaannaaantaacanccnnnncccttncaaannnaaaacctttatttaatgtcccccacatcc

SEQ ID NO: 8668 - DNA, 798 bp, Zea mays
  Predicted polypeptide sequence is orthologous to G1053
atagtaatcctagtccacaattatatcagcatatgagatgtgagcttcattgcttaactaggactacaaccagagttcaacaatcttagtgcatgtgcaccagaggacactcgttgctaataatgtcatcagtttgacaggacatctgcaacatctagataacctttttgcagatatttcaccaaaatatagacccactacagggtgcggtagtcttatgagacccagaaccgtccgagccatacatactgctgtgctggatcatgtgcagcttggaccaaaatgaaaacctagtcaaacacacagtagagctatgttacaagggaaacctggtcgtcgcctttagaacctagtcaacatatgggccccttccaaatcgctttgcgtggagtcggacttttgtcaatcttcctaggcataccaggaaacgccttagatggtggcaacatcaccccttgcattttcggcttattgggaggaacattgtggggaacggcacaatgatattttgatgtaaccgccgcattctttttatggatcaagtcatttggtacttctgtcttcttttgtagtatattggctggagtctgattttcagctacaattgattgaaggccacccttggctgattcacatattataccctttgcctgagactggtaagctattacagtctgtctcaactcctttacttcacgttccactcttgccaatcgttgtttagcacaaatatccacatcatccattttctccaaatgatcaaccaaaagattattctcattttccactcttaacttt

SEQ ID NO: 8669 - DNA, 839 bp, Zea mays
  Predicted polypeptide sequence is orthologous to G1062
ctgaggccaggcaaagactctccgccctcccactcccacctcgccacctcctccttcctcgctcccaattttctttttttttccccttccccttcggcgcggcaggattttctccatctgctttccccatttccgccgtattttattcgatttcgaggtcggttttctgttgcacagggagaaaggtgggttctttgcgccgctgccggcctcggacttcaacgacgccgggatgagctgggacgacgaggacgagatcgaccaaagcgtcgacgcctcctcgatggccatctcggcctccatggagaatgctgcgggcgcggtggcgggggcaagtggcgccggcggtggcagcgggagaggcaagaagaaagggatgccggccaagaacctcatggcggagcgccggcgtcgcaagaagctcaatgaccgcctctacatgctgcgctcggtggtgccgaagatcagcaagatggatagggcttctatccttggcgacgcaattgagtatctgaaggagctcctgcagaggatcagcgatcttcacaatgaacttgagtcagctccgagctcttcgcttgttggaccaacatcagctagcttcaacccatcaacaccgacattgcagacatttcctggccaggtcaaggaagaactttgcccgggctcattcccaagccctactggacaacaagccacagtcgaagtcaggatgagggaagggcatgcagtcaatatccacatgttctgtgcgcgtaggccaggcatcctgctgtcgacaatgacggccctcgacagcctaggcctcgacatcgagcaggcggtcatcagctgcttca

SEQ ID NO: 8670 - DNA, 772 bp, Zea mays
  Predicted polypeptide sequence is orthologous to G1062
gggggcttcctcgggcggcggcggtgacacggtgctggacgacgccgacgacgacgacggcgggagcatcgacgcgtccgggctcaactacgactcggaggacgccaggggcgttgaggacagtgggaagaaggacggcaaggactccaacgccaacagcacggtgactggcggcgccacgggcgacgggaagggtaagaggaaggggttgccggccaagaacctcatggcagagcgccgtcgccggaagaagcttaatgaccggctctacatgctccggtccgtcgtgcccaagatcagcaagatggacagggcctccattctcggcgacgcaatcgagtacctgaaggagctgctgcagaagatcaacgatcttcagaatgatctggagtcgtccccttccacggcctcgctgcctccgacgcccacaagcttccaccctctgaccccgacgctgcccactttaccgtctcgcgtgaaggaagagctgtgcccaagcgcattgcctagccctacttctcagcaaccgagggttgaggtgaggatgagggaaggccgggcagtgaacatccacatgctgtgcgctcgcaggcccggtctcctgctctctgccatgagagcgatcgaaggcctcggcctcgatgtccagcaagctgtcatcagttgcttcaatgggttttccttgtacatcttcgaggccgagctgtgcaaggaaggccctgggcttctgccggaggagatcaagcccgtgctcctgcagtccgctgggttc

SEQ ID NO: 8671 - DNA, 566 bp, Zea mays
  misc_feature (510)..(510): n is a, c, g, or t
  Predicted polypeptide sequence is orthologous to G1063, G2143
tttttttttttttttttttttagctagctacccagaatgattaaattacgatcagatcaaaattacctctgatctctctatagttcatcatctccatccaccaatccatcgatccaccaccacaccacgccaccattgatcgatagagacagactatattgattcctagctagttaatccgatccggtacaaattaaggaaaggaaaggaagctcctaccactatcgaatttcctctcctcgctcgatcgctcagtgcattccatggctgctctggccgccggcgctgctgaacccgaaccctagcgcggcgtgggcgccggcgccgcccatggacgacgaggacgatggcgacgtcggcccgtggatgtcgacgggcctcacgagcccggcccagacaatgagcggcaggccgcccacggccgagacgctgggcccggctcctgctccggcggccgcgggcgccgggggctggagctcctgcacctggcgcttgaggaacttgatgtancggatggcctggtcgagcatggaggcggtgcccatcttggtgccgtcgggcacgaa

SEQ ID NO: 8672 - DNA, 615 bp, Zea mays
  Predicted polypeptide sequence is orthologous to G1063, G2143
tttttttttttttttttgaagaaacactgatggatatatagagagagagagagataaaaaaggggtagtacaatgtaaatgtacagcctacgtagggtagaccagcacgtacacgtactcatcgatcacgcgcatgcacgggctgcgactccaacaaaaaattggagcagccacgtcgtatgccgtatgcggctacagcaggcaataaatgtatcaaggatcctacgtctttacacaggcatgcgatcatgcgctagctagttcacgatgcagtgcacacacacacagacaacgctacaagagcatcggcagagaggccggccgtacgtcgtcgtcgtcccgtcgagacgccaacaacggagagcgctggccggccggccggccgaagcgctagcatagctcgatggtaacgatcgaccggcacgcgcgcgcgttcgtctgtcgcgcgcgtcgcgttacatgtcgccgtggggcagcgcgtactgccacggcgcgtggaatgccgggtaggcggcggcgccgagcgcggcggctctgtgggctgcgcgctccatggactgcacctgggacttgaggaacttgacgtagtggatggcctcgttcagcatggacgcc

SEQ ID NO: 8673 - DNA, 680 bp, Zea mays
  Predicted polypeptide sequence is orthologous to G1063, G2143
gaccaagtgctggctagctagctgtatatagctagtagctagaatgattatattatgattgataaaatccaaattacctctgatatgatctctagttcgtcatctccatccctccctccatcgatccaccaccatctatcatggatagattaatggttcctagttaatcccatccgctacaaattaagcaaaggaagcaccttcaattaatcccccctccttggtcgctcgctcatcagtgcattccatggctgctctggccaccgccggcgctgctgaagccgaagcctagggcggcatgggcgccgcccatggacgacgaggacgaaaacgacgtccgcccgtggatgtcgacgggcctgacgagcccggcccagtcaataagcggccctggacccagcggcaaaaacggcggcacgccgccgggtcgccctggcgccgccgagcccacgaccgaggtgctgggcccggctccggctgccgccgggtactgctggtgctgcggctgcggcggttggtgctgcacctcctgcacctggcgcttgaggaacttgatgtagcggatggcctcgtcgagcatggaggcggtgtccatcttggtgccgcccgggacgaggcgctgcaggatgcggatgcgctcgctgatccgctcgcgccggtgccgcgccgccccgctctga

SEQ ID NO: 8674 - DNA, 730 bp, Zea mays
  Predicted polypeptide sequence is orthologous to G1064
aaatcgaactctgtgcttgcaatatatagaatgtgaaggagccagagaaggctataataacgcaaaccgaagaaaacgcaaacgataagtcaagagaagcgcagattaaaaacaggagcgacgccttagcggaccagtgcatgcacagcacaagcctccgagaagacctacgagtcgtcgtcgctggggctcatgctgtcttgtcgctcgccgccgccacgctgctgctgctgactagagccgccttccgctccgttctgcgccgccggcgcagccaccgtgacggcatgcgcccggtacgcgttgagcgcggcgaggacccccatgtggccctcgcctccgctgctgctgccgccattttcgtggccgatcccgagctgctgcccaccgggtatcagcgccatcggggcggggaaattcatgaaatgtagcccactcggcacgccgcggtacacgggcgccgcgccgccgtcgccgcttcctggttgcggcgggaacgtccagatcgactcgttgttgctgctgccgcctccgccagccgctgctgcggcctgagcgttgctgctcggcaccatccacacggttcctggcatttggctctgcgtgtacccggccatctgctgctggtattgctgctgctgctgctgcatttcttgctcccaccgccgtttcttcgacaggtcggagttggcggcagcagacgacgacgacggtgatgacacgtcaaggc

SEQ ID NO: 8675 - DNA, 915 bp, Zea mays
  Predicted polypeptide sequence is orthologous to G1064
cgttccacgctctcccaaacaactaaaccactccatttacccggccggctagaaaacatacacgccaagttatatgcatctatcgccgtgtatatataccatggcctaagtgaccatggacgtcgccggtgacggcggaggaggcggccaccgccccaacttccccctccagctccttgagaagaaagaggagcagccgtgctccagctccgctgcggtgggcacgtcggcgggaggcggcaacgggaatggatcgggggccggaggtgaggcggcgcaggtgcggaaggcggcgcccaagcggagctccaccaaggaccggcacaccaaggtggagggaagggggcgccgcatccggatgccggcgctgtgcgcggcacgggtgttccagctgacgcgggagctcgggcacaagacggacggcgagaccatcgagtggctgctgcagcaggccgagccggcggtgatcgcggccaccggcaccggcaccatcccggccaacttcacctcccttaacatctccctgcgctcctcgggctcctcgttctccgccccgccccacctccgcggcgcccccttattgcctagccccaccagcgccgccgcccggttcggcggccgtgctgacgcgtgggaccgggtcgtcggccttggcttccctcccgagggcccggcctcgtcgtcgtcgtcgccgtcccctctgctgcttaacttctccggcagcgtcggtctcgacgtgcagccgtcgccgtctgccgcagccgcagccgcagccgccgatatgtcgaggaagaggcggtgggaacaagaaatgcagcagcagcagcagcaataccagcagcagatggcggggtacacgcaaagccaaatgccgggcaccgtgtggatggtgccgaagcaacacgtcgccgcagg

SEQ ID NO: 8676 - DNA, 914 bp, Zea mays
  Predicted polypeptide sequence is orthologous to G1068
tgctgagccccttgcagtgctgggaggagaaggacaaggtctctgatcagctcagcttgtctggtcaaagctgagagcctcgttgtgctgtgagtgcaagctcgaccgacaggacccctgccactgtgaagcacagcgtcagcggcgacaagacgaaggggcggaagctgccaagccgatagatctacgcaaatggagaccaaggacgtgtcgccgctcgccgccgccaccaccaccaccgcggcgcccgtgcctgcaccgacctctcaaccgcctccgccggccccttcttctatggcgccgccgcagcaccagcaccagcaccatccgccgccgccgttcgcgcagcaggcggccccggttccgtcgcctgccgcgtccatgcccggcggcatgcggctctcgttcgaccagatgtccgggaaggcgcccggggagcagcaccaccactccgcgcccatgctgtacacggtgccaccaccgcagtccgccgcgggcgcgggcgcaccgggggccaatgtgctgggcatgggcgagctgatgcgcaagaagcgcggccggccgcgcaagtacgcgcccgacgggagcatggctctggcgctggcccccatctcctccgcctcagccggcggcgccgcagcccccggacagcagcagcacggcggcgggttctccatcagcagccccccgtccgaccccaacgccaagcgccgcggccggcctcccggctctggcaagaagaagcagttcgaagccttgggctcctggggcatcgccttcacccctcacatcctcaccgtcaaggccggcgaggatgttgcttcaaaaataatgacattctcacagcaaggcccctcgcacagtctgcatcctttccgcgaatggtgcaattagtaatgttacactttgggcag

SEQ ID NO: 8677 - DNA, 433 bp, Zea mays
  Predicted polypeptide sequence is orthologous to G1078
cttttttttttttttttttttttttttgacagggaaaaacatccaggagccttctcctatattccatcactctactttgagctatatattatattatattatattttgcagtttccctatataagtaaactactgaatcacccagagagagaaaggatggtctcttggtaattctggtggggcaagaggtcctaccgcactgacccagctcggcggcacaccacgtcaagagcttcaaccactgtccctgagaaaccggctatggcttggaatatacccggcaggcctgtctggatgttgttcagcgtcattgaccgcgtgacctcgatggccttagcgtgcctcgccatctcgtcctccaccttccgacggcactgggcgatctcggttttcttctccgcaagaggatcacgggcgtcgtacgcgtggctgt

SEQ ID NO: 8678 - DNA, 1295 bp, Zea mays
  Predicted polypeptide sequence is orthologous to G1078
ggcacgagggagaatctttatgacgaggagcaaccactctacaagttaatcaaggatgaagaatttgcaaggctccagtataagaaacatgtctcagtgctacaaaagctggaatcaggagggcatgatagactgcatgccgaaagacttcgggattctattgaagaactttatactcggataatctggttggaagaagctgtgagtttggcatgtttttccatatcaaatctcagagacgaggaattatatcctcagatcattgaattatctgcagggcttgtgcatatgtggaaaaacatgcacgagtgccatcaggtccagaaccatattgcccagcaagttagtctccttggcaacagacctgggagtgaaccaacaagtgacactcatcgccaggcaacatctcagctggaaattgaggtgtctggatggcacactgccttctgcaatcttatcacatcgcagcgtgaatacgttagcatccttagccaatggattggtctcacagactgccttccggatgatggtggcttaatgagaagttcatctggaatccttagcctctctgaggaactccagcgtgctcttgacaggctaccagagaaggtagcagctgaagcgataaagacctttatgtcagtcatacactctatagttgtacagcaaagtgaagagcgccaactaaagaagaagtcagataacatggatagcaagttccagacccagttagagaaacacagtgaaaatacaatgcaaaactcggcccagcctccaaataagaataactattcagcatcaaagaatggaacgaaactggatgcatttataaagcaggtcgaggaggagaaagccagatacctaacctctgtgagggtaagccgagccatgacactgaacagtctgcagacaagccttcgaaatgtgttccatgctctggagggattctcaggagtgtgcgtacaggcatttgaaggtatcagcagatgcagtgaagttgctgttattcactcgggagcagcttcacctgctatttcctcgtgaccttgcttcaatgactgtgattattcattgtaagtaggcaaaggataaactggttccacgtgaatacccttcgcttctaattttcagaactttgaatagctttcgggggattatgtgaagtcaatataggcataatagtcttgaatacatcacaatgtctcaacttacattttggttcttattgcatgggatgtactgctctgtacataatcatttacattttgaccgaaccaaaaaaaaaaaaaaaaaaa

SEQ ID NO: 8679 - DNA, 594 bp, Zea mays
  Predicted polypeptide sequence is orthologous to G1078
gcaaggcaaccttaatgtctgtacattataaatctctcccctcccactccccccaaaaaaaggaaaacaacaaatcctgggcaaaatcacattatctacaactacaactgaaaccatcctgggacagggcaaaacatccggggaaccatcttctatacttgaccactctactttgagctatatatataatatattgcagtttccctatataaataaactactgaatcccccaaaaaaaaaaaaaaaaaaaaagaggcagcaaatggtctcttggtaatcctgatgggaaaaaacttcttctaccgcacaaacccagctcggggggagaacacatcaagaacttccaccactgtcccccaaaacccagctatgggttggaatatacccggcaggccggtctgtatgttgttcagcgtcatggaccgcgtgacctccacggccttggggtgcctcgtcatctcctcctccaccttccggggggactgggcgatctcggtcttcttctccgcgagagggtcgcgggcatcgtacgcagcgtggctttcgatgccatcccgcccgctgccggggaggccgaggccgaccatggagtaa

SEQ ID NO: 8680 - DNA, 810 bp, Zea mays
  Predicted polypeptide sequence is orthologous to G1078
aaccttctcggcgcgcagctcctctgtctacctcgcctccagctccactacatacgctagctagctcgcgcagctgcagcagcagcttagcaagcaaagaatgggggccgcctcgtcgcgggaaggggacgcggcgcgcgagcacacgaggcggtgccgggagcggcggcggctgatgcgggaggccgcgcgcctgcggcaccacctggcggcctcgcacgccgcctacctccggtcgctcggcgtcgtggcgtccgcgctcacgcgcttcgcggtcggcgagccgctcccggtgtccgaccacaccccgcccgccgtgctcgcgcaccgcccggtcgtcgccccctccacgccgccgccgctgctccgcgccatcgaccagccgcagcgcgaggaggcgcggggcggcgcttctgccggcgtcggcgtcggcagcggcagcgccggtgctgctgcaggggaggacatgatgaggatggtggtcaggcaccggagcctcgcggaggtcgcggcggggctggaggagtacttcctcaaggccagcgtcgccggagacacggtgtccagcctgcttgaggccagttccaccgccgagttcaacggtggctcacacagcttcttgggcgccctctgctgcctttcggcgccagcgcttgaccgcgtcgacagcatgggcagccggcagaggcacagcgccaccttgcagcagctcctggcgtgggagaagaagctccacaaggatgtcaaggtgccaacatatatataatcgaacccaattgcttttgcttgctaaaagtagtcatgaaggca

SEQ ID NO: 8681 - DNA, 880 bp, Zea mays
  Predicted polypeptide sequence is orthologous to G1089
ccaaaggatctcaagaagacaaggacaccgtcgagtcgccgccagtcgctcgatggggtgcgggcagtcaaagatcgatcaagaggaggcggtgtttcgatgccgggagcggaagcggctgatggctgacgccgtggcctcgcggaacggttttgccgccgcccacactggctacactgtccgcctgaagagcaccggcggcgcgctatccgatttcgcccaaggcgaggcgccggaccctagcctggtgtcctcccatacccaccacgctccggctgtggcgacgtcatctgtctcgactccgccaggcccctccgcagcttccgtcaacagcccctccccgccgccgccgccattcgccgacttctctcattctagcctccaaagatcctcatccacccccaacattcctatgccggagccgagggccgcagccaaaaaccgccctcctgccgatgcttctatccgagaggaggatgaggatgaggatgaggaggaacaggatggacatatcaagatcgatagcgatgacgacagtgacgacgacagtgacgaagacgacgatcaccatgagcatgacgatgttagtgtggatgacatggtgcatggacaacaatcaaagcggattttgatgagtagtgtgggatcttctccagtaacaccacctccgcctccaaggttgaaccacaccccaccaacgcttgccacagcaacgccaccgcccccggtgctggagtcacagatggctacctgggactacatctttggcccaactccccacccatcacccaccctagagcagcctgctgctgatactttgtggatggaaaggcgtgataaggagccagtggctgaggtgaaggcacttgtggcaaaaaca

SEQ ID NO: 8682 - DNA, 829 bp, Zea mays
  Predicted polypeptide sequence is orthologous to G1095
ttctcatcgtttttaatttccatcacctgcaatgcaactgcagcccacgccgcgtggtcaaggtacgctgaccgacaatgcctcacgcctgcagctgccgctaccagcggcggtcacgggtcaatgggcacgttcacacgcacggctgactgcctgcctgccatgtcccgccgcgttcgccggcagttcgaccactactagtagtaccgaatgaggatgaatgtgcctgcctgccatctcccatccccatcaccctcctctgcacagactgcactgcactatccaactcggagctgcattggcactgccactgctgcaccgctctgcctacgcacgccacgccttgaccggttccagttccgtacatggacgcgcccacggcgtcgtcgccgtcctcgtccttccccggcacgagcttcgtggtcctctccgtctccatcgtcggcatcctcgccacctcgctcctgctcctggcatactacctcgtcctcacccgctgcggcctcctcttcttctggcgcccgggcatgcacgacgacgacgacgacgtcgccgccgggccgggccaccgccgccacgtcgtcgtcaccgtgcacgacgagccaccacgccggagcggcatggaggaggcggccatccgccggatccccacgttccggtaccgccacggcagtacgcgcctcgtgctggcggcggaggccaagcaggccgcgtgcgccgtgtgcctcgccgacttccgcgacggcgagaggctccgcgtgctgccgccctgcctccacgccttccacatcgactgcatcgacgcctggctccagtccgccgccagctg

SEQ ID NO: 8683 - DNA, 1326 bp, Zea mays
  Predicted polypeptide sequence is orthologous to G1108, G2394
ccacgcgtccggcacaacccttgctgccgtcctggtcgccacacggccacaccaacccaacacctcttcttcctccgctctcagcttaccccaccacaggcgagggaggcgactccttcctcgcggctgcccgctccggccccgatcgcatctcctttgcacgccacggcccgcggcccgcgcgcagtgtccatcggcacggccgtcctccgtgtgtgggggcgcatctggtgctagcttgccgggctagggtttggcttggcctcgtctaccgccccgtctcgtctgataggcacaggttccgtgcacgcgatcgtcgtctctccatccgttgtgactgcttgccgtcccccgcttgcttcgtcctgctacgggagggccactgctgccatcgcgtccaccgacgaatttccccacagagcattagagcaattatcttggagttgcagatctgtacctgaagattcatattgaaatctggaagcttctgctgttgagtacagagaaatatttcttgccttttgaggaagactgcagagcccctaaatgtgaaacttgtttcttttcttgtctactcctgaatgctgacgaactcagcctctcacgttacttagctgaaggtcgtactggtacagacaccgaggatggagcaagcaacaggtgtaagtggtcctgaacacataattgatattccaagggaaattggtcctcctgcttcggtttctcgtagtgctggtagagagaaccatgaagaatcgaatcctgtggacaggccttcaacaagagctctagtacctgccttgcaggcaccatcagcaataggtgctgtacctattacagggcatacttcaggcactaggagaaatgacaactatgttcgtcggcacagaagcccattgaattctggactgtggatttcaattgaagttattgttaactttagccagattgttgctgccattgttgttctttgtgtgtcaagaaaggaacacccacaagctccattacttgagtgggtcataggttacactgttggttgttttgcaacgttaccccatctctattggcgctatatacaccgtaatattgtaaatggtgagcatgagtcatcacatacacctcaagggtccgctcataacaactcaaatgaagcgactcatgctgcaagtgcatcagaacgccgcagaaatgctgcccgaaatgctgtgcttgctaatcctaggatcaatgcgctgtttgaccacttcaagatggccctggattgtttctttgctgtctggtttgttgttggaaacgtgtggatatttggtggccgtcttctgctgc

SEQ ID NO: 8684 - DNA, 1181 bp, Zea mays
  Predicted polypeptide sequence is orthologous to G1108, G2394
gcacgaggcaactgtggggaaaacactgatgctgtaactgctttggagctccttgggtaaaacctccatcttctcacattttgttccatttgagtttgctccagcagtccagctccatgtaccaacttgcgttttggtggaatccagtttatcacaaactgtgaatcagttcatgaattctggtgacagtgagtaataccttgtactagtctgtccttgactccttgtattcttttgaaactgtgattagtaccctgttatttcacattattggtgcttctaatcatgagtacatttaacgatagatgttcatcaatatttctgcacattaccactagctaaaatgtgaaagatattaagaggttcttggatgtcatctagtagtggctactgccatttctcactattcttttctgacctagtagtaatttggtattttgtctgtgcacatgataattagggactaatattgcaaaatgggacagcttgtttgcatgtttcaactccatttcaaagcattgatatttattcagcaactgatcactcttttagagtagtcaatgttgtattctggattttctacttgatcatttgttagtgagctcactcatagcagatcttacctttagttaatactccattccaaattataagttgttctggctttttagatacatagcttttgctacgcacctaaatacatattatgcctagatatatagtaaaagttgtgtatctagaaaagccagaatgacatattttggaacagggggagtagtatagattcaatcacatagtttttccctcttccatagcatgttaaatgtaacatctaataatattgatgcaggtgtgctgcatctgtcttacgaagtatggagatgatgatgagcttcgtgagcttccttgcacacacttctttcatgttcaatgtgtagataaatggcttaagataaatgcggtgtgcccactctgcaaaacagagattgggggtgtggttcgatctttctttggcttgccatttggccgccgccgtgtcgataggatagcggcaagaggtgtagctagctcaagattcagtgtatagaacaatgctgtttttccgcataaagagctctgctctgttgcaatggtttaaaaaaaaaaaaaaaaaaaaaaactcgagggggggcccggtaccc

SEQ ID NO: 8685 - DNA, 828 bp, Zea mays
  misc_feature (728)..(728): n is a, c, g, or t
  Predicted polypeptide sequence is orthologous to G1108, G2394
tccacttcttcctcttggtctggttcgggcagagcatccgcacctgctcggccgattaccccggcgttttctgttccctttcaccccgcgtgcgggcgctatccttcccgtggcgacgtctgggtgaccgctgccgcagccctacactaggttcctaggtattcgccgggcccttccccggcgacgagcacccaccatcttaggctacctctgtggggatcttctgtgaagcaagagaagttacctagcacacaactcaaagttcagtagattattgaggatcaacatttcagccatctgtatgttagttaatatgatggccgatggtaacatctggttagaaagatagaaactcattattgcgctacatatggtagtgcccattcgacataagaactaagctggacattggtagatccaagttattaatggcgcacacttcctgtgatggtgtacatcatgttataagtgtagcacatggggaaactgcatcaacatcaaccagtcatcaagatatgtgcagtgactcggatgaaccacatcaggaagataggctatcaacaagcacacaaaccctgtcatcagagtcttcgccatcaatatcaccaactgcttatagcaccagaaatttatcttttcctagaagagatagtatatatggtcatggaagaagtccatggaattctggtttatggatctcgtttgaaattgtcatgtacattgctcangttgtagctgctattgtcatcctcatcttttcaagacatgaacatccccatgctcctttgttcgcatggataattggatatacacttggctgcattgcta

SEQ ID NO: 8686 - DNA, 911 bp, Zea mays
  Predicted polypeptide sequence is orthologous to G1108, G2394
ggaaagaggaggaagaattcgagtccaagtcttggagctctcgctttaggcggccagggtggaactgccccttgcccgtggttggtgaggcgattcgtggtcgggagcttccgtttctcttcggaggtgaagtggatctgacctactgtaggggaaagagcaaagtacattatcttgtacaaatgtgcattacgctacctttatcataaaccaaatcatctctgtttctgggaacagcaaccagtaatttcccatgcaacctcttggttgatggatgttcttcctgttgggtcagaaagagaaagtcaaacagatagtcaccctttactcatggagcatgcgattggcatcccaaggcatgatgttgcttctacttcgacacctcatcgagacaataatgatggcatggatcaactgccccgtgattcagaaagttcttctggaacaactgatgcatcttactctccgaatgctcctctagcaaggagagatgataatcgccttcggcgtcagcaaagtctaaattctggcttctggatatcaattgaactagctgtaaatcttagccagattatagctgctatctgtgttctgtctgtgtcaaagaatgaacatcctcatgctccattgtttgagtgggtcattggttatacaataggctgcattgcaactcttcctcatctatactggcgctatctccagcgcaaccagctggccactgtgctagggtcaaatcagaactacgttccagacaacagctttgagagtagttcttttactgggatttcgccccctcctgtgtctgaagctggtgttgtaactgtatcaaatggagtcttgagaaacaatgtggttatcacaaatccaagggccctagcttttgctgatcacttcaagatggcgctggactg

SEQ ID NO: 8687 - DNA, 864 bp, Zea mays
  misc_feature (823)..(823): n is a, c, g, or t
  Predicted polypeptide sequence is orthologous to G1108, G2394
cgccgaggacgaggaccccccgacaacttacccggggggcagctacatttatacaaagtcgacgacggcaagaggataaacgagtcgaggagaaaggaacaaccttaaccggagcccccgttcccgctaggtagattaaaagttatctcaggtgcttcactaggaaaaaatgaagtaccttagttaagttttgtaacaaggatatttgatcagtgcatgtcaaaggagggtatcaaaccaacgtgtcatatgactgtctagcttatgaatgttgctcctgttttatcacccctgaaggccaagcacacaatcatcctttattgatggctcacactggaaacttgagccagcgtgatcacacaatcgatataccaatgagtgatggtatgaccgcatcaacatctcaccaggatgatcatagtggctcggatgagctgcatcgcagcagaggtccttcgaatgaagtttcaccaagcccagatacatcttccggtacaaacgatgtatctaactctcacaatgcatcctcagcaagaatagatcgaggccaccgtcaacagaaccctttgaattctggcttctggatctcaatcgaacttattgtaaatcttagtcagattgtagcagctgttgttgttctgtcagtatcaaggaacgagcacccacaggctccattgtttacatggcttcttggctatacaataggttgtattgctattcttccgcatctttactggcgttatcttcaccgcaatcgcctagacatggagcaggagatgccaccccaaaggtcgccaggaatgaacatatccgagattaattnctatgctgtcgtttcatctcctcatgcatcagaagctgtgg

SEQ ID NO: 8688 - DNA, 791 bp, Zea mays
  Predicted polypeptide sequence is orthologous to G1108, G2394
cacggattgatgtgctcttttctatatatcatggatagatatatttgtatgtgcacttacagtcacccggtcattattgcatcgatgttacagacacccgtgtgcataagtacatctctcgaacagaatggaactgtaccttgcaggcatgtaccaaggacctagcatatatatacatgaacctatgcaatgtacaaggtaaaccattacaggagctgcagcggtgccaccagctgatcaggtaacattttctatacaaggagacaatcaccaggcaaatcctgacagcaaggaggttagcaacatagcatcaaccaccaacacagtggggtcatcttaggtggccaccactaccagcatccatggttcctaagcgaaaatgtttcggccaagaacaatgttgaacacactgctctgcactgaggcaggaaatactatattggtaagatgaaacaaaaccatcaggaaaaaagaggacttgttggaccatatagtgtgtaactttcctacttgtagtttgttatatgattgtcagtttaattagaccgcatcaaagagcccctccgtcatcttcatgctcattggaaaggccaagagagcagacaacaactaccgttgtgactccacgtcgttgtctactctattgttgttgttgtcgggatccacagagccactctctggattacttgttgcttttgatccccctatctcagccttgcatagagggcacaacgcgtttatctggagccatttatctatgcattccatgtggaaaacatgtgcacagggga

SEQ ID NO: 8689 - DNA, 828 bp, Zea mays
  Predicted polypeptide sequence is orthologous to G1108, G2394
ctaaatgcgtgatgtgtctgctcggatccaatccgcgattggtttttgtcatggctcactcgcgtgttgctcgcgtcctggccttgccaaaccctctccgccgcggatctgcgcgacccggtaatgtccgtcgtgatctgctgccgccatcaacgccctactcccctcctagatcccgtgatctgctacgaagctgccatcaatgccctcctcccccttcgctcagctccccctcgcgccttcgatccgctaccgtgacccgctgcgaggcggccatcaacgcccatgtcctccttcgcgcagctaccttcccaggatctcgggcgctccttcgtcgccatactttttggttcagcgggacgcccagcccgtagatcgttgccctcaagaagtaatagtccatacaatacctggactcggcgcatgaggcctaagcttttgctgatcacttcaagatggctctggactgtttcttcgctgtatggtttgttgtgggaaatgtgtgggtgttcgatggacattcttccgcccatgacgcacccaacctgtacaggtgtcggtgagaggtattcaagttggaattggaattgtaggttatagtccactagaagaggttttttttgtgcagtggagcaaaactagctgactcgctgtcagagcaagacttccgcaaggggaactcaaactattacctatatgtgcataatacatggttcaactatccttgcttttaaacatctccttgatctttgatacattttttggattttgctcaagtatttgacatatacaagggtcccatccccgatgcttggagcaaactgcttg

SEQ ID NO: 8690 - DNA, 800 bp, Zea mays
  Predicted polypeptide sequence is orthologous to G1108, G2394
gacaacaacgacacatttttcagtcaggcgattacttgctggatcatgtaaggactcgttggtccatgacataatctctttctctctctcactatataatttacaaggtgctcttctggaagccacacacacgcccaaggcaagttgctgtctcactatacatcatggaagccgttgtgattcaatgtcgtttcctaccctcctgtggctgtcgcggcgcccaaagccaatggctggaggagcggtcctcgggacgacgtcgatctcagctttgcagagtgggcacagcgcatttatcttgagccatttgtcgacacagtccttgtggaagaagtgcccgcaagggagcaaccggagatcatcgttatccacgtacctcgccaagcagatacagcaaacggcgtcttcagcagaaacagcgcgttccttgtccgttccaggagcaaagactccaccgccaccttcgtttgcctccccgttacgaggcttctttgacctgaacctgtatgtgcccagggcgttgatcgcatccgaagtagcacctctgttttcgtccagatcttcccggaagcccatcagggagattatgcagggtaagcagcagcatatcagcgcgcagaggatgaagggcatcgcatagccaatgcagctgaaagtgaggaaggctatgcacaacctgtacaggttgggtgcgtcatgggcggaagaatgtccaccaaacacccacacatttcccacaacaaaccatacagcgaagaagcagtccagcgccatcttgaaatgatcagcaaaagcttggg

SEQ ID NO: 8691 - DNA, 614 bp, Zea mays
  misc_feature (550)..(550): n is a, c, g, or t
  Predicted polypeptide sequence is orthologous to G1142
ttttttttttttttttttcagagcttcgcgacaaaaccatgcaagtactgaagtacatatcaatatcatccatatcacacttctctacatcgctaaactaccatccatgctcaccaatgacatgtagtccatgtccatgaccatgaccatgaccatgaccatgtagtacacaatgtgatcccgcaagcctctgtcttctgctcctagcggcgttgcatccgtacggtggcgtctccgggaacgcagccttggccagcgcctgcctgacgccctcctcgagagccttcagcgtgcggcagccggcgccgtcctctctgcacagtacgaagtcacactgagccctgcctcccagggcggccatgtccgccctcagcggcctcagcctcatggcgcgtaacgctccggcgaggtcagcgtggagccccggccggtcgtcacagctgacggaggccctgatgtacgtcgccgccgctctctcgtaggcagtggaggccgtgccggtgcagcagacgacggcgatctcgttggtctctccggggatggtggccantggtggctgcgtggtttcggccgatttcttcttgaggtccttgagttggcaaaccacccgggct

SEQ ID NO: 8692 - DNA, 840 bp, Zea mays
  Predicted polypeptide sequence is orthologous to G1145
aactccggttaccaaagaaagggctcccatacttctcatagttatatgtatccatctgttaagtcacaccatgtaaacaagctccgaccacctacatgtgtcctgaagattttacatactatactggtagcaaggcctcggacagcacatgctcggctcctgctagtctagagaaagggagggagggagagagcaaaccatcgagctaggataaacaaaaactcccaagctagcaaatgattctaaaccaaagagacaaaaaaacttacaagctacaggacttacaacctacagcaaaacaagatattctgcatacaatcagaaagtcgctgagccggttctcctcagttggtacttgggttccggaagaggctcaaagaaaagtatattttccaactcctttaacgtggttagcttcttattctcctcttctaatcgagaaaccttgttttccagttcattagtgtatgcctgcttcctagcccttgaacgagcagctgactccctattcttgatcatcctcttctgccttctctccaccaacttatcagccacatctcctggggaaccacgctttctaccaggcatcggagaatcagaaagtgcacccatcatcggtgaagaaatgtggccatcagagtatgactccaaaatagcacttggtccaacattcagggactgaaggcttaactgacccggtatgtaagcacctggcaaactatgttgcctgtgctgatggggctcgatagctgtaatccgctgctgatagtggtctaaccattgtgcccctgctgtcaaacccgcagccccagtgctaccaacctgttccacactgcctat

SEQ ID NO: 8693 - DNA, 885 bp, Zea mays
  Predicted polypeptide sequence is orthologous to G1145
cgatggtttcctcgcacacccatcacatggccgcctcctccccttccacctcctcccctaatggcagatgctaggcggcggcgcccctcttgagaagtgaaagggaaagatttgttttgccgcccgcgccctgctcaggcgctccgcctcggtcgggccacacaaggtagcgccttccgcctcgttgcctgacccattcctgtttcgttcgaagcactgaagcagccccagaccgacgccaggcgcccaggccagtggtcgacgcctgtggtgagctgataggcgatgtcgtcaccgtctccggtgctggcaagggctgcgcgtctcacgtgtaggttgtgatctttctgcccagagatgtgcgatttgtcttcgcttgatctgagtgacagtaaaacggagaccggctagtgttgttcctgaaacctgttgatttatggggagccagacaatcgcatcacaggctgggggaggtggaagaggcatgggtagtagtggtggtgccggtgcagcgcaacgcgggcagatgcagagtctggcaagacaagggtctctgtataaccttacccttgatgaggtgcagagccatttgggagaacccctacacagcatgaaccttgaggagctgctgaagagtgtctttcctgatgacctggaccctgatggtggcactaccagccaatatgagcagagttcgggcctcttgcgacagggaagtatcacaatgccgcctgagctcagcaggagaactgtggacgaggtgtggaaggacatccaggatgcaccaaacagaaatgttggggagagtggtcggcggaagcgggagcggcagccaacgcttggagagatgacgcttgaggatttcttggtgaaagctggggttgt

SEQ ID NO: 8694 - DNA, 815 bp, Zea mays
  Predicted polypeptide sequence is orthologous to G1145
gtgagtctctctcctcctcctctgcttccttcccttcaccgcccttcttccctttttggaccctcctcctctcttcaacctcttgcggctgtgccaatccccccctgttctctgattgatccatcgatctggtccctcctcgtccccccttcccctccccttgcttgcttgcttgctcaggtaaaaaaaaaggagcaggaggagctgctgcactgcacaagcagaacccctcccctctctttgttcgcaagattctccctttcttgtcatatgccccgcaaaggttttgtttccactgtcgccgctccggccgagcaaagcacctgctgttcttgccacttccgatctctgcgtgcgcccgcccgccctctttcacgcccccccaacccccacccccacgggcgcatttgatttctttgcaggtgcagccgtgcaggtgaggtgatcgcgcgtggatgggagttcagacaatgtcgtcccactcccacggcgacgacggccgccgcggcctcccgcggcagggctcggtctacggcctcacgctgaccgaggtggagacgcagctgggcgagccgctgcggaccatgaacctggacgacctcctgcgcaccgtgctcccggcggcggcggccgtcagccctccatgggcgagatgacgctggaggacttcctctcccgcgccggcgtcgccgtcgatgccgccccgcattggatgcaccagtacccgcagcagcagcagtacgcgctgccgcggcccctaccgcttccgggcccggctctggacgccgcgtaccacggcgaccggccaggtgttt

SEQ ID NO: 8695 - DNA, 707 bp, Zea mays
  Predicted polypeptide sequence is orthologous to G1145
acctgaataccttctcgtataaggaagctctcaaacttaaacatgtgtctagaaaatgtacacactgacagacaccaaggaaatgatccgccaggacatgctacagcttgctagcgacctacatacactgacctaccgggccgggaaaaagctataccctcaatctatcaaatgtttctaatacaaaaggaaggaaaccatataaagtaaaatccttgtataatgtacaaaaatcactatgagcattgtcagcgccgaaactcaaaaggcagccgaacccgttctcctgagttgatatttgggttctgggggaggagcaaaactcagtatctcatccaactcctgctgtttctttagcctcttattctcctcttctaaacggaataccttgttttcaagttcattaatataagcctgctttctcgctcttgatcgcgcagctgattccctattctttatcatcctcttctgccttctttcaaccaccttatccactacctcccctaaggcaccacgcttgcgcccaggtgtctgagggtccgaaagtgcaccaaatgatggcgaagtaatctggtcatcaaagtaaattgaatccaaagtaacacctgtagcaatagacaatggctgagggcgcaactgactagccatgtatgaacctgccaaactcaattgctgggaccccaaaacttgctgctggtactgttgca

SEQ ID NO: 8696 - DNA, 860 bp, Zea mays
  misc_feature (727)..(727): n is a, c, g, or t
  Predicted polypeptide sequence is orthologous to G1145
cacccagcgtgctctctctccctctttctctctctctcgtggcggcgcctgggcagccgtcgctgccgcctgcgctaggtgccaggtcttcttcgggcccttcgccggcgacgagtaccaccaggttgtacatgtatacacccatgtgctttactgggtcggaccctactcatcctccacactaaggccatctccatagactgcactgtttagactccactgtttagagagtggagatagggagtgagatagagagtggaatagggaggatgctggagatagcctaaggttgccactgagtgtgtgcatgattcagaggcaatgtcatcacaaactggaggtggcaaagagagtgacgccggccctgggcaacacaggcagatgcaaagtttggcaagacaagggtctttatacaaccttaccctcgatgaggtgcagaaccatttgggggagccattgcttagcatgaattttgatgagctcctgaagagcgtgtttcctgatggtgtagattcagatggtgctgtcacaggcaagcctgatcggacctcgagcctgcagcgacaggggagcatcctgatgcctccgcagttgagcaagaagactgttgacgaggtgtggaagggcatccagggtggaccagagaccagtactgtggtggatggtctgcagaggcgagagaggcatccaacacttggggagatgacacttgaggacttcttggtcnaagctggggttgttactgaaggacttgtgaaggattcagctgattttccaagcaatatggatacagctggcagcagtgttgttgtggctgctgcttctagtttgaaccctggagcacagtggttgcaacagta

SEQ ID NO: 8697 - DNA, 657 bp, Zea mays
  Predicted polypeptide sequence is orthologous to G1146
tttttttttttttttttttcggaaagacttggatcgttatatgaaataaatgcaactcaaacgtgagcgtgttaatgcagccttgttcaggcttgttataataaataatgcagcagccttgttcagtcttcaaaagagcaaagccttgttcaggaaaggggttcccgtgggcaaggactagcagtagaacatgagccttctcagttcacccttgatctccggaagcggcttcggaccagcagcagcagcagcagcagagggagctgatgaaccataagagccgacacttgtcgccgcatcagagtcttggttgacgtaaaagcgggcgcggaacgctaacttgtgggcgtagtatgctgggggagcgattgacacagagcgagtgcagcttgaatacaagaagcataggttatatgtgagagactgcagcgcgtctgcagtgaagttgttgtcgtctctcaggacatgggaatgcgcaggacggctagttcccttgatcccagcatgggtgcgcaggaagaaatcaaattctgttgggtggcagatatccttgtcaacaacagtgccaggtagaatatttccactcttgtccgcccattggcgatcatttgggttgtttgggaagagccttgtgtggtgcctcttctgcaccactag

SEQ ID NO: 8698 - DNA, 2419 bp, Zea mays
  misc_feature (284)..(289): n is a, c, g, or t
  misc_feature (380)..(385): n is a, c, g, or t
  misc_feature (839)..(843): n is a, c, g, or t
  misc_feature (995)..(999): n is a, c, g, or t
  misc_feature (1337)..(1341): n is a, c, g, or t
  misc_feature (1381)..(1385): n is a, c, g, or t
  misc_feature (1587)..(1591): n is a, c, g, or t
  misc_feature (2183)..(2188): n is a, c, g, or t
  misc_feature (2344)..(2349): n is a, c, g, or t
  Predicted polypeptide sequence is orthologous to G1146
gcacgagatcaaatttgctgctcgcgctgatctccaccatttggctatgtttcttgctgggaggcagccagatgcccctcaagaggctcttcaagtacttgacatcgtgctacgtgaaatgcctactgccaagtattgtcctgttggtagatcattttattctcccaagttagggagacctcagcaacttggtgaaggtttggaaacttggcgtggtttctaccaaagcataaggcccacacagatgggtctttctctgaatattgatatgtcctctactgcannnnnngaggccctccctgtaattgattttgtttctcagcttcttaatagagatatctcagttagaccattgtctgattctgatcgcgtgaagattnnnnnngccctacgaggtgtgaaagtggaggtcacacaccgtggaaacatgcgtaggaaatatcggatatctggccttactccacaagcaacaagggagttatcattccctattgatgatcgtggtactgttaagactgtggtgcaatacttcctggagacttatggtttcagtattcagcacaccactttaccttgtttgcaagtgggcaatcagcaaagaccaaattatctgcctatggaggtctgtaagatagttgaggggcagcgctactcaaaacgacttaatgataaacagatcactgctctactgaaggtgacttgccaacgtccccaagcgcgtgagaaggacatcttggagactgtgtatcacaatgcctactccaaggatccttatgcccaggaatttggtataacgattgatgagcgtcttgcatcggttgaagctcgtgttctgcctnnnnnaaggctgaaataccatgatagtggcagagaaagggatgtattgccaaaagttggccagtggaacatgatgaataagaaaatggtcaatggtggtagagttagcagctgggcatgcattaacttctcacggaatgtgcaagatggtgctgccnnnnntttctgtcatgaattggctttgatgtgccaagtatcaggaatggattttgtacttgaacctgtgctgtcaccttgctatgcaaggcctgaacttgttgaaagagcactaaagggacgctatcaagatgcgatgaacatactcgggcctcagggccgagaactcgacttgctgattgttatactgcctgacaataatggttctctttacggggatgtcaaaaggatctgtgagactaatcttggattggtctcccaatgctgtctgactaaacatgttttcaaggtgaacaagcagcagtatcttgcaaatgttgccctgaaaataaatgtgaaggttnnnnnaaggaatactgtgcttgttgatgctttggcaaggagaatnnnnnttgtcagtgacatagcgactattatctttggtgctgatgtgacccatccccatcctggggaagattctagtccttccattgcagctgtggttgcttctcaagactggcctgaggttacaaagtatgcaggattggtgagtgctcaagcccatcgtcaagaattgatacaggatcttttcaaggtatggcaagatcccgaaannnnnactgtctctggtggcatgatcagggagcttctcatatctttctggagggcaactggacagaaaccaaagaggatcatattctacagggatggcgtcagtgagggacaattctaccaagttctgttgtatgaacttgatgccattagaaaggcctgtgcgtcattggagtctgactaccagcctccagttacttttgtcgtggtccagaagcgtcatcacaccaggttgtttgctaataatcacaatgataatcgtgctgtcgataaaagcgggaacatactgcctggcaccgtggtggactcgaagatctgccatccaactgagtttgatttctacctgtgcagccatgctggcattcagggaacaagccgccctgcccattaccatgttctgtgggatgagaacaactttacggctgatgggttgcaaactctcaccaacaacttgtgttacacgtatgctaggtgcacacgctcagtatcgattgttcctcctgcatactatgctcacctggcagccttccgagctcggttctacatggagccagatacgagtgacagtggatctatggcaagccgtggccctccaccannnnnncgcaacaccaaggctgctggtgttgggaatgttgctgtgaggccattacctgccctcaaggaaaacgtgaagcgggtcatgttctactgctaagactgatgctgttaaggcagagctaccttttattattacagtatatcgtgaagactagagtannnnnnccatgtacttgatgatgctgagctaccttttattatgtcgtacgatatatatgcgtggtactggttacag

SEQ ID NO: 8699 - DNA, 1054 bp, Zea mays
  misc_feature (80)..(109): n is a, c, g, or t
  misc_feature (140)..(144): n is a, c, g, or t
  misc_feature (495)..(499): n is a, c, g, or t
  Predicted polypeptide sequence is orthologous to G1146
ccaacgaactgagaggctcactttatatataatgcatcaagtcaaagcagaaaatttcaaaagcaatgaccacaaggttnnnnnnnnnnnnnnnnnnnnnnnnnnnnnncacttgccttggacttctacgaagtccaccnnnnntaataggcattttctgacgagttttggatagaatactcgccaggcccaaaatatgatttggaggtcgtgcggcccgcccttcagggttacttcaccatagttacaccaacccagaattactcgattcatttcatggcaacaaaagtgtcgatgacggtccttcctgcaaaggccaccttcagcagtagaacatgaactgcttgacactctccatcactttcggcagctgcttcaccggaacagcgccatctttcatgcgagagctcgccactgaagacgacccctggtcggagaggtcatcgtccatgtagtggcgcgcacggaaggccgccaggtgtgcatagtacgccnnnnnaactatagagactgatcgagtgcatcgcgcatacgtgtagcacagtttgtaggtcaacgtttgcagtgcatcggcagtgaatttgttttcgtcaaacagaacatggtagtgtgctggccggctcgttccctgtatgccagagtggctacaaaggtagaagtcgaattcacttggatggcatatcttcgtgtcaacaacagttcctggcaaaatgtttccacttcgatccatctgtccatgtgcatgatgatcttcagggaaaagccgtgtgtgatggcgcttttgcaccacaatgaatgtaatgggaggaaggtagccctcttccaagctggcacacgcctgagtacaaacataaacgtaactcaattaggagattgcaacaaaagagaataatattgtgaagaaaaccacctttcgaattgcatccacttcataaagcaagacctggctaaactgcccctcactgacaccatctcgatagaaaattatcctgcttggtttgcggctcccgtttgccttatagaatgacacgagtagttccctgatcattgtcgt

SEQ ID NO: 8700 - DNA, 2635 bp, Zea mays
  misc_feature (158)..(162): n is a, c, g, or t
  misc_feature (363)..(367): n is a, c, g, or t
  misc_feature (628)..(648): n is a, c, g, or t
  misc_feature (1126)..(1148): n is a, c, g, or t
  misc_feature (1176)..(1199): n is a, c, g, or t
  misc_feature (1398)..(1403): n is a, c, g, or t
  misc_feature (1715)..(1775): n is a, c, g, or t
  misc_feature (2457)..(2466): n is a, c, g, or t
  misc_feature (2510)..(2514): n is a, c, g, or t
  misc_feature (2537)..(2542): n is a, c, g, or t
  Predicted polypeptide sequence is orthologous to G1146
ccgagccgacgcccaaggccgcgtacagagagatcatgacgaagctgttgtccgagaaccagcacacggatttcgacggccgcttctccgtgtacgatgatggtgactcgctcttcacagccggtgcgctgccgttcgacaccaaggagttcgaggtnnnnntctctgcaggcggcgacgaaaagatggacaggaagtacaaggtgatgatcaaccatgccgcaacgattagtctgctacagctgaggatgctgttagcgggctatcccacggacatccccgcgcaggcgctcgtggtcctcgacaccgtgctgcgtgacgtcttcaacgaacgcaatgacatggaatgcgtcgtgattgacnnnnnggatcgcacactgggtgttgacgcatggaaggggctctatctgagcatcaggccaacacaaaactgcttgtctctgattgcagacgtgtcctcatctgtattcgttcaacccctgctattgattgaattcgttcagaagatcctaaagatagatgccgtggataggaacttgactaaacctgagtatgacaagctcttgaaggccctcaggggtgtgaggattcaagtcacacacagagataatagacgccgagtatggtnnnnnnnnnnnnnnnnnnnnngccaactctctacgtacagagttgctggcttgtcagtgaatcctactaatgatttgagttttgaatcaaaggttggagtcacaacgactgtgattgattacttcagagaaatatacggcctggaactgaaatacaaatatctcccatgcgtcaatgctggcagcgagcaggatccaatctattttcctatagaggtttgcaagatagctcccaagcagtgttaccagaagaagctggaaggtagtcagttttctactccaaggaagtcagcctggatccatcctgaagccgagcaatcctgtcctcagattgttgagcagaggcagtacaaacaaaccaaacgtgcaaatgaatttgacttagaatttgatggcaatcttacaacagttgctgctagagttctgctgcctccaaatcttaagtatgatgattctgtatcacagaaaacatggtttccactggatgggtactggaatannnnnnnnnnnnnnnnnnnnnnnggtgccaagatcagaaactgggcatgtnnnnnnnnnnnnnnnnnnnnnnnnaaggaagatattaagaagttttgctttaagctggctgaaatgtctcgtattactggactggactttgccgatttgaagctcccaatattcactgcacgtccagatcgagttgaagatggtattcgtaggtgctatcaggaagcgaagaacaagctaagggatcagaagattgatttactgcttgctatactaccagatnnnnnngacagtttatatggaaatattaaaaggatctgtgagacagatattggtcttgtgtcacagtgttgtcgaaggtcaagagtcttagtgaataataatcagatattggcaaatattgctattaagatcaatgccaaggttggaggaagaatctcagtattcgatgacgtacagaagagtttaccggttgtttcaaataagccaacaattatatttggtgctcatgtttctcacccttctgttgtagatggttctactggcccttctattgcttctgtcgttgcatcccaagactggcatgaggtgtctaagtannnnnnnnnnnnnnnnnnnnnnnnnnnnnnnnnnnnnnnnnnnnnnnnnnnnnnnnnnnnnaaggagctccttcatgcatttgcaaacgagtccaaggagaagctccagcagctgatattctacagggatggcataagtgagggtcaattcaatcgaattttggagaaagaaatcccagcgatagaaaaggcttggaacgcactgtatgacaatgagaagccacaaatcaccttcgttgttgtgcagaagaggcataaactgaggctgttccccgtggacgacaactataagatccgttctgctaagaagaaaattgttgagcctggcacagtggttgatagtgagatctgtcacccagcagaatttgatttcttcctttgcagccaatctggtggtatcaaaggcccaaggcgtcctgtgaggtaccttgtactgcgagatgataacaacttcacggcagatgaactgcaggctctcacaaataacctgtgctacacttattcaggcggcaatcgttcgttgtcggtcgctcctcccgcatactacgcccaaaagctcgcacatcgggcccgcgtctacctcgccaaaggctcggacaataatgcagcagctgctaatggtggtcggaagcaaattccagagataaagaatgagctgaaggggtccatgttctactgctagtcctttgcctgctgaacggacgatgaattgttctatagtgaaagacttgagtgtgctctgnnnnnnnnnnctgaatctggagaaggatggcatctgcaatagtcgccgtgttcnnnnnagtacactagaataaatggatgnnnnnngtggacgcccatgttgaactagttttcttttccagtaagtacttcagaatgagtgagataaatatatcattcagcgtctggtggtctggcatt

SEQ ID NO: 8701 - DNA, 3777 bp, Zea mays
  misc_feature (54)..(173): n is a, c, g, or t
  misc_feature (201)..(231): n is a, c, g, or t
  misc_feature (258)..(353): n is a, c, g, or t
  misc_feature (375)..(379): n is a, c, g, or t
  misc_feature (956)..(962): n is a, c, g, or t
  misc_feature (1420)..(1424): n is a, c, g, or t
  misc_feature (1454)..(1458): n is a, c, g, or t
  misc_feature (1617)..(1622): n is a, c, g, or t
  misc_feature (2512)..(2516): n is a, c, g, or t
  misc_feature (2571)..(2575): n is a, c, g, or t
  misc_feature (2615)..(2619): n is a, c, g, or t
  misc_feature (3315)..(3319): n is a, c, g, or t
  misc_feature (3413)..(3418): n is a, c, g, or t
  Predicted polypeptide sequence is orthologous to G1146
ctgctttctccagtgagccgcacccgcactaccgctgacgctaattaaccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagtgccattggtggagctggtaactnnnnnnnnnnnnnnnnnnnnnnnnnnnnnnncagccgtctgccgagcctgctcagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgagcgaactcaacaacctnnnnnaggacgtggctgggtgcctcaacagggtggccatggtggtgggcaacaccagggtcgtgatcgacattatcagggacgtggaggaccagggccacatcaccttggtagtggggcacctgagtatcacccgcgtgaataccagggacgtggtggtgaatatcagggacatggtggtgagtaccagggacggggtggtgactaccagggacgtggtggtggccgctccagaggtggaatgccacagccatactatggtgggcataggggaggtaatgttggacgcaatgttcctccaggtccgtccaggacagttcccgagctgcaccaagccccatatgtccagtatccagccccggtggtttcgccctccccatcgggacctggctcatcctcacagcctatggcagaggtgagctctggacaagtccagcaacagtttcagcaacttgccgatcgtggtcagagttccacgagccaagaaattcaagtggcaccagcatcaagcaaatcggttcgattcccgttacggcccggcaagggcacttatggggacaggtgcattgtgaaggcaaatcannnnnnngctgagcttcctgacaaagaccttcaccaatatgatgtatctataacacctgaggttacttcacgtggcgtcaatcgtgctgtcatgggtgagcttgtaacaatatatagacaatcccatttgggtgggcgtctacctgcatacgatggaagaaagagcctgtatactgctggaccattgccatttacttctatggcatttgaaattaccttgcaagatgaggaagatagtcttggcggtcgccaaggtggacataggcgtgagagagtatttagggtggtgatcaaatttgcagcccgtgctgatctccaccatctggctatgtttctagctggaaggcaagcagatgcccctcaggaagctcttcaagtgcttgacattgtactacgtgaattgcctaccgcgaggtattctcctgtcggtaggtcattttactctcccaacttagggagacgtcnnnnncttggtgagggattggaaagttggcgtggnnnnnaccaaagcataaggccgacacagatgggcctttcactgaatattgatatgtcctctactgcatttatcgagcctctccctgtgatcgattttgttgctcagcttcttaacagagatatctcagttaggccattgtctgattctgatcgcgtgaagattnnnnnngccctaagaggtgtgaaggttgaggtgactcacaggggaaacatgcgcagaaaatatcgcatttctggcctcacctcacaagcaacaagagagctatcattccctgttgatgatcgtggtactgtgaagactgtggtgcaatacttcatggagacttatggttttagtatccagcacaccactttaccatgcttgcaagtgggtaatcaacaaagaccaaattatctgcctatggaggtttgcaagatagttgaaggacagcgttactcaaagcgactcaatgagaaacaaatcactgctctactgaaagtgacctgccagcgccctcaagagcgcgagctggacatcttacagactgtgcatcacaatgcatactatgaagacccctatgcactggaatttggtataagaattgatgaacgtcttgctgcagttgaagctcgtgttctgccaccaccaagacttaaataccatgatagtggccgagagaaggatgttttgcccagagttggccaatggaacatgatgaataagaaaatggttaatggtggcagagtgagcaactgggcatgtattaacttctctcggaatgtgcaagatagtgccgctaggggtttctctcatgagttggcagtcatgtgccaaatatcaggaatggattttgctcttgagcctgtgctgcctccagtgactgcaaggccagaacatgttgagagagcgttaaaggcacgttatcaagatgcaatgaacatactgaggccacagggaagggaacttgatctgctgatcgtaatactgcctgacaacaatggttctctttatggggatctcaaaaggatctgtgagactgaactcggattggtctcccagtgttgtctgactaaacatgnnnnnaagatgagcaagcagtaccttgcaaatgttgcactcaaaataaatgttaaggttnnnnnaaggaatactgtacttttagatgctttgtcaaggagaatnnnnnttgtcagtgacagaccgaccataatatttggtgctgatgttacccatccacatcctggagaagattccagtccttccattgcagccgttgttgcttcgcaagactggcccgaggtcacgaaatacgctggactagtgagtgcgcaagcccatcgccaggagctgatacaggatcttttcaaagtatggcaggacccgcagagaaggacggtaactggcggcatgataaaggaacttctcatttctttcaagagggcaactggacagaagccccagaggatcatattctacagggatggtgtcagtgagggacagttctatcaagtattgctgtacgaacttgatgccattagaaaggcctgtgcgtccctggagcccaactaccagcctccagttacttttgtcgtggtacagaagcgccatcacactaggctgtttgcgaacaaccacagtgatcagcgcacagtcgatagaagcggaaacatactgcctggcaccgtggtcgattcgaagatttgccatcctactgagtttgacttctacctgtgtagccatgctggcattcagggaacgagccgccctgctcactaccatgtcctgtgggacgagaacaagttcacagctgacgagctgcagaccctgacgaacaacctgtgctacacgtacgctaggtgcacccgctccgtgtccatcgtgnnnnnggcgtactacgctcatctggcagccttccgagctcgcttctacatggagccagacacctctgacagcgggtcactggccagcggtgcccgtggnnnnnnacccggtgcggcacgcagcagcacgagaggggccgggagtgtcgaggtcaggcccctacctgctctcaaggagaacgtgaagcgtgtcatgttttactgctgagacgctggtgggctgccttcgccaaggaaaatgccctggagcattcccatgtacccgcactgtttcggtgatacagtactatctaacgccgattttgcgcgttaagacttccagtgatctgggaaatttcttgtacgactgttgtagtgttgtgtattcgtaatgtgatgacgcggcagttcttctaggagcttagtgccgtgtaaaatatctgttgtaagttgtaacctgtcaccctctagtgttatgtcatgat

SEQ ID NO: 8702 - DNA, 649 bp, Zea mays
  Predicted polypeptide sequence is orthologous to G1146
gagattgtactccagcgtgccgttaatgaattgattgaattcaacctagaaaacaccagaaggtttcttctacacccccttttcatagtacactggaacattggatgcatgcatctgaaccaacaagaactattatacaggcatttccgagtattttacagcgatcgctaacagattgattgttcatgatccaaatacgcatcccgtttcctcttcgttcctggagaaagctaatctaatccccctactgaaccctaccaagttagctacagcatgtgaatggttgttaaagtggtcacctcgtcaggagtagaacatcacccttttcaccttctccttcacagcaggcaggggcttcaccaagcctccgttcgtgccattggagctcttcgacgtctggttctccgacatctctggttccatgtagaaccgcgcccggaatgctgccaggtgtgcgtagtatgcaggagggacaacagaaaccgagcgtgtgcaccgggcataactgcatcaataacatgtatatcaagctaataaaattctcaaaaaaaaaaattaaaagtgcaaaggacaaatataaaatatacaaagaagtgcattacgtgtagcaaaggttgtttgtcagtgtttgcatttcgcccaacacaat

SEQ ID NO: 8703 - DNA, 1084 bp, Zea mays
  Predicted polypeptide sequence is orthologous to G1146
gcgggcacgcggttaaagtgaaggatccacaaaagggatttgttccctacctaatgatcaggcatgctaaacatcttagttgtctaacttagttcttcagataaatgatttgtcctttttttaaatgtcatatttttgcttcagggaactactcgtgccattctataaggcaaatgggagccgcaaaccaaataggaaaattttctatgggttcgtaattgtctgtttgaatgaattttgttgttgtctaaacttaaatctcttttccttgcatgtaaagaaaaagacctgccagttttctttatgttagtacatatttcaacagctaaacagctacaccttgtatacttggagaagaatcctggagttactttacttgtttccttgatttgcagagacatgccagtgaggagcagtttagccggttcttgcattatgaagtggatgcaattagaaaggcgtgtgccagcttggaagagggctaccttcctctagttacattcatagtggtgcaaaagcgccatcacacactgttttgtcctgaagatcatcgttcacacagacaaccagatcgacgtggaaatattttgcaaggatgaactagatgcaaaacctgaagagctggaaggagaagagttggaatctaagcttctagagcctgttgcagctctttcggtgcatccagtgcatgtcccaggaaacaagcaactagcttgccctacttcacagaaagttatagctaaatacgatgagctggctgcactacaagctgaaatggcattgtgatcaggattaacgcatggaccgaggaagcgcaatgacaagcctaatagcctgcaactgatgaaaggaatggtctctactacacgtattattgtccatcccatctttgtttaatggtcgtagctgctttatacaattattcctacctatgctagactgtgagccattgtatatcaatgtattttatcatattgatttcgtagcaacgtacgagcatatacctagtatatttataaacaatgtgtagcacttgccacatttaaacagctaatcttaaaaagacaaaaaaaaaaaaaaaaaa

SEQ ID NO: 8704 - DNA, 766 bp, Zea mays
  Predicted polypeptide sequence is orthologous to G1146
tttttttttttttttttttgatatgcaaagctccattgaaatagatataaatgtcgaaacaacaatggcgcaccaccatagagccattcagtcagagccctcaatattgagacaaccgaaatcgaacaattctttgatggaattttgtacatgttggtttttttggataagatcatttaccaatgttcaatgagaggcccatttgagttggacggaagcttgggtaatatcctctccagcactctagcccaccgcaatgtcctcatcaccaaaacttcttggagaaggaccaaaaaagagttacataattgagagaaggtgactcaagacaatatccagtgcttggattgcgtcatatggcgtgtcccttcgttgacaattgatcaattgatttttcggccctccttccccaacttgacaacgaactccaatgatttgaacgacatctcgcttgcagtgtacatgctcttgcttcaaatcatatgcacatgtgtcttgtgggcgcgagatgtcgcattgtgtggcttgacaagctctgagagcagcaccctgttggtccttcttccttttgtttcaggatttattaaaacctggtaaatgtgtatgggtcgagtcaaatatgtatggagcacaaaagaaaaacttccaaccagacattaagagataaacatctagtatttcttgcatacacaataaacataaatcactgatttcaacaaataaaacttaggacataatcgagcaagataacaaacaaatggatatc

SEQ ID NO: 8705 - DNA, 774 bp, Zea mays
  Predicted polypeptide sequence is orthologous to G1146
ttcgcgttctgcgcaagtgcttgctcaacaaggtctaacagcgaaacaactagagttactcatcataattctgcctgatatgagtggtttttatggaagaataaaacgagtttgtgaaactgagcttggtttaatcactcagtgctgcgcacctaagaatgtaaggaaaggagggaatcagtaccttgagaatctttccttgaaaatcaacgtaaaggttggtggccggaacacaatgcttgaagatgctttcaaccggagaataccgcttctgacagattgtccgacaatagtctttggagctgatgttacgcacccatctgctggggaaagttcatctccatctattgcagcagtggttgcatcaatggattggccacaagttacaaagtacaaatgcttggtgtcttcacaaggtcaaagggttgaaattataaatgacctttatacagaagtggaagatccacagaagggcattgttaaaggtggaatgattagagatttgcttatgtcattcttcaagtcaactggccaaaagccttcgaggattatattctatcgtgatggtgttagtgaggggcagttcagccaagtcttgctttatgaaatagatgccattcggaaggcatgtgcaagtttacaggataattatctcccaagggtcacatttgttgttgtgcaaaagcggcatcatacccgcctgtttcctgaaaatcatcgttcacgagatcaaacagacaggagtggaaacatcctgcctggaaactgtgttga

SEQ ID NO: 8706 - DNA, 704 bp, Zea mays
  Predicted polypeptide sequence is orthologous to G1146
cacactcctgtcgtaccacaaatcagaactaatgcgtcaataggcaccgtagttgataataatatctgccacccaacagaatttgatttcttcgtgtgcatccatgctagggccaagggaacaagccgtcctacgcattaccatgtgctacgagatgacaacaagttcaccgcagatgctctgcagtctctaacatataacttgtgctacattgcgcagatcatccagggcggacctataagatgtcaagtgtgtacgccccaacaacccacagatgcggctcgacgctctccatcgtctggtataccaggataggcttcaagagaggctaagaaaatctaagtgtttaggacttgaagaggctgcaaagaacaaaggttttgaccttggtaacgatgcactcattgcaaactgttgaggaggaataactatttggcagatgcagacatgcagtagcttcacacttggttcatcggacaacagttctttgaactaagtagagtggaaggaaactgaacctaacacccatccatgacccagcttacatataggtggttttactgggttctgcatcagatcctcgcatacaaggtgacttcacaaatttagccaataagttgtatagccgagtgaagctatgtttgacttatgctacgacgagccaccatcacatttgcaacatgctaaagagcaaaatgacacca

SEQ ID NO: 8707 - DNA, 1544 bp, Zea mays
  misc_feature (283)..(283): n is a, c, g, or t
  Predicted polypeptide sequence is orthologous to G1181, G1850
gcacgagggcgaggcgggtcgccctcgccatattagcgcctccctcctcctcctcctgctcctgcgcgcccctgctcgtaatcctaaccgccctggtttctctacacgctacgggaccggtaacttctagaacccaccaccttccatccttccttcctttcctctctctctgtctctcctcgcgcccacggtgcccgccagccagatccgcgcgttcaccggcgccatggccgccgagcatgccaccgccgcggtgggtgagccgcctcccgccacgtcgcanccggcggagggcgtgacggcggcggcgggccagaggtccgtgcccacgccgttcctcagcaagacgtaccagctggtggacgacccggcggtggacgacatcatctcgtggaacgacgacgggtctgccttcatcgtgtggcgcccggcggagttcgcgcgcgatctgttgcccaagtacttcaagcacaacaacttctccagcttcgtgcgccagctcaacacctacgggttcaggaagatcgtgccggacaggtgggagttcgcgaacgactgcttccgccgaggggagaagcggctgctctgcgacatacaccgccggaaggtgtcgccggccacgggggcggtcacggtggccgccgccgccgctgcggccatcccgatggcgctgcccgtgggctctccggtgtactccggcgaggagcaggtgctgtcaagctcgtccccggcgctcccgtcgctgcagcagcacccgccggcgccgtccgggtcgggctccggcggggtggtctcgggcgacgtgggcgaggagaacgagcggttgcggcgggagaacgcgcggctggcgcgcgagctcggacagatgaagaagctctgcaacaacatcctcctcctcatgtccaagtacgccgccactcagcagccggacgccgccaaggaggcggccgccgggaactgcaccggcgagtcgtcggatgccgccgcggcgcctccgctcccttcgatcctggagctcctaccctcgtgccgcgccgaccccgcgcccgctgcagccggaacggatcacgaggatgacgaaaaggcgggcgctaggctgttcggcgtctccatcgggcggaaacgaatgcgggacgagagcgaccaccacgccggcgtctgcgcagcggaggtgaaagccgagccggtggacgcgcgtcccgaccagcagcggcagcgcaacgccacggagccgcagtcgtggcccatttaccggcccaggcctgtgtaccacccgctccgggcctgcaacggctcgggcagcgctgggagcgaccacgacgggtccaacgactcgaggtgacgggagcaatcgtcgatctgccctcagtaaattagtattacacttactaatggtactaggtaactatattacaggttaaactaggatgtgagctctaaatctctaattatgtggggatttactgaccgatcctatgtaaaaatctccaagtgtttatgtagttgatctcatattactgcaaaaaaaaaaaaaaaaaaaaaaa

SEQ ID NO: 8708 - DNA, 906 bp, Zea mays
  Predicted polypeptide sequence is orthologous to G1181, G1850
gcacgcggtcccatggctctgccggtgcggccggcctcaccgtcgctctctaccgacgagcatgtcctctcctctaactccggatccgccgaggaccacccgcaggctgccgcttccggctccgtcagcgcgtcggcgtccggcgacacgggggaggaaaacgagcgcctccggcgggagaacgcgcggctgacccgcgagctcgggcagatgaagaagctctgcaacaacatcttgctcctcatgaccaagtacgcctcctcccagcagctagacgcctctgcagcgctctcctctgtcgtcaactgctccggcgagtcatcggaggccgtacccgcgcctccgcccctccccccggcgatcctcgaactaatgcccgcgtgcccgggtcttgccaccgcggccgcgggcctcgtcgccgaagcggatcctgaccaggcctcgaggctgttcggcgtctctatcggcatgaagcggatgcgcgacgacgacgacaccggcgaggaacaggcggaccacggcgccgcagcggatgtgaagacggaggcgtcggatccgcagcatcgcatggagccgtcgccggagtcgccggaccagcatccgtggcccatataccggcctacgcccgtgtaccattcgatgcggccctgcaacgggccggaccagggcgccgggtccgaccaagacgggtccaactccaggtgattgggcccaccgcaccttgtagaagcttctagttctaattaatcaattgccatatcggcaactaattattatcctagagaaacataataatactatattttcttctgtttttccttggctagttggggattggaagcttctctcccttgttgtaatgggtgcttataaatcagcggtaaaatccaaaaaaaaaaaaaaaaa

SEQ ID NO: 8709 - DNA, 1034 bp, Zea mays
  Predicted polypeptide sequence is orthologous to G1190
gcgccgcccaaggggtacaagccgcccatccggtggcccaagagcaaggaccagtgctggtaccggaacgtcccctacgactggatcaacagccagaagtccaaccagcactggctcgtcaaggagggcgaccgcttccggttccccggcggcggcaccatgttccccaacggcgtgggcgcgtacgtggacctgatgcagggcctggtcccgggcatgcgcgacggcaccgtccgcaccgcgctcgacaccggctgcggcgtcgccagctggggcggcgacctgctggggcggggcatcctcaccgtgtcgctggcgcccagggacaaccacgaggcccaggtgcagttcgcgctggagcgcggcatcccggccatcctcggcatcatctccacgcagcgcctgccgttcccgtccgccgccttcgacatggcgcactgctcgcgctgcctcatcccctggaccgagttcggcggcctctacctcctggagatccaccgcgtcctccgcccgggcggcttctgggtgctctccggcccgcccgtcaactacgagaaccgctggcacggctggaacaccaccgcgcaggcgcagaaggccgacctggacaggctcaagaagatgctggccagcatgtgcttcaagctctacagcatgaagggggacatcgccgtgtggcagaagtccgccgacgcctgctacgacaagctcaccccggtcaccacgcccgccaagtgcgacgacagcgtcgaccccgacgccgcctggtacgtgcccatgcgctcctgcgtcacggctcccagccccaagtacaggaagctggggctcaacgccacgcccaagtggccccagaggctcagcgtcgccccggagcgcatcagcgtcgtcccgggcagcagcgccgccgccttcaagcaggacgacgcccggtggaagctcagggtcaagcactacaagacgctgctgccggcgctggggagcgacaagatcaggaaagtcatggacatgaacaccgtgtacggaggatttcgcaa

SEQ ID NO: 8710 - DNA, 588 bp, Zea mays
  Predicted polypeptide sequence is orthologous to G1196
gtcgggtgatgagttgcatagttcagatgatcaaccctcgtggttctgattacatttaagtaattagtctttcgctcctatctgacgaccttatcaatgccatttcgatattatacgcttttatgttgcgttgaatgatttcgatacactatatatgtttactgacctcgtatgctacattctcagccagatactgtcgccgcctcaagatcctcgtcgcgaggttcacggcgccggctcgcatccctccttgctctgctcgcctatgctagcaccttttcgtctcatatggctgcagctcacttatcgtagttgaaatggtgcacgtgatgtatgcattgtaatcctattaattgcacatgtaaagtggtcgccgagttctgatcataatcttggtgtgcttgagttcatggtcggttgattcacgacgcagttggtctgcacattttaagggctttcggttaggccccttctagtcatttttgactaggaggggatttaaactcctccaatccctttctggatttgtgtaactgaacatgctaaggcggcacgatgctgttagtatgctgtacggttactgccacc

SEQ ID NO: 8711 - DNA, 1080 bp, Zea mays
  Predicted polypeptide sequence is orthologous to G1206
aagaatgctgagccattgcctgttggtcctgtgaaggttgttcctcgtgctatgagtatgacgaaagcagcaccaagaatgtgtcactgctgcggggtaaagaaggcagcgcgtgttgccaattgcaagaactgtgatacgaatttctgtaacagctgcattaataaatggtattctaagttgtccaggaaggatataaaggctcgttgtcccagcttgccgtggtctctgcaattgtaaactgtgcagccttggtcataccaagggtgctactcataaggaaccgccaagtggtgaaaggaagatactcagcataaaaatttccaaccatcaattttacaagcttttacctgtaaaacttgaccgggagcaacttgacgagttggaattagaagctaaaatacaaggaacaaaaacatctaatgtccgtgtccaggttgctgaaaatggtcagagtgagtcactctactgtaataactgtaagctctctgtgagtcaattcttgagatgctgcccaacatgcccgtttaagctgtgcctaagttgctgtcagaagatacgtcaaggaaacatgtcgaacagcaaccctgaagataagttcaagaaccggttgcttcaacaagagtctgtccatgaggatggcagcattacttgcccttcgattgagctgggtggctgcggtgacgccatgctgaacctgatatatgcatctccatcgagccagtctgaagagctcagttcagaatgtgagctggatgctgcaggcaatcattctggagtgaaggatgctgaagttcacggatcacctgtacctgagagtaatggaagattagcagcagcttcccaggcagaaacaatgtccacatagtctcagaagatgcaattcttgttggctcatctttcaggtgggagcgcaagcgtttatattacattgaagcctgaagatagtgtatgatatggtcaaaaatcggtagagggtaggttgcctgattaggttgcttgatttaggaggttgccagcctatatggccattgattttaggcctgtgacctggggataatccmcaattgttgtattgtt

SEQ ID NO: 8712 - DNA, 643 bp, Zea mays
  Predicted polypeptide sequence is orthologous to G1206
acagcccttacgccttccatcttcccagtcagcagtgaaacaatcaaccacctacacgattgccagagcctttcaggagattgcgctgccttttaggaggcttcacatcaacagcgcggcagcgccagcgccatctttggacttgccgtatcccctcttccgacctctttggcggccgcccttctttctgtgcctatcaccagcagcttcatcgttggacttgcgacatgggcggccacgccttccttttaggcttctgttcttcagctccagcctttttttgttcttgggttgggcaaaccaactcttcgaccactccgaggaaggatccaagaaatttactacttggttcagagcatgaagagcaatcttcttgatctccagcttatcctctttagccctgtgatcaggtggaagccgcctaaactctccagtcagtttcatgcactcgttgacgctttctggggggacaaagtccatcgcaaccttaatgcaagacttcaagttcctcacttggtgaggacatccagcaggaatgaaaaccgcttcaccaagcttctgctcaaacgtccagggttcaacaccatattcttccttgagctttctcttatgctcctcggttaagtagaaagtctgatcgtga

SEQ ID NO: 8713 - DNA, 1559 bp, Zea mays
  Predicted polypeptide sequence is orthologous to G1206
taagcagcgtggccgtagttctaatggtaccgtaaacaggactaaaaaaatagaagaggggaatgcgtctggactaattgctgtggctcccgagtcagaagatgatgatgatgccccatttatagatggaaaccaagcagagggtggtgcactgtgggatatttttcgacgggaagatgtgagcaaactgcatgattatctaatgaagcatgctgatgagtttagacattgcaactttgagccagtgaagcaggttactcatcctatacatgatcagtgtttttatctaacaattgagcacaagagaaagcttaaggaagaatatggagtcgagccttggacatttgaacagaagctaggtgaggcagtatttatcccggcaggatgtccccaccaggttagaaatttgaagtcttgcataaaggttgcactagattttgtttctccggaaaatgtccgagagtgcatcaggttaacagaaggtttccgtctgctgccgaagtggcataaggtgaatgaagataaactcgaggttaagaagatagctcttcatgcattcaatcaagctattaaagatatcactgatgaatcatctaatagcaatgaaagcaaatggatccggagatagtgaggatcatgaaggccattgaatccatgcttgatgtccatggaagttagaacaacctgcattcgacatcttgctatcgagaacctgaatgaaaaccgtagtggcttatcggatgccgacaagataacaaaacctgattttagtgtattatgcatgatattagtaccttatataatacgtagcttggagaaaaggccattcaccgtttctcattgttgggaggttctaaagaatgaagccaaatggttacacttggagcagggctcacaaaatattgatgtgctggtgaacaaaggtgtagggttttctccaagatgtcggatttgacactgaagaagattgagtattggaagaggtccgattgaacatttggcactgacattcaccaacttgttcaaatagaggaaaaggatatggaaatggagaaagagcgcatgtatgcatgtgtaggtcagggagtggctcggatcagccttgagtcaatttccactgcgttttcttcggttatggatgagcacgaggagtaaaagaaacagaagaaggctgagtgtgattctcatatgcttattttcttgtcctgtgtaatggatgtgtgtatgtgaaccatatgcgaacttaaacgtctttgtttgtaccggtcaggccattctgagtgagggttccgtctcttctttttaggactccactgcgaggtgtcggtgtgtgagaaatggtgcaaacaagtttctgagaaatggtgcaaacgtgtgtatgaaactctacgaggcatactcttacctagtattgtgtctagtgaaaaatgggacacatccgatgctactgtaaactcacttgttgcactcaggttttgagttggatttttctttcaaactttttcgtataaaggcttgagtttatctaacactagatttcataaaaaaaaaaaaaaaaa

SEQ ID NO: 8714 - DNA, 725 bp, Zea mays
  Predicted polypeptide sequence is orthologous to G1206
ttttcataaaaatgacatagtatttatatccaccttttgacacaaaaggtgcaggaccccaaatatcagagtgaaccaaatcaaagggttcaacagaatgagaatcactagtaaaatatggaagttgtatttgttttccaagatgacaacccttacaatgaaaattagactcaaccgaagtatgacctaagcaacctgactttattaaagtagacaatctagagccacacaaatgacctagacgatgatgccactgggcaaaagacgcaacagaagaaagggtagctgaaagcacatgcgctggagatgtagccaaggaaggaagccgcaaagagtccaagatgtagaggcgaggagcggctctacggcgacggccagtcccaatcacttcccctatgcgaaggtcctctagtttatcttcttttgccctgtggcccactggaagtctccggaaatcctcggttaagctgagacattgctgaatgttctctggtgatacaaaatccagagctatcttggtgcaagactttagattccgtacttgatgaggacacccagcaggtatgaaaaccgcatctccaagtctttgcacaaaggtccatggctcgattccatactcctccttgagctttctcttgtgtttgttggtcagataaaatgtttcatcatgtacagggttaaatatcttttcaactggacaacagtacatatggcgaaattctttg

SEQ ID NO: 8715 - DNA, 861 bp, Zea mays
  misc_feature (729)..(729): n is a, c, g, or t
  misc_feature (743)..(743): n is a, c, g, or t
  misc_feature (765)..(765): n is a, c, g, or t
  Predicted polypeptide sequence is orthologous to G1206
caatgcattaccacctgatgacgatggagaaattgcaaaggataaagaatcatctcctggatcagagtggcaaagtgaactaggtcagagttcagatcacaacaatggggtcaacacaactgatgagatgtacaatggagctcattacatttcacacaatcaaaaaagcactggcaggaaagttggcattaaacctcaagaagagaaatctgaaaaggctgattgcagtggcacatgtgcttatctaaaaggaagttctgaagataatccggaaatgcctattgtggagagctcataggagcagagcaccggtggtgctctatgggatatcttccgcagacaggattctgataaattgcaagattatcttaggaagcattgctctgaattccggcatatttactgcaatccagtcaaaaaggtattgaaccctggacgtttgaacagaagcttggtgaagctgttttcattcctgctggatgtcctcaccaagtgagaaatttgaagtcctgcatcaaagttgcgcttgattttgtttccccagaaaatgttggtgagtgtgttaagctgacggaggagtttagacgacttccatctttccacaaggctaaagaagacaaactagagatcaagaagatggctgttcatgccctgaacgaagctgtaaacttcctggatcctcgttcctcagaagagttgaaaattgggggttggtgagaacatctgtgnagatgaatctgtanatgagaaggagctgccgcctanaagaaggagtgaagtgtcaagcgttgatgagaagcctaaatagaaagcgaggggagcatcaagtccaaaagtgaactgctgatgaagtcgcccatt

SEQ ID NO: 8716 - DNA, 742 bp, Zea mays
  Predicted polypeptide sequence is orthologous to G1206
gacaaaaataaagccataaccatatgtacaacgatgtttaacataacgactcccggatcaaagacgaaacatatccccaggtcacaggcctaaaatcaatagccatataggccgataacctagctaaattaagcaacctaccctctatcgaatccggaccgtatcatacacatcttcaggcttcatgctagtgaacatgtcagcttgcgctcccacctgaacgatgagccaaccatagctgcatcttcattcctcagacactgtttctgcctgggcagcagccaataatcttccattactctcaggtacaggtgacccatgagcctgagcatccttcactccagaatgattgcctgcagcatctagctcacattctgaactgagctcttcggactggctagatggagatgaatatattaggttcagcatggcgtcaccacatccacccagctcaatcgaagggcaagtaatactgccatcctcatggacagactcttgttgaatcaaccgattcttgaatttatcttcaggggtgttgtccgacatgtttccttcacgtatcttctgacagcaacttaggcacagcttaaacgggcatgttgggcagcaccttaataatcggctcatcgagagcttacagttattacagtagagtgactcactctgaccagtttcagcaacctggacgcagacattagatatttttgttccttgtattttagcttccagttccaactcatct

SEQ ID NO: 8717 - DNA, 906 bp, Zea mays
  Predicted polypeptide sequence is orthologous to G1226
cgcagctagcttcgcaacaagtaaacgatacctcgcgtcgccaagagcttaccgacaccgagaagcagccacgcgctcgcggagctagagctagagcctagagctagagcgcgagagcgaccgtcggccactcgccatgtcggcgctagtggacgcgctgtgcgcgccgcccagcgacaccgcgctcgtctacgacaccttcaacgcggccaacttcctcttcgacgccgccgcgttctgtgacggcgccggcattgtcgccgccccggcgtccgcgcaccaggcgcccgtggaggcgcaggcagcgacgacgtcggcggcgccgacgacgacggctagggccaggaagcggcggcggcggccgaggagctgcaagtccagggaggagaccgagacccagcggatgacgcacatcgccgtcgagcgcaaccgccgccgccagatgaacgagtacctcgccgcgctccgctccatcatgccggaggcctacgtccagaggggcgaccaagcttccatcgtcggaggggcaatcgagttcgtgaaggagctggagcagcaggtccagtgcctcgaggcgcagaagcggaagctgctggttcaccagcgcgtggcggcggcgaagcctgcagacgcgacgccaatgcgcgccagcagcagcggcgccagggcctgctgcgcggattcggcggcggcggcggcgacgacgagcaactgcagcagcggcttgacgacggaggacgcggcggcggaccacgcgctgccgccgcccccgttcgcgcagttcttcacgtacccgcagtacgtgtggtgccactcggcggcgcgcgactccgcggaggaggaggacgggcggcggtcaggggtggccgacgtcgaggtgaccctggtgagacgcacgccagcgtc

SEQ ID NO: 8718 - DNA, 809 bp, Zea mays
  Predicted polypeptide sequence is orthologous to G1229
gaagatcgatcgaaaaagcgatccattattcgatcagcagtgaaaaatgaagacataacagctagccatctgtctctagcatactgctaaactaactacgtactactagagagccaacagcttgtacgtacagtacagccggacgtagattatattgcaccctgctgctgctctgcttgttactaactgtgaataatgcatggaagccatgcatgcatgcaggtacgtagctagccagtgcaagtataagccaacaacaaccctacgttatcacaataacgtctgctgaatttcctgcacaagctcctccgcgctgagctcgcactcgatcccaatcttgatggtgaaggagtgcaccatggtgtcgtccacggtgctgacgctgacgtgaaggatctccagcgggaggctctcgagcgctgcgatgatcttgagcgcctgcccgggcgagcggtgagacaccgtcttcagcacgaggttgggccctgcaaactccaccttcacgtcggggagccgggtgagcccgccggacgccgccggcctgctgcaggctgctgcctgcgcggcgagctcggtcacgaggctgtctagggtcggcaggtacgtcgagtagtgccgctgctgatcgtgcgagtaggacgacgaggaggacgacgtcgtcggcgttccgatgtaggcgggcggcggcggcggcggcccggtgtgggagtctgcagcttccagtcgtcgtcgccgccgcgccggatgcgggcttgtacgggctgcccggggtcggcgtccgggggctcaggggcaccgcgacgtgcggg

SEQ ID NO: 8719 - DNA, 1536 bp, Zea mays
  Predicted polypeptide sequence is orthologous to G1242
agttcacagaggacgccattaaatttaagatggatgataatgccgaactgtatgattttgatgatgagaaggatgaaaacaaggttgatttcaagaaactcgttagtgataactggatcgagccacctagaagagaaaggaagagaaactactctgagtctgattactttaagcaagcgcttcgccaaggtgcaccaacgaagcctagggagccaaggattccaagaatgccgcacttgcatgatttccagtttttcaataaccaaaggctaaatgaattgtacgaaaaggaagtgcggtacctcatgcaagcaaaccagaagaaagataccattgatggtgaagacgaagatcaattggagcctttaacagcagaggagcaggaagagaaggagcagttattagaagagggttttgcatcatggacaaggagagacttcaacacatttattcgtgcatgtgagaaatatggtcgcaatgatattaaaagtatatcctctgaaatggagggtaagacagaagaggaagttcaacgctatgctaaagttttcaaggagagatacaaggagctgagtgattatgatagaattataaaaaatattgaaaggggggaagcaagaatatcccgcaaggatgagattatgaaggctattgggaagaagttagaccgctacaagaacccatggttagagttgaaaattcaatatggccaaaataaagggaagttctataatgaggaatgtgaccgctttatgctttgcatggtgcacaaacttggatatgggaactgggatgaactgaaagctgccttccgtatgtctcccttgttccgatttgattggtttgtgaagtccagaactacccaagagttggctaggcggtgtgatactcttatcagactggttgaaaaggaaaatcaagaatatgatgagcaagagaggcaggcaaggaaggagaaaaggcttgctaagaatacgactccaacaaagagagcagcactaaggaattcagagggtgagagtgctccgttgagctcattcaagaggcgacggcagtctcttatggacgattatgtgggctcgggaaggcgaaagagagggtgatgtgatgtttgacatcctgcctttggagctctcagcgagatgcagtctctgcaatgctttaagcccgtacgtgctgtgcttagtttcttgtgcacgtgagttgaatgcctcaagggctggtgactttgtagtgtaagttatgcaacgatgacatagattagttattataaatcctaaatgaggtatgtatgcgcatgctgtattgtagtgctgtagattcggacttcgcaattgcaactgttgctacacttttggtcagtgatgatgcctttcgctgcaacagttgaggctccagttcaatatttgaagataaatccggtcccttctgtctagggatggccatgggtacctgatacccgttcggtaaaaaccgtattagagcacatgtgatcatttgttataaaaaaaaaaaaaaaaaaaaaaactctcgtgc

SEQ ID NO: 8720 - DNA, 564 bp, Zea mays
  Predicted polypeptide sequence is orthologous to G1246
ttttttttttttttttaccccttgttttttcttcttcttattttttttttattcaaaaattgccaaatcaatgtggtatcctggaaagttttgttgttggttgtgccatattcataaaagttgaaatgaataaaataaaatcatcgcttgcgctgtcataatttcacgcttttctcacaaaagcacgccattcacacattggttaccgtgactttcttcagtgaaggataacatcatgaaagtcggtcttgtgctcatcggcatgctcgccgtagtgaacaggtccaagcttgaggatgcggtagctgttgttggagctggagctggagctggacgactcagtcgaggctcgtcgaggagcacagggacgagtgtgagagcgggcagccggcttctgagggtatgagggagaagtggctggggcgagagacaggaaagaagacttgggagccggggtgagagggaggaacttttgaggaggaagagcagacattgtgaattttgtagtagtaaagagttgctgttgtggttgtggttgtggttgttgatggtgatggtgatggt

SEQ ID NO: 8721 - DNA, 777 bp, Zea mays
  misc_feature (577)..(577): n is a, c, g, or t
  Predicted polypeptide sequence is orthologous to G1247
ctctcccttgccccaccgagtagatttgaggatctccagctttttgaggacaatccagttttcgtcgaagttcaaaatgacggtggtggaggcgggtgaagtgttgaacttgaaggtgggcgagaaccctctactggagggtgaggccaagacggggtacgtctcgcccgacgaccaagacggggagaccgccagcgaaaaaccctgcggcgcgccccagctgaagaagggcccctggagtcccgatgaagataagcttctcaaaaattatgtcgaggcacacggcgaggggaaatggaacaaggtgcagcgcaactccgggctcaatcgctgtggcaagagctgccgcctccgctggaccaaccacctcaggcccgatctcaagaaagggcctttcgacaatgagcagatcgacaagattttgaagttttacctcaagtggggccccaagtgggccaagatagcctcgcgattgcctggtcgcacagataatgaaataaaaaacttttggaataccagaataaagaagactgagaaacagggtttgcctatctatccggaacatgtgctttctcangttaagcaaccgcaacaagacatgaactgtgaaactcctggattgtcacatggcaagaaacggataagagagattgagattcatgatcttatggatgtcaaaatcttatttcagcaccttgactatcataaggatctagtggttccaacaaaaccctttgaaacgccgtgcatctattggtagtctggaaattcctggtg

SEQ ID NO: 8722 - DNA, 821 bp, Zea mays
  Predicted polypeptide sequence is orthologous to G1255
ttctccgcgttgagcttccggacctcgtaccttatcttcttggcgaacagcctcgtccgccgcttctcccggtaccgtgttacccgcgcctctcgcccgccgcccatccccagccgtggagtcaccgccgcctccccacccaaccgtcctcctcccgccatccagcccgtgaggtgggcgtggggccagaaatcgtcgagctggacgcttggccgttggccatcggtccacggcgagcttccccagctctcgatgatggcctcgtagttgaggctgagatccaggctcctcttcaagaattgcgtacccgcggcggcggcggcagcgttgctcgccgacgccttctgttcgaaactgtcctcatcctcgttatccatcatcaccgtgggcgagcagcagttgaagtctgtgtccagcacctcagcagcagctgacgacgcctctggcttcatctccgtagggccaaacccgggagcgccctcgccgcgggagcgggagcttacgatgccgttgggctccatctttatccggccgacgtcttccgcctgctgcgccattagccctaggctctccatgtagaacgatctatccagctcgttgccgtcgtccaggccctggccaagaagggcttccatgtctgcggcgaactctctgagctcggcgtccgtggggccgaagccggcaaagctgtccgggagctgctgcacgggcgattccgcgaccacgaccggtggtgcctttgtgttgttctccacggcgccgtcgacgtcatccctgcagcaggatgaggccgtcgggtcatcgaccggaggcggtggcga

SEQ ID NO: 8723 - DNA, 609 bp, Zea mays
  Predicted polypeptide sequence is orthologous to G1255
gaaaaaaacatgttttttttattttaagttgaattaactaaaaggcagcttccacgaattgtttgttccttcttggcatgatttcctgacgacgggacgagatatgcaaacccccaggctcaacaaccaaacatgcagcaagccgggggcattaagcgaggccagcgatggggaggctgcccccggggggagcacgcttgacgaatcggcccttcatccggggccgcttctcggcgttgagcttgccccccccgtaccgtatcttcttggaaaaaagccccgtcctccgcttctcccgggaccgcgacacccgggcctcccggccgccgtccatccccagcctaggggtgcccgggagggcctcgccgccggggccgacccctccccccacaacccacatgttcgtgtagtcggggggccccctgggggcgagcttgacgggggggcgctcaccgcccccggtccacggggagctcccccagctctggatgatggcctcctaattgagggtgagcgagaggctcctctgcaaaaactgggcgtcggctcccgtgtcgctgctggcggctctctcgtccgtccccgtgtcctgaggcgatgcgtaatcca

SEQ ID NO: 8724 - DNA, 561 bp, Zea mays
  Predicted polypeptide sequence is orthologous to G1267
tttttttttttttttgacatcatcacacagtggctcaaatagtattaaaaagggaaatagtcaattacatcatatgtctgagacatccatatagtctttacaataaatcaaagtgtggaaaagaaatgtagataaacgcggccttcacaggcagccgactgggggttgccgctaacccacgcctagaactcattataatcttggaactcctgatggtctccttccacggcttcatcttctcctgagcagtggttgcaatgctgacaacctccaccaaccgactgttgctcaggggcttctcctgtgagttcttcgggctcctcaaccagatcgttctcgccgatggaggagggccaatcgacagcggagcgcaggtcacggccagcgccgaactccgacatcttcaccatcactctatggtcgcatccgtccactgcgcggctgggcggtggtcggctccgactgcacgaggtccgccggcgtgaggtagagacgaggagcctcccgccagtagagtcccgcggcggcggtaatagggtcggctgcgcaccaaaggaggcg

SEQ ID NO: 8725 - DNA, 838 bp, Zea mays
  Predicted polypeptide sequence is orthologous to G1267
ctcaggcctcagccagcgtgcgcgcccacaacccctcacgtcgtccccgccaatcacaccgcacgaaccgaggacgacgggacaccaccgtcaccgcgacgtagtagtagtactacatgcatagcatagcctcgtggagtcgtggtagtagtagtttagttttgctcgcttccacaccgcaccgccgttcccttttttatatcccgcggatgcgcctgcctctgcctcggggtcgggggggcagctggtgacatcggattcggatcaggccgagaagatcgaactgctccgatccggcgcttaatttctctctctctctctcgggctagctgcccgggcaaatggacgccgagtggagcggcgacgagagcaaggctggcgctgcgggcggagtttcgtcggctgattgcccaagttcgccaccgccggtgtcgccggcgccaccgtccacgtcgccagctgctaccggtgccgggaggaggcggtcggcgaacaagcgggtggtcaccgtgccgctggcggacgtcagtggcccacggcccaagggcgtcggcgagggcaacacgccgacggacgcgtgggcgtggcgcaagtacggccagaagcccatcaagggctcgccttttccgagggcttactacaggtgcagcagctccaaggggtgcccggccaggaagcaggtggagcggagcagggcggagccggacaaggtgatcgtcacgtacctcgttcgagcacagccactcggaggccatggcggcggcgagggcgcagaaccgcccagccccgaagccaaagccggcccagccaccgccagtccccgccggagtccccgtca

SEQ ID NO: 8726 - DNA, 864 bp, Zea mays
  Predicted polypeptide sequence is orthologous to G1269
tccatttccttgcccttgccagccagagcgagactccaccgcttcctctccgccgcgtcctcctcccctccctccgttcctcacggctctccggactcgccccgcggctggccgtgctgagtttcgttctctggccggcaaagaagcgatttttttgtgctttctggacggatcccggccggagaagggaccgaatttccacgacctcgaccgccggctgctcctctgctgggctctccgtgcgcaagaagagcctaccaaggtgaatccggagatttgagctccgggcccgcctcatggagtccatggcgcaggaaagggacgcgttggattcacctgccttgtcgattgacaaaaggctgcggtcggatgctgtcgaatcacccctggtggatgatgcaacgcaacccaaggagggggcggacggttaccctgtcaaggttcggaagccttacacgatcacgaagcagcgagagaagtggacagaggaagagcatgggaagttcctggaggcactgaagctctatggtcggtcttggcgccagatacaagaacacattggcacaaagactgctgtccagattcggagccatgctcagaagtttttctccaaggtcgtgcgtgaacctggggccagtaattcaattgagatcccaccccctaggccaaagagaaaaccactgcacccataccctcgcaagtgtgccgactccaccgtgacaaatgctccaatgggcgaaccgaagaatgctcctgtttcatcaccatctggttctgaccaagagaatggttcgcctgtctcggtgttatctgcaatgcagtcggatgcttttggttcatcaatatcaaacccatcaactgggg

SEQ ID NO: 8727 - DNA, 335 bp, Zea mays
  Predicted polypeptide sequence is orthologous to G1272
ttttttttttttttttttgatcgaacagaaagaacacaaatacaaaaaaaattatagagtatttgcattgatttcatccaaacagagtgttaggccttcaagaccatgctccagtcatagcctagctactccgaataccgagagacgaaaataagagcaaccagctccatatcaaggataagttacgaaaataagaaagcttgaatgctaaacttggagcagctcagcagtagaacataacgtccttcacgttgtccttgatcttgggaagttgacgcacctcgacaggcccctcacgggctactgtctgcccgctgctgccaggtgtcgagcca

SEQ ID NO: 8728 - DNA, 3158 bp, Zea mays
  misc_feature (77)..(82): n is a, c, g, or t
  misc_feature (336)..(340): n is a, c, g, or t
  misc_feature (418)..(422): n is a, c, g, or t
  misc_feature (671)..(675): n is a, c, g, or t
  misc_feature (841)..(863): n is a, c, g, or t
  misc_feature (1046)..(1050): n is a, c, g, or t
  misc_feature (1131)..(1135): n is a, c, g, or t
  misc_feature (1525)..(1529): n is a, c, g, or t
  misc_feature (2315)..(2389): n is a, c, g, or t
  misc_feature (2427)..(2431): n is a, c, g, or t
  misc_feature (2854)..(2859): n is a, c, g, or t
  misc_feature (2945)..(2968): n is a, c, g, or t
  Predicted polypeptide sequence is orthologous to G1272
gtttcggtggggttcttgccgctgcggttgttcgtgcggcgcggatttagggagggttctgaggcgagggcttttgnnnnnntcgagcgatttgcagctttgggtccgatacagtgctcatcaaggctcactaaatggagtctcacaatggcgaggccaatgacttgcctccaccacctcctctgattgctggtgttgaaccacttaaagctgatgaaacaaagatgccattgaaacctaggagtctggtccagagaaatggatttggcagaaaggggcagccaataaagctgataacaaatcacttcaaagtttctcttgtgaatgctgaagaannnnnctaccattactatgtcaatttgaagtatgaagatgatacaccggttgatcgcaaagggtcaggaaggaaagtgattgnnnnnctgcagcaaacttatgctgctgaacttgcaaataaagattttgcctatgatggtgagaagagcctgttcacaattggtgctcttcctcaagttaaaattgagtttactgtcgtggttgaagacgtttcaactggaaagactcctgcaaatggcagtccaggcaatgatagtcctcccggaagtgacaggaaaagggtccgaaggccttacaatacaaagacctataaggttgaactctcttttgcggcnnnnntccctatgagtgcaatctcacaggctttgaggggtcaggagtcagagcacactcaggaagcaattcgagtgattgacattattctgaggcagcactcagctaagcagggttgcctattagtaaggcaatcattcttccacaacaatccttccaattttgttgaccnnnnnnnnnnnnnnnnnnnnnnnagaggttttcattctagttttcgagcaacccagagtggactttcactcaatatcgatgtgtcgactacaatgatagtgaaacctggtcctgtcattgactttctgattgccaatcagaaagttaatgatccaagcatgattgattgggctaagggcaagcgtgcactgaagaacttgaggatnnnnntaagtccagcgaaccaagaacagaagattgttggtctcagcgaaagaacttgtcgtgagcaattattcacactgaaacatnnnnntggtaacaatggtgactctgaagagatcactgtttatgattacttcgtaaagccgcgtggcatagtgctgcaatactctggtgatcttccttgcatcaatgtgggaaaactaaagcggccaacatattttccaattgagttatgcagtcttgtgcctttacaaagatacactaaagctttgaacacacttcagaggtcatcactcgtggagaaatctaggcagaaaccgcaggaaaggatgtctgttttatctgatgtgctgcaaagaagcaactatgatgcagagcccatgttgaaggcatgcgggattacaattgctagaaatttcacagaagttgatggtagggtattgcagccacctaagcttaaagctgggaatggtgaagacannnnnacacgcaatggtagatggaacttcaacaataagaggctcattagagcttgtagtgtcgagaaatgggcggtggtaaacttttctgcacgatgcaatgtcagggatcttgtccgggatctcatcaagtgtggaggcatgaagggcattatggttgatgctccttttgctgtatttgatgagaatccttcaatgagacggtcacctgctataagaagggttgaagacatgtttgaacaagtgaaaactaagcttcctggagcaccaaagtttcttttgtgtgttctagctgaaaggaagaattctgatatttatgggccttggaagaagaaatgccttgctgaatttgggatcgttacacaatgtgtggcaccaactagagtgaacgaccagtatcttacaaatgtcctacttaagataaatgcaaagctgggtggcatgaattcgttgctccaaattgaaacatccccagcaattcctcttgtatccaaggtcccaactataatcttgggaatggatgtgtcacacggttctcctggacattctgatgtaccatctattgctgctgttgttagttctcgtgaatggcctcttatctcgaaatacagagcttctgtccgcacccaatcacctaaaatggaaatgattgactcattgtttaagccacgggaagctgaagatgatggtctgatccgggagtgtctgattgacttctacaccagttctgggaagagaaagcctgaccaagttatcatattcagggacggtgttagcgaaagtcagtttaannnnnnnnnnnnnnnnnnnnnnnnnnnnnnnnnnnnnnnnnnnnnnnnnnnnnnnnnnnnnnnnnnnnnnnnnnncacgttgattattgcccagaagaatcatcacactaaannnnncattcctggaaagccagataatgtcccaccaggaactgtggtggacaacaaagtctgccatccaaagaacttcgatttctacatgtgtgcgcatgctggaatgatcgggactacgaggccaactcactaccacatcctgcatgatgagataggcttcagtcctgatgatctgcaggagctggtgcattcgctctcttatgtgtaccaaaggagcacaacagccatatcagtcgttgctcccatctgctacgcacatctggcagctgctcaggttggccagttcataaagttcgatgagatgtcggagacgtcctccagtcatggcgggcatacttcggcgggcagcgttccggtccaggagctgccgcgcctgcatgagaaagtgaggagctcgatgttcttttgctgagccgtggttttacnnnnnnggtggatggtgaacccctctagttatgtcggtagacgctcttggatgacgctctagttgtggtccaggaaggctcgagctggtacnnnnnnnnnnnnnnnnnnnnnnnncgtcgctgcggctatgttggtgcctcaggaagacttggaacctggttaggatgtcgttaaatctaccccttatcgttcctggttcgttgggctgttgttcttattgtccgtcctggtgtctgatttctgctttgttgcatgcaagtgtgaggcccagcttgatattgaaaagtttggcgtacatgtcgtt

SEQ ID NO: 8729 - DNA, 2052 bp, Zea mays
  Predicted polypeptide sequence is orthologous to G1272
accggtccggaattcacgggtcgatccacgcgtccgaaaggccaagcgtgctctctagggcttgaggattagaaccactcctgcaaattcagaattcaagatttttggtctcaacgagaggatctgcaaagaacaagcgtttccgctgaggcagagaaatggtagcaacggagattgtgataccattgaaataactgtctatgactactatgcaaagaaaggaatcgatctaaagtattctggtgatttcccctgtataaatacagggaaggcaaagcgcccaacatattttccaatcgagctatgctcgcttgttccgcttcaaagatacaccaaagctttgtctacgctacaaaggtcatcccttgtggagaagtctagacagaagcctgaagaaaggatgaccgttctaaatgatgcactgcaacgcagtaactacgattctgaccccatgttgagggcatgtggtgtttcagttgctccaaaatttacccaagttgaaggaaggatccttcaagccccaaagctgaaagccggcaatggtgatgatatcttttcacgaaatggacggtggaatttcactaataggaagttttatgaaacctgctctgtgaataagtgggcggtcgttaatttctctgcacgttgtgatgttcggaatcttatccgtgacctgatgaggaatgcatctgcaaagggaattcaaatggaggaaccttttgatgtgtttgaagagagtccctctatgaggcgtgcacctgtgtcaagaagggtggatgatatgtttgggcagataaaatcaaaacttcctggagctcctaggttcctcttgtgccttctccctgagaggaaaaattgtgaaatctatggtccttggaagagaaagtgcctggccgagtttggtattgtcacacagtgtctagctccattaagagtcaatgatccgtacctgcttaatttgctgatgaagatcaatgcaaagcttggtggtctgaactcgttgctgcaagttgaagcatcttcgtcaataccacatgtgtcgcaagtacccaccatcatcttaggtatggatgtttcacatggtcatccaggacaagatagaccttcggttgcagcggtggttagttctcgtcaatggcctcttatctctagatatagagcatcagtgcacacccaatctgccagactagaaatgatgtcctcgttgtttaagccgcggggtactgatgatgatggcctcatccgggaatcactgatcgacttctacactagctctggaaagcgaaaaccagaacacataattattttcagggatggagtcagtgaaagtcagtttacccaggtcatcaacattgagctggatcagatcattgaggcatgtaagtttctggatgagaagtggtcacccaagttcactgtgattgttgctcaaaagaaccatcacaccaagttctttcagacgggcatcaccagacaatgttcttcctggaactgtggtggatagtaaagtttgccatcctaagaacttcgacttctacatgtgtgcacatgctgggatgattggaacaacaaggccgacccactatcatgttctgcacgacgagataggtttcagtgccgacgagatgcaggagtttgttcattcgctctcttacgtgtaccagaggagcacgacagccatctcagtggttgctccagtgtgctacgcccacctcgctgcagcccaggtgagcacgttcctgagattggaggagatgtcagacgcgtcctccagccagggaggagggcatacctcggctggcagtgctcctgtgccggagctgcctcgcctgcatgacaaagtcaggagctccatgttcttctgctagctgatgtgcgtgcgcatcaggatcgagctccatgttttgtgttagtaaggcctagttagtaaggctgtagaaagaatgtttaatgtttgcatgctaaagtagctcaggaatgaaacgagccaagggcagaaccaaaacaatcaaaaccactactatatctaccagagcactgatcgatcaaaca

SEQ ID NO: 8730 - DNA, 759 bp, Zea mays
  Predicted polypeptide sequence is orthologous to G1272
ttttttggggagtaatcttctatttcttaattgccaaatgttcgaatacaagagataaataggcattatgccttctaacaaacatagatggaaaaactcctcaaattgagaccgtggttttctggccgcggtgactcagtctccaccgatgatttgttgcaacccaatgatcaacacctgattaaattgactttcgctaacatcgtccctggagatgatgacttggtcagcctttctcttcctagaacggatcagaccaccttcagcttccccccgaattaaacaatgagtcaaacatttccattttaggcgattaggtgcgaacagaagctttgtatttcgagacaacaggacattcacgagaactaacaacctaagaaaaacaaaatgaaacagtcacagtagctactatttattaaatatcatataaaattatcaaacgtatatttacagagcattgttcatatacaaagagagcgttgttcaatccagatccgaaagaatgtacaaaaaatctagttcctggaccaaataagtatcacaaatatcaactttcaaattgtcgttgtaagattggtagaaagcataaaaattttccagcaagtagacgtgtgtattctggcttttaaaggttgaaaatgtgcatgccttcctagttattgaaatcacgccaaagtgataagcatcaaatgatttaaagataataaagtgaaattttgctttcaggcaactatgtaacttagtcaaggtttgatagta

SEQ ID NO: 8731 - DNA, 832 bp, Zea mays
  misc_feature (666)..(666): n is a, c, g, or t
  Predicted polypeptide sequence is orthologous to G1272
ttgctccaaattgaaacatccccagcaattcctctcgtatccaaggtcccaactataatcttgggtatggacgtatcacacggatctcctggacattctgatataccgtctgttgctgctgttgttagttctcgtgaatggcctcttatctcgaaatacagagcatctgtccgcacccaatcaccaaaaatggaaatgattgactcgctgtttaagccacgggaaactgatgacgatggtctgattcgggagtgtctgattgacttctacaccagttcagggaagagaaagcctgaccaagtcatcatcttcagggacggtgttagtgaaagtcagtttaaccaggtgctgaacattgagttgcaacaaatcattgaggcttgcaaatttcttgatgagaaatggaatcccaagttcacattgattattgcccagaagaatcaccacactaaatttttcattcctggaaagccagataatgttccagccggcactgttgttgacaacaaagtctgtcatccaaggaacttcgatttctacatgtgttcacatgctggaatgattgggactaccaggccaactcactatcacatcctgcatgacgagataggcttcaatcctgatgacctgcaggagctggtgcactcgctctcttatgtgtaccanaggagcacaacagccatatcagttgttgctcccatctgctacgctcaccttgcagccgcccaggttgggcagttcataaagttcgacgagatgtcggagacttcatctagccatggggggcatacctcggcgggcagcgtccctgtacaggagctgcccgtctgca

SEQ ID NO: 8732 - DNA, 794 bp, Zea mays
  Predicted polypeptide sequence is orthologous to G1272
ggagaggaagcaggacctgggagacctcgcctcgtccgtcctcctgcctacttccttgcttttggtaggtgctgcttgttttatcttgaaatgggctctcatgatggcgaggatgaagagttgccacccccccctccggtgccaccagatgtgattcccattaaagctgaagatgctgtgggtgaatcaccagcaaaccatatattaaagccaaagagattactgatggacaggcctggtataggaagaaaagggcagccgacccagctctattcaaatcactttaaagtcgctgtgaagagtacagaagacgtcttctttcactactatgtaaacctgaagtatgaggatgatcgacccgttgatggtaaagggatcggcagaaaggtgattgataaactgcagcagacatatcgtgcagagctttctaacaaggactttgcatatgatggagaaaagagcctgtttacagttggtggtcttccacaaaaaaagaatgagttcaccgttgtcttggaggacgtatctactggaaagactgctgccaatgggagccctggaggtaatgacagtcctggaggtggtgataggaagagagtgaggaggccataccagacgaaaactttcaaagtggagataaattttgcagcagaggttcctatgagtgctattggtcaagtcattagaggcgaagaatctgagaactccctggaggcgcttcgtgttcttgatatcatactgaggcagcattccgcagaacaaagctgctttttggttaagcaatcatttttcta

SEQ ID NO: 8733 - DNA, 811 bp, Zea mays
  Predicted polypeptide sequence is orthologous to G1272
cggaaagaagcccggccgggtcggaaggggagcagttctcgccttctcggggaggtcgccagcgggttgggcagaggctttgcagcttttgggtcagacgcagtgttctccaaggctcactaaatggagtctcacaatggcgaggctgatgatttgcctccaccaccccctttggctgctggtgttgaaccacttaaagccgatgaaacaaagatgccattgaaacctaggagtctggtccagaggaatggctttggcagaaaggggcagcagataaagctgataacaaaccacttcaaagtttctctcatgaaggctgaagattttttctatcattactatgtcaatttgaagtatgaagatgatacaccggttgatcggaaagggtcgggaagaaaagtgatcgaaaaactgcagcaaacttatgctgctgaacttgcaaataaagattttgcatatgatggtgagaagagcctgtttacaattggtgcccttcctcaagttaaaatggaattcactgttgtggatgaagacgtttcaactggaaagactcctgcaaatggcagtccaggcaatgatagtcctcctggaagtgacaggaaaagggtccgaaggccttacaatacaaagacatataaggttgaactatcttttgcggcaaaaatccctatgagtgcaatctcacaggctttgaggggtcaggagtcagagcacactcaggaagcaattcgagtgattgacattattctgaggcagcactcagctaagcaggtttgcctattagtaaggcaatcgttcttcccacataatc

SEQ ID NO: 8734 - DNA, 816 bp, Zea mays
  Predicted polypeptide sequence is orthologous to G1272
gctcggaaatcataattgggatggataaattcatgcataagttcttgagttatggccataggttacagaataaaagcatcaacaatcagctaacagattcgtcagaacacgtgatccaaaattactgctcttaaaaatgagcttcattacgccaacagttcttcaacattatgatcagtacttgaactctgagctatattctcatatcaaaatctgagaacaagaacaataaactgaagcagatgaggctttaaaatctgtacttgagaggtcaagcacagagaggagcatagacttaagatgatgaacgtaagtcatagttttaaaatctgtacttctgaccactcgtcattgtctccatttgagacagaaggaatttctgaagatgatgacttggtcaggctttctcttcccagaactggtgtagaagtcaatcagacactccctgcagcaacattaaaatccaacaagcaatgggagaaagcatgtcattagtacataacttaacaaatgtaatgcaggctaaaatatcttacctgatcagaccatcatctttagcttctcgtggcttaaacaatgagtcaatcatttccattttaggtgattgggtgcggacagaagctaacaacaatagatggtacctcacaatgtccaagagaaccatgggacacatccattcccaagattatagttgagaccttggatacaagaggaaatgttggggatgtttcaatttggagcaatgaattcatgccacccagctcatgtcaccggtgtgcccgtggtcccgtccccggtgtcggtggtcgtcgatgc

SEQ ID NO: 8735 - DNA, 527 bp, Zea mays
  misc_feature (19)..(62): n is a, c, g, or t
  Predicted polypeptide sequence is orthologous to G1273
ttttttttttttttttttnnnnnnnnnnnnnnnnnnnnnnnnnnnnnnnnnnnnnnnnnnnncagctggtatgacaactgtgagagtgacttggagttgtaaacaaaataaagaaaagtaaaggcagcagtctttaatggaattgtgaaaccagcagcttaggctagatttaagtactggaacgaagaatctgaacttctggttgtcttcgtctctactccggcggcgtcatgtcgtcaataccatgcgtgtcacacatcacagcatctgtgcttgtcgacagcaatggcttcctcgggggacaaggcttgcccggcttcaagtgggtgggctcaccactatacacgatctcaacaacctggccatctggcgtcgtctccaccttcctcttcacagggcagctagggtgagtgcacttgtagtagctccgcgggaactcgctgactttcactttcttttgcccgtatttactccacctgtacccgtcaagtgacaagcgactgcgctcaccattccgcctcgcagct

SEQ ID NO: 8736 - DNA, 795 bp, Zea mays
  misc_feature (7)..(32): n is a, c, g, or t
  misc_feature (140)..(144): n is a, c, g, or t
  Predicted polypeptide sequence is orthologous to G1289
taccccnnnnnnnnnnnnnnnnnnnnnnnnnncgagcaagatacacaacacgtttcatgatcccttccctttgtatgtatttgtcaaaacttgcctactactgcataagtctataacatccttgttattatgctttggcnnnnnggaggggtattacctcaacttaccatatgtattttctatacttatacaggtaataatctacatagactgtgttgtagaaagaattagtttgatcaggtctcaaagaatcaatagaatcgttggttgttgaagactcccttgaaagtacgatctatatgtcaccctgatgtggaagctggtttgccaggacgccagaaactctttgtagccacaagaaattgctgtttcacgacgacaatttcatagtgcagagacttcaggattgggcgtatcttctttatcatctctaacgtgtctttcaacacaaaccatcttccaggtctcagtattctgtcgatttcaaccaccacgtcgatgaggtcacacctgtttgtaagatttccaatgagattactcatgtggagaagatcataggtacgagggtaggtgctgaaagattcgcaccagtcatgatatgccccaatcaaacctctgttgaaaataagtggcaaggtatctggttgaccaattggcacagcattcataacccataaaggttgatcaatgagtgctgcggcaaaccctccaaacccagcattcatgtccattacattgcgaatgcttgaccaattaagtgggaagtcattgaaatatacttctgaaatgaggctg

SEQ ID NO: 8737 - DNA, 1263 bp, Zea mays
  misc_feature (67)..(96): n is a, c, g, or t
  misc_feature (108)..(112): n is a, c, g, or t
  misc_feature (181)..(185): n is a, c, g, or t
  misc_feature (281)..(305): n is a, c, g, or t
  misc_feature (869)..(874): n is a, c, g, or t
  misc_feature (1063)..(1068): n is a, c, g, or t
  misc_feature (1213)..(1217): n is a, c, g, or t
  Predicted polypeptide sequence is orthologous to G1289
cttttgcaagaggcaagaatcatggctaaatggacaatattgatgtcatacagtagaagtttatagnnnnnnnnnnnnnnnnnnnnnnnnnnnnnngcctaacagaannnnnagcactaacctattgatttaacctgtttgcaataacaaacagaaatttgcatgaccaaggccaaaacannnnnaaaatagtaaaacaaagcgggaaaattggaacatgaaactcaacttgatatggggcttcaatgaagcatctaatctatgctatgagaagaatcgannnnnnnnnnnnnnnnnnnnnnnnnacaatgagtccatggagccaataccattttgggtggaagccggaatcatcatgactaagaacctatactgccagggcgccagaaacccttggtggcaagaagaaattgatgtttgacaattgtagtcttgtaatgcaaagacctgagaacagggtccatctttcttatcatgtctatagtgtcttgcagcacaaaccatctaccaggtctaagtattctgtcaatttcagctgcaacttcaatgatgtggcaccttttcgtaaggggccctaagagataactcatgtgaataagatcataagttcgtgggtatgtgttaaaagattcacaccagtcatgatataccccaatcagacctctgttgaaaatgatgtgcaatgtatctggctgatcaacaggtacaacattcataacccacaacggtcgattgataattgatgctgcaaatcctccaaaacccgcattcatgtccataacattgcgaacactagaccaattaactgcaaattcgttgagatatatttctgaaacaaggtccttccaataacttgtatcagaatcaannnnnncttgaggaaactgaatggaagaattgttagatgtagccgagtgcttaatattaagtctttcaggccacgagacggcccaactattcccgtcacctgaactcggaactgcaggaaagaggcaactatcgagaggtttataccaagggaaacgtgatccatcactctcagagcacagaggtggttcattannnnnnctctcaagggagcatgaatttgatgtcggcttttggtatataacaactccgatcttattgatatctcgagaccttaccactgtcctccagcagatcgatttggtcagagctaccaccgcattccaatcatctatatctcttgggnnnnngcgataggcaggtgttgcagaccaaatgtaataccctccaggcctg

SEQ ID NO: 8738 - DNA, 789 bp, Zea mays
  Predicted polypeptide sequence is orthologous to G1313
ctctatctctctctcagtctctctcttcctccttaaaactctctctcccagcactgaaaattctccacatactctgctgctgctaagtggtggcatctcgtttacgcgagatccccctcctcccccgctttccactcctctcctccaccctagtcgactccttccctgcaatccgctggccggctcacagtaccagaggagtccaccggaggagctcagctagactcccaccctggtggctcgatcggcaccggccgctgcctgcgagactccgccagcgcgcgatgtaccgggtgaagagcgagggggagggcgagggctatggcgactgcgaaatgatgctgcaggaacagatggactcgctggtggccgacgacgtcagcagcggaggagggtcgcctcacaggggcgtcggcacgcccctgaagaaggggccatggacgtccgcggaggacgccatcctggtggactacgttaagaagaacggcgagggcaactggaacgcggtgcagaagaacaccgggctgttccgctgcggcaagagctgccgcctccggtgggcgaaccacctcaggcccaacctcaagaagggggccttcacccccgaggaggagcgcctcatcatccagctccacgccaagatggggaacaagtgggcgaggatggctggtcacttgccagggcgtactgacaatgagatcaagaactactggaacactcgaataaagagatgtcaacgagctagccttcctatttatcctgctagtgtatgcaatcaatctacaaatg

SEQ ID NO: 8739 - DNA, 843 bp, Zea mays
  Predicted polypeptide sequence is orthologous to G1313
ccctagcggaacaggtgacggcggcgcgctaccggtgacgggggatacggcggcatcgtcctcctcggcccctcctccatccccggcgtggcggcgccagcagccggcctgcagaagattaaaggagccccaggagccccaactttcggaggacgacccagctgccttcaaagttcaaaatcaaaatgacggtggtgagggtggacgagaaccctgcgccggatggagagaactctcccctagacgatgagtacgtctcggccgacgatgaacacgttgatgatgaagacaaggagaccgatagcatcgacgactatgaaaaccccagcgggacgccccagatgaagaagggtccctggtcgcccgaagaggataagcgtctcaaagactacgtcgaggtacacggcgcggggaactggaataaggtgcagcagaatgccaggctcaaccgctgtggcaagagctgtcgtctccgctggacgaaccacctcaggcccgatcttaagaaggagcctttcaacgctgaggaagaggaaaagataatcaagcttcacattagacggggccccaagtggtccatgatggcctcatatttgcctggccgcacagataatgaaataaagaacttttggaataccagaaaaagaagaaaacagagatgtggttcgcctctctatccagaatatatgctttctcaggttagtcataaagacatggactttgaaactcttggagagtcacatggcaagaaacggtcaaatgagtgctcaaaagaaaaggttgttgatgtgcaagaacttgtggatgagttaattgtatttgagcaccttgactatggtaagg

SEQ ID NO: 8740 - DNA, 918 bp, Zea mays
  Predicted polypeptide sequence is orthologous to G1313
cggcgccgtctccggcgcgccgagcgctgggtgcaccaggccgaacagcgtgtccatgtcgtcaccccgacgctgcaggccgctgattctgctctctgggactgaaactccgcaatcatgccgctccagtgcagcgccgccgccgctggccgggaccagcgcctgcggttcgaccttgatgacgtcgtgcagctcctgcagcatctgttcgaggctcgccgcgttctgatgatccggcagcgcaagtccggcggcgacggcggcggccgaggtcggcggcgccggctggccgtattggtttgaagggagctccactctggggccgggggacggcgagagcggtgggagcctgctctggtcggcagcggcggcggcgcgcgcgccgtggccgccgagagacaggtccggcatggccgggtgcaccggcccggtcggcgtcgacggggacacgggcgacgagtgcgcgagctggaagtactgcgcgttccgcgcgaacggcttggcccacggggacgacggcgccgagaagggcggcggcgagaggaactgcgccgtctgctgggtcgtcgtcgcggcgagctggctgcgagccaggtcgagcggcgccgggcgcgagctggcgtacccgggcccggcgcccagcgcctggacatcggtcgtcgtcgtcgccgacagctgcggggacgacgcgagcggcgggaagtcgtagtcgtcgtagtggcagcgcttggagagggcaaggtggagctgcacctccggcgggtacacgggcaggccggcgcgctggcggcgcttggtcctcgtgttccagtagttcttgatctcgttgtccgtcctcccgggcaggtgcgcggccatgcgcgcccactgtttgcgagctgcgcgtggagctgggctatgaggagctcctcgtcgggg

SEQ ID NO: 8741 - DNA, 806 bp, Zea mays
  Predicted polypeptide sequence is orthologous to G1314
tgcgcggttgcgccctgcccctgcgtctgtacgcccccgcccccgtacggctatctaggctaccactcactggtcactggtcagactcagaaccccagcagcactgcgcagtgcagcgcatagttgatcagctgcagctcgtgcacgtagccgtgtgccgcgcgcggcggacatgggccgcgcgccgtgctgcgacaaggcgagcgtgaagcgggggccctggtcgcccgaggaggacgagcagctgcggagctacgtccagctgaacggcatcggcggcaactggatcgccctgccgcagaaagcagggctgaaccggtgtggcaagagttgccggctgcggtggctcaactacctgcggccgaacatcaagcacggcggctacaccgacgaggaggaccggatcatttggtcgctctacagctccatcggcagcaggtggtcgatcatcgcgtccaagctccccggccggaccgataacgacgtcaagaactactggaacaccaagctcaagaagaaggccatggcggccagtagcagcggagcagccttcgcggcgcccgccacgccggcgctctcgcccgcctcctcgtgcgtcaccagctcctccagcggcgacgtgcgcctcggcgcagcgtacacggagccgccgccgcctcggcagcacgcggggctcgtacgctctgacgctccgcggacggagctcgcgcccgtgccggcagtcgcgcacctggacggcgcctgctggccggccgcggcggcgctggacgtgctcctgcccgagctcggcggcgagcagctgttcc

SEQ ID NO: 8742 - DNA, 590 bp, Zea mays
  misc_feature (57)..(57): n is a, c, g, or t
  misc_feature (87)..(87): n is a, c, g, or t
  Predicted polypeptide sequence is orthologous to G1317
gaggttcttggtagaacttttttgcggcttctgatagatctttccaaatatataatngcttcgtttgggatgtcgatattggaggancatggaattggattggattcaataccaaatcagtcatgctattgaaatgagatgtaattccaattctattgtttggacgtcgctgaattggagtttggaattgtgcggtctaattccacgcaatacagaggggtgacgttcggtattgggagagggagtttctagttatagtccaattctagtgaattgggtctctgattccaaatatcaattctgtgtgcaaccaaacgacaaaatttaggaaagctgaattatatgctccaatatcgacatccaaacggactataatgcaaaaccaacccctctaatatttccatgtcaagctaggtagatcctagaattttgaggccaggagatagcaaaaagtcatgcctaacaaaatataagaggaaattaagtaccgcaaaacaataagctcagtaatagccatgactatataacttggacaaatgaacttatttaccagggcaactattttcccaattgctgggttaactttctgc

SEQ ID NO: 8743 - DNA, 590 bp, Zea mays
  Predicted polypeptide sequence is orthologous to G1324
gtcccttccagtttccctttttagaccaaagatcattggtacagcttactgcaggaagatctctaacacctaaaaaacacaaactaacttaatactcaccagaatctaaacaaccactatgcaaactcatctaaaaacctaccagcaaaaaaatgcgacaaatatacaaccacagctgcatttaccttcagcagttcatgcaaaacaacaccaggctcctgctacctagccaaaattcaaccacaatagagaaaacaacactctaattttgttcaatgttgtttaccatgttcctgataagctctgccactctttctttatccttctgtgataccatcaccgtccagttctgcagcaaggccaccagcttgaataagaccactaccagctaccaccttggctcctttatcaagttgttggaactttgttttgttaattctgactgctgattggatcctacaatggaatgccatccactgaaagatattcaccagtgtaagagctatgcagtcttatacgtccaccttatgttgattcaccacaccaccataagttaaatctttgtatagagattttgttgtgtctccctg

SEQ ID NO: 8744 - DNA, 441 bp, Zea mays
  Predicted polypeptide sequence is orthologous to G1324, G2893
ctaagccgccacggtcaaggttgccttctattgccgcccgacccttgaagtgtggctgcagtagttcgtcgtgactcgtggagtcttgtgataagcctcgccgggcgtggaggtaaccgggtgagagggaattcctcatcgtcgtcatacgtacctagtggctgtcgtacgccatggctagccaatctgccaccaccccatcagcgaggttacgagtcacctgaagagcaagttggtacctggaatctcaagtcccaggtcaagaacaggtaccgcaggatgaggcgcatgaaggatgttgtgacgacttcgtgagaggtgtaggccgtcatctcccagtcaactttgggttgctggatcgttgtctccttatgatgtaattatttatttattttgtacagaactcctattatatagtaaagatgtgacattgctttttgt

SEQ ID NO: 8745 - DNA, 1292 bp, Zea mays
  misc_feature (31)..(35): n is a, c, g, or t
  misc_feature (192)..(217): n is a, c, g, or t
  misc_feature (323)..(348): n is a, c, g, or t
  misc_feature (668)..(689): n is a, c, g, or t
  misc_feature (706)..(728): n is a, c, g, or t
  misc_feature (735)..(765): n is a, c, g, or t
  misc_feature (807)..(866): n is a, c, g, or t
  misc_feature (931)..(953): n is a, c, g, or t
  misc_feature (957)..(993): n is a, c, g, or t
  misc_feature (1267)..(1286): n is a, c, g, or t
  Predicted polypeptide sequence is orthologous to G1330, G2423
gcacgagccgataccggcctcaacgccctcnnnnncccagcctcacaaccaattcctgtttcagtcgatcgcagttagcatggccacgacacagagctgtcagagcaggagcagcgcctgcagcaaggctgctgcttgcttcccggccgccgtagcggtcgacgaggagcacggccaccacagccaccagcnnnnnnnnnnnnnnnnnnnnnnnnnngagaacgacaataataagccggagctccggcgtggcccctggacggtagacgaggacctcaccctcgtcaactacatcgccgacaacggcgagggtcgctggaacnnnnnnnnnnnnnnnnnnnnnnnnnngcggacgggcaagagctgccggctgcggtggctcaactacctccggcccgacgtgaagcgtggcaacttcagcgccgacgagcagctgctcatcctcgacctccacacccgctggggcaaccgatggtcgaagatagcgcagcacctgccgggaaggacggacaacgagatcaagaactactggaggacccgggtgcagaagcacgccaagcagctcaactgcgacgccaacagcaagcgcttcaaggacgccatgcgctacctctggatgccgcacctcgccgacgacgtcgataccatcgctgcggccaacgacgacnnnnnnnnnnnnnnnnnnnnnntacgcctcctcgtcctnnnnnnnnnnnnnnnnnnnnnnntgcagcnnnnnnnnnnnnnnnnnnnnnnnnnnnnnnncgaccttgctgcgggcgcctacgacgtccgccagctgcacgnnnnnnnnnnnnnnnnnnnnnnnnnnnnnnnnnnnnnnnnnnnnnnnnnnnnnnnnnnnnacgatgacggaggcctgcttttcgcgaacttgcgcgccggcgagatgctgatggacggcggagannnnnnnnnnnnnnnnnnnnnnnaccnnnnnnnnnnnnnnnnnnnnnnnnnnnnnnnnnnnnntcttgatcagtcggtggtgcaggctgctggtgccggcgctggccagtttcaggacatggagctcagtggttgggtgcaaggcttctccgagagcattacagataacttttgggccttggaggaaatttggaagatgcaatgagcgagcaattttacatcttacacatccatccaaattaaagacaacatagatacacatatacatatcatatattctaacaacaggtgccatatacgatatacatacacaagttgttgtatagttgtattccgnnnnnnnnnnnnnnnnnnnngcctct

SEQ ID NO: 8746 - DNA, 910 bp, Zea mays
  Predicted polypeptide sequence is orthologous to G1330, G2423
cttctcccgccttctcctcctcccagcacagcagcagctgtgaccacatcaccacacacacacacatatatacttggtcatcatccagcttccagcagccagctgcccgccgatcaacgtgtaggcggttcaaagggaaatctgctgatggacatggcgcacgagagatcagacgccagcagcgaggaggaggtgatggccggcgagctgcggcgcgggccttggacggtggaggaggacctccagctggtcaactacgtcgacgcgcacggcgagggccgctggaactcgctcgcccgatcagcaggtctgaagcgcactggcaagagctgccgcctccggtggctgaactacctccggcccgacctccggcgcggcaacatcacgccgcaggagcagctgatgatcctggagctgcactcgcgctggggcaaccgctggtccaagatcgcgcagcacctccccgggcgcaccgacaacgagatcaagaactactggcgcacgcgcgtgcagaagcacgccaagcagctcaaatgcgacgtcaacagccagcagttcaaggacgtgatgcgctacctctggatgccccgcctcgtcgagcgcatccaggccgccgcagccaacaataacgccagcggcgccggggttccgccagctggcgccgccgcggacgacacgccgctctcgtcgtcgtggcagcacggcggcggcgccgacgacgacggcggcctctacgcgtcgccggagctgcccacggacgcctgctggccctccgcagactgctactactacccagccgccgctgaccaccagctactgaacaaccccgccgccgccgccgtcttcccggacctgtcaagcaccacggccgggtcgtcctctccgtcctcggattcccgcgcggggacag

SEQ ID NO: 8747 - DNA, 129 bp, Zea mays
  Predicted polypeptide sequence is orthologous to G1331
gtgaactacctgaggcccgacctgaagcgaggcaagatcacgccgcaggaggagagcgtcatactccagctccacgccctgtgggggaacagatggtcgacgatcgcgcgcagcctgccggggcggacg

SEQ ID NO: 8748 - DNA, 766 bp, Zea mays
  Predicted polypeptide sequence is orthologous to G1340
gatcgcaacgcaagctccatctccagtcaacaacgagtcaatgcatgcacaaaaaaaaggggagggagggagctcaaagcagatacctagcactagcagcagcagcagcaggaggacacgttgtacttactactactacatgcacgcgagcgagacggaccaatgcaatgctacacacacgcttccattccaccacctccaaaagaattcggagtcacacagcctccaacaaacaatgaatcacgcttcaccttatttacatcctggtcggtcggtcggtttgtcggtcgatacctggatcatgttgtcgtcggagcccagatatagccgcccggccgcgacggacgacggatcgcacaacgaacgccggcgcggcggcagatgagccgagccgagctgagctgggagaggtgttgacaacgacggacggtcaaggccgagcgttagttgccggcctgcccggcccgatcaccgggaggcggagtcgccgctgcggtggtcggagacgagggcgtggatggcgctggagaggctgttgacggcggaaacgaggcccgcgaagccctggcgccgcacctccgtgcgctcctcctccagccgcagccgccgctcctccagctccaggacctcccggtgccgccgctcccgcttctcctcgcacgccaccagggtgcgcgccagcaccgtcgcgctgcgcaccacgctggaccccagccggttcagccgccgccgcttcggctccggctccgccacggcgtccgacccg

SEQ ID NO: 8749 - DNA, 726 bp, Zea mays
  Predicted polypeptide sequence is orthologous to G1340
cccaaccacaccgccctcccctagctcgtcgcgtcccgacccgatgccgtagctagcagcggccctgcagccagccacccacccacgcctgcagccgtcgcatgtcggacaacaccgtagccaaggcggcggcagcgaccatgacgcccgccgccgcctccgacccgtcgccgtcgtcctcgtccggcgtcggggcgtccccgctcgcgctgctccgcccgcacgcgcacggccacatgacgccgccgtcgccggcgctcgcggccccgccgccgtccccggcgtccgcgccccgggactaccgcaagggcaactggacgctccaggagacgctcgtcctcatcacggccaagcgcctggacgacgaccgccgcgccggaggcgcccatgcccacgcccacgccctggccgggtcgcccaccacgccgcgctcggcggagcagcgctggaagtgggtggagaactactgctggaaccacggctgcctccgcagccagaaccagtgcaacgacaagtgggacaacctcctccgcgactacaagaaggtccgcgactacgagtcccgcgccgccgccgccgcgccggccgccgcgccggccacgagggctctcccgtcctactgggccatggagcgccccgagcgcaaggaccgtaacctgcccacccacctggcgcccgaggtgttcgacgccgctcaccgacgtgctctcccgccgcgccgcgcgc

SEQ ID NO: 8750 - DNA, 898 bp, Zea mays
  Predicted polypeptide sequence is orthologous to G1340
ggcgctcctccgcggccatcacctcccggtgccgccgctcctccgcggcctcccggctctccagcgcctccgacaggatcgccgcgcaccgtccgatcgctccgcccaggacgttgtagtcgtcgtcggagtactcagtctcagactcggcggagctctcgtccccgtcgtcctcctcctcctcctcgccgtggcgtccttgtcgtccctgacggcaggcgtgcgttccagctggcgctgacggcgtgccgctccctggccgcagctcgtccagtgacggccgcctcctcttcctctccggcgactcggggctggaatgcccgtgcgtcccttgttcttgatcatatgcatggagaaagaaaacaatcatgcgtatgcgacgacatcatcgtggaccacagaaatggcgcccaagcaatagaatgcagacagtgacgagacgaccaataagtaccgggaggcagaggtcgtggcaggacttgagcgagcggggaagcttgcatgggaacgtcgagtaggctggaagaggacgccgccgtgagtccgcctccgccactgccgcagcagcccatggtcatcctcctcttgatgacctcgcccatggcgtcgtatatctcgcggaggaggttggtcgggaggcccctctccttcctctcctccctgcccatcgcccagtagctgggcgctctgccgccggcgccggccccagtaccgctgagctcgtacgcgcgcaccttcttgtagtcccgcatgaggttgtcccagcggtcgttgcactggttctggctgcgccggcagccggcccgccagcagtagtcctcgacccagcgccaccgcgccaggccctggtccccccgggtgccgctcctcgtgcaccttccgcttgggctcgatcagc

SEQ ID NO: 8751 - DNA, 780 bp, Zea mays
  Predicted polypeptide sequence is orthologous to G1341
tttttgagacgtgcagttgaagtctgcatgaatcctttccataatttaaagccacatatgttttatgatacttcacatctcttctcaaattgagagttgagacattgtgatctattcaagactattatgcctatattgacttcataaaatcctccgaaaactattcaaagttctgaaaattagaagaaaagggtattcacgtggaaccagtttatacttcgcctacttacaatgaataatcacagccatcgtagcaatgtcacgagcaaatagcagatgaagccgctcccgagtgaataacagcaacttcactgcatcagctgataccttcaaatgcctgcacgcacactcctgagaatccctccagagcatggaacacatttggaagggctgtctgcagattgttcagtgtcatggctcggctttccctaacagaggttaggtatctggccttctcctcctcgaccttctttctaaatgcatccagtttcgtttcattctttgatactgaatagtgattcttatttggaggctgtgccgagttttgaattgaattatcactgtgtttctctaactgggtctggaacttgctatccatattatctgacttcttctttagttggcgctcttcactctgctgtacaactatagagtgtatgattgacataaaggtctttattgcttcagctgctaccttctccggtagcctgtcaagagcatgctggagttccttggagaggctacggattccagatgaactcctcattaagccaccatcat

SEQ ID NO: 8752 - DNA, 781 bp, Zea mays
  Predicted polypeptide sequence is orthologous to G1341
ggttgcaaggtatcattgttactaaaacctaggactgtatacattttatacaacattgcttcaggtcagcagcctcttcgggtccgagctccgcttgaagttgtacaccgactcaaatgcctccatgcacacgctggcgaagcccgtcatcgcctggaaaacgttagggaagccagtctgcaggttattcagggtcattgctctggtgaccccgatgctcttctcgtatttgatcttctcctcgtcggcacggctcctcagagcctcaaccttcgcccgcttgtcagctaccgatgattttcgtgacatttctctgtaaccttcagcgccgacatattttgactccagggctctcagctcctctgccttcttctcaaactctttgaatgcagactccgacctcttcttctgcttatgctcctcagcttgttgaatgacgacagcatgaatcactgtcaggagagtcttgatcccttccgaggccaccttatctgggattctgtcgatggctagctgccattcctcacacaagccatagatatctgagttctgagctttagtcagtgggtcgtggtggcagaacagcgatagacgaagccagccggtcaatgagtagacgtagtctctctgggatttcaccagactacagaaggctgaataccacctgtcaacctctatctcgagctgaagagctgcttgccggtggacattggaagtcggattggtattccgagcattgttcaggtactccagctgctgcacgatgtgggtctgaacttga

SEQ ID NO: 8753 - DNA, 723 bp, Zea mays
  Predicted polypeptide sequence is orthologous to G1361
ttttttttttttttttcggagctattcttttctcttttttttttccttttgatagatgatgtaattcagcagcactcaaaaaaaactttgttggcgtggctagctactgaccaggaagtctctccggatgcgtgtagcagatgccgttctcgccctcgatggtggggatgaactcgtcgacgagcgggtgcagcttgcgggtgtccggcctcgccttcccctccaggtgctccagcagctcctggtccgtcggatcgaacttcacgcccgccggcagccccggcaggtcctggatcgccgccgcctgctgcacctgttcgtcatactgcgcgcggtgtccgcaggaggggcaggtcctgatgaggttgacgtgggaggaggcctgcagctgctgtttcttggcggcggcggcggtggccaggttgtcctccacggcacgcacgtcgttgaagctgttgcaccatgtcatggccgtcgacgacgacgatcgatctccgccggccccaagctagcctagccttgtcaccacgtcccggccctcctctttctactaaaagctaggggggagggaagcaggggaagggatagcagagagagagagatagggagggagatcgatcgaaagcctcttgttgtccgctttgctcctcagctcgcccccatatgatgcaacgccaaggctgatccccaggggaatgacaggccgcgcaaaagctcgtgccg

SEQ ID NO: 8754 - DNA, 1455 bp, Zea mays
  Predicted polypeptide sequence is orthologous to G1361
gcacgacgctctctccggccgatccctgtcgagccgggcgctagcgctacctcttgtcagcccttgcccttctttaatcgcgcctgctgtcttctcctcgctcatggagacgtcgtcgttctagctactagatcagttactgccttagccttactgctagctagctagtcgtcgtcgtcgtcgcccgcccgcgcgcgcgcttcgcttgtttttcgttatctatcgatcgagaaggaagcagctaataattagggggtccgatcaattcgttgttatgacgtggtgcaatggcttcaacgacgtgcgcgccgccgtggagagcagcctgtccccggccgcagccgccgtgggcaagacggcggcggcgtcgcttgccgtcctggtcaagatgtgcccgtcgtgcggccaccgcgcgcaatatgagcagaagagcacgacgatccaggacttgccggggctgccggccggcgtgaagttcgacccgacggaccaggagctgctggagcacttggaggggaaggcgaggccggacacgcggaagctccaccccctcgtcgacgagttcatccccaccatcgacggcgagaacggcatctgctacacgcacccggagaggctccccggtacgtacgcaccgtgtgagcaaggacgggcttgtccggcacttcttccaccggccgtccagggcgtacacgacggggacgaggaagcggcggaaggtgcacagcggcgacgacggcggcgagacgcggtggcacaagacgggcaagaccaggccggtgctgtccaacggcaggccccgcgggtacaagaagatcctggtgctctacacaaactacggcaagcagcgcaagcccgagaagaccaactgggtgatgcaccagtaccacctcggctccgacgaggaggaacgcgacggcgagctcgttgtctccaaggtctttttccagacgcatcctaggcagtgcggctacaccatggccagggaatccgccgtcgttgtccctgccgccgccgcagtcaccggcagcagcaacgcgtttattgccggccatgatggtagcgtcctcagagaagcaaacggcggagctgatcagttctacagcccaagagcaatgatggggtatgaccagggggggcctggaaacagggcacctcctgcccctgctgtgcctccccacttcatgcctaactttgctgtccatgcagcaagggctagctttgccccttgaaccgagaattcaggacaatatacaaacctatcaaatttgccagatataaataggcatttaggagcatgtgcaaactcccaggacctgaacacaattcactacttgtgctgggattgtataaaaaatgtcatgttcttaccctctaacttcacgttcatttacaagctcctcccttattgccatgcaacaatgtgataagattaaagaaaaaaaaaaaaaaaaa

SEQ ID NO: 8755 - DNA, 677 bp, Zea mays
  Predicted polypeptide sequence is orthologous to G1361
caacacgtactcatcctcttattgtccaccattacggttcagtaaactcgtcgaccatttgtagtaagttattgcattcatgaagttgccattatctgcctgcatttccctcccctctaacctatatcagtcgaatagttcctcttgcgcgtcttggtcagggaccaaagccagcagcccccgatgtagtgtgcacctcaaagttaggcaccaggtgagcaaaagcggcaaccctgctgttaaaagctgcctggttgtagctaattagtgctgctgggctgtaaaaatctacaatgcctgcctccttcaacatgttgttgccgccgccattgccaccgtcatgggggtgggggtggtggtggtcagtcgctgcgttggcagcgagcgggatggcgtccttagccgtcgccgaaccgctgccgcactgcctcggctgcgtctggtaaaacaccttggagacgacgagctcgccgtccttctcctcctcatcggaccctaggtggtactgatgcatcacccagtttgtcttctccggcttccgctgcttcccgaagttggtgtagagtaccaggatcttcttgtagcccttgagttttccaccggtgaacaccgggcgggtcttgcccgtcttgtgccatcgcgtctcgccgccctgctcgtcggtatggacctttcgt

SEQ ID NO: 8756 - DNA, 1242 bp, Zea mays
  misc_feature (231)..(235): n is a, c, g, or t
  misc_feature (478)..(482): n is a, c, g, or t
  misc_feature (526)..(530): n is a, c, g, or t
  misc_feature (707)..(734): n is a, c, g, or t
  misc_feature (988)..(992): n is a, c, g, or t
  Predicted polypeptide sequence is orthologous to G1363, G1782
gcacgaggctgaccagtgctatggcatgcttacgacttatggaatgagatccatgtctggtgggagaatgctgttgccactaattgcgccagccgatgcacccgtttatgtgaacccgaaacagtacgaaggcatcctccgtcgtcgccgtgctcgcgctaaggcggagagcgagaacaggctcaccaaaggcagaaaggtgtgagaagactcttcttgtagctgggtgannnnnttgacccttcctacttccatgacagttgacagcgagctaccatcgcaagcagcatttgcgatgctcccatgctttacagtcaccacgttgactggtgatcagtgatcgctgtgtgcctgttcatgctgcagccttatctccatgagtcgcgccacctccacgcgatgcgccgggtgagaggctccggcgggcgcttcctcaacacgaataaaggagggcacggcacggacgttgctgcaaacnnnnncagcaagatggcggcggcggcggcaccatcccgtctcgccatgnnnnntagcgctgagcctccatggctgtcagggctcagcgacggcagcaacccgtgctgccactcccggagtagtgtctccagcttgtccgggtcctacgtggcgagcatctacggtggcttggagcagcacctccgggcgccgcccttcttcaccccgctgccgcccgtcatggacggcgnnnnnnnnnnnnnnnnnnnnnnnnnnnnctcctccttcaagtgggcggccagcgacggctgctgcgagctcctcagggcgtgaaccgaggagggaggggatggctactcagacgaacggccttctccccgatggctggttgtctgtaggcaaatcattcttggctgttctgcattggggtgcgacctacacatcatccgcctaccgtacctaccccacccgtgtccctgaaattccagggtgcttgggttacttacaggggtcttgtgtggtgatgtggctnnnnnatatgcatttgctgtaacatagcgtacccaaaccactgttgcttggtacttctcgctatcactgcctcatcagtatggattctgcatttctgcgttgtcacagtgtatgaataattgaggcgtcagacttcagggttgctccagttcttggagataggtctgggtttgtttgaagcttgcctggaggtctgaaactttgtgtttggtgaagatgctacgttattgcagtttgaatctgtaagtttgggat

SEQ ID NO: 8757 - DNA, 1303 bp, Zea mays
  misc_feature (164)..(168): n is a, c, g, or t
  misc_feature (216)..(235): n is a, c, g, or t
  misc_feature (793)..(797): n is a, c, g, or t
  misc_feature (829)..(853): n is a, c, g, or t
  misc_feature (873)..(895): n is a, c, g, or t
  misc_feature (907)..(934): n is a, c, g, or t
  misc_feature (1247)..(1299): n is a, c, g, or t
  Predicted polypeptide sequence is orthologous to G1363, G1782
ccacgcgtccgctgtctgtgtgcgagcgcaagagaaagggagtcagagagagagggaggagaccttgcagaggagcgaagcaagcaaggtgggaaagaggcagcaagggcggcgggctgccggaaggggaacatgctccctcctcatctcacagtacgaactgnnnnncaagagtaaagaatttccgtgagatgagacagaatggcgcggtgatgnnnnnnnnnnnnnnnnnnnngcctgattacgactccccggctacccagtcaaccagtgagacgagccatcaagaagcgtctggaatgagcgaagggagcctcaacgagcataataatgaccattcaggcaaccttgatgggtactcgaagagtgacgaaaacaagatgatgtcagcgttatccctgggcaatccggaaacagcttacgcacataatccgaagcctgaccgtactcagtccttcgccatatcatacccatatgccgatccatactacggtggcgcggtggcagcagcttatggcccgcatgctatcatgcaccctcagctggttggcatggttccgtcctctcgagtgccactgccgatcgagccagccgctgaagagcccatctatgtcaacgcgaagcagtaccacgctattctccggaggagacagctccgtgcaaagctagaggcggaaaacaagctcgtgaaaagccgcaagccgtacctccacgagtctcggcacctgcacgcgatgaagagagctcggggaacaggcgggcggttcctgaacacgaagcagcagccggagtnnnnnggcagcggcggctcctcggacgcgcaacgcgnnnnnnnnnnnnnnnnnnnnnnnnngttcacgaagcatgagcacnnnnnnnnnnnnnnnnnnnnnnnccactatcacgnnnnnnnnnnnnnnnnnnnnnnnnnnnngacactggcaactcatccttggcttatcagcgattcgactcggctctcgctcgtctgaaactgaactctctgcaactactgtaactgtaactaaactgggtgtgcccggattggcggtcgttctgttctactactactagtaccttagtacctgctacgcgtcgttgggtctggactagagagccgtgctggttctttgatgaacttggctggacttgaggtgttgactagcgcgaaactgagttccatgtaaacttttgcttcaagaccgatgactggcggcataataagtagcagtaataaccattcttcnnnnnnnnnnnnnnnnnnnnnnnnnnnnnnnnnnnnnnnnnnnnnnnnnnnnnatcc

SEQ ID NO: 8758 - DNA, 1208 bp, Zea mays
  misc_feature (1179)..(1179): n is a, c, g, or t
  Predicted polypeptide sequence is orthologous to G1363, G1782
gcacgagggaccagaggaagggacggcggggaggtggcaaggcgcagagagcaggttcgcttggcggacgcaccgagggaggcgtgtgggagccatgcttcttccctcttcgtcttcgtcttccgcttccgcttccaaaggtaactcctttgggaaaaccgttaacgatcatctgaggtcaactttgagttttgataacaagcaacctccatttgcgagtcaaaactttgactacggtcaaacaatagcttgcatttcatacccgtacaatcgttctagatcaggagatgtttgggcagcctatgagtcacgcaccagcactgccactgtgttccgttcccaaattgctggtgggggttcatccacaagaattcccttgcctttggaattagcagagaatgaacccatatatgtgaatcccaaacaatatcacgggatacttcgcagaagacagttacgtgccaagctagaggctcagaacaagctagtcagagcccgaaagccttaccttcatgagtctaggcatcttcatgcaatgaagagggcacgaggttccggtggacgattcctcaacactaagcagctccagcagtctcacacagccctcaccaggtccaccaccacaagtggcacaagctcctcaggctcaactcatctgcggcttggtggtggcgcagccgcagctggagatcgatctgtgctggcacccaaaacaatggcctcacaagacagtagcaagaaggccgtttcttcagccctcgccttcactgcgactccaatgctgcgcagagatgacggcttcttgcagcacccaagccatcttttcagtttttctggtcattttgggcaggcaagcgcgcaagctggcgttcataatggaagtcagcatagggttccagttatgagatgaccggtttgcgaaccatagctggtgatccaggcgtctagggtcaacttcgctgtggtgtcttagtctctcaggcaattcatccttggcttaatttctggctttttattagaaggtaccaaaatgtgttccataccgttgtggccacagagcccataaaccagggggtttgatggttggcactcctacccaaactattgttgcagtggtgtttgttagaataaaccttgactattattctgtacaatttgcctttatcttgtactgccaanttattgtgtaaaaaaaaaaaaaaaaaaaa

SEQ ID NO: 8759 - DNA, 573 bp, Zea mays
  Predicted polypeptide sequence is orthologous to G1380
gccttcttctacccccatcccaacgcccaggccacaccagcgcagcgagctctctcctcgtagcggagtcccagcccctcacgccctcccgatcgcgctcgtcggcgcccttgtcgactcgagcccgcttctgggccgatcgacagcgagagcgagagcagcggcgcgccgaggagagctctttcggtgctgctgtataacgacgacgacagcaggcggcagataacacataaaggcgcgcgatgtgcgacgcggcggccgtggcggctccgcggtacaggggcgtgcggaagcggccgtggggccggttcgcggcggagatccgggacccggcgaagcgcgcgcgcgtctggctcggcaccttcgactccgccgaggccgcggcgcgcgcctacgacgtggccgcgcgggccctgcgcggcccgctcgccaggaccaacttccccgcgctcacctcccgccctcctgccaacctgcccgcgcccacgcccacgtgcagctcaagctccaccgacgagtcctccagcgggccccgggccggggtgcccagggcgggcaggcgcgctgctggga

SEQ ID NO: 8760 - DNA, 517 bp, Zea mays
  Predicted polypeptide sequence is orthologous to G1380
tttttttttttttttcgatagaaggagttatgtattatgtaaggaataatgatgaagggggacgaggggaggaactcgggcccagttgcatctagcttgcggtggactcgtcgtgtaacaccacgatacccttcgagtgctgggagtagcgctcaaccccgatccatactagtgttcttacacatggcagcaaggcgtgcagcgacagcgccggaagcgggacacgataatcaagcgtcgcaaggaagttggtgttctccgacggcccgcggagtcggcacgcctcactgtcgtacctcctggccgcctcctcagcagtgtcgaacgtgcctagccacagccacacgcccttatgttgatcgcggatctccgccgagtaccgccccctaggccgtctcctctgcgcgtccctgtacctcggctccgtcggcacgcccgccgtcgtcactttcctcttgccaccgtcgacaacactccccttgggcaccgtggcattgcagcacggctgatgctccac

SEQ ID NO: 8761 - DNA, 633 bp, Zea mays
  Predicted polypeptide sequence is orthologous to G1380
gaaaaggaaccatcatccaattctattgccattcgtatcgcgtagtacatggcactactgctacaagctcacgacaagtcaaagcaaaatccgcctcgtccgtggatccgattccgatcgctcagagacagagccgcaggtccgtgcagaacccgaggtcgtggccaccgtccaagtcgagcggcgccgggaggttgagatcgagcgacgggcgcgcgcgcgaccggaccgtggacgcgtcgtcgccgtcgtccacgacggaggccgacgacgcgcagtcgctgtggcagtcggcgtcggtgggcggcggcggcgcctgccgtgggggccgccgcggcttcgcagcagcacggccgcgatgcgccgccctggccctggggtccccggcgcggggcccgctggaggactcgacggaggagccggaactgcacgtgggagcggggcggcgggaggtggtggtgagcgcggggaagttggtcctggcgagcgggccgcgcagaggccgcgcggccatgtcgtaggcgcgcgccgcggcctctgccgagtcgaaaggtgccgagccagaagcgcgcgcgcttcgccgggtcccggatctccgccgcgaaacggccccacggacgcttccgcaggccc

SEQ ID NO: 8762 - DNA, 782 bp, Zea mays
  Predicted polypeptide sequence is orthologous to G1380
gaaaaataaactagtggccaaaccctagcccgccgagctcccgcgtgcgctctccgccgcccgcctactcctctctgtccgcgatgcgccgggcgaagccgcagcagccctcgccgtcgcccgagatccggtaccgcggcgtgcggaggcggccgtcggggcgctacgccgccgagatccgggacccggccaagaagaccccgatctggctcggcaccttcgactccgccgaggccgccgcgcgcgcctacgacgccgccgcccgatccctccgtgggcccaccgcccgcaccaacttccccggcgccgcggcttccgcgccgcggcacagggcccgctccgcctccgcctccgccgccgccgcagcccccgcggcggtgccggccacgtctagccacagcagcaccgtcgagtcgtggagcggcggcgcgccccgcgtcgccgccccgccgcggagcgccgccgcgcccatggaggaggacgacgacgaggactgccacagctactgcggatcctcgtcgtccgtgctctgcgaagacgcccgcggggacgacgacgacgacgcggcggcgtcccacgcgcccctgccgttcgatctgaacctgccgccgccgatcgacgcggctgctgaggccgatcagatgggtgcccgctacgacacgctactccacctctagctcgcgacgacggccaggaattagaggaaggaatcgagaccgtctgtccttcttcggctgctgatccggtggtgttctatcgctagatgcataattcttgccttt

SEQ ID NO: 8763 - DNA, 1179 bp, Zea mays
  Predicted polypeptide sequence is orthologous to G1382
gcacgagaagaccctaccctggggatgactctaatgatgatgatgacttggactcaaaacgcaggaaaatggaatctgctggtatcgatgctgctttgatgggtaaaccaaatcgcgagccccgtgtcgttgtacaaactgttagtgaagttgatatcttggatgatgggtatcgctggcgcaaatatgggcagaaagtagtgaaaggaaaccctaacccacggagttactacaaatgcacacatacaggatgcccagtcaggaaacatgttgagagagcatcacatgacccgaagtcagtgatcacaacatatgaaggaaaacataaccatgaagtccctgcttccaggaatgcaagccatgagatgtctgcagctcccatgaagccggtggtgcatcctattaacagcagcatgccaggctttggtggcatgatgagagcatgcgatgccagggccttcaacaatcaatattctcaggcagccgaaagtgacaccatcagtcttgaccttggtgtaggtatcagccctaaccacagcgatgcaacaaaccagatgcagccctcagttccagaacctatgcagtatcagatgcgacacatggctcctgtgtacggtagcatgggacttccaggaatgcctgtgccagcaatacctggcagcatgtacggttccagagaagaaaaaggaaacgaagggtttactttcaaagctgcacctttggaccgatcagctaacttatgttacagtagtgctggtaacttagtgatgggtccatgagtgcctcttctgatggctatacctccatgaatcacacctatcaccgtcgtcatgaagttctcttcagaagatgctcctctacttcgtatcgtccgcacataattggaggcggtcaaggtatacctgggagctgcagcgatggcacatgatgtcttttgctgtgtggatgaactcgctgtatgtgacgctgcagctaaacattcgttgtacagcaaaccagttatgattaattagattatgataatttggttatgtaaacttctttctggacataaccgaagagccatctggtggcaaagctttgttatctcctgcatatgaacgatgccagtttgacattcatatgaaatgaaatatatcatttcccaaaaaaaaaaaaaaaaaaaaaaaaaaaaaaaaa

SEQ ID NO: 8764 - DNA, 817 bp, Zea mays
  Predicted polypeptide sequence is orthologous to G1382
cactcacctctccacacccccccgccaatggccgattcgccgaaccctagctccggggacctccccgccggccccgggggctcgccggagaagccggtcctggcggatcgacgcgtggccgcgctcgccggcgccggcgcgaggtacaaggccatgtcccccgcgcggctgccgatctcgcgggagccatgcctcactatccccgccgggttcagccccggtgccctcctcgagtcccccgtcctcctcaacaacttcaaggttgaaccgtctcccacaactggtactctaagcatggctgcaatcatcaacaagagcactcatatggacataatgccttcacctagggataattcagctggtagtggccaggaagatggaggttctcgggattttgaattcaagcctcatctcaattctcatttggcggctccttcagtcaacaatcaaaaccatcatgacactatgcaaaaatatagctcaaatcataccacaccatctagcaatttgaagactgaaaataaacctctctgttcacgggaatcgagtcacacagcacatgcttcaattgctccaaaccaaactgtttcgatagtttgtccgtctgacaacatgcctgctgaagttggtacaatggagatgcaccagatcaatagttctgaaaatgctacccaggagacacaaattgaaaatgtagctgaaaaatcagcagaggatggctacaattggcgtaaatatggacagaagcatgttcagggaagtgaaaatcctagaagttattacaagtgcacgcatcctaattgtgaaagtaaaaagc

SEQ ID NO: 8765 - DNA, 557 bp, Zea mays
  misc_feature (549)..(550): n is a, c, g, or t
  Predicted polypeptide sequence is orthologous to G1389
aatcaaaattatataaattagagaaacaatccgggtaggaatcattccgacccaccaatccgggacaaacgaacaaggcctaaagaattgcttgttggcatggtgttcaacaggtggagtaacttacgcctgaccggctgagagctgctatgcagctacaggtgccttcagctcagctccggggcgaagccaggaattacatgtagggaggccggccgaaagagccatcttgtaaaaaattatcgcggttcaactggtttggttactcgcacttagcggctgtctgagttaatacttgacaaaaaaaaacaagcacagctcaactggttaggtttctcgtagtggtggtggtcgttcggggttaattcatcgacttgacacggttgctcctatttttttctatatggattatagatagggagggtttattgtattttgatcgtagacgctaatcataaactgtaatgaatggacgccttcgttctctctgagtacaaaggccccattgaaatatgcatgagaaataaagcaaatttagaggaaataaannaaaaaaa

SEQ ID NO: 8766 - DNA, 836 bp, Zea mays
  Predicted polypeptide sequence is orthologous to G1411, G2509
gaattccttgtgttgggggcgtcgtccctcctcggcgcggagaggggccaaaggtggaagcagcagcagggaacggctttctcggccacagttactccgcggcccgcgccgattacgacgtcgcggtcatggccgcggcgctcacgcacgtcgtctgcgccactgagccaccaccgccgcgcgggggcgaggcggcggcgcttccgccggggccgcggcaaggaggagggacgacggagctgcaggcggcggcgcgggcacatcagtacaggggcgtgaggcggcggccgtggggcaggtgggcggcggagatacgggacccggagaaggcggcgcgcgtgtggctcggcacgttcgccacgcccgaggaggcagcccgcgcctacgacgacgccgctcgcaggttcaagggcgccaaggccaagctcaactttccgacgactactgctactgctacgacgacgacgacatcgctgtcgtcgccccaccagctgctgcggtcagccgcggagtcggagacggcgggggaggagttccccgacctcgggcagtacatgcacatactccagagcagcagcgacgccgacgttcgggccgtcgcggccgggttgccgctgatgaaccgcctgccgccagtggacggtcgccaagaccatggcagcagcagcgcgagcagcgggcgctaaggcacgcgtgacgcttgtgatcgtcacggtacccatgagcccatgacctcagacctcccatgccaatgcagcgcgcgcggtccagcattatttggccatttgctgttatcaaacgtgttcggtgttccatgagcgtgcgtgacgtgacac

SEQ ID NO: 8767 - DNA, 923 bp, Zea mays
  misc_feature (17)..(17): n is a, c, g, or t
  misc_feature (53)..(53): n is a, c, g, or t
  misc_feature (311)..(311): n is a, c, g, or t
  misc_feature (445)..(445): n is a, c, g, or t
  misc_feature (718)..(718): n is a, c, g, or t
  misc_feature (901)..(901): n is a, c, g, or t
  Predicted polypeptide sequence is orthologous to G1420
tccggtttcggtccggnattcccggctcgacccagcgtccggtcgtcttttanacttatacttccacgacgagctggcgtcgctgttcgcgcagcggccggcgccggccggagaggcgatgatgacgcagcagcaccagcaggcgccggcgtcgtggttcgcggactacctgcacgcgggcgccccaggcatggggatggactacgacctgctgtgccgcgcgctggacctgccgctgccgggggacgacgtcgtcaagagggaggaggagctgctgctggtggacacgggcggggacggaggaggcttcnccgcgcccacgcccacgcccagcgggggcggcacggcgccggtcacgcccaacaccacgtcgtccatgtcctcctcgtccagcgaggcggcgggcggcgccgccggaggaggaggaggaagggaggaggactcnccgcaggggaggtgcaagaaggaggaaggggatggggaggagagcaaggcgctcgacaagggggaggaagacgctgacaagggcaagaaagggtcagcggcggcaggcaagggcaagggtaagggcgagaagcggcagcggcagccgcggttcgcgttcttgaccaagagcgaggtcgaccacctcgaggacggctaccggtggcgcaagtacggccagaaagccgtcaagaacagcccataccccaggagctactaccggtgcacgacgcanaagtgccccgtgaagaagcggtgggagcggtcgtcccaggaccgggcggtggtgatcaccacgtacgagggcaagcacacgcaccccatccccgtcacgctccggggggacacccacatcctcgccgggcagctgcgccaccaccacaaccaccacctcggtgccttcccaacccgttgtcgnaaatgggcgcggcgcccttcgg

SEQ ID NO: 8768 - DNA, 540 bp, Zea mays
  Predicted polypeptide sequence is orthologous to G1435, G2741
ttttttttttttttttatttaagttaattttatttctcttcaattttctgtatgggactaaaaactcattactttccccttcaccaaaagcttcgaaatttattctctaataaacttgaacaaaagctttggctttaaaaataccgaataccttggaacgggacggacggagtacagtagaagctttggataatttggagggagtagagtatagagtgaggcaggcaatcgcttgttccgttttggatttgtcttccggtcttccccaagaggaaactagattctggagtcgtcgccgaagcgggtgtcatctgtctcctccccctcctccgttgtacaggtagtggtacgcctggccgctgaccatgggcaccatgccgacggcgacgccgtgcaccggtgtgggtgcgaagatgtggtcggacggggacggaccctgcccccgcatccgcttcacgtacaaccggtacttctgcaggtggctggccacgttctcccgcgtcagaccttccacgttcatcagctccatgatggtcttgg

SEQ ID NO: 8769 - DNA, 863 bp, Zea mays
  Predicted polypeptide sequence is orthologous to G1435, G2741
ggtgaaaagggaaaagaaacttctctttctttctttatttcttaaaagagatccatttaccgctcacacgaagaactgaattagcaagagatccaaaaccaaaaggatcgatgggattattgagggatccaatccaacagaagggtcatttgtgggcgtggtggtagtgatggtactggtactggaaccctcctcctcccattccgttgtggttgtggtacgcctgtccgccgctggccatggtgccgtacatgggcacctcatgcaccaggctttgcggcaccggcgtggatgcgaagatgtggtcggacggcgacgggccctcgtcggagaggccctgcatccgcttgacgtagaggcggtacttctgcaggtggctggccacgttctcccgcgtcagcccttccacgttcatcagctgcatgatggtcttgggcaccgcgttcttcatccccaggtgcgccaccacgtccacgaaccgcttgtgcagctgcggcgtccacaccagccggggccgcttgctgctgctgctcatgttattgttgccgttcgtcgtcgccgccgccccgccgcccgccgccgacgagtccgccccttcgtcccccctcgctgccggatggaagggcgcgaaggaggagctccctccgctgcccgacgacgacggcggcggcgcgcgacgcagccgggacaccgtggcagccgacgcgcggtgcacgtccagcagcgtccgcccggcctccggcgggatgcggaacgccgctgccagacccgccggcaccagcggctgcgacagcggggtcagctcgtcggcgcccgggagacctgacttccactccatcacggggtcgttctcgccgccgccg

SEQ ID NO: 8770 - DNA, 746 bp, Zea mays
  Predicted polypeptide sequence is orthologous to G1444
cacagcacaacacaacacaagccaccccaccccaccccaccaccaccccctccttcgatttgcaccctcgctccccaaatctctcctcactccgccctctctccgctccgctagacccgcccatgaggatcaggaggcggcctccgggccagcctctcgcctacctgctgccctcagatccatccgccgcgccgcagtcgccgccgcgtgcgtcgtcgatagatcgtcaggagcgtcctcctccgcccccggggggcaagcaaggggagggggagttgcacttgcacccggcaacaaatgattcccccgcacccgcggatctcgaggacggccgcagccgctcctccgcgctccggcgcccagcattgctgccgcagttgcaggagcaggacgacgcggtggagcagcgcagccgctgcggcggcctaggtgcgcaacaacggcaacgacaggggccttcagatggccgcagcagcctagacaatggtcgcgactgccacgtgccggagccggtgacgatccaggccggagagcgtcgtctcagcaacggcgtcggcgcagcagcggtggcgacaacgacgacagcaacagcgggcgcgaaggcgacgaggcagcagcaagaggcaaagcaggataccggcggcggcgcgaggagggccgcgcggggccctgcaggcgcgctgatggaggggtcgcggtgcagccggaagaacgggcgcgggtggcggtgcacccagccgacgctg

SEQ ID NO: 8771 - DNA, 537 bp, Zea mays
  Predicted polypeptide sequence is orthologous to G1449
ccttcgtcgtcgtccatggacagcagcagcaccacccacccgccggcgctatccgccgcgtcgtcgtcgggcttccggccgacgacgacggagaggagggacgaccttagcaccgaccttcagctagggctctgcagtctgtcgccggcggcgtcctccgccctcctggtggtagcggagagcaagagcgtcctttccacgccaaggggcagcaggaccacccaagactggcccccgatcaaaccattcctcagaagcgccttgacagcctcggcacgccgacgacggcggacactgttcgtgaaggtgtacatggaaggcgttgcgatcggccggaagctggacttgctcttgctggatgggtacgacagcctcctagcgaagctccgccacatgttcaaggcctccatcacctttgctgatgctatggagtaccaccaacgagttcctcacgagaagcctgcacatgttctcacctatgaagaccgggatggagactggatgatggttggggatgtaccgtgggagctcttcctt

SEQ ID NO: 8772 - DNA, 836 bp, Zea mays
  Predicted polypeptide sequence is orthologous to G1451
ctcatggatcgttacagagcctgcctggctacattcacaggattagtgtttctccaaacaatagccaagtttcagcatgtgtaccgacagcggctgctggtagtttcttctacttgggagttgggtgtcatatacgactggacagaattattagatggtagtacataacctggaaggagagctaatgctgggtctggtgctgcttccacctcgacgccatggactgcaaaaaacataggaagcgcgaccgagcgagcgggtccgtcacaggccagccctaaactaagctcggggcgcgtaacgagctcctgccttctgtttcagaactcgaccgaacccacggacgcgatcccggtgcttaggctcctcgactcctgcctgctaacgtagccgtcgcagctgctacctagcctccgcgccgcggggccgagctcaggagctccaggccctgcttgcccatctgctgcacctcctgcggcgagagtatctttatgcaggacaccgtgctcgcgaattcccaagactgatggacggtcatggtaaattactgccaagggtcgtcgcccacgagaaggacgtcctcctcgcggtcgacgaatacaagctgccagcctgatctcagagggtcttccaactggccctcaaggccaaataggcgccctagttccctacggagctcgtgatagctactaaacctggtgatatcaagcgaccttccgtaggttccagatttgtaaaccttcacaaaggttgctggtggtcggttcacttggtcagaattatccgaacatggcgggacgtaccctgaatcatctaagcagcctgaagaattcagc

SEQ ID NO: 8773 - DNA, 654 bp, Zea mays
  Predicted polypeptide sequence is orthologous to G1451
gtcggcacggcgaattcccaagagaagctggttattatcattccagataaatatgatagaatcccctgctactagtcttttcgcgcttacaaaaacactccaaccagtcgtcagtagatgcctttttggctgaccacgaaaaatatgacgaaatttccattcattatcatgcagatctcttgcaaccagctcttgcactggaggctgttgtgaaaaatccaatggagggaagactttctcagctgctcggcgcggaacagagaatccaccatgggtactcgtatcacttgcagtcaacgtcttgcagaagtaattggttggctgcttgctaccagcacccaattcaattggaagaaaaggatccttttgctcttccgggctcaatggttgcagtgtcatttgggcatacacctcttcagtctctgcatcagcatgcattgtgacattatgaagctggcatattaactgtggaggtaggtttggatagtttgggatttgagcatcaacttctttattagttgatgcagcaacctgctcactatggccctgaggaaagtagacgacccggctcccaaccacaggcagggacacaaggggccctgcgcatgcatgccatagctctgagttcagacacctttgttccccgtcactttc

SEQ ID NO: 8774 - DNA, 1555 bp, Zea mays
  misc_feature (27)..(27): n is a, c, g, or t
  misc_feature (40)..(40): n is a, c, g, or t
  Predicted polypeptide sequence is orthologous to G1451
agcagaagccccagatgcaacaccagncaagaatcacagncagcagcagcaaccacagtgtctgccagtcccccaacatcagcaaatgcaacaacagaatatgaccaactaccagtctatatctaatgcattatcaccgttttctcagctgtcgccagtttctcagtcttcacctatggcgctgcagactatattaccgttctcgcaggcacagagcttcacagacacgaatgtaggttcattgtctccatccaatggtaacaccatgcaaaacacactgaggccgttctcatcagaagcagtttctcacctcagtatgccgaggcccactgcgatacctgtcgcagacccatggtcgtcgaagcgtgtcgcggtggagtctctgcttccttctcggcctcaggtttcatcccagatggaacaattggaccctgcaccagctagtatacctcatagctctgcgttggcaccacttcccggaagagggtgcttggttgaccaagatgtgaactctgatcctcaaaatcatctcttgttcggtgttagtatagactcgcagtcactgctaatgcaagggggcattcctggtctccaaaacgggaatgattcagctgctataccttattccacttccaatttcctcagcccttctcagaatgactttcctctggaccatacactaaattcttcaggctgcttagatgattctgggtacgtcccgccatgttcagataattctgacaaagtgaaccgaccaccagcgaccttcgtgaaggtttacaaatctggaacctacgggaggtcgcttgatatcactaggtttagcagctatcacgagctccgtagggaactggggcgcctatttggccttgagggccagttggaagacccattgagatcaggctggcagcttgtattcgtcgaccgtgaggaggacgtccttctcgtgggcgacgacccttggcaggaattcgtgagcacggtgtcctgcataaagatcctctccccgcaggaggtgcagcagatggggaagcagggcctggagctcctgagctcggcccccgcgcggaggctcggtagcagctgtgacgactacgtcagcaggcaggagtcgagaagcctgagcaccgggatcgcgtccgtcggttcggtcgagttgggatgagcagcaagatagcgcgcacgcagcagcagcagcagcaggttacgcatcctcagcctcagggtaggtaggggactgaagggttggtctgcgacttgatgacccacgagctcctcgttgcgcgcttcgttcgcctccatgcgatggatagaagttcagcgcagaccaagccttagctctgcgagctatgtaccatctaataattctgtccgtgtcgtaccatgtcaactcctaagtagaagaattgaagaaactaccagcagccgctgtctggtatacacgctgaaacattttttttcttgtttggagaaatactaatcatctggatgtcaacaaaaaaaaaaaaaaaaaaaaaaaaaaaaaaaaaaaaaaaaaaaaaaaaaaaaaaaaaaa

SEQ ID NO: 8775 - DNA, 1067 bp, Zea mays
  Predicted polypeptide sequence is orthologous to G1451
aagcaaaagtttatgggctcacagtcaatgtcttttgggggctcggtttcgcttaactcgcccactagcaaagatggttctgttgacaacaaagttggtcgtgatgtgcagaaccagtccctttttagccctcaagtcgactcttcctccctactgtacaatatggtacctaatcttacctcaaatgttgctgataataatatatcagcgtttccctctggatcaacatatctgcaaagtccaatgtatggttgtctggatgactcttctggtttattgcaaaatacaggagagaatgatccgacaactagaacttttgttaaggtttacaagtcaggatcggtggggagatccttggacatcacccggttctctaattatgctgaacttcgagaggaactgggtcagatgttcggcattaagggtcagttggacgaccctgatagatcaggctggcagcttgtatttgtcgacagggagaacgatgtgcttctccttggagacgacccctgggagtcatttgtgaatagtgtatggtacatcaaaatactttcacctgaggatgtgcataagatgggaaagccaggaaacgatccacgctacctatcttagctacctatcttaaatcgatacatggagctctttctggctcccatgacgattctgcggcacactgcagcactgttcacgacggcctgctctactgtgctcgcatgttcgcccgtgtcatctctactctctagcatgcacaccgtgctcgtcttcagaagacgaactccccgtcgcttgtatccggtgcaggtcaccgctcctggactgatattttgtaggttccacgtaggaatcagtatcagcaactctatcctagtttgtggtaggctcgcgcggcgctcgttcctgtgtcgcatcaggatcttcggactaaaatgcgtagtcgaaaccgttctcgtgattcgtaagctattcatgtatttgaggattcctcgacatgctttcgacgatgaactgcaataatctgaatgcaggaggattgtttgagatttgtacttcaaaaaaaaaaaaaaaaa

SEQ ID NO: 8776 - DNA, 1492 bp, Zea mays
  misc_feature (1459)..(1459): n is a, c, g, or t
  misc_feature (1461)..(1461): n is a, c, g, or t
  misc_feature (1472)..(1472): n is a, c, g, or t
  misc_feature (1474)..(1474): n is a, c, g, or t
  Predicted polypeptide sequence is orthologous to G1451
ccacgcgtccggcacagatgacactacaaccactcaacccgcaagaactgaaggacccatatttacctgcagaattaggttcggccaataaacagccaacaaactatttctgcaaaacattaacagcaagtgataccagtacccatggtgggttctccgttccccgtcgagcagctgagaaagtgtttcctccactggatttcacccagcaacccccatgccaggagttgatggcaaaagatcttcatggcaatgagtggaaattccgtcacatctttcgtggccagccaaagcggcatcttctaactacaggttggagtgtctttgtaagtgcaaagagactcgttgctggcgactctgtcctttttatctggaatgacaataaccagcttctgctgggaattcgtcgtgcaaatcggccacaaactgtcatgccatcttcagtcttatcaagcgatagcatgcatatcggtcttcttgctgcagctgctcatgctgcttcgacaaatagccgatttacaattttttacaacccaagggcaagcccttcagagtttgtcataccactcgtaaagtatgttaaggctgtgtatcatacccgcatatctgtggggatgcgattcaggatgctttttgagacagaagagtctagcgttaggagatacatggggacaattaccggaatctgtgatcttgattctgttcggtggccaaattcacactggcgttctgttaaggttggctgggatgagtcaactgctggtgagcgacaaccaagggtgtcactatgggagattgaacccctgacaactttcccaatgtatccatctccttttccgctcaggctcaagcgtccatggccaacaggcttgccttctctgcatggtgggaaggatgatgacctggctaactctctcatgtggcttcgagataccgcaaatcctggttttcagtcgttaaattttggtggacttggtatgagcccttggatgcagccaaggctggatgctaccttacttggtctgcaacctgacatgtatcaggcgatggccacagctgcttttcaggatgcaacaaagcaggcatcgcccacaatgctgcagttccagcagccccagaacatagctggccgggcttccccgcttctttcaagtcagattttgcagcaagcacatcatcaatttcagcagcaaccgtaccttcaaaacatctctgagagcacaatccaagcacagggtcagtctgagttcctcaagcagcagatccaacgcagccagtcattcaatgagcagaagccccagatgcaacaccagcaagaatcacagcagcagcagcaaccacagtgtctgccagttcccccaaacatcagcaaatgcaaccaaccggattatgaccaataaccagtctatatctaatgcattatcacggtttttcagtggtggccaagttttcagtcttnanctatgggggtngnagatatattaccgttttc

SEQ ID NO: 8777 - DNA, 722 bp, Zea mays
  Predicted polypeptide sequence is orthologous to G1451
gccaacagacgccccacctcgctacggagctcgtcgtagctgctgaatctagtgatgtcgagcaaccttccgacggtcccggatttgtaaaccttcacaaaggttgcaaactgttgatttgcctgttcggcattctctgcacatggaagataatccgactcatctaagcagccagcgctgcgtagcggttgattcaaggggaaatcgttatcagaagggctcaggaaattggaggttgagtatggaatagtgcctgaactgttatcattctgaagggctggaatgcccccttgcatcagaagtgaatgtgagtctatgtgaacaccaaacaagaggtgattttgaggatcagagcacccatcttcatccactaggcattctcgtccaggtaatggtgctagtgcagagctctgcggcatgttacacgtcgccatatccaaatgttctatatgtggtgaaacatgaggtcgacaagggttaacagactccactgcaactctcttggatgaccatgggtcagataccgatacaggggcgttcattgccacacatgggaggctcgaagctgcttcggaaggtaatctccccaacatgccatgcattgaagggccagtagatggtgagagagagctaatgtttgtatctgggaagttttgttgatgcgagaatgctggaactgtctgcaatgcggaaggtggggagtgagtggctggggaaagctg

SEQ ID NO: 8778 - DNA, 768 bp, Zea mays
  Predicted polypeptide sequence is orthologous to G1451
ccttcttgccttgcctgcatttagagctacagtagctatcgtacagcatgtccattaccataatgatacatggatcatcatctagctatattaaacgactaggttattcccgatcaacagggcctgagactgagaggatcataacacaggaacgaaacgacttgcggatggcaaatcctgcaaatgctggattgccggttttggttcagagcttcagatcccggccttcgcctcagtcctcttcagtagtccagaggcaccacaggcgcaatgctgccggtgaggttctgcacgtcgtggcctgcagaatagtcgtcacagacactgccctgcagcatcctcgctccaggcgcagacagaaggtcacctccgccgccgcgggccatctgctgcaggtcttgcggcgagaggatctttatgcaccctacgctattcacaaactcctgccacgggtcgtcgccgaggagaagaacatcgttttcccggtcgacgaatacaagctgccagcctgatcttgcagggtcctccagttggccttcgagaccaaataaccgctcgagctcgacacgcaactcgtagtagctgccgaatctggtgatgtcgagcgatctcccgagggaccctgatttgtaaaccttcacaaaggttccaccttgtgatgggtttacaccacaaacatcgtcaagagaattgaaggttcctgattcacccaaacaactggaagttgctatggagttttcaggtagcaaattcgcatcactatatctc

SEQ ID NO: 8779 - DNA, 863 bp, Zea mays
  Predicted polypeptide sequence is orthologous to G1451
caggaaccttcaattctctcgacgatgtgtgtggtgtaaacccatcacaaggtggaacctttgtgaaggtttacaaatcagggtcccctgggagatcgctcgacatcaccaggttcagcagctactacgagttacgtagcgagctcgagcggttatttggtcttgaaggccaactggaggaccctgtaagatcaggctggcagcttgtattcgttgaccgggaaaacgatattcttctcgtcggcgatgacccgtggcaggagtttgtgaatagtgtatggtgcataaagatcctctcgccgcaagacgtgcagcagatggtccgcggcggaggcgaccttctgtctacaactggagtgaggacactgcagggcagtgtctgcgatgattattctgcaggccacgacatgcagaatctcaccggcagcatcgcacctgtggtgcctctggactactgagaccgagatgaagaccagaaactgaagttctgaaccaaaaccggcaattcagcaccgcaggattgccgtccacgagtcttttcggttcctatgatctatcttctctcaagttgtgttggtcagaaataacctagtcgttaatatagctagatccattgtatcattatggtaatggacatgttgtacgatagctgttgtagctacgtgtagccatagcctaagctctaaatggcaggcaagaattggtctatgaaagtatggatgcaggcactcactgtagaggtgacctagccctgtagttctctatatcttctcatatctaaaagctgacggttccatgtggcgcctaaactattgaaccctgtcacctttgtcatatttttttcaccttcattcgccggttgt

SEQ ID NO: 8780 - DNA, 938 bp, Zea mays
  Predicted polypeptide sequence is orthologous to G1474
ccacgcgtccgaaattgctgacctccgtcatcagcatcttctctctctctctctctctgctgagctgcttactcattccagcttcaattttctttgtccgtgatctagctagcttgcatgtctctctagagtcgatctgaatcgatacaattgagactagctactacgtgtttgcagatgcatagctagctagctctcaatcacatgaactcctccagcgccaccgctatggatcaaataggcaagtactggggcatgtggggagcaaggagaagcagcagcagcagcagcacgatccccatctctgcttgggctgcggcgtacggcggcagcagcgagccgtcgtgggaggagcaggccttcgcacgcgacgcggcggaacacctcggcggctgcgtctggccgccgcgctcctactcgtgcaccttctgccagcgcgagttccggtcggcgcaggcactcggtggccacatgaacgtccaccgccgcgaccgagctcttctccggctggggggctcgtcctcccccgaggacgtgcacgccaccaccaacgatcagccacacccgcagcaaggtgctctcctgtacagggcagcagcctctaaccctagcactaccacgccgagtactactgcagctgcaggtactactgctgccggcccagcagcagccataaccatagcaggtgcaggggatggagatgccaacaccaccaccaccactacttacttgtcaagaattatcaaggagagcaagaacaagcgcttcatgcccatgccagatcactctgtcgcggggatgagagaagatcaggcggcggccatagatgatcatcgtcataatgaagatggcgacagctggcggtcagcctcagccgcggaaaagaggaggcgtctggatcatccgttggcaacggcggcggcgcttctgatctttgt

SEQ ID NO: 8781 - DNA, 664 bp, Zea mays
  Predicted polypeptide sequence is orthologous to G1474
gcaagcaaatgaagagtgtgacacgcggatttgttttaccgaggttcggttctcgcaaacctactccccgttgaggaggccacaaaggccgggtctctttcaacccttccctctctcaaacggtccctcggaccgagtgagcttctcttctcaaatcacttgggaatcaaacttcccgcaaggaccaccacacaattggtgtctcttgcctcaattacaagtgagtgtttgatcacaagaaagaatgcgaaagaaaagaagcgatccaagcgcaagagctcaaatgaacactacaaatcactctctctagtcactaaggctttgtgtgaagttgggagaggatttgatctcttttggtgtgctttgcaatgaatgctagctcttgtatagtggttggaagctggaaaacttggatgcaatgaatggtggggtggttggggtatttatagccccaaccaccaaacatgaccgttggtggaggctgtctgtcgtatggtgcatcggatagtccggggcacaccggacatgtccggtgcgccagccacgtcaccaaagccgttggattccgaccgttggagcttctgtcttctgggcccgcctgagtgtccggtgcacaccggacatgtactgttcaatgtccggggtgccagtgcgcgcgtgcctg

SEQ ID NO: 8782 - DNA, 795 bp, Zea mays
  Predicted polypeptide sequence is orthologous to G1480
gatagacaacccagtaaagttgtatcttacaagacacaataaattccctagttcgttcaccaactggtgatgacccatcgaaattccgcgccatcatttaaaaatagcgatggcggaatttcaccacgaatgctgctcacatgaatgacgacacgacacaaacgagaagggcggttgcttaacttgcttcaagctgggcgaacgccaccgtcagaagcccagaagcgctgctgtgatgccattcattttcaaggcacgaactttctagaagcttggcacgaccccgtaggccccggcgtccacgaagaagccgtccctggcgtcgtcggagaaggagagccagaacttggcagcagcgtcgatgctgtccgatgtgccggcgcccgaggaggaggaggaggaggtgccggcggcgcgcttgacaaagcggcccttgatcctgggccgcgcctcggcataggccttgcgggacgcgtagcggatggtcttctggaacttgcgcctctcgcgcttctcgcggtacctctgcaccctcgcctcccgctccgccgccgccgcggcgaccacggcggcgccctggacgacgacagtgggcgaccacgtggccgtccatgcggcggcgggcagaccgggctgcgcccacagaggtgcagcgccgtgatggacgacgggcgccacgccgtccggcaggtagccgccgccgcccgtgacacaggccgcgaggtcgacgtcggacagcaggtcgaacaggcccctgccctccgcgccgctgtcgccggtggtggagctcgccga

SEQ ID NO: 8783 - DNA, 720 bp, Zea mays
  Predicted polypeptide sequence is orthologous to G1480
ttttttttttttttttttttttttaagacaacttggtgcgcggtatagattggtgatccattagcagcggctactgcagtttcttactagtagtacaaattatacatcactagtttacgcaagagcttgctcaaaaagagagtacatgggattactactcctccctatacatcgatcgatacaagtacaaggcgcgcgcgcagcggcgtgccatgccggttcaagcgcgcggccggccatgtgcgcgcgtgttgggcccgggcacatcaaaagctcggtacgacgccgtagccgaagtcgagcacatatgacatcggcacggcggcctcggcctcggcctcagcgtcgtcggcgtcggcgtccccgtcgtggtcagcacgcttggcaaaccggcccttgattcgcggccgcgtctcggcgtaggccttccgggacgcgtaccggatggtcttctcgaagcgcctgttcttccttttctcacggtaccgcatcaggcgcgcctccctgctctcccccatcagcggcaccggcctcaccgcagccaagtctccccgctccggcaccacctccacgtccgcggatggcacctgcatacggaaccgatcgagtccgcaacgatacgtcaggacgagcacatggagtgtctaacggatgtgcgtcccgaaagttgggagcttggttggggtcctacgctgtggctctggggagtcccggtgtatg

SEQ ID NO: 8784 - DNA, 803 bp, Zea mays
  Predicted polypeptide sequence is orthologous to G1480
gtctccgcgtacgccttgcgggacgcgtaccggatcgtcttctcgaaccgcctgctcttgcgcttctcccggtaccgcatcagccgcgcctctcgctccaggcccctgctgaccactgccaccatgggcgccatgccagacgccgcgtcgggcacaaccgctgcctccgacgatgacacactgtggttcacggagtgatcggagtagaagagcttggtgccggcgaggtcgagctctggtgacccgctctgctggacgccgatggtcttgatttcgtccatggaacgcgcgaagtcgaggtcgaggtacgggtcagagtccgcgaagaacacctccgtcgtggcgccttctttctgcccgtggtcgggctcggggaggagccacgacgccgcctcgtcctcgttgctcccgtcgtcgtcggttgctttgggcggcgccgccgaggcgaagggcttgggcgcgtcggccagcgcgccgaagaagggcgccacgtggaggcgctcgtggcggcgcgcgagcgggttcgccgagtggatgtcggcgtcgcaggaggcgcagagcgcggcagcgtccgcgcggcacgtgaccgccgccggcgcgtgctcgcagacctcgcagagccagacccgcgcgtggcgcgacccggcgccgtgcgcccgcgcgtcgcacccggcgcacaggaacgccgcgtccgcgcggcagtagaggcgcgccgcctcggcgccgcacgcgtcgcagggccgcgcgcccaggccccagtaagcaggggccccgcccgccgacttctcgtcaccctccatcgc

SEQ ID NO: 8785 - DNA, 873 bp, Zea mays
  Predicted polypeptide sequence is orthologous to G1480
gcacaattgcacaaacgcaagaagctcaacaagacaagaaactgaggcaagaccaagaagaagaggaggaagaagaaaaaggcctagaacaagatgggaggcgaaggcagcacaagcccagcgcctgggggagccgcctgcgcggtctgcggcggcgccgcggtggtgtactgcgtggcggacgctgcggcgctctgcagcccctgcgatgccgctgtccacgccgcaaacctgctggcgtcgcgccatgagcgcgtgcctctttccatggccgccgtgccgtccgcatcaggcgcgtacgacgacctgttcgcgcccgacgacgtcgacgcggcggcgcccgcgcaggcgcaggggctgggcagcccccggaacggcagctcgtcggcgagcttcaccaccagcggcgacagcggcgcggagggcagcagcctgtttgacttcgacctgctgtctggcgtggacctcgcggcctgtgtcacggacggcgtggcgcccctccaccacgacgacgctgcaccgctgtgggcgcagcctggcctggccgtcgcgtgggcgaccgcgtggtctccggcggactccgccgccgccgtagtcgccgcggcggcggagcgggaggcgagggtgcagaggtaccgcgagaagcgcaagaaccgcaggttccacaagaccatccgctacgcgtcccgcaaggcctacgccgaggcgcggccgaggatcaagggccgcttcgtcaagcgcgccgccggcacctcctcctcctcctccttcggcgccggcacacccgacgacggcaacgacgccacgggcgccgctgccaagttctggctctccttctccgacgacgccagggacggcttctacgtggacgcc

SEQ ID NO: 8786 - DNA, 808 bp, Zea mays
  Predicted polypeptide sequence is orthologous to G1480
cagccatttctaacgcttacgcaacccagtccgcccgtgtctctggtgacaccgacacccgtggcatctctctcgtgactcccggagcagaggcatggacaccgcggcggagctggagctggggctggagttggagcagaagccggcggcggggtactggagcgtggtgggcgcgcgcccttgcgacgcgtgcgccgcggagccggcgcggctgcactgccgcgcggacggcgcgttcctgtgccccggctgcgacgcccgggcgcacggcgccgggtcgcgccacgcgcgcgtctggctgtgcgaggtctgcgagcatgcccccgccgccgtcacctgccgcgccgacgccgccgcgctgtgcgccgccacgagcgcctccccgtcgcccctctcttcggcgcgctcgcggacgcgccgcagcccttcccgtccccggccttcgctgccgccgcgggggccgaggccccagctcagggggaagcggtggcggaagactacgggagcagcgaggccgaggcggcgtcgtggctgctccccgagcccgacaacagccacgaggacagcgccgccgacacgttcttcgcggagtcggacgcgtacctcggcgccgacctcgacttcgcccggtgcatggacggcgtcaaggccatcggcgtgccggtcgcgccgcccgagctggacatcggtgccggcagcttttgctacccccgaacactccatgaaccacattttgtcgtcatcctcggaggtggcggtgggaccggacgcgcaggcggccggcctgccggtggtggtggtggtgagc

SEQ ID NO: 8787 - DNA, 873 bp, Zea mays
  Predicted polypeptide sequence is orthologous to G1480
catcacaaacaattcagtttcattcaccagagtatatagtccaacaaagagacatcaaagaaatttcttatgcacagcttttcttattgcaattatttcccaatcaagacacatcaaaagggcagaccaattgctgatggctcggcgcccatatgagtagggtctggaaaagggaaggcaattcttcccccgcaaatgccgagagactgcttcgaacccgcgacctagtgactcagtgagttctcaccactgcaccagacataaccttttcccaatcaagacacatcaaataaaaaaatatactttcgtgaacttatcccgttacaactcaaatagtgcatactgcatacaatcttatcttacaggtaaaaagagaactacagtgcatgttttttacactctcgagacatctacaaaattgcccttcctatcaagaatatttcaagcagcaactacagaaatcttgggccgttcagcttgtgcatcaacaagtcgcatcaaaaaatttccccctcaactagagttgcagaagttttgccaaacttggtggctacttaaggttcagttgctactggctctgattgtcatgatctgggcactggtattgttagcattgcaatgaagtttctccctcaactgctgttttccggcaattttgccatcttggtggcaattagcatttcatttgtttctttagataattgctagctagagtcttgatgactaaaccaaaaggccagaaactccaaaaagtggcatttacaaatccttccttaatcgtacttggcagtgtcccagagatgatgagtcagacaggcaccacagctccggatctcccaaaagaaatcatgagacttaacaacgcttacttcc

SEQ ID NO: 8788 - DNA, 712 bp, Zea mays
  Predicted polypeptide sequence is orthologous to G1481
taggccgccgtggcgcgctgacgacgagttgtggcacagcatgcccgtctgcgatgtggagcacggcatgttttcctttgcgcactctccaccactcgcgccgttggcgggggcctcacggctgctgctggacgtggagctggcgacgggcggcggcgtcgcctcggcctcctccgtccagggcacgacctggttctccccctccccttcttcctcatcgtcgtcatcctcgaccacaacatcgtcgtcatcctcgtcgtcatcctcctcctcctcgtcgtccccgcggccgtcgcccgtgccgcccatctccacgtcaccgcccacgccgacggcacccgagccgcggcggacgcagcggtcgcagagggaggcagaggggccgaggcgcgggcccgcggcgcgccacgaagtggggcgcgcgcagccccggcacagcagcgcgcgcgcgtggcgcgccaccaggaagttggcgccgtgcacctgcgcgtcgcagccccagcagagcgtggcctcgtcggcaccgcagtacaccctggccatggcgccgcacagctcgcacgcgcccccgggggcgggggtggccgcgcctttctccttcccgccttcccacgccgcagacatgatcctcaccgttggaccttgcctcaccgccaagacaacaggagggagatttctcggtttcttccttagctttgtttgtttggggcta

SEQ ID NO: 8789 - DNA, 809 bp, Zea mays
  Predicted polypeptide sequence is orthologous to G1482, G1888
cgaagattgtatagtagatagggggtagatgaccggcgaaacggccggcggcgacacgtatggcgcgtttggcctctgcggctctgtacaaatggcggcccaagacaggaccagacttcttcgcaaaatgttcgtggcgctctcaggaacgccttagtcaaagctttgcacgctatagaagacttgtattttagcttttgaatattttcagctaattttaggagctgtgcattcaaacacgcgttagtcaaaggttcgcctcagttaaaggtttcttcatgcacgccgcagaagactagaatcttgcagcagtatttgcatggcaccgaaccgacggctgggatgatagaactgaaccgacctgatagaggccatccgagcaggcgccgacgtcgccagcggacgcgtcgtcaatgaggaagtcctcgacgtgccacccgggcagcgtcttggtcaggtactcggagatgctgctcccgtcgctggcggtcgccgtggtcgcgccgccggcgccgctgccgctgctgcaggattcgtcgttgcaggggccgcggctgttctcctgctcctcctcttcggatgggcccgcagagtccaccggcgctgacgagaggcgcacgccggtgagcaggaaccggctgtgccgcctcgtcatgtcgctggcgctgtgcaccggcgcgtcgcactcccggcacaggatcgccctgtcctccttgcagaacaagaagcccctccgctcctgcacgcagccgatgccagacaggcagcgccgctactcggttagcaagcaccaaagcaccgtccgagcc

SEQ ID NO: 8790 - DNA, 614 bp, Zea mays
  Predicted polypeptide sequence is orthologous to G1482, G1888
ctcgtccaccaggaagtcctcgacgtgccacccgggcagcgtcttggtgaggtactcggagatgctgctgctgtcgctcccgtggctggtggcgggcgccgacgacggaagaggaggaggatgtgcggctgcgtcgccggcgctgcagcagaagctgccgctgctgttctcgtcgtcctcctcctcctcatcctccggcgccgggcacgcggcggcgggctcggcggagaggcggacgcccgtgagcaggaaccgggcgtggcgcatggtcaggtcgctggccgtgtgcaccgacacgtcgcagtcgcggcacaggatggcgcggtcctccttgcagaacaggagcccccgcttgtcctggcagatgtcgcagagcggcggcggcggcggtggcgccgggctgagcagcgagaagcggcggtgcttgccggcgagcttgttggcgcggtgcacgcggcggtcgcacgcgtcgcacagcgccgcctcgtcggcgcagcagaacacctcggccgcctcggccgcgcacacgtcgcactgcaccttcatctcggccactccactctgcttttccctcaagcgatgatcgcgcgcgctctggcggctcagctcagggc

SEQ ID NO: 8791 - DNA, 856 bp, Zea mays
  Predicted polypeptide sequence is orthologous to G1482, G1888
gtcctcttctctgttcctctccagcccccttttcaacctttgacgctgtagcttgagagcgagcttagtgcctaccatattctcctcctgagcgactgagcgctggtctccgataggctcgccatgcaggtgctctgcgacgtctgcggcggcgcgccggccgccgtgctcttctgcactgacgaggccgcgctctgctccgcctgcgaccgccgcgtccaccgcgccgacaagcgccgccgcatcccgctcgtccagccctgcggcgacgactccgccgccgccgccgccgcgccgctctgcgacgtctgcaaggagcggaggggcctcgtgttctgcgtggaggaccgcgccatcctgtgccccgactgcgacgaccccatccacagcgccaacgacctcaccgccaagcacacccgcttcctcctcgtcggggccaagctctccgccgcgctcgtcgaccaggcgcccccctcccctgacgacgacgacgacgacgtcgccgagcccgacgctgtccccgccgcctgcgcggccaaggcctcgtctcttgagtccggcggcggcagcagcatctccgactacctcaccaacatctgcccgggctggcgcgtcgacgatcttctcttggacgactcgtcgttctcagcgccatctaagaccggctacagcgacggccacgatcaggtgccgtccgtggatgccgacctcttcgacgtggtggccagcggccggccaggcaagcgcgtcggcggcgcagcgctgggcttcgacaaggccccggcctccgttgtggtcgtcccgacgcaggggtgcgtgacggagaagacttgggacagcgacagcgacgtgttcg

SEQ ID NO: 8792 - DNA, 616 bp, Zea mays
  Predicted polypeptide sequence is orthologous to G1483
ttttttcggcacgagtatcagtgaggtcacgctgctgggggaggcttctggatacttcttctgcctagaggaccgtgcactactttgtagagactgtgatgttgctatacacacagtgaattcctttgtttcagtacatcagagattcctgctaactggagttcaggtgggtcttgatcctgctgatccagttcctctttttgctgaaaagcatgttaatgcttctggtggatcagtaaagcaatcagtgagacatctgcctaggagaagcccgggagttcaattttcagttgaaggcagtgcttctgttccgagcaaaaatgtatcaaatggagattattcaaggcagaattctgttccaacagccagggcagaagtggttgattggactaagaacaatactacaattcagtcagtagaatccccacctaagtacatgtcagaggagagtccaacacttctgcaatctagccagaccacaacagtcttctctaaccaaattaacggcaatagtgatgggacctaccacttgtcattctcaagtggtaatgtgacagacagtctaccagattggcctgtggatgagttcttcagtaactcagaatatgttccaaac

SEQ ID NO: 8793 - DNA, 868 bp, Zea mays
  misc_feature (18)..(18): n is a, c, g, or t
  misc_feature (702)..(702): n is a, c, g, or t
  misc_feature (709)..(709): n is a, c, g, or t
  misc_feature (717)..(717): n is a, c, g, or t
  misc_feature (727)..(727): n is a, c, g, or t
  misc_feature (732)..(732): n is a, c, g, or t
  misc_feature (821)..(821): n is a, c, g, or t
  Predicted polypeptide sequence is orthologous to G1483
atgcagttttccgtccgnattcccgggccgacccagcgtccgggcttcttgatacttcttctgcctagagaccgtgcactactttgtagagactgtgatgttgctatacacacagtgaattcctttgtttcagtacatcagagattcctgctaactggagttcaggtgggtcttgatcctgctgatccagttccacctattgctgaaaagcatgttaatgctgttggtggatcagtgaatcaaccagtgagacatcagccaaggagaagcccgacagttcaattttcagttgaagggagtgcttctgttcctaccaaaaatgtaacaaatggagattgttcaaggcagaattttgtcccaacagccagggcagaagtggttgattggactatgaataatagtacaattcgatcagtagaatctccgcctaagtacatttcagaggaaagccccacacttctgcaatctagccagaccacaacagtcttctccaaccaaattaatggcaatagtgatggggcctaccacttgtcattctcaggtggtaatgtgacagacagcctaccagattggcccgtggatgagttcttcagtaactcagaatatggtccaaactttggcttctccgagaatggttcttctaagggtgataccgctaagctggggggcgctggtggatctccacaatgccgtttggctganagctcanttgctgangaactattanggcangtgcctggattgatcaccgatgaatatatgggccgagtacctgagaattcatggacagtgcctgaggttccctctccacaacagccttngggctcaactggcatgggaaattgtgtttccctgcgtatgacagccc

SEQ ID NO: 8794 - DNA, 889 bp, Zea mays
  Predicted polypeptide sequence is orthologous to G1483
ctcgacgcctcgtccaacaggagccggcgacgtcgcccccttcgtcccctccgctgcgcccacgccacgaatccattccattcccattcctccccacgccgcgcgcctccataataccacaccgccacccccatgccgctcgcccaccaccacaatccccagccctcacgcgccattggaattgacattcgattcccagcgcagctatcgagctccctttccccgccttgttggcgcgcgttagagcgcgagagagaaccggctaacctccggcggcgaagaagttcatgaaggtgctgtgcagtgcatgcgaggcggcggaggcgagcgtcctctgctgcgccgacgacgccgcactctgcgcgcgctgcgaccgagaggtccacgcggcgaaccgattggcaggcaaacaccagcgcctgcctctcctcgcccccggcggccaaggcgccgccgccgtgtcgccgcccaagtgcgacatatgccaggaatgcgacgcctacttcttctgcctggaggaccgcgcgctgctctgccggagctgcgacgtcgccgtgcacactgccaactccttcgtctcggcgcaccgccggttcttgttaaccggcgtccaggtcggccaggagctcgagcctgacgacctctccctggagcagcgagaggcgtcgtctcccccgccggcgaagagcgagccgaccccgccgctctacagcgagagcgacttcggctgggcggccggcgccggcgctaccgggagcctcacggactggtcggccgtgcaggaggaggtcggctcccctgccccccgtctcgcggaggcggcgcccagggccacgccgaggcggactccgcgggcgcgggctttcggtgccgggcagggccgcatcgc

SEQ ID NO: 8795 - DNA, 848 bp, Zea mays
  Predicted polypeptide sequence is orthologous to G1483
ctcttcccctgcagcctgcagctaagctaatccacccccacccccgagctgaatcgcccctcttcccctttctatcctcatcctccccccgctgccgcgagctcaacctgtgcatggtcgtcgcagcaacagctccatgaaggtgctctgctccgcgtgcgaggcggccgaggcgcgcctgctctgctgcgccgacgaggctgccctctgcgcgcgctgcgaccgcgacgtgcacgccgccaaccgcctcgccggcaagcaccaccgcctgccgctcctcccgcccgacgacgtctccgcgcccaactgcgacatatgccaggaggcccacgcctacttcttctgcgtggaggaccgcgcgctgctctgccgggcctgcgacatggccgtgcacacggccaacgccttcgtctccgcgcaccgcaggttcctcctcaccggcgtccaggtcggcctgcagcccgccgccgcggcccaggacgcagacccgcacccgcccgccgccgcggaacccctccagacgcccccgccgcccgacaggaaggcggcggcggccggcgacggcagcagcccggcgctgctctacagcgacgacgacatcgactgggcggccggcgcggacgccggcggcggcgtcagcgtcgccgtcaccctgccggactggtcgctcgtccacgagcagttcggcgccccgccggtggtgccccgacacgcggacccggcgctagccagaacgccctcttccaagcgcagtccccggcggtcggtcgccgcggcgttcaccgtccagggcggcggcggccttgcagggggcttgccggactggccgctcgacgagttctttggct

SEQ ID NO: 8796 - DNA, 722 bp, Zea mays
  Predicted polypeptide sequence is orthologous to G1488
tgcgcctggagccgctgccccacgcgtcgcacgcggtggggccgaggaccaagggcttgcggcggctccggcgggtgacggcgccgtggagcgtcccgccggtcctgccgccgcccgcgggcggcggcgcgccgcggcgccggtgcacgcactgcgcgtcggaggagacgccgcagcggcggcagggcccggcggggcccagcacgctgtgcaacgcgtgcggcgtgcgcttcaagtccgggcgcctgttccccgagtaccgccccatcctcagccccaccttctccccgctgctgcactccaactcgcaccgccgcgtcatggagatgcgccgccacgtggaggcggaggaggccgcccccgcagccggccgcgccggcgccagggtccgccgcgccgagcgtcgccgcggcgcgcgccgccaagggcgagtgatggcgcagctttcgtttggcgatggaggcgaccggagaccggccatgattacctgacctccgctccttttatctccgtagttttcgttcgcaattctagtttttgttaggactgggtaggattaggaggtcgatgcagcagctgcagacgagagggagggaagagcgtcgtcgtgatcaaatgtcctgtgcaaccgttgcttctgctgtaaacaagactcatggaggtcaccaaactgctctagtccatccgctgtagtctatccgctgtagcctgtagggattgga

SEQ ID NO: 8797 - DNA, 905 bp, Zea mays
  Predicted polypeptide sequence is orthologous to G1488
ctgttctctcaaatcagctggattacacctagtaggctctggctagctagtggaccaagggcttgtcgccgtcgacaagcagtggcgccgacggcccctccagcagccgcgagtccagagagctcggcgcgttgttgttcaggtcacttcccttgcctccgccgccgccgtgtcctgcatctgccgcagcgtcgaccatgtccccaacgcgcagctcgccgctggcaaggctgccgtccaccaccggatgcggcagaggctggtggagcggcgtcggcgggtactcctccttcacctgccaccgctggggaaactggaggacgtccatggctcgcggatgctccgcgggcagagggtggtgctggccctggctcttccgctgccggtggagctgcatcacctggctgtgcttgttggcgtgctccgacggctcgaaggtggggctcgccagcggccggtactccggcagcaaccggccctgcctgtaccgcacgccgcacgcgttgcacagcgtgctgcggcccagcggcccttcccgccactgcggcgtcgacgacgacccgcagtgcaagcactgcttcgccgacttcgggggccgccacggcttcctcgccgaagccgattttttcttcttcttgacgaggtacaccgctggcgctagcggcggcgccgccgcgggtaccgtcctcggaggcggcgggggtctcccccgtttcagaggcttcttcctcaccaggcgcgggagtgtgtggaccgggggccggggcctggcgcacgggcaggcgctggtgacgaggacaggaacggtcctcctcggacggattattggcctgcgacgctgggggaacggcctcttcgccttcctcggcgcggggacggggagcctgaaggccaccagcccgacg

SEQ ID NO: 8798 - DNA, 769 bp, Zea mays
  Predicted polypeptide sequence is orthologous to G1488
acacgaaaaactttgccgaaagatgaacagagatacgcacaaccaaagacgatgaagttgccgagacaggaaagagaaggtccaagaagattactattctctcaaatcggctaggctggaagccggattgcccctagtaggctctggctagtggctagctaatcgatcaagggatcgtcgtcgtcgacaagcagcggcgccgacgggccctccagcaggagcgagtccagagagctcggcgcgttgctcaggccattgccgttgccgccgccgtgtcctgcatcggcgtccgcatctgccgccgcgtcgaccatgcccccaacgcgcagctcgccggcggcgaggctgccggccaccaccgggtgcggtagaggctggtggggcggcgtcggcgggtactcctccttcacgtgccaccgctggggaaactggagcgcggctgtgggtcgcggagggtgcttctccacgggcagagggtgctgctgctggtggtggtggctctggctcccgctcctccgctgccggtgaagctgcagcacctggctgtgcctgttggcgtgctccgacggctcgaaggtggggctcgccagcggccggtactccggcagcagccgcccctgcctgtaccgcacgccgcacgcgttgcacagcgtgctacgccccagcgggccttcccgccactgtggcgtcgacgacgacccgcagtgcaggcactgcttcgcggacttcgggggccgccacggcttcttcgccgaggccaccgagccgg

SEQ ID NO: 8799 - DNA, 2391 bp, Zea mays
  Predicted polypeptide sequence is orthologous to G1493
aggatcctctgctagcagagaattcggcacgaggtcccgaggcgccgcctgatgagcggctaggcgccggatctacggcagcgttggaggtctgatttggacgggagagagcgaggtgaggtctcggttttctcgatataggagatggcggcggcagaggcgcggggagcggacttccccgtggggatgaaggttctggttgtggacgacgacccgacgtgcctcgtcgtgctcaagaggatgctccttgagtgccggtacgacgtgacaacatgtccgcaggctacaagagcactaactatgttgcgagaaaataggcgtggttttgatgttataataagtgatgtccacatgccggatatggatggattcaggctacttgaacttgtaggccttgagatggatcttccggttatcatgatgtctgctgattcaagaacggatattgtaatgaagggaattaagcatggagcatgtgactatttaataaaacctgtcagaatggaggagttgaaaaacatctggcaacatgttgttaggaaaaaatttaatggaaacaaggatcatgagcattctggtagcctagatgataccgatcgtaacagaccaaccaataatgataatgaatacgcttcctctgcaaatgatggaggtgatggcagctggaaatctcagaaaaagaaaagagagaaagaagatgatgaaactgacctagaaagtggcgatccttctacatcaaagaaaccaagagttgtttggtcagttgagcttcatcaacaatttgtgaatgcagtcaatcacctcgggatagacaaagctgttccaaagaaaattttggaattgatgaatgtccctggcttaaccagggaaaatgttgccagccatttgcagaaattcagactctacctgaagagaattgcacagcatcatgctggaatacctcatccatttgttgcgtctgcttctagtgctaaagttgctccgttaggaggactggaattccaagctttggctgcttctggtcagatccctcctcaagctctggctgctttgcaggatgaactccttggtcgacctacaagcagtttggcattgcctggaagagaccagtcatctttgcgactggctgcaatcaaaggaaacaagccccatggagagagagaaatagcatttggtcaacccatatacaagtgtcagaataacacgtatggtgcattttctcaaagcagcccagcagttggaggattgccatcttttgcagcttggcccaataacaaacttggtatgactgattcatcaaacacattgggaaatgtgggcaattctcaaaatagcaatatgttattgcatgaattgcagcaacagccagacaccttgctgtcaggaacccttcacaatattgatgtcaaaccttctggtgtagttatgccatctcagtcgttaaatgtgttcccggctagtgaaggcatctcacataatcaaaatccattggttataccatctcaatccccaagctttctggcatcagttcctccatccatgaaacatgaatcccttcttggatcaccttcaccatcaaccagtctgttgggtgggcttgatatggttaatcaagcttcaacaagtcagcctttgattagtagccatggagcaaatcttcctggtctcatgaaccgcagctcaaatgcaatgccttcaccaggaattagtaattttcaaagtgggaatattccttatgtggttaatcagaatgctatgggagttagctcaagaccaccaggtgttctaaagactgagtgcactgaatcgctgactcatagttatggctatattggtggtagcaccagtgtggactctagcttgctctcttctcaggccaaaaatccacagtatggtttattgcagagtcaaaatgatgttagcagcagctggttgtcttcacaagattttgatagttttggaaattctcttgggcaaggccaccctggttccacttcgtctaacttccagagttccgctcttggcaaattgcctgaccaaggacgagggaggaatcatgggtttgtcgggaaaggcacttgcattccaagtcgctttgcggtggatgaggttgaatctccaactaacttgagtcacaacattgtaaacagtggagacatagtgaacccggacatattcggatttagtggacagatgtgaaactttcttgaatttgtaattagggttgatcagtgaggaccggaaacaaatttagtggtttgaatggttgctcgtattttcgtttcttccttttccttctgtaattggtttataaggggaatcggctatgtgacagcatatggaatcttgctttatagaagtttgttcagtttaaaggacttgaaattaatc

SEQ ID NO: 8800 - DNA, 2391 bp, Zea mays
  Predicted polypeptide sequence is orthologous to G1493
gcggcggctcccgaggcgccgcctggcgagcggctaggcgccggtctacggcgacgatggaggtgtgatttggacgggagagagcgtcgtggtgaggtctcggttttctcgatataggagatggcggcggcagaggcgcggggaggggagttccccgtgggcatgaaggtgctggttgtggacgacgacccgacgtgcctcgttgtgctcaagaggatgctccttgagtgccgatatgacgtgacaacatgtcctcaggctacaagagcactaactatgttgcgagagaataggcgtggttttgatgttataataagtgatgtccacatgccggatatggacggattcaggctacttgaacttgtaggccttgagatggaccttccagttatcatgatgtctgctgattcaagaacggatattgtaatgaacggagttaagcatggagcatgtgactatttaataaaacctgtcagaatggaggagctgaaaaacatctggcaacatgttattaggaaaaaatttaatgaaaacaaggaccatgagcattctggtagcctagatgacaccgatcgtaacagaccaaccaataatgataatgaatacgcttcctccgcgaatgatggaggtgatggcagctggaaatctcagagaaagaaaagagagaaagaagatgatgaaactgacctcgaaaatggtgatccttcttctacatcaaagaaaccaagagttgtttggtcagttgagcttcatcaacaatttgtgaatgcagtcaatcacctcgggatagacaaagctgtcccaaagaaaattttggaattgatgaatgtccctggcttaaccagggaaaatgttgccagccatttgcagaaattcagactctacctgaagagaattgctcagcatcatgcaggaatacctcatccatttgttgcgcctgtatctagtgctaacgttgctccgttaggaggactggaattccaagctttggctgcttctggtcagatccctcctcaagctctggctgctttgcaggatgaactccttggtcgacctacaagcagtttggcgttgcctggaagggaccagtcatctttgcgagtggctgcaaccaaaggaaacaagcaccatgaagaaagagaaatagcatttggtcaacccatatacaagtgtcagaataatgcatatggtgcattccctcaaagcagcccagcagttggaggattgcaaccttttgcagcttggcccaataacaaagttggtatgcctgattcaacaagcacattgggaaatgtgggcaattctcaaaatagcaatatgctattgcatgaattgcagcaacagccagacaccttgctgttaggaacccttcacaatattgatgccaaaccttctggtgtagttatgtcatctcagtcgttaaatacattcccggctagtgagggtatctcacctaatcaaaatcccttgattataccatctcaacccccaagttttgtgtcatcaattcctccatccatgaaacatgaatctcttcttggattaccttcaacgtcaaccagtctgttgggcgggcttgatatggttaatcaagcttcaacaagtcaggctttgattagtagccatggaacaaatcttcctggtctcatgaaccgtagctcaaatgcaatcccttcaccaggaattagtaattttcaaagtggaaatattcattatgttgttaatcagaacgctatgggagttagctctaggccaccaggtgttctaaagaccgagagcactgactcactgagttgtagttatggctatattggtggtagcaccagtgtggactctggcttgttctcttctcagtccaaaaatccacagtatggtctactgcagaatcaaaatgatgttaacggcagctggtcgccttcacaagattttgatagttttggaaattctcttgggcaaggccaccctggtaccacttcatctaacttccagagttccgcccttgggaagttgcctgaccaaggacgagggagaaatcatgggtttgtcgggaaaggcacttgcattccaagccgctttgcagtggatgaggttgaatctccaactaataacttgagccacagcattggaaacagtggagacatagtgaaccccgacatatttggatttagtggacatatgtgaaactttcttgaatttgtaagtagcgttgatcagtgagcactggaaacaaatctagtggtttgatgaatggttgctagtaatttcgtttcttcttttttttcttctgtaattggtttataaagggaataatctatgtggcagcatgtggaatcttactttataagtttgttcagtttaaaggacttaaaattggtcagtcccttgtcatat

SEQ ID NO: 8801 - DNA, 751 bp, Zea mays
  misc_feature (18)..(18): n is a, c, g, or t
  misc_feature (211)..(211): n is a, c, g, or t
  Predicted polypeptide sequence is orthologous to G1504
acccagtttccggtccgnattccacggctcgaccccgcgtccggatgaattggtgacccggtcaggcgtgccatcgcccccccacaaagcacaagcctgtgctgctgctgctgctgctgcatgagcatgactgaactgaacctgtggagtactgccgccatgatgacctagggcctgccactactacatgtccctggggatcatcgtacgntcgaaaagatcagcgcgcaatgcactgcagattgcgcaagaagaggacctgacccgcgcttcacaaggctcatctctagcttgatcaaatccaatccgatgatgctccagcgttattactatactgccgacttctgtagacagcgtcgaccctaccaaacccaacagttcctcgctcgctttcgtcagctgctagttaaagtatagtagcattcactgttgacgttgacgctgactcaggtgcatccatcttctctacctgcaggcactacggccacccgacggtgctgccggccttcacgccgacggcgttcctgttctgagcggcggcgaaccgcaagcaacgcaaaacgtcggcggaccggcggcggtgtttgtacagctcgtgtgtgtggtggtggtgcatctcgacgacgacggcttcctgctttgttttttttttttgttcttccaacctttatgcacagcaaagagctgatccctagcttagtgcttctgatctatatatgatgtgtatacacaactctgctgtttcggatcc

SEQ ID NO: 8802 - DNA, 587 bp, Zea mays
  Predicted polypeptide sequence is orthologous to G1506
gggcatcagtggaccggaaggctttaccaagtctactatgaaaccactcaaaagaccccgtgacacccactttcagagtgacgcagaactagatggtaccatgaggagtcctctaagagttctaaaatccggggctttggctcttcagtttgaaagttcatctttgccaaaatctagctatgccaccgaagattcaacctgcactggaggagcacctaatctattcatgttacccctagaaaagctaccattactggtcccttctcagtatgccgtctctgatcaagacttgctgctggaaatacctctcaacgcacgacacccagaggcagaacttctctgtcaaccatctcagctgatgagctctataaccagcagctccacctctatgggcggggttgctgaaggagaagggtacctggagcaaccatagtctcaggtcacatcagcaagcagcttaggaacagccagtagttgcagtttactttaacctcctggatcgtgtcgcctctctgtgccgatcaccaatggggcctaagtgtccttatttacataacaatgtgcttcgtatgccaacttggcgaaat

SEQ ID NO: 8803 - DNA, 901 bp, Zea mays
  Predicted polypeptide sequence is orthologous to G1506
tctaaaagactggatacagaacgaggaaaacaaacacccgaaaagaaaggaagaagaggagaagaacaccaaacaagcagaactttttttttgagaactccataggctgtggaattgtctccaggaatcccctctgggtttgacgagattcatacagagaaatacttcttgattttccccctttcttttgctcaagaatttacctgtacaggcgaaaccgcttctttgttcccttttttttctgtgtttgttttattgggattttcctctggtccgttcttcttcacctgtgaggtggtgagaagcagagagaatcatggggaagcaaggaccctgccgtcattgtggagtcacaagtactcccctgtggcgaaatgggccaccagataagccggtgctctgcaatgcatgtggctcgagatggagaacaaagggttcattggcaaactacactccaatgcatcgcaaggacgatattgatgacgatgaacccagagttagcaagctgaagccaccgacatcaaagctgaagtcacagaagaaaaaaccaaatcacattataatggagaatgggccattttctggtcagaatttccgaaagatgggggatgtcgaccaaagttatcggtctagttcgggatctgcagtatcatactctgagagttgtgccccatatggtgctgctgatgcaagtgaaatgactggttcagcacagtcgcatgcttgggagtccctagtgccatcaagaaagaggagctgtgtcacccgtccgaagccttcccctgtagaaaagcttgcaaaagatctaaacttcatcatgcatgaagagcagttatattacccttcaggatcatcggaggaagacctactataccatagtgaaactcctgtcgggtccctt

SEQ ID NO: 8804 - DNA, 705 bp, Zea mays
  Predicted polypeptide sequence is orthologous to G1506
ccctgcaataaggtgatatttttttcacacggagataatactttctccacggaccatatgctacagacaaccagcaaaaacccaatccaaaagcatgctacaaatgttagctgaacggacaattcgccaagttggaagatgacgcacattgttatgtaaattagggaatgacggatgcataacgcccattggtgatcagtaaatggaggcgtcaagatccaggaggctaaagtaaactgcaactactggctgttcctaagctccttgctgatgtgacctgagactatggttgcttcaggcacccttctccttcagcaaccccacccatagaggtggagctgcggcttatagagctcatcagctgagatggttgacacagaagttctgcctctgggtgtcgtgcattgagaggtatctccagcagcaagtcttgatcagggtcgacatactgaggagggaccactaataacttttctgggggtaacatgaataaattaagtgctcctccagtgcaggttgaatctttggtggtgtagccagattttggcaaagatgaactttcaaactgagccaaagcaccagattttagacctcttagaggactcctcatggtaccttctagttctgcatcaatctgaaattgggtgtcacggggtcttttgagtggtttcatagtagacttggtaaagccttccggaccactga

SEQ ID NO: 8805 - DNA, 486 bp, Zea mays
  Predicted polypeptide sequence is orthologous to G1506
ttttttttttttttccaaaaagataccccattcaaatataagactgttcaactttactgttaagcgcaaacaatgccaatttcatattggtaggaagagcatgctgaaaataagagtgcatgaaaccaccacaaatattttaagcaagcaccgaagcatcgacaatatattttcttttactactatagactaatcaaaggaacatctttgtatcacatacacaaagagaaagatagtttcggtattctctgataccaggcaccaacaatagcttgtagcccatccgttctcaatcctgattgtgcctcattgccatgcatgactgagatgttattatgtcatagattctgtcaagaaaaggaggatacaaatttcttgtactgacgaatcacctccttcaaatccttgaatgaacttatcttcaaacaacttttgtgtctgggagactgaagaatcaagttttcttttgtacatactttgcctttt

SEQ ID NO: 8806 - DNA, 638 bp, Zea mays
  Predicted polypeptide sequence is orthologous to G1510, G1779
tcgcccatcacccacctctgactgtcgtctcgagctaaaacccttgctctccctgcccgcccattttccttaccccttggcattcgctccactgcttctccggcgaattggatcggcgatccatcgtcgtcggatcgcaactcctgactagcttgttgctgcaggatcgttatccgtcgcgcctgctgcttgggtttgttttccctgctcacggaaatggggatggagatagacatggagacgtatcccaatcttaatacttccccctcggccgccactgcctcaggcgacgccaaggcctgcgccaactgccacaccaccaagacgtcgctctggcgcggaggaccggagggccccaagtccctctgcaacgcctgcggcatccgctaccgcaagaggaggcaggcgatcggtctcgacgcagcagcggcggccgccgccaactcacagcaagatctgcagcagccaaagaagaaggccgccgtcgatccgcagcagcaggaccagcatcagctgagaaagaagacaacagcggtcgctaatccacagcaggatcggcatcagccgagaaagagagcagctgcccgctgccaccgatccacagcacaccagcatcaccaagaaagacacggacaaga

SEQ ID NO: 8807 - DNA, 422 bp, Zea mays
  misc_feature (15)..(15): n is a, c, g, or t
  misc_feature (360)..(360): n is a, c, g, or t
  misc_feature (413)..(413): n is a, c, g, or t
  Predicted polypeptide sequence is orthologous to G1510
aaaaaaacggagaanactttccgcccccccacaaaaaaccgcatcctcctcgccggtcgcgcacgggcaaagcagctttggccccagcgacggcagttggcggacaccacagggtggaggctgcggcgtcgtccgcgggggctgtgctggccgtcgccgttgcctcgcagaggttgataggcctgctcgctcttgcggttcaaactgtaaattgtgtagcagaaatatataatgaagaccagcaggaaatatacaagttattatatggaggaatcaaatctgaaaatgtccctgaaattaaggctgggtcagatgatgatgatgacgatgaagacgatggaacatgaagatgaacgatgnatgatggatgatgatgatgatgatgatgagggtggtgaccacgacccatgaanaccgatgat

SEQ ID NO: 8808 - DNA, 866 bp, Zea mays
  Predicted polypeptide sequence is orthologous to G1512
cgttatatacccctacggagcctcttctcatcagcctgctccttatcgccggctgccgtgccgccgcgtcctgctccccgctcccgtgttcgtcgtccgaagcaccgccgagcgccgcggcctcgcgccagcgccaccgcccagaaaccatctttccctcccgcgccgctgagcccatagcccatatcggggcctcgttcgacttcgaccgaagcgcgctgtgtcaaatttctgcgaccttgccgccgccttcatcattctggagctcggattgatttcttcctttgctgtgctgtcattaccgaactaaagcagtttctgagagcaagcgtcacaatcgccatggaagctgggagaatggatcagccttgcatggcttctatcaatagccagcctttcgtggctgatactgagccagtgaagaaagccagtggggacatgcctgcggcgccgacaggaagcgggtgcttcgactgcaacatctgccttgattttgcagcagaaccagtggttaccctctgtggtcatctctactgctggccttgcatctacgagtggctgcgccctggggtggagtcaaccgccagcgacaacggcagttcggcaaggcggcaatgccctgtatgcaaggcaacactctcaccggacacccttgtgccgctatacggccgcggagggagctcaaagaagtcactggatggcatggccatcccgcgccgccccatggtacaccgggaggctgtcgagcaacagaatgcacggagccatgtcaatgaccagcactaccaccagagcacgggagacagccctcagcaccagccattgatgcaggcgcaccaccatcccgtcccccctgggttcgactt

SEQ ID NO: 8809 - DNA, 815 bp, Zea mays
  Predicted polypeptide sequence is orthologous to G1517
ctgctggttcgatccaaaccctaccaaatcgatggccgacggcggcaactgcgggccgggcggcggcaatgcatcggcgccggtgtgcagtttcgtgaggaaaccacccaagaacatccggaagcgccccgccgcgcccgcggggtctgatgacgacgacgacggcggcggcggcgccctcgccgccgcgcgctccaagaaggggccaccgtcctcaaccgctggcaagctcgttttctccaccgcaggtgcttcctccgaggcgccgcggttccagtacgaatcgtcccggacgatccagtccacggacacccgcgcaactgccacgctcgagacggagacggagtttgaccgcgacgcgcgctccatccgcgagagacagctcaagcaggccgaggagtccctcaagaagaacccctccgctgttgctgcttccgcctccgcctccaccgctggagaggtgtacaaggggatccacggctacacggactacaaggctgggttccgacgggagcacacggtatctagcgagaaggccggcggttcgcatggtccgctccgggcgtccgcgcacattcgcctctcccagcggtttgactaccagcccgacatctgcaaggactacaaggagacggggtactgtggttacggcgattcctgcaaattcatgcacgaccgaggggattacaaatccgggtggcagctcgagaaggaatatgaggaggctgagaaggcccgcaagcgacgaattgccatgggtggtggtggtgagagtgatgatgaggcagcagatgacgaggatgaggaggaggcgc

SEQ ID NO: 8810 - DNA, 1681 bp, Zea mays
  Predicted polypeptide sequence is orthologous to G1519
gtcgacccacgcgtccgtgctagcaggcgcccccaccggcgatgcgggccccagctccggcgctgggagcaacccacccactcggccacggaggttccccggggcggcgcagccggagatcatgcgggcggcggagaaggacgatagctacgcagcccacgtcacggaggcatgccgcgacgcatttcggcacctcttcggtaccagggttgctgttgcttaccagaatgagataaaattgcttggtcagtccctttactacttgctaacaactggttcaggccagcaaacacttggtgaagaatattgtgatatatctcaggttgcaaccttgcatggacttccacctactcctgctaggcggattctattcattttgtaccaaactactgtgccctaccttgctgaacggatcagctccagaattgttgcccgtagtattgtactcaacgaatctcagtttgatgaccatcctgaaagtgataattctagtagtgacattgcacaatccaccacaaatagtgacattccttcaagaagcttaagtgtttctgctctgtcagggttcagaggccgagttcatgccttgtggcaatgggttcttcagaaatggccttcaatgctgccatatgctcaagattttatacagttggctatccggacaaatctaatgttcttctattttgaaggtctgtattatcatttgccaaagcgagcagctggtattcgctatgtattcattggcaagccaatgaatcagagacctaggtatcagatcttgggtatttttctgttgattcagttgtgtattcttggagctgaaagactccgaagaagtaatatatcgtcaatagctagttccattaatcaaatatcatctggaggctatccatcgactacaggtcggggcatccctgttctaaatgaagatggaaatatcatcagtgacatccgcagtggtaaagctgcagatatagcttctcattcagagacctccaatggcaagagcaaatgcaccctttgtctcagcatccggcaaaatcctactgccacaacctgtggacatgttttctgctggaattgcataatggagtggtgcaatgagaagcctgagtgccccctatgcagaactccgattacccattcgagtttgatttgtatatatcattcagatttctagcaaatcatttcgcacagtaggagtccatatcatacttcactggcgtcaaaatttccagaccatatttcggcaagaaaactgcatgccaaaatggtttcgtatacttaagtgggagaagagtacgagaccatttcaagaggttaaagatcagagagttgcatacgataatttgttgtaggttgaaagtttagattgaattagggaccacaggtagtagaaattatttattggcagttcggatagtagataacttgtattggacaccgatgtgaattttattggttagaacaatgtccgactcgaatcatcgagctatttagcaatatgttgtgtccattttcgtcgcacttataccagcttgtatgttttgactaagttaggtgcaggtatgttactataattttcatttatgtttgagtatagaatataaaatagctgggtggaaaaaaaaaaaaaaaaaaaaaaaaaaaaaaaaaaaaaaaaaaaaaaaaaaaaaaaaaa

SEQ ID NO: 8811 - DNA, 853 bp, Zea mays
  Predicted polypeptide sequence is orthologous to G1519
cccacatccgccgtcgccgttccccagcatcgcgaaacccgccctcgccgtctccatgcacgcactcgccgccgcctcatcctcccatccccatctccctcatctcccccttggaggactcaaggagtggcatcggattgcagttaactgccctgggcagcccgatctagcgtctggtgcgcgccgttggcagccagcggtggcctgccgagcgccgcagggaagccacgagcacacgctgtcacgggaggaagcaggcggagcacacaggcctttctgtttagcccgccaggtagatcggatttagcgagatgcttgcggcggtgatccattgccaccagtaacagggaaaagcaggcagctagcggccgatccatctctgacgacaacgctagcggccgatccatctttgcctctacccacgccgccgccgagccggccactccctgatacgggcacagcgccgctgcggcggctcaccagctccaacctctgtcctccgatactccactgtccggtcgcaaatgctcctccatggaacggctgatggctacacaccggtacgtatccagcagcgtctggttctggagcatcagcaggtatcagatcttgggtatttttctgttgattcagttgtgtattcttggagctgaaagactcggaagaagtaatatatcggcaatagctagttccattaatcaaatatcatctggaagctatccatcgactacaggtgctatctcttgtacttaatttttcttatgctgaatcttagagtttacttgctattaacgtaatgcagatacttaactttttgtttctgttttttgtcctagtaaatgtaaaccaggtc

SEQ ID NO: 8812 - DNA, 781 bp, Zea mays
  Predicted polypeptide sequence is orthologous to G1521
accgacagatagtgtgatggtattattttgtgacatactcgctgtcgccaaacatctatttttatcgtcagatgtttgacgctaaaattgtttcatggtgtagtggttgttagacgtcgatcacttgatgaccatcctttgccttggcacttgtttagtttatccatcttcaggttcatccatcagcatcaccttgtggagaagcccacgcttaacatcatctaggggttgactcaactcgtctttcgcattacgtgatcacttaacgtaccatgactaaaatgattcaactacacgcggatgacaatgaatccgaggtcgagcaatccatcgaacacttggcaaacattgcacgaatctttcttcattacccggttcctatgaatttctctccttggcaccaagttggagacctacggaatggagcaccgcagtatgctatggatcttcgacgtgtccacggttcaagaacatccagcatccactttgaatttctatggttcaagcacatcctcgaccccaaacgaatagcacgtcgggacattaccacccacgccatccatcatatggaggtgaacatgagcgacgaccgacaactcgtaggggcgtcgatgaccagtagctgtgcacggccgagcaccacgcgaggtcgaggcgaagatgaggatgaagaaggacgacagcatcggaccaacatgccgacacagggcgtgatgggaatcatggccaggatttgggcaagctgagcgacggtgctggttatggaattccacgatgaggt

SEQ ID NO: 8813 - DNA, 869 bp, Zea mays
  misc_feature (424)..(428): n is a, c, g, or t
  misc_feature (639)..(660): n is a, c, g, or t
  misc_feature (792)..(814): n is a, c, g, or t
  Predicted polypeptide sequence is orthologous to G1526
ctcagtatgattcacgttagaaaggaagaccgtcatatcggaagggcaaggttccacccactcccatccggccatccccatctacaatggtctaaacccagatcttactcctaccaaacatgccctcaacaacctacttgacactaccaaagtatcaacggcgtagcgtcagctatacacatcggcaatgatcatttatttaaacaacatcttgagatgctcaatgcgagcgccacgaatctcctcgtcggtgagcgccccagaaaccatcctctgcttgcgcatctggacctgctgcatccgctcctcgacagtacccttgacgatgaagcgtcggactcggacctctcttttctgcccaatgcggtgaattctcatgatagcctgctcttccacagccggattccaccacggatccatcatnnnnncgttggaggcagcagttagatttagccctacacctccagccttgagcgacatcattagcaccagcttgtcctggctctcactgaactccttcagaactttctctttgtgcttctggctcagcttgccatcaaacctcaagaacttgatacccttctgggtgaagcggatctccagaagatcgaagaaggaagtaaactggctgaacacgannnnnnnnnnnnnnnnnnnnnnaaggctctccagcatcgttacgagcgttttcactttgcacgagtccttccagttgttcttggcatccacctggaaacgactctgagcaggcagtatgatcaggtcagacttgctgatgtgacgtctacagannnnnnnnnnnnnnnnnnnnnnngtcctccagctagaaacaaggcattcgccacacatccggtgtgcgcaagcctcgt

SEQ ID NO: 8814 - DNA, 798 bp, Zea mays
  misc_feature (14)..(14): n is a, c, g, or t
  misc_feature (746)..(746): n is a, c, g, or t
  misc_feature (793)..(798): n is a, c, g, or t
  Predicted polypeptide sequence is orthologous to G1526
cagttccggtccgnattccccgtcgacccacgcgtccgcgatgtttaaaaaattgggttgaatcttccacgattctgctctcctgcaggagttggaagctcttcgcagttcaggcgccaagagtatcgtgtttagccagtggactgcttttttagatctgttgcaaattccactttctaggaataatttctcatttgctaggctggatgggacgttgaatcttcagcaaagggagaaagttataaaggagttctcagaggacaaaggcattttggttctgcttatgtctctgaaggctggaggtgttggaatcaatcttactgccgcttctaatgcatttgtcatggacccttggtggaatcctgctgtggaagaacaagctgtcatgcgcatccatcgaattggtcaaacgaagactgtttctatcagaagattcatcgtgaagggcactgtcgaagaacgaatggaggctgtgcaggctcgaaagcagcgaatgatttctggagctttgactgaccaagaagtccgcactgcacgtatagaagaactgaagatgcttttctcctgagactacaaaagggctgttgtgcatcggatggtcggcaattcggcatggctaaaacaagatggctggtagccagaatgttggaaggtaagacgagggtaggaaattgcacgcccaaatatcttggcgtttagctgctgttgtgcgcacgatttgtacatcatgaatggttaatggctgnacagagtccaagacgcttcattgagtgaaaatcgaagcatcatctcnnnnnn

SEQ ID NO: 8815 - DNA, 3968 bp, Zea mays
  misc_feature (52)..(82): n is a, c, g, or t
  misc_feature (877)..(1014): n is a, c, g, or t
  misc_feature (1552)..(1556): n is a, c, g, or t
  misc_feature (1642)..(1663): n is a, c, g, or t
  misc_feature (1794)..(1826): n is a, c, g, or t
  misc_feature (2399)..(2466): n is a, c, g, or t
  misc_feature (2683)..(2687): n is a, c, g, or t
  misc_feature (2889)..(2916): n is a, c, g, or t
  misc_feature (3157)..(3179): n is a, c, g, or t
  misc_feature (3185)..(3186): n is a, c, g, or t
  misc_feature (3218)..(3240): n is a, c, g, or t
  misc_feature (3361)..(3364): n is a, c, g, or t
  misc_feature (3366)..(3370): n is a, c, g, or t
  misc_feature (3404)..(3408): n is a, c, g, or t
  misc_feature (3437)..(3440): n is a, c, g, or t
  misc_feature (3672)..(3692): n is a, c, g, or t
  Predicted polypeptide sequence is orthologous to G1535
tgggaatttctctcatctgatagactgatccctctcctggactgagttctannnnnnnnnnnnnnnnnnnnnnnnnnnnnnnattcgtgacctagctagtatgtacagcagcttcgtctttcaagactgcagaggagcatacaaaggaggaactgaagaatagatggaagccaagtcactgtcgcagtcttctcaccgagctaggaaagcaaatgtggcgagccttcactgttgctgctccgagcattttcatgtgtccgttgatgcttggccatttgcacatcgcgggtgaactgggtccttgattttgcataaggagcttcccttgctgcagctaatcttttagcacggagaatgttctggcgtctcttccaccagcacgcagcgaatacaactaggaatagaatagctaaaagcacgccgaaagccatgccgatctttgcagccacggatagatgagggccacactcacgtaacccaggtattccacatagtccggcattgtccgtgaagttaaatctagctctgtgcagaggccttcctcccaaactggctggaacacgaccagaaagacgattgccattcaggttcagtatctgtaatgatgtcagctcgccgaggctctctggaatagatccattaagctcattgtatgacagatccagtacttgcaccacagagatggtacccagggagattggaatgttcccctttatgctattgccactcaagtttaatctcgtgccgaattcggcacgagtccaggtggccaaggacgaggacatggatcagctggagatggagatggagctcagcggcggctccgggagcggccacctggacggcctgctcagcttcgccgacgtggacgacgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggaagcgctgttcaaggagtgcccgcacccggacgacaagcagcggctgaagctgagccaggagctggggctcaaaccccgccaggtcaagttctggttccagaaccggcgcacccagatgaaggcgcagcaggaccgcgccgacaacgtcctcctccgcgccgagaacgagagcctcaagagcgataactaccgcctgcaggccgccatccgcaacgtagtctgccccaactgcggccacgccgccgtcctcggcgagatgtcgtacgaggagcagcagctccgcatcgagaacgctaggctcaaggacgagctcgaccgcttggcgtgcatcgcgacccggtacggcggcggccgacagccgagcatgtcgtcgtccgcgctggtctgcttatcggcaccgccgccggtgctcatgccgccgctcgacctcgacatgaatgtctactctcgccatttcaccgaccagtccccagtcatgggttgcggcgacctcatccagtccgtcctcgggccgccgtcgcagcagatcaccnnnnncgccgagcaccacgcctccacgccgtcgttcatgggcgccatggcgcctgtccaggagcaggacaggcagctggtgctcgacctcnnnnnnnnnnnnnnnnnnnnnntcgccaagatgtgccgcgcgggcgagtcgctctggctgcggcgccgtggcgcgagctccgaggtcatggtagccgacgagcacgcccggatgttcagctggcctgtcaacggcggccagcaggatagcagnnnnnnnnnnnnnnnnnnnnnnnnnnnnnnnnngggatcaagggacggcaccgtggttatcatgaacagcatcacgctggtggatgccttcctggacgctaacaagtggatggagttgttcccttcgatcctatccaaggcaagaaccattcaggtcataaaccatggatctgcatctggtcatatgggcagtggatctctcctcttgatgcaagcggagttgcagttcccgtctcctttggtgcctgcgcgagaggtggtgttcttcaggtactgcgtgcacaacggcgacgaggggacctggtccatcgtcgacttcccggccgaggggttccagctggaggcactgcaaaccccatctgttgtaaggtgctgtaggcgcccctccggttgcatcatccaggacatgcccaatggctactctagcgtggtgtgggtggagcacacggagattgttggagaggagaagccactgcaccaggtgttcaaggactacgtcgccagcggctctgccttcggcgccacgcgctgggtatccctgctccagcgccaatgcgagcgccttgccagtgagctcgcccgcaacatcgccgacctgggagtgannnnnnnnnnnnnnnnnnnnnnnnnnnnnnnnnnnnnnnnnnnnnnnnnnnnnnnnnnnnnnnnnnnnaacatcagtgcttctgggagccaatcttggacttcactctcagaaactacagaggacacgatcagggtcactactcgcaagaacacggatccggggcagcccagcggtgtcattctaaccgctgtctctacaagctggcttcctttcaaccatcagaaggtcttcgagcttcttgccgatgaacaacagcgttgtcagcttgagattatgtcaagcnnnnnctcacttcacgaagtggcacatattgcaaatggatcacacccaaagaattgcatttctcttcttagaatcaatgctgcaagcaactcctcccagaacgtggagctcatgctgcaggagagcagcacccaccccgagggcgggagcctcgtggtgtttgcgaccgtggacgtggacgccatccaagtgacaatgagcggcgannnnnnnnnnnnnnnnnnnnnnnnnnnnctgggcttcgccatcttcccggccgccaacccttcggctgcagcaaccagcgccgcaggctccggcgacggccaaagcagcccagcaggtaacgccgacgagcccgccagcggctgcctcctcaccgtgggcatgcaggtgctcgctagcgcggtgccctcggctaagctgaacctctcgagcgtgaccgcgatcaacagccacgtctgcaacgccgtccaccagatcacagccgcgctcnnnnnnnnnnnnnnnnnnnnnnnctgaannccggcggctgctgcctccgagtagtaagtagnnnnnnnnnnnnnnnnnnnnnnnagatccatacaccacaacaaaagccaaattgacttccaggtccggttgtttctgctgacagacatcgcaggtgcaagagagggtttgacaggagcccgaaaccaacacacggaaagttccnnnntnnnnnttctctttcccgccatatgcctcttaaaatgacnnnnntacccctgaccgaacgaagagaatggttnnnncattttgatcattttgggaagctagtgcggtgtcatctacagctactggaaaagaaagggtcctgtcaagctctcacttgtgccggccgattctctatcacgcagaaaacaatccggggcagcttggtcatgcaggtgttgctgctggtagctctctctctctcggtctgttcccttgctcagaagtcagaactgtgaagaaggttagcttcgattggtatgcttatttcgnnnnnnnnnnnnnnnnnnnnncgggagatttacctagtagttcgcgcgtaatggtcgggcgtagagccgtgtaactctgtattagaagagactgaggacttgattgtttaggagagcaagagaaaaggtgcgagaggaggagtcaagagcgaaccaaaccagttgtgaccatctgatcccaggctatcagggaagaagggtcttggttcgggaattgacttgttccctctctgcaccgcctgtttgtgctgctactcaagctcgtttgattacgttggtaggttgttttctcgtgcc

SEQ ID NO: 8816 - DNA, 867 bp, Zea mays
  Predicted polypeptide sequence is orthologous to G1537
cccaagagccggcacagaggcaaaggccagccctccagtgacaggcagatcgaggccacatggagacgccacagcagcaatccgccgccgccgccgccgccgccgcccacgggcaggacgacggcgggtcgccgccgatgtcgccggcctccgccgcggcggcggcgctggcgaacgcgcggtggaacccgaccaaggagcaggtggccgtgctggaggggctgtacgagcacggcctgcgcacccccagcgcggagcagatacagcagatcacgggcaggctgcgggagcacggcgccatcgagggcaagaacgtcttctactggttccagaaccacaaggcccgccagcgccagaggcagaagcaggacagcttcgcctacttcagcaggctcctccgccggcccccgccgctgcccgtgctctccatgccccccgcgccaccgtaccatcacgcccgcgtcccggcgccgcccgcgataccgatgccgatggcgccgccgccgcccgctgcatgcaacgacaacggcggcgcgcgtgtgatctacaggaacccattctacgtggctgcgccgcaggcgccccctgcaaatgccgcctactactacccacagccacagcagcagcagcagcagcaggtgacagtcatgtaccagtacccgagaatggaggtagccggccaggacaagatgatgaccagggccgcggcgcaccagcagcagcagcacaacggcgccgggcaacaaccgggacgcgccggccaccccagccgcgagacgctccagctgttcccgctccagcccaccttcgtgctgcggcacgacaaggggcgcgccgccaacggcagtaataacgactccctgacgt

SEQ ID NO: 8817 - DNA, 917 bp, Zea mays
  Predicted polypeptide sequence is orthologous to G1538, G1545
gctactactcctagtcctagtacaggctacagaggcagagcgagcaaaactgcctgtacatagcaaccatcaacgacgaccgatccaagtagtgagcattagtggatctactacgtacatatatagaaggaaacagctgcagctctctctctcgctgtttcctgcgtgatctgcttgtgtagctactagctagctagcggagcggaaccacccatgggctgcgaggaggaagagaggctgctgttcccgtccttcgtctttcccgagagcttcgcggaggccgccacccccggctccggtggtgagcagaagaaggctcggcagcgtcggaggcgcaagccgcggccggcggagggcggcgagggcgcggacgagcaggccaggaagcggcggctgagcgacgaccaggcgcggttcctggagctcagcttcaggaaggagcgcaagctggagacgccccgcaaggtgcagctggccgccgagctgggcctcgacgccaagcaggtggccgtctggttccagaaccgccgcgcccgccacaagagcaagctcatggaggaggagttctccaagctccgcgccgcgcacgacgccgtcgtcctccacaactgccacctcgagaccgagctgctgaagatgaaggacaggctggcggaggtggaggaggagaagacgaagctcgtcgcggcggcggcggcggcggccggcggcgcagcgggcgcagggagcagcagcccgagctcgtcgtcgttctcgacggtgacgcaccacccggccgcggcgctgcaggtggggcagttcggggtggagccggaggaggccgccgacctcgtctacatgaccgagtacgcctactacagctacatgaacatgatggaactcgcgcccgcctacttcggtggagtcgtctacgacta

SEQ ID NO: 8818 - DNA, 433 bp, Zea mays
  Predicted polypeptide sequence is orthologous to G1539
ctcgaattccgttgctgtcgggcgccaaaatctaatctttgggtatggattagtattccagaagataatccagcattgttaaacctactgtgaccagtcatcgaggtcattctattgaagaatagtaaatggggaagagcacattaactgttgcacacatgagaagcagataccaaaatatttttttttgggtatggattagtattccagaagaggattaggcatagataaacctactgtgaccagtcattgagctcgatctattgaagaatagtagatggggaaggacacactaactattgcacacacataagaagcgaataccaaagtttaattactagaaaacactttaccaaatctaaactttgggtatggattagtattccataagagcgacagcaacggcgacagcaacggaattcactggccgcgt

SEQ ID NO: 8819 - DNA, 586 bp, Zea mays
  Predicted polypeptide sequence is orthologous to G1543
caacaacgggagcgggaacgggtaacaacatgagggacctggacatgaaccagccggcgagcggcggcgaggaggaggagttcccaatggggagcgtggaggaggaggaggacgagcgcggcggcgccggcgggccgcaccgcgccaagaagctccggctgtccaaggagcagtcccgcctcctggaggagagcttccgcctcaaccacaccctcacaccgaagcaaaaggaggccttggctgtcaagctcaagctgcggcccaggcaggtggaggtctggttccagaaccgcagggctaggacgaagcttaagcagacggagctggagtgcgagtacctgaagcgctgcttcggctcgctgaccgaggagaaccggcggctgcagcgggaggtggaggagctgcgcgcgatgcgggtggccccgcccaccgtgctctccccgcacacccggcagccgctcccggcgtccgcgctcaccatgtgcccgcgctgcgagcgcatcaccgccgcaacggccgcgcgcaccccacgcccggcgcccgccgcgagccccttccacccgcgccgcccggtccgcggcgtttt

SEQ ID NO: 8820 - DNA, 1385 bp, Zea mays
  Predicted polypeptide sequence is orthologous to G1554
gcacgacgctcacacttgttctttccggcacagcacacaggacaccccttacagattcatcgcgacgatggggctggacgtcgtggagatcgggatgggcgccgatttgagcctggatctgaggcacttcgcctccaaggccgtgcggcagagcaaggactacgcgccggcgccggcgccggacatggacgcctgcatccgccgcctcgaggaggagcggggcaagatcgagatgttcaagcgggagctgccgctctgcgcgcgcctcctcgcagacgtgatcgatgtgatgaaggaggaagcggggaaggcggtggcggaggaggacggcgccgccggggacaagagcaaggggatgagcacggcgcagctctggaccggagattgcggccgcgaggacgcggaaccagagaagcaagacaaggagaggagctcgcctgaggccaggtctcgcgccgccggcggcgctttcttgccgctcaaggctgccgtgggctccggcgcgccggcgttcgcgccgctcggcttgagaatggacgacaaggccgccgcgcgcgccgggatgcccgacctgtgcttgctgtcgccgccggcgaccaagagcgccgccgaggagagccgtcgccaggtggtggggtttgcgcaggcggcgacgagggcggccgccgccacggcgccagctgccccttcgcttagcgttggcatccagtccccgtcgcagcaggcgaggaaagctcggcgttgctggtccacggagctgcatcgccagttcgtcgccgccttgaaccagctcggtggcccccaagttgccaccccaaagcagatcagggagctgatgaaggtggacggcctcacaaacgacgaagtgaaaagccaccttcagaaataccggctgcacaaccggagggcgccagggtccggcgtggtgagccagcccatcgtgctggtgggagggctgtggattccgcaggagcaaagcagctcgcagtccgggtctccccacggcccgctccacttctccacctcaggcatcgccgtctcgtcggcgggcaccgtcagctgcgaggaggaagacggacggtccgagagctatggctggaaatgatggagaggctgctgctgctgctgagaggggagccgcagcctcaggaacgggaatcatcaggagggaaactgagagtagtgtagctgtctgtacacatacatagttacattacattacatacaggggagtgagggagatcgggccttgagcgctcgagaccaaactgatgcttcgggtttgtacatcccaaagagatgagatgatacagttttgcggctaatccatgtttcgggctttggttgtcaccaaaaaaaaaaaaaaaaaactcgagggggggccc

SEQ ID NO: 8821 - DNA, 963 bp, Zea mays
  Predicted polypeptide sequence is orthologous to G1554
cacagcagtacagttgatcatattatctgagaagtactatactagtaaaagcttgtagcagctagctacagccaatagtgtaagctccaacacagacaaatatacttgcgccagtagtgagtgattctagtacatcctcggatcgagcttggcagcatggcttcttcgccgtccgacctaaccctagactacaagcccaacggcaacggcgccgcgtacgcagtgacgaccccgaagccgccgcaggagacgctcgtggtggacggacaccaccaccaccaccatctgacggcggcggagcagacgacgcagaagctccgggagttcctcgcgcgcctggaggaggagcggctcaagatcgacgccttcaagcgcgagctccccctctgcatgcagctcctcaaccacgccatggagtcgtaccggcagcagctggaggcgtaccagatggggagcctgcagggcgcgccggcgaggccgctggtgctggaggagttcatgccgctcaagaacatcgggatcgacgccgccgccgacaagatggggaacccgacgtcggagaaggcgagctggatggagtcggcgcagctctggaacgggcccgcggcaacggcggacgtggccgccagggggccgcagacgcccaaggagagcgcggagtgcgcgcacggcgccgcgggcgccggccacgggcagcgcaacggcggcggcggcggcggcgcgttcctcccgttcgccaaggacaagaccgcgtccgcggcagaaggcgcggcgctgccggagctcgccctcgcgcccgcggacaaggacgcggccgacgctgacaggaagccgtaccttgatgccgccgccggcagcaacaacggtggcgtcctgggctcgcggagagacgccgtccagagcgggggtcgtcaacgtcaagccgggcgccgaacgcgcccggaggggcagcagggcgcaccg

SEQ ID NO: 8822 - DNA, 838 bp, Zea mays
  misc_feature (17)..(17): n is a, c, g, or t
  misc_feature (44)..(44): n is a, c, g, or t
  Predicted polypeptide sequence is orthologous to G1560
ctccagttccggtccgnattcccggctcgaccccgcgtccgggnaaggatatctagatgatgggaacttgactcaagttagtgaccagtcagagctgaacgacgacttctgggcagagcttttggtcgaagattttggagacaaggcaggacagccagagttggagggaagaactgaagacgtgaatgaccttgctcaacaactggggtatctgagttcttctagcccaaaatagagccagttcctaatggttgcccccacaatcactggtgctttccctaccctactgttgcagaccatcctgatcaaaccggtacttttcaaattcaattcaatgacacaaacctgttaaaatctggtggagaggtgttcatactgaaggcgtgctgtggagaggtcactgccttgacgttgaaggcttagcgctgtactctgctgtgggagttacgtgtggggtgttggctaaatgtctcttccggcgtcttctggcaaaatgatctcgtggacggtgactggcaaagatgcctaggggccaacgtatacgtacacagctgttatcagatcttgttcaaagtcattgcgcggttttgacggtgctatgtatcgatcagggttctggccttctggggttgggttgtagaattgactggctgatctagtgttctccatgtatgactggtgtaaccttaaaacaccctcagcttgttgttgaactgtgacaagcatctcgtttttttgttgtactccattttcatcatcattgtacatcaaattgctgaattatgaacagatcccctataatttggtggactgcgtcttggcatttggctaccggccc

SEQ ID NO: 8823 - DNA, 705 bp, Zea mays
  Predicted polypeptide sequence is orthologous to G1560
gaaccgcaacactacaaagcttccaccgcatgaaattagacaaacagtttgcacacaaccactgacagaaacatgtataaccatcagtactacttgctgagtcgctgtcactgtacataactacagactgaattcctgacgggcagggtcgtaaaacaaccaacagatcgctggcgtcgcctaaaacagccactccagtggcaagcagcaatcactagtcagatcacatcagatgcacctagcagttctcccttgacaccatggcgaatgccagccaattctcatggaagcaagccctaccattggcgaggaattcagaagggcatggaaaccgagcaacggaagcagaattgcctagtcttgctgacacagtgaacacaattcaggagctgcgggttctggtaagatggaaataacaaaacagcaacgaagccaagactaattgctagatgttgggccatctgagttgagataacccatcttctcagacagcacattcatatcatcctcgattacagggctatcgttctcctcgccaagtccttcgttcagcaactgctcccagaagttgtcattcagatcctcctggggcatgtcttgctgctgctcagaggtactgccaatatcaatatcaatatcaatatcatgtggcccaatcaggccgtggccatcgaaagctgggctctcgaggtcagctgggattcc

SEQ ID NO: 8824 - DNA, 599 bp, Zea mays
  Predicted polypeptide sequence is orthologous to G1585
gataaatcggcacacaacacctacgccatccgcgctttcgcgcagcacaccgggactctagctttcttcacgcgtcgcgtacgctcaatttgtcatgcattataccagcacgtagtagaaggcaccgtgctggagcggctccactgtgcagcccaacgggtcgacggggacgggcacgaggtcgaggccgccgcggtcgccgacggcgcggagcagaacggccgcctcgccgaactgcgccctcacgtcgagcctggcagccgcgacgttgtgtgccacgctcttgcccgtgacgctgtccgtgatgcacagtgctacggcgacgccctcctgcgctgccgtgggcgccgcggcaacggcggcaggcggtgcaccgccggtgctgacaccgacgacggccccggacccggacccgggcactaccagtccttgcagtagatcatagttgacgataacagcattagtacttgcaggcaaagctgtgagcccagcggtcgccatggtagcagcggttcccggcgacgcagcaaggggcaccgccgcggaagccgtctccatggccgcgctagctccgaagccgtactgcagcaaccccagcg

SEQ ID NO: 8825 - DNA, 720 bp, Zea mays
  Predicted polypeptide sequence is orthologous to G1585
acggttaagccatactactatctttcaggatacacagggattgcaatacgatatagttcttacgttcttagtgcacttcagtgcaactgtgcaagcaatcaagcatacataatatacgagacaaattaaaccaggacttaataaatcggcacacaacacctacgtacgccatccgcgctttcgcgcagcacaccgggaactctagctttcttcacgcgtcacgtacgctcaatttgttataccagcacgtagtaaaaggcaccgtgctggagcggctccactgtgcagcccaacgcgtcgacggggacgggcacgaggtcgagcccgccgcggtcgccgacggcgcggagcaaaacggccgcctcgccgaactgcgccctcacgtcgagcctggcagccgcgacgttgtgtgccacgctcttgcccgtgacgctgtccgtgatgcacagtgctacgacgacgccctcctgcgctgccgtgggcgccgcggcaacggcgacaggcggtgcaccgccggtgctgacaccgacggccccggacccggacccgggcactgccagtccttgcagcagatcatagttgacgacaacagcattagtacttgcaggcaaagatgtgagcccagccgtcgccacgctcgcagcggttcccggcgacgcagcaaggggcaccgccgcggaagccgtctccatggccgcgctagcttcgaagccgtactgc

SEQ ID NO: 8826 - DNA, 772 bp, Zea mays
  misc_feature (12)..(38): n is a, c, g, or t
  misc_feature (736)..(736): n is a, c, g, or t
  Predicted polypeptide sequence is orthologous to G1591
tttttttttttnnnnnnnnnnnnnnnnnnnnnnnnnnngatctgttctgttctaatattatgtatactatctgccagtagatctgggtttttcgttttatgctgcattatcaaattaatcttaggccctgttaattttccaacattaattaggtatggagaaaaaagtacacttttacactcttgcaagaaaattaggatgctaaaaaggaaaaaaaggtaaataggcaaagaagttagcaactagcctttgcagtagctagattgcagccatgcacaaacctgcatatacaagctagttatctattaatctttgtgatattgcccatgggctgtttcatagaggaggatgtcttgcgtgattaggcttgctatctgtgtgggtgtttgttctttgttgtcgaaaactcgtctgcgtcgctccccatactgctcagtccaaacatagcagaccataccagaccttaatccttgtacttcttacgtctgaacgaccagggttaatttttgaactaaggaccaaacaatacatgaaaagggctagattttggatttctcaaacagcaattggtagtgttcaatgtcgtgtaaaatatggtggtgagaataagggctatggtactgaataccagctaatttcctgctaatataattggataagacgttcctgggaaaggattcttgggtttgttcagattccatctaagcacttgttcggttattctcattacatttangtgccgtttggttcatatattggtaacgcaatgagt

SEQ ID NO: 8827 - DNA, 1338 bp, Zea mays
  Predicted polypeptide sequence is orthologous to G1591
agcttccatcccagtccaatcgtcctcaccctagcaaatcccagagacagagactaggaacccacggcatttggctgctgatcgatcgagctgtgtgtatgtgtgtgagaggttggcaggttgcctgttagctcatgatagactgctgattgatcgatgcatatatgatttgcaggtagaaacaacttcttagaacgcatatacgacacacacatatagctagctgtcgttctgcagtcagcgcacacacagctaagcttcctacctaggattgagctagctaggcgtgttgaatccatcgtcagtcgatcgatccgatctagcattagcattagcatcctccatgccgcagacaccttcgacccgctggtgcccgacgccggagcagctgatgatcctggaggagatgtaccggagcggcgttaggacgcccaacgcggcggagatccagcagatcacggcgcacctggcctactacggccgcatcgagggcaagaacgtcttctactggttccaaaaccacaaggcccgtgagcgccagcggctccgccggcgcctctgcgcccggcaccagcagcagtacgcgcagcagcagcagcaggccaccgcagcagcgccggcttcgagccctaacagcagcgccacccttcttgcacctccggcagcaggcggcagcagcgccccctgtgtgcatccggcggtgatgcagctgcaccatcaccaccacccgtacgcaaccagcttcagcatgccccatctgggctacttggggcagcaggcggcgactgttacgccagtgctcaacccagctgctgccggcatggtggaccttgcaggagcaggagcaggaaatagggctactggtgcaggcggtgcctatggcggtggagctgggttatacaacagctgcagcagcaatcagctggaggtgtgggacgccacagagccgatggatcactgcaacgccagctgcggtgcggcatcaggcagctctgacgagggtggcgcagctcatctgcagctgccggcatgctgccgccgccctctcaagacattggacctcttccccactaagagcactggactcaaggacgagtgcagcagctccaagtcgtcctcttgctccacatccactaactaatttaagcatcgtcattattaaatcgctttagtttctacattgttggcttctggtatttctttgatttgctagctagtagattcggtcatcgtctcaagtgtgtcattatatcgttgcggtgcgttgtattgtgtgttgttataactacgtttaagtttcagtactttatctcaatttatctaaaaaaaaaaaaaaaa

SEQ ID NO: 8828 - DNA, 1248 bp, Zea mays
  Predicted polypeptide sequence is orthologous to G1591
ggcacgagctcatcctatagcgaaccgcaaaaggcatagtcacatagactaggaacgcacggcattctgcagatcgatttgagttgtgtgtgtgtgcgcgtgcgtgtgtgggaggttgcacttaccacacacacacataaccaagctacctagggtaggcgttgaatccgagcgctagcagtagcaatagcatcgtcgtccatgccgcagacaccttcgactcgctggtgcccgacgccggagcagctgatgatcctggaggagatgtaccggagcggcgtgaggacgcccaacgcggcggagatccagcagatcacggcgcacctggcctactacggccgcatcgagggcaagaacgtcttctactggttccagaaccacaaggcccgcgagcgccagcggctccgccgtcgcctctgcgcccggcaccagcagcagtacgcgcagcagcaggccaccgcggcggccccggcttcgagccctaacagcagcgccaccgttccgtccctcgcagcaggtggcagcagcgccggtgtgcatccggcggtgatgcagctgcaccatcaccagcacccgtacgcaaccaacttcatgccacaccagctgggctacatgggacagcaggtggcgactgttccgccagtgctgaacccagctgctgccggcatggtggaccttgcagctgcaagagcaggaggaggaaataaggctactgctgcaggtagtggtgcctatggaggtggagctgggttatacaacagctgcagcagcaatcagctggaggagtgggaggccacagatgcaatggagcactgcgacgccagctgcggtgcggcatcgggcagctctgacgagggtggcgcgctccagctgccgccatgctgccgccgtcctctaaagaccttggacctcttccccactaagagcactggactcaaggacgagtgcagcagctccaagtcctcctcttgctccacatccaccaactaattaatcgttattaccaaatcgctctagtttctacatatattgcttctagtagttcttcgatttgctggatagctagtagctagattcgatcatctcaagtgtgccattatattgttgtgttgtgtttgtgtgtgacgctacctgttttcatttgttataataactacgtttaagtttcagtactcgaactcaatctatgtatatctatcctggtgtaatggatttattgttttatcccaaaaaaaaaaaaaaaaaaaa

SEQ ID NO: 8829 - DNA, 885 bp, Zea mays
  Predicted polypeptide sequence is orthologous to G1591
ctccccactacatgcttcttcgtcgtctcatcctcttcttccaatccagacctccgtccacacccacccatctgctcctcctcctcctccctccctagtacccattttgtctctctcaacagtccctctctctccagtctccacacacccaaccaaccaaaccaaaccaaaccaaaacctttttgctagcttattcacagacagcagcttccaaccaatcaaactcatcgaccgatcgagtgctcgtacaccaatagctcagccagccatcaaatcctagctggaggtgcgtacgtacttggctagaggaggtagacgacgacggcgacgacgaccgacatgccgtcgcagcagcagcagcagcagggccagcaggtggcggcggggtcgacgcggtggtgcccgacgccggagcagctgatgatcctggaggacatgtaccgcggcggcctgcgcacgcccaacgcgtcgcagatccagcagatcacggcgcacctcgcctgctacggccgcatcgagggcaagaacgtcttctactggttccagaaccacaaggcccgggaccgccagaagatgcgccgcaggctctgcatgagccaccacctcctctcctgcgcgcagtactacgccgcggcggcgcaccacggccacgccgccttcctcgccgcgccgccgccgtacgggcaccagctgctctccccgtccacgacgtcgcccaccccggctgctgctgctgctgccgccgctgcagcgtacggctactactaccccgccacggccgccttcgctgcaccggcgagccggtgcgccggcaacgccactcccccgtcgccgaccacccagctgttccactatcagggtggcggagggcttgtgccgacggag

SEQ ID NO: 8830 - DNA, 1041 bp, Zea mays
  Predicted polypeptide sequence is orthologous to G1637
ctgtaacaacttgtgtagtacttaacccctcgcacctcatgaatcccaacttcaacagtgtgtggagcgctcccgagatcaatatgatgaactcactcatcactagtcacatcgccaacaacacctacacaaacaacaaccagcatgttgtggcaagtcgtagtgccattgtgaaccacaataactttgggatgccaacggaggtcgttccacccgtggacaacatggacatgatgcaaggctatctaatggctgatacggatgccatgaggcttgttcagggacaacaacatatgccaaatgttgttcctaatcaaaggaggcatgcagtgaagttttggactacagatgagcacaggaatttccttcgtggtctagaagtgtttggccgtggtaaatggaagaacatctccaagtacttcgtccccacaaggacaccagtgcagatctctagccatgcacagaagtatttccgcaggcaggagtgcaccacagagaaacaacgctttagcatcaacgatgttggcctctacgacacacagccatgggtgcggcagaacaactcctctagcagctgggaggcgctcaccttcactgctggccgtgcgtacaataatacaaactactgtgcctttaacagcctcccgtatgccagcagccaggcaagtaacaaccaggtagctacatggattacagaccagcaggcaactgcaagttcttctatagctcctccagcgacggaggagagccagatatataaccgataatatatataatggtcatcagcagctgggagaggctttcttcatatataatcaataggtagatagatatggacaacgtccattgactagtttaatttctatctatatgttttgtatccaatgatgcatgtaaaacctagttggttgttaaaggtcattagtaccatactatatatgggctagaaacagtttcattgaaatttgcccctgagcaatacaatgaaattttaccaatgtgttatttatatattaatgtgtctaaaaaaaaaaaaaaaaa

SEQ ID NO: 8831 - DNA, 805 bp, Zea mays
  misc_feature (790)..(790): n is a, c, g, or t
  Predicted polypeptide sequence is orthologous to G1637
cagccgccacaaacagccagccggccgccaggatttctccttgcgttcctgcatggctgcatggccactaacagactgccggccgccaggagctatccatgcatttctgcatgggcctcatggccgagctatgctcaagtgccgcctctggtttccctttttttttttttaattttcttctccccagccgctgctccactcggccgccagggagcatcacgcttgtttctttctctgattctttgtctgagcagccgctagagcacagagctactggccgaacgtgcccgagtacggccgttcctgcgcgttgcatgctcctatctctctcttttttttttctttctttcactgtttactgattttggagattactaacgcacggttggcttcaatgcaccggagatggccggcctgagccgcctcgcatccccatcccgccgacgtgcgcgtcccttcgggtgggcgcgccgtcgtcggatgggtgctgcgcggtggtcgaggcccagtccgacgagttaagaactgcggcactgttagccgtcgcctgcgaacctctctctccccaggatctatcctcaactcgatccctcaagtgattttgtaacgggatcgagttttggaggtaaagaatcatagatctgggtcccgcgatatttctgttattttctgtgatgattttagtgcatctgtacacttttgattcacgtggtttttgaaaaaaattagggttctaaccctagcttcgttctgtacgacttttttctgatctgttcttgaccgtttattnaaaaaatcacgagta

SEQ ID NO: 8832 - DNA, 920 bp, Zea mays
  misc_feature (746)..(746): n is a, c, g, or t
  Predicted polypeptide sequence is orthologous to G1638
gaagaaagcaaggagagggagccagggaggaaggggaaaaacacgcggagagggtgagcaagaaagaaccgaggcggatcgccttctgttcctcctgccggctccgcgagaggaggcactgctcagtcccgtgattcctacaggggggaagaaagaggtggaacaacgccccggggcagagcagagatgatgcgggagacgtacatggacgtgctgccgccggtggaccacatagccgcacggagcaactggttcccggcggcggcgcgtctgtggacggcggcggagaacaagcagttcgagcgggcgctcgccgggctcgacctctgccgcccggactgggaggaggtggcgcgggccatccccggccggacggtgcgcgaggtcgtcagccacttcaagcacctcgaggtcgacgtccagcagatcgagagcgggcaggttcccttgccggcctacggcggcggggccagctcgttcaccctgcagtgggacggctacggccccggtccgggggacttcaggcacgggtaccgcttcgccggaggctgcgggaggcggcaccacggccgcacgccggagcaggagcggaagaagggcgtgccatggacggaggaggagcacaggttgttcctcctaggcctgaagaaatacggcaagggggactggaggaacatatcgcgcaactttgtccagaccagaacgcctactcaggtggccagccacgcgcagaagtacttcatcanggctcactccggcggcaaggacaagaggaggtccagcatccacgacatcaccacggtcaacctgacggacgaccagccgccctcgccgtcccagtcctccctgatcaccagccagtcgaacgcaccagctccatctccagctccggctcccagcgcggggatatgccaggtccc

SEQ ID NO: 8833 - DNA, 684 bp, Zea mays
  Predicted polypeptide sequence is orthologous to G1638
gtttatagaatcatgttgccaatcaaagtcatagttgtttgtgttgttagcatcgctagtgaaggtgagcgcctcccatccaagagagttactctgcaccattgttggatctatggatgaactggctattatgtgttgacctcttgtccatgtagctacatggccactgctcgtctggctagtatgtgtgagtttgttcaagacaacattttgtctctcaaagtcataatatttgttgttgtaagcagtatgaccaaaggtgagagcctccaaactaaaagagttcttttgcacccgtggatctgtgtcatagaggtcgatatcattgatgctaaatcgttgttttcttggggtgccctctttcctatggaaatacttttgtgcatggctgcagatctgtattggcgtccttgtggggacgaaatacttagatatgttcttccagttaccacgaccatacacttctaggccacgaaggaaattcctgcatacatatatggttcagaatcaacaagttagatgataacatatgtcttgttcataccctcaagattggtgaaaataaaatcccactgaatcatggtattaaacactatacaccactagcttattacttgtatgaaaaataacattaaagatgtgataaacatttcaaaaaacaaagaggaaatgaattacttgtgc

SEQ ID NO: 8834 - DNA, 837 bp, Zea mays
  Predicted polypeptide sequence is orthologous to G1638
cgccgctccgggctgaccaagggctcgccgcctcccgtgtcctccgactccgacagggaaaggcgaaaccttgggtcggctcgctagtggagtgcagggtacgttgatgacggagctgtggatggaggtgctgccgccgccctacttcgcggggcaggcggcgggcgggtggttcctgccggaccggcgggccgggcccggggcgtggacgctggaggagaacaagatgttcgagcgcgcgctggcgagggtcgactgggacgcgccggaccggtgggagcgggtggccgcgttgctgcccggcaggacggcgtccgacgtcgcggcccactacgacgacctggagtgcgatgtcggctgcatcgaggcaggcttcgtgcccttcccctgctacggcagcggcggcggcgcgtcgcagtccgccgggttcacgttcgactgggacgccggcgggctgggctttaagcgctcctgctacgtggtcggcggcggcaagcgcgagcgcgggccggaccaggagcgcaagaagggcgtcccctggacggaggaagagcacaagcagttcttgatgggcctgaagaagtacgggcgaggggactggaggaacatctcgcgcaacttcgtgacgagccggacgccgacgcaggtggccagccacgcgcagaagtacttcatccgcctcaactccggcggcaaggacaagcgccgctccagcatccacgacatcaccaccgtcaacctccccgacgacgacgcgggcggcaccgcctccgcctcgccgccctccgtgctcacctccgcctccgcgccctcgtccaccggcggcggcggcccggt

SEQ ID NO: 8835 - DNA, 129 bp, Zea mays
  Predicted polypeptide sequence is orthologous to G1640
atcaactaccttcgggcggacgtcaagagggggaacatctccaaggaggaagaagacctcatcatcaggctccacaggctcctcggcaacagatggtccctgatcgccagccacctccccggccgaaca

SEQ ID NO: 8836 - DNA, 826 bp, Zea mays
  Predicted polypeptide sequence is orthologous to G1640
atggggaggagggcgtgttgcgcgaaggaaggcgttaagagaggggcgtggacgagcaaggaggacgatgccttggccgcctacgtcaaggcccatggcgaaggcaaatggagggaagtgccccagaaagccggtttgcgtcggtgcggcaagagctgccggctgcggtggctgaactacctccggcccaacatcaggcgcggcaacatctcctacgacgaggaggatctcatcatccgcctccacaggctcctcggcaacaggtggtcgctgattgcaggcaggctgcctggccgaacagaaaatgaaatcaagaactactggaacagcacgctgggccggagggcaggcgccggcgccggcggcagcagggtcgtcgtcgcgccggacaccggctcgcacgccaccccggccgcgacgtcgggcagcagcgagaccggccagaagggcgccgctcctcgcgcggaccccgactcggccgggacgacgacgacctcggcagcggcggtgtgggcgcccaaggccgtgcggtgcacgagcggactcttcttcttccaccgggacacgacgccggcgcacgcgggcgagacggcgacgccaatggccggtggaggtggagttggaggaggaggaggagaagcagggtcgtcggacgactgcagctcggcggcgtcggtatcgcctcgcgtcggaagccacgacgagccgtgcttctccggcgacggtgacggcgactcttggacgacgtgagggccctggcgtcgtttctcgagtccgacgaggactggctccgctgtcagacggccgggcagcttgcgtagacaac

SEQ ID NO: 8837 - DNA, 416 bp, Zea mays
  Predicted polypeptide sequence is orthologous to G1641
ggcggcgactggcggaacatctcgcgctggtcggtgaagacgcggacgcccacgcaggtggccagccacgcgcagaagtacttcatccgccaggccagcgccgccagccgcggcgacaccaagcgcaagagcatccacgacatcaccaccccgtgatggctcctgctcgtggacgacaaagctagcaccgagagatccagacctggctactgctgctacctgcattttatctttacctttgcgagacgggatcaaaaaacaaacagccgtccctgtggttatagaaatgtaggcaaagctaagctagcctggctggtatctggggtctggtataactgtatcaagcggcactacaatgactatcgaataaataagttttgcaagccaaasscaaaaaaaaaaaaaaaaaaaaaaaa

SEQ ID NO: 8838 - DNA, 807 bp, Zea mays
  misc_feature (782)..(782): n is a, c, g, or t
  Predicted polypeptide sequence is orthologous to G1641
ccgagagaagaaagcagagagggagggagaacaaagagagagagaaaaaaaaaaccagagaggttgagcaagaaccgaggcggatccgccttttgtccctcctgcccgagggctagcctgccgccgcccccgcgagagatcgagaggaggcgctgttcagttcaggggggtgagaagccgtgggggaagagatgatgcgggagacgtacatggacgtgctgccgccggtggaccacatagccgcctcacggagcggcggctggttcccgggcgcggcgcgtctctggacggcggcggagaacaagcagttcgagcgggcgctggccgggctcgacctctgccgcccggactgggagaaggtggcgcgggccatcccgggccggacggtgcgcgaggtcgtcagccacttcaagagcctccaggtcgacgtccagcagatcgagagcggcctggtgcccatgccggtctacggcgccggggccggctcgttcaccctgcagtgggacggctgctacggccccgcggactcgaggcacaacggctaccgcttcggaagcggaggctgcgggaggcggcaccacggccgcaccccggagcaggaccggaagaagggcgtgccgtggacggaggaggagcacaggctgttcctcttaggcctgaagaaatacggcaagggggactggaggaacatatcgcgcaactacgtccagacgcggacgcccacgcaggtggccagccacgcgcagaagtacttcatcaggctcaactccggcggcaaggancagaggaggtccagcatccacgaca

SEQ ID NO: 8839 - DNA, 807 bp, Zea mays
  Predicted polypeptide sequence is orthologous to G1641
catcatccgtccacagccgcaacgaacgagagacagccagccagcaacgccgcgcacgcaaacgcaacgcagcgaccgtgtcgatcgaccagcggagcggaggtttgtttgagtcgacgggcatggacttccaccacagcagcagcagcgtccacgcgcacgcggcagcggcgcggccgtggatcaaggcggaggacttcaaccccagcagcagcgtccacgcggcggggccaccggcggtaccggctgcggcgcggccgtggaacagggcggaggacaaggtgttcgagagcgcgctggttgcgtggcccgagcacacgcccgaccgctgggcgctcgtcgcggcgcagctccccgggcgcacgccgcgggacgcctgggagcactacgaggcgctcgtcgccgacgtcgacctcatcgagcgcggcgcggtcgacgcgcccagctgctgggacgacgacgacggcgaccaccaagtccgcggcgccggcgctgaccgggcgcgccgcgaggcccggcgccccgggataccctggagcgaggaggagcacaggctgtttcttcaaggtttggagaagtacgggcgcggggactggcgtaacatctcgcgcttctcggtgcggacgcggacgccgacgcaggtggccagccacgcgcagaagtacttcaaccggcagttcaaccccgccagccggaactccaagcgcaagagcatccacgacatcaccaccccttgaccctgcccgccgacggcgacggcgacggcgacgcgggctcccctgctttggacgaatcgcgacagccact

SEQ ID NO: 8840 - DNA, 820 bp, Zea mays
  Predicted polypeptide sequence is orthologous to G1645
ctcctgctgcagtctctcctcctcagcggacccggtcctggatggccgccttcttcgctgctgctccgccgccggcggcgggtgctctcgcgtcgttccaccacgaggagcagcagcgtcaggacgccgccgaggagctgtaccacgtggacgacgacgtcggcgagggcggctgcggcgcaggacagcaggggaagctgtgcgccaggggccactggcgccccgccgaggacgccaagctcaaggagctcgtcgcgcagtacgggccccagaactggaacctcatcgccgagaggctggacggcagatcagggaagagctgccgcctgcggtggttcaaccagctggacccgcggatcaaccgccgggccttctccggcgaggaggaggagcggctgctggcggcgcaccgcgcgtacggcaacaagtgggcgctcatcgcgcgcctcttccccggccgcaccgacaacgccgtcaagaaccactggcacgtcctcatggcgcgcaagcagcgggagcacaccggcgcgctccgccggcgcaaaccctcgtcctcgccggacccggcgccgccgacgtcgcacttggcgcccgtcgtcgtcctccaccaccaccaccaccagcaccacgccggctcgcctccgcgcaccgtcgccgccgctcacgcgcagtacacggcagcggacacccgcgcgcacagcggcggcgagtccgacgagaccgcgtccacctgcaccaccgacctgtccctcggctccgccgccgccccctgcttctaccagagtggctacgacgcggctccgcgcgccgcggcgttcgc

SEQ ID NO: 8841 - DNA, 887 bp, Zea mays
  Predicted polypeptide sequence is orthologous to G1645
cgagcgatccgtccatctgacgggaatgagagggtgcgtgcgtgcgtgggggagagtgagatgcctgcctccctgtagcgtgtaggagtagctctggcctcttcctctacctccagccgtgcggttttctgctgcggaagaaacgggagcagtgtcgctcgtcccgctcgcgcgcacatcctcaactcgtctccgtctctcccgcggcaactgacgacgatgccgtgctcgtcgccggccccgacatggctgctgcgagtgtcgccagcggctgccgcggccgaccaggccgccgcctcgtcctcgtgctcatccaagggcggaggccgcgtgctcacggccggtaccaccaccatggacacggccgccaccgctgccgccggcggcaatgccgccgacctccaggagagcagcagcagcggccagtcccggctcgcggcgcgcggccactggcgcccagcggaggacgccaagctccgtgagctcgtcgcgctgtacgggccccagaactggaacctcatcgccgagaagctggacggcagatccgggaagagctgccgcctccgctggttcaaccagctagacccccggatcagcaagcgccccttcagcgacgaggaggaggagcgcctgatggctgcgcaccgcttctacggcaacaagtgggccatgatcgcgcgcctcttccccggccgcacggacaacgccgtgaagaaccactggcacgtcatcatggcgcgcaagtaccgcgagcagtccacggcctaccgccgccgcaagctcaaccaggcagtccagcggaagctcgaggcagcctccgccgcggtcgcaatgccgccgggcgcgggcgcgggagacgtcgccgtccgccagcaccaccacctgct

SEQ ID NO: 8842 - DNA, 765 bp, Zea mays
  Predicted polypeptide sequence is orthologous to G1652, G2776
acaatctgctccctcccaaaaacatggagtgacaggatcaaaccatgtaaaaaactggagggagagaaaataggatgttgggtaactaggtaataaacctctgcacccatgcagcaaaaaacagtggaaatggctatctttgggggggcactgttgggggacagcaagcaactctcttcggaagcaaggcaaggaagaacctgaaaacattaccattagcctcaaatccttaaggctaatggaaaaaaaggttggcctagattaagtttggtcagaagctaaacccatcagaaggatgatttgaacgcttgatttagcttcttgacaatatccttgacagaccagcagaagtcgtcaccagccatggccatgatggtgatgtcgagggaggaggctgtgaaggggagcacattggtgttcatgatggagaggccaaggcgctcgacctcagagagggcggcgatgagcacccccttgcggttctcgcagtggatcctgaccagcactgtgcggtccgacacccgggcctcgatctccggcagagtgccggaagcctcggtggcaacgaagttctcgtcgcaggaggagccctcgtcgtcgtcggccgacagctgggacttcttgaccagcaccgccgcctcgaccgggcgccgccgggcgtcgtcctccagccccttcacctggtcctgcagctgcttcacgtacttgatcgcgtcgccgagcaccgatgccttgttcatcttcttgaggccagggacgatcttg

SEQ ID NO: 8843 - DNA, 838 bp, Zea mays
  Predicted polypeptide sequence is orthologous to G1652, G2776
ccgacgaggagggcctctgccaaaatgtcgtcggcttcttcgtctgcgccgccgtgctcccaggatcacatcgtcgcggagcggaaacgccgggagaagatcaaccagcgtttcattgagctctcggcagtcatcccctgcctcaagaagatggacaaggcgactatcctatccgacgcgacgaggtacgtgaaggagctccaagaaaagctcaaggcactgcaacaaggcggaagctgcaacgcccggggcggcacggagtcggcgccggtgcttgtcaagaagccgcgcatagcggcgccgggggatgacgacaaggaccgcggcggcgcgccttccccttcctgcgcgccgcctggggctgcggcgaccaccgggaacgcgctgccggagatcgaggcgaggatctcggacggcaacgtcgtgatgctgaggatccactgcgaggacggcaagggggtgctcgtcaggctgctggccgaggtcgagggactccgcctcagcatcacgcataccaatgtcatgcccttctcggcctgcatcctcatcataaacataatggcaaaggtggcggagggcttcaacgccacggcggatggcattgtagggaggcttaatgcagtgctagcagctggaccaacgtgttagggatgggtgcgcagaaaaacaacaagctgtgtcaaagaactagcggcgctacccgaataatttctgcatgggccgggcctgtacatacttgtatgtcaccaagaagtacctttggcgttctatcgcatgcatatgcagttcctctttgattcgagcgaataatgtcggtgtgtcgtatgtttatccaatc

SEQ ID NO: 8844 - DNA, 574 bp, Zea mays
  Predicted polypeptide sequence is orthologous to G1655
ttttttttttttttttccccaaactggtttctgatccttcattccccggtaccaaaatcatggcacgcaacacacaattatccacaagttcttttatgtactaacacgagagtaagtaccaaagcacagcagagcagaaagaagagaggagcagcatttgcagctgcggtaggagtaaggatcaaggaatttacagcaaatcacgagctcatcactctgctagtcccaccaccaatcgctcccgacaatagcaacgcacgcaccgcaaaatgattaacatccggcagatgcagatggggggagcgagcaggagccggtgatcaatcatgtcatggggccaagcggctaggccaaccaaccaatcaatccgtcaatccagccacacccgcgcagccacgtctcacctctccgccggcgacgacagctgcgcggccgccagcgcgtcggcgagcgcgcgcatggcgctgacctgcatctgcagcgcggccacgtagtcggcggcctcctccagcagcgcgggcgcggggagcctccggcagcccgggacgaggcagcccagcgcgcggagccgctc

SEQ ID NO: 8845 - DNA, 649 bp, Zea mays
  Predicted polypeptide sequence is orthologous to G1655
gatctgaaccaacatttcaagctgcattcatcggagagcgaatcgaagcaggtgagaacaaaccaagctacaaaagaatcctgagccggagggaggagaggatagagacagcaaaaccactgtgggctacggcttcttctatcacatattacagcacgggttaatcgctgggacgccatcgtcgtcgtcgtcgtcttcatcataacactaaccgctcaccgaactgggagaaacaagacgacaaaggaaactagaaagagggaaagctagcggttaactaatcccgaggaaaaattcggggcgagggaaaaaatagacggaaaaaaaatttacaacgaatccacgaatgttggtcacgccggcgaggaggaaggggaagagccggcgccggaagatgatgaggagacggcggacagcgcctcggcgagggccgtcatggcgcggacctgcatctggagcgccgcgatgtagtccgtggtctcggcgaggagcgtcggaaacgacagcttccggcagccgggcacccagccggcccagcaccatggccttcctcgccaccggaggcagcgcggcggtgcccttcgccccggaggcgccgtggcgcggaggcggggacgcgggggcccgaaggcgcgcgcggggcgcggcc

SEQ ID NO: 8846 - DNA, 753 bp, Zea mays
  Predicted polypeptide sequence is orthologous to G1655
caggtttctctgaagtacagatcagtaattatggttatgagatgatacaagcaagccatgaacaacggttaatctgcttgcagcagcagcagcagcagccagaggtacactacaggacgttcagcaagaagcacatgaaagatacatcatacatgagggtgtgatctgaatgaacatttcaagatgcattcatcgaagagcgatcgaagcaaatgaaaataaacccaagctacaaaagaatcctgagctagggaggaagggaggagcggagacagcctacgacttcttctatcacattaccgcacgggttaatcactgggacgccatcatcatcttcttcttcatcgtcacactaaccactcaccgaactgggagaaacaagacgacaaggaaaactagaggggagagagagagaaagctagaggttaactaatcccgaggaaaaattcgtggggggagaaaagagagggaaaaatttacaacgaatgcacgaatgttgaggcttcggcttcgatcacggcggcgaggaggacccggcgccggaggaggaggtggcggagacggcggacagcgcctcggcgagggccgtcatggcgcggacctgcatctggagcgccgcgatgtagtccgtggtctcggcgagcagtgtcgggaacgacagcttccggcagccgggcaccagccggcccagcaccttggccttcctctccagagggggcgtggcggcgcccccttcccgccgaggccgagggg

SEQ ID NO: 8847 - DNA, 672 bp, Zea mays
  misc_feature (17)..(25): n is a, c, g, or t
  Predicted polypeptide sequence is orthologous to G1660
ttttttttttttttttnnnnnnnnntattttaaatctgtggcctagatgacagaataaattagaaatggtacagaaaatcatcacagaaaataacagaaataacgcaaggtctcggatctacgttttatcagctcataactcgatcccgaatattacattagatccatctcatacattcattcacacacaataagggattcgagtaaacggggactagatccgagtttcgaaaggttaaagacggcgccccataatcggccgaccaactctggtgaaggaaaagacctgcccgcgcaaggcgagggaaatagcgccagattcaagaacaagaaataaaaaaaacagaaatagagagagtaactagcggctagatgctagaaagaaataaaaaaaacagaaacaaagaaggagaaggggcgaacggccaaaaggagcagggagaaaaggatagctcggtcggcccaagctcctggcgaccggttcttgggtgagcggtctggaacttagaaacagagattagaaagagcatgaacagagaggagaggcggccggttttggtcgtcgggcaaggttcaaaaggcgatggccgacatatttttgtttttttttgggctagccgagctctcaccggccaccgaccgacgaccgtgcaccctcacatggggacgcac

SEQ ID NO: 8848 - DNA, 912 bp, Zea mays
  Predicted polypeptide sequence is orthologous to G1660
ctccagcggggctcgccattgatggagtacgagcgcatccacgggccgctcccgcgccatcagtccgggggattctctccagctaagctgcgagcaatgcttcgcgggatagagaaacgccagcgcaacaacggcgaggactcgtctccggaggccaacgactccggcgagctcgacgaccggaggagcttggaatgctccacctccaccgagatgtcgagcaacagcggccacaggtcaagaaaccgtgccccggacgacgacagcttcgactcggagagcagctcgtcggggccgccgacggtgaagaggtcggccgcggtggccgcgttgctgccgcccttctctcggccaacgccgtccaagtgggacgacgccgagaagtggatctccagcccgacgtcaaaccgtactggccgtacggggcctaccgctggagctgtgccgaagaagtctgcattggccttccctgactatggaggccgcccgccagccgttgctaaggtggtagcggatgtgcctaccaacgctggaccagatggtctcgcccatcctgatttacttaagcctggacacaatgcttcagtagttgttgacggaacagcacctgcagttaggtctgtctgtatgagagacatgggaacagaaatgactccaattgcgagccaagagccttctcggaccgcgactcctataatcgcatctagtccaacctcctctcggacaccaaccccgcaacgcaccgcagaattcagtgtgagtaatatagatcctaaaaagatcgagatgcctgaagaggaggaggtacagatgagtacgagacaggaaattatggatcttggtgaaagggtagggaagaccactatagccgcatggggcagcaaggaagagaatctgccgcacgtttcacgg

SEQ ID NO: 8849 - DNA, 866 bp, Zea mays
  Predicted polypeptide sequence is orthologous to G1660
acatacgtgtgtatatatatatatatatagttacaacagcttacaagcgactcattctcaacgggcgactcatcttccatgggcacttcatgagcaccagttccagcagccaaacgacggcggcacccggccggtcctcctgatgtgctctgcctgctcagcggtcctcgcggctgcgcggttccgtttcagctccgccgtggcacgcttctcgtctgcgctgtgcctcgccgacgcgagcttggtcatcagcttgtcttgcgcgcgggcacgcatccgctccacctcgacctcgattttcctcatctcagcttctatctgggctttctgatggtcctcccaagcctggatcttgatctcttctcgcttgaatctcgctaaatacttggccttctccgcctcctcccacgcagccgcacggatcgcggttatgttctgcgtcgactggtccatgggcaccggtttcagcgagagcgaggcgtccttctcctcctccttcttgctcgcccatgccgcgatgctggtcttgcctagctgcgtgccaaggagcatgatctccctcctggttttggtctgcagctcctgctcgctcagctccgagctgctgcattctcctccgtggctgatgaaggagccgactgcgctggggccaccgagcgtcctccgtggagtcgttggctgggagcagtttgggctcgtcgccctcaccggcgtcccggtccgggacggctcttggcttgcgatgggcgtcatctctgtgcccatgtccctcatcgacactgaccggaccgttgttggaggagggatgcatgttgctgcgctctgaagcgtggtgatgcatcatggcggtgaaattaacagctgct

SEQ ID NO: 8850 - DNA, 855 bp, Zea mays
  Predicted polypeptide sequence is orthologous to G1660
ccacggcccaccccccaaatcggccaatctccacttcttaagcctccctgttgcctcgcacggcctccgcctcctcgtcgtccggcctcccgcgccaccaccggggcctcgccgccacgaatggagtacgagcgcatccacgagccgctcccgcgccgtcagtccggcggattctccccagctaagctgcgagcgatgcttcgcgggctagagaaacaccagcgcaacagcggcgaggacacgtcgccggaggccaacgactccggcgagctcgacgaccggaggagcttggaatgctccacctccaccgagatgtcgagcaacagcggccacaggtcaaggaaccgggccccggacgacgacagcttcgactcggagagcagctcgtcggggccgcccacggtgaagaggtcggccgcggtggccgctttgctgccgcccttctctcgcccaacgccgtccaagtgggacgacgccgagaagtggatttccagccccacgtccaaccgtactggccgtgccgggcctaccgctggaactatgccaaagaagtccgcattggcatttcctgaacatggagcccgccagccagccgttgctaaggtggtcacggatgtgcctactatcgctggaccattggttaagaattcagatggtcttgcccatcctgatttgcttaaacttgcacacgatgcttcaatagttgatggaccagctcctgcagttaggtctgtctctatgagagacatggggaccgagatgactccaattgccagccaggagccttctcggaccgcgactcctatgattgcatccagtccaacctcctctcggacaccaaactcctcacgcacc

SEQ ID NO: 8851 - DNA, 2605 bp, Zea mays
  Predicted polypeptide sequence is orthologous to G1666
cccaaggttcgtggcatatctgtaggcatctaccccgtcttcgtcgtccgctcctcactagctaccaagaggtcgccattattgccaacatagagtgtacgtggatgtctatatatatgcctacttgcacccatatggcataggcgttcgatccccttagcgcggaggagagctcctccggttcttctctacccttcgcatggaagttcttgcattgcttcgttgcttctctagtttcttccttctacgtctttccagcatacgcatgcccctcgtccgccggttcacgaggcatcgtctgatgatcagtagataataagcaatataatactgatctagaatcgagttgttgtactcttcgcagataggcgcgtgatggcgctttcagcttcccgagttcagcaggcggaagaactgctgcaacgacctgctgagaggcagctgatgaggagccagcttgctgcagccgccaggagcatcaactggagctacgccctcttctggtccatttcagacactcaaccaggggtgctgacgtggacggacgggttctacaacggcgaggtgaagacgcggaagatctccaactccgtggagctgacatccgaccagctcgtcatgcagaggagcgaccagctccgggagctctacgaggccctcctgtcgggcgagggcgaccgccgcgctgcgcctgcgcggccggccggctctctgtcgccggaggacctcggcgacaccgagtggtactacgtggtctccatgacctacgccttccggccaggccaagggttgcccggcaggagtttcgcgagcgacgagcatgtctggctgtgcaacgcgcacctcgccggcagcaaagccttcccccgcgcgctcctggccaagagcgcgtccattcagtcaatcctctgcatcccggttatgggcggcgtgcttgagcttggtacaactgacacggtgccggaggccccggacttggtcagccgagcaaccgcggctttctgggagccgcagtgcccgagctccagcccgtcaggacgagcaaacgagaccggcgaggccgcagcagacgacggcacgtttgcgttcgaggaactcgaccacaataatggcatggacgacatagaggcgatgaccgccgccgggggacacgggcaggaggaggagctaagactaagagaagccgaggccctgtcagacgacgcaagcctggagcacatcaccaaggagatcgaggagttctacagcctctgcgacgaaatggacctgcaggcgctaccactaccgctagaggacggctggaccgtggacgcgtccaatttcgaggtcccctgctcttccccgcagccagcgccgcctccggtggacagggctaccgctaacgtcgccgccgacgcctcaagggcacccgtctacggctctcgcgcgacgagtttcatggcttggacgaggtcctcgcagcagtcgtcgtgctccgacgacgcggcgcccgcagcagtagtgccggccatcgaggagccgcagagattgctgaagaaagtggtggccggcggcggtgcttgggagagctgtggcggcgcgacgggagcagcacaggaaatgagtggcactggcaccaagaaccacgtcatgtcggagcgaaagcgacgagagaagctcaacgagatgttcctcgtcctcaagtcactgcttccgtccattcacagggtgaacaaagcgtcgatcctcgccgaaacgatagcctacctcaaggagcttcagagaagggtgcaagagctggagtccagtagggaacctgcgtcgcgcccatccgaaacgacgacaaggctaataacaaggccctcccgtggcaataatgagagtgtgaggaaggaggtctgcgcgggctccaagaggaagagcccagagctcggcagagacgacgtggagcgccccccggtcctcaccatggacgccggcaccagcaacgtcaccgtcaccgtctcggacaaggacgtgctcctggaggtgcagtgccggtgggaggagctcctgatgacgcgagtgttcgacgccatcaagagcctccatttggacgtcctctcggttcaggcttcagcgccagatggcttcatggggcttaagatacgagctcagtttgctggctccggtgccgtcgtgccctggatgatcagcgaggctcttcgcaaagctatagggaagcggtgaaggggcagctggaaatttggacatcgacgggcatggaaggcttcatgggatcgaagcaaagatgtatttcttgtttctttagataacagacatgaatcggacctttatatcaacaattatatgggcatgaatacttaagactccagcccttaacacgtagaaactcaaaaaagaagagaggaagctaaagactaagcgtaaggtatatttggaagtaaattatttttatagtttctaagcaatctcatggtttataggaatactagagtgtttatggcataaggtgtttggttgcattcataaaacctatattttcaaagtcatagcattctagataccatgatatttttgtaatattggaaactacactccaacgcaaagtttttatgacatggct

SEQ ID NO: 8852 - DNA, 766 bp, Zea mays
  Predicted polypeptide sequence is orthologous to G1672, G2802
gggctaaaaaaggaaggaattatgaccttcttactaagtttatttcttcgtgatgcgtattagcatgaactaaccaaaggaaaatcagcatcaatttagaaaataaaagaaattaaaagggttaatgtacatgcaaacaatgccactagtttttacaattggaaaacaggtagtacgaataaaaaaactgtgataaaccgtaaactgattatagttatacttgattgaggtgctctaatacatctaacggtccacacatgatcccttcaatgtcagcacacacagtacctttcctcccatcggtctttcccccttctcttttcgttggccattttgtctcttctatcttggagagctcacactgtaaactagttttatcctcatttctttattgagggagatctacagagatatgttttttttctctgttctttccccactattgtaggtgtacattctccaagaaagcaacgctgcatattcaagcagacaaaaaccattccagtgaaagtggttgcggttagtgttccttcagcattcacatcatcgccactatttaccaggtccctgttgctactacccatgatgatcttggttgtcaggtggccagtacgggtaaggccattctgtctcttgggggtgagcaatggaagcatctccttttgtgcttgtggacgacgtgcagcccattatcagttcttccaagccggcagatctgcggtcaagcttttgttgtggctgtgactgttggtgctgttgctgaaat

SEQ ID NO: 8853 - DNA, 740 bp, Zea mays
  Predicted polypeptide sequence is orthologous to G1700
ctcacaagtactactaatctcggttatgttaagtgctgtatcaataagatttccccacaactgaactcttgctcttcttcttcctccccagaaaaatggcaatcataacatcaatggccccatctttatgcgtttttttcctttcccagctaaacacacaatggtaatagaaatacatcgatgggctaggctatccttatttcttccctttaacagtttggcatgctgtactcggtgaaccttcagcgtcagcctgaggcgcagcgacagcgaccaccgtcaccgccaatggctcggccgcatcgccgtgcagttcttcaacctggacgctacttgatccgtcacctccggccgcctcaccttcctgtggtgtgttggcatcaacgagtccctcctcctggcgatgatgtgcgttcggagactcctcttctaccgcagtctgtgcttccagatccagtccggtgctggttgccttgggggcgggaaggagcgatactcggcagagggggcaggtggtgtttgtggagagccagtggtcgatacagttgatgtggaaggtatgcccacagggaggtatcttctgaagcctctcgtccggttcgtattctgctaggcagaccgagcacctgtcaaccatgaccacgtgttcagaagataacacaacataatagaataacaatacagggacaaatggcagcacaaagaaatgtcttaatatcaatagaaaatggtcacacagg

SEQ ID NO: 8854 - DNA, 845 bp, Zea mays
  Predicted polypeptide sequence is orthologous to G1706
cggttgtccgaggactgtgacgacggatttggattgcctgggctgaaggcttcagggttggcacagacaccggtggccgagaagaaggtattccctgtgaggttggggaagttcaagaatgtcggaacccatggtgcagtggaaggtggcaatgccaatgccaatgccaatgctaaccccagggtgttgactagggatgaaggggagagtagcagcagcaggttggatggaaggagatgcttctccatgggcacctatcagtatgttcttggcacatctgagctccgggtagctctccagcctggctgtatcaggaatggcactggtggtgcaatgaggggaatgcctcctggtttaagttcaatcaatgctgatattatggaggggaagaagatctgtgcacgcaacaaaggggagagtttctccgtgtcaaaaatttggcaatggtctaatcttaagggcaagctacctgctggttctgatgaatgttcggatgctgggagccttccatggatgaagaaaggaggtgctgtggatacatcgaacttatgactctctgtactggtataatgtgatagtggcctttctttaattagtgttgctcaccgaagttcttacctgtagtcattttccttatctagttttcatgtgctgattttgattgggagtgccaacctcatcgggggcttaactttttggtaatcttgcccatgttagtatgttgcgccttggtacattgtgatgacttaaaatgatctgatctggtctgcctatactttgggttgggttcagtatcaattgttcccccatccaaacttaagtcaattggttaaaaaaaaaaaaaa

SEQ ID NO: 8855 - DNA, 661 bp, Zea mays
  Predicted polypeptide sequence is orthologous to G1706
ccagtgcaagtacaaaattatgggctaatatctatatctatatgtgtgtgctctgcactgccaacctgctgggattaacgttagtcatcaaactattgtacagtttgttgcacaccaaaatcacccaaaaagatgcttctttttttttttcttttttggcatgagtgaataattggtcgttcggggaatgatttcaccagcaaaattctactaccaatcccccgctagtcaacaaggtgaagcgggggtgtcggttgtctgtcttgtctactgctgtgtatgatcaagtcaagtgtcgctatgttgcctcctcgtgtttgtcgtccgatccttggccgccggcgcccacggcaggccgtcgtcgtcggcgcaaaggccgccgggcagccgcttgctgccgcgccactgccaaatcttggacacggaaaagctgtcgccgcgcgcgaacaccttcttgccctgacgcgggtcgctgccgctgggcgcggcggcgctggggccgcacaccgcgcccgacccgccgcgcgcattgccgtgccgcaggtgcacggagaccaggaggtggtcgccgtcggcgagcacgtactggtaggagcccatcgagtagcacctcctccgcccgtcgatgcggctggtggcgcctgtgctggactcggcgtcg

SEQ ID NO: 8856 - DNA, 564 bp, Zea mays
  Predicted polypeptide sequence is orthologous to G1743
gcacgagggctactcggagctggtgctcccgaagcagctgctccacctgctgctgctgctggggtacgtccgccgcttcctcctctgggcgttcgacgccgtgggcctcggcgacctgctggatctcggggacgaccaccaagcgccgcagccgcagccgcagcaccggcgggcggagttccgggcggccatgccggcgatggtcatcgaggaggccctccccgtggcgcggttcgacgagctggaggcgcgcgtcgtcgttggcggggactgcgcggtgtgcctcggcggcatcggcggcggcgacgaggtgcggcggctcggcaactgccgccacgccttccaccgcgcctgcctcgaccgctggatggagcacgaccagcgcacctgcccgctctgccgcgcgccgctcatccccggcgcggcgctctggcccgccgacgcctccgacctggacttctcctaccccggcgcgccgctgacgcccgtcgtgccctccccgacgctgctgcggccgcacgagctgctgctgctcgcgggcctgggcggatactgagctcaccg

SEQ ID NO: 8857 - DNA, 912 bp, Zea mays
  Predicted polypeptide sequence is orthologous to G1743
cgcacgcacgcacgcacgaccagttgccacggcagaccaccccgcccagcggccagcttgctcgccacgaccacgatgggcttccccgtggggtactcggagtcggagatgctgctcccgcgcgtgctgctgcaggtgctcctcctcctcggccacttccaccgcttcctcctctgggccttccacgccgtggggctcggcgacctgatcgacctcggctgcaactacccgccgccctccgcgtccacggcgcaggagatgatggagcaccagcaccaggggcgcgacgacgtggcctccccgctgcagcaccagcgcccggagttcaggcccgtcgcggcggcgctcatcgaggaggcgctccccgtggtgcggttcgacgagctgtgcggcgcggcgtgcgggggcggcgactgcgcggtgtgcctgggcggcatcggcggcggcgacgaggtgcggcggctcggcaactgccgccacgccttccaccgggcctgcctggaccgctggatggcgcacgaccagcgcacctgcccgctctgccgcgcgccgctcatcccatgggccgccgacgccgactacgacatgtcctatccgtctcccctgccgcccacgccactgcggcggcctcacgagctgctgctgctgcttaccggcctgggcggcttccagtgatgcgcctgcgcgtgggcagcgtggctggcacttgggcaggccggccacgcgaatccgatccgtggcgaggcaaaccgcgtgctcatgtgcggcccagcacgcccggtcggtcaggcgggtgaccgccgccaaacctgctcagttgccagccgtacacgcttggcctcgtcttcggtcgtgtctccgactccgttggttttttacagaggctcccagtcccaggtcaaacaaaaaaag

SEQ ID NO: 8858 - DNA, 865 bp, Zea mays
  misc_feature (727)..(727): n is a, c, g, or t
  Predicted polypeptide sequence is orthologous to G1743
ccatatcctctccagctttccgctccgcccttgtcgctcgtccagccaccgtgcccgtgcccgtgccgccgagaattctatccagaagcaagcaacaagagcccacccccgcttcgcgcgctctttcgtgccaggcaaacacagagcacagctatctgctcgtgtcccggtccgtccaactcgctcgctcgctcaatccactgatgatggggatcccgctggtgtgctactgcctcgccgtgcccaagccggtcatcgccttctgcaggctgctcagcgccgtcagggacgccgccctgctgatgctggccgtggtggggctgtgccgcttcccgcccgacggcgcggtggacgccggccaccagcccggcgaggtgaaggcccggctccccgccgtggagtacggccagctcctggccgagcacgacgagcagcagcagtccggcgaccacgactgcgacggggacgccgcgtcgtcggattgcatcgtgtgcctcgagacgctggaggcggcggacgaggtgcggcggctgggcaactgcgcgcacgccttccaccgcgcctgcatcgaccgctggatcgacctcggccgcgcgacctgcccgctctgccgctccgacctcctgccgcgcgcgccgggctgggccagccggctcggcctgggccggctcacgcgcgttcggtgaggaggaccgtcttccagggcagtttttaatttgtctattgnatgatggggcgcggacaggttagcgacggcgatcgcccgggtggtataacagctgctctgcctgccatcagccaaccgctaatctacggggggggctcaatagtacgtaaaaggcgcctcacacttggtatacgtaaa

SEQ ID NO: 8859 - DNA, 644 bp, Zea mays
  Predicted polypeptide sequence is orthologous to G1767
tcgcggccgcgtcgactcacagtcaggcagtctgcaggcatccatggagtactactacgcctaccagcacagcagcagcggcggcttgagctcaaaggagaagaggccgccgctgaagcgggggcagctcaagcggcagatcgtgaggaccatcagcagcctcgtggtgccgaggcacgccgccgtcgctggcgctgctgctgctgctgggtcgagggagaaggaagatcgcggcagcggattcggcggaggacggagctacgactgacgatggatctctcggagaaggcgtgataagagatacgattcccagcgtcagtttgtgtgttgttatctgtcagtcagaagaaattaccttgttcttatcacgccaactcagggaaaatgggccaagcaagtttttcctccttggctggaactcctgcgatgaattctggcttgactgactaggggatgcgtcgagcatcgatggtctacaaggggaacaggtgcagcaaatatgtcaacattagaacgtttgtgacgataaagtgtcaggaagctatgtaattaaaatcaatcatcatgatgctacattatgtcagttttctgttgaaaaaaaaaaaaaaaaaaaaaaaaaaaaaagggagggggtcgacgcggcc

SEQ ID NO: 8860 - DNA, 765 bp, Zea mays
  Predicted polypeptide sequence is orthologous to G1767
ctttttttttttttttttttttttttatgacaaaaccatgcacgtaaatccctccagagggaagaaagttgttaacattgaattacatgaagaaacacagagaaatgtgacaaaaaaaaagaagcaagaaaatcggaatcatcacgccaaaagcttgtggcgatcgatgatccaaatttgaaatagatgcaagtctaaaacctaaaaccatcgaccatacctcctcctggatcaccttgctgcatacaaccatgtgtgcgtgaactagcaatccctaccactgctccaaaaccctagatgcgttgcgccattcagctcgccatacacatgcacgtgcgcccgatccactgcatggatcattgcatccacgcgccggctaggtatggcggatggcgcccttgcttctcctgtggttcatgatgttccacgtacgcgcgtactcaccgagcttgcatcttgcgtcgacggggatctctatcatggcctccacgcgctcgcccacacgagaggctgttccttccacgccaggaagacgcctgctccggctgccgagtcgtctaaaccggcgtcccgcatcgaccagccttcccgataccgacggagcaacgaccgcacgtcgtcggcgacgtcctcgctgaacgccaccggagagaagccggaagaccgcatgcggcgcgcccatgaagccgccgtctcccgccgctccatggactccgacgccgggcacgagaccaagtctacaatggcacgtccggctcccctctc

SEQ ID NO: 8861 - DNA, 827 bp, Zea mays
  Predicted polypeptide sequence is orthologous to G1767
gccgcctcgccgcagtagcagcttacatggatacgctgtttaggttggttagccttcaagcctccgagcagcagcagcagcaatcggcgtcctacaactcgaggagcaccacgtcgagcggctccaggtcgtcgtcgcaccagaccaacgcatcctacaactactactaccacagcaacagcagcggcggcggcggcgggcagtactactacggtcagcagcacccacaccagcaccagcaccagcagtactacctggagccgtaccagcaagaagaatgcggcaacacccaccacctttacatggatgaagacttctcctcctcgtcctcgtcgaggcagcatttccactcgcacggcgcggtggtgcagccgccgacgtcgtccacggccacgcccacggcgccgacgccctcgctgtccacgtcgtccacggccgcgggggcggcgcacgcgctgttcgaggcggccgacctgtcgttcccgcctgacctcaacctcgacttctcgtccccggcctcgtcgtccggcgggggcgcggcctcgtcggcggcggtcgggggaggtggcgggggaaggtgggcgagccagctgctgctggagtgcgcgcgcgcggtggcgggccgcgacagccagcgcgtgcagcagctgatgtggatgctcaacgagctggcctcgccgtacggggacgtcgagcagaagctggcgtcctacttcctccaggggctcttcgcgcgcctcacggcgtccggaccgcggacgctgcgcacgctcgctgcggcgtccgaccggaacacgtccttcgactccacgcggcgcacggcgctg

SEQ ID NO: 8862 - DNA, 681 bp, Zea mays
  Predicted polypeptide sequence is orthologous to G1772
caacaaacaattcccttcaccatgctgcatacattatatctggaatccgcaacacatgcatggtcaagttacattccaaaatatccccatcttgcttgaggagtagaactagttttatcagaattatgaacattggcttcaaatcacgtcatgaaatgcgacatatagaacttaaaagctactctatatcttgggatcctaacaccagggtaaattttttttgacatggaggtatactctatggtggcaagggggctaagaagaacagtattttttgcctttatgttggtgaggaagcttaagtcagctgtacagttcaaagggatgtgccatcacccatcagataatgaagcttcagatcttgtccaccaattcggctggcacattgagatcaaaaagtgcatcaccaccgccattggcatctacccggtctcgcttgttagatcggtgccccctattatcccccctattaccagaactcgagccatgcaactcatgagttcgtttccccagactaatcgatgctggttggttcctgtgttcatcctcctgactatgttttgttgactgtgaactttgttcagcaggatcccagctaatattgagctctgaggccctgtcaaggcccttagatttgtatggagcgatattgtgaggtgtgcgtagaggatataacaaatc

SEQ ID NO: 8863 - DNA, 425 bp, Zea mays
  Predicted polypeptide sequence is orthologous to G1772
acaagctttttttttttttttttttttttttttgttaggttaggtatattctgataccagctacctggaatgtaattaatctagctatcttgtcactctctgtcagtctccatatgcacatcacatctactgatctacgcatccacacaagcaacgtgcatgggtcatcatccattcattgatgagcagagcaggcacatgaatttcagaacactaatttacaatttaaactaactttacatgaacatatatgatggaagcaaacaagatagaactcgctccaattaatctgcacgcgtgctgctgatccttccaatgatatatcatctgtctctctctcgatctctactgcatcccgatgtggctgttgagtagcagctgctgctggttcaagttcaagaacgggttgttgctgctgtagccgt

SEQ ID NO: 8864 - DNA, 771 bp, Zea mays
  misc_feature (765)..(765): n is a, c, g, or t
  Predicted polypeptide sequence is orthologous to G1777
gtcacaaacctgtggagaagatggtggctgcaacctggttgcatgtatatgtggacaagcattctgctggttatgtgggggtgctacaggtagagatcacacatggtcaactattagtggccacagttgtggcaggttcactgatgatcagactaagaagacagaacaagcaaggcgagacctctatagatatatgcactaccacaatagatacaaggctcacaccgactctcttaagcaggaagcaaagctaaagaatgagatccaggggaagatatccatttcagaaaataaggaatcaaagataaaagattattcttgggtcataaatgggttaaacaggttgttcagatcaaggcgtgttctttcatattcgtatccgtttgcattctacatgtttggtgatgagattttcaaggatgagatgactcctgaggaaagagaactgaagcagaatttatttgaggaccagcaacaacagttagaatttaatgtcgaaagactgtctggtttccttgagaaagattttcaactttttaccgatgatgaggtcatggatacaatgaagcatgttataaatctttccaatgtggttgataggctctgcaaacaatgtatcaatgcattgagaatgatttgttatatcctctacgcacacctcacaacattgctccatacaaatctaagggcattgacagggcctcggagctcaatattagttgggatcctggtgaacaaagtcacagtcaacaaaacatagccagnatgaca

SEQ ID NO: 8865 - DNA, 917 bp, Zea mays
  misc_feature (753)..(753): n is a, c, g, or t
  Predicted polypeptide sequence is orthologous to G1784
aaacaacaaacagaaccgaagccgactagcgcgaccgaggaggcagagacgggtggaggaaaagggcaaagtcgccgcccgccgcccgccgctgatcggtcggtgagcccgatgcgctgtaccgctcggcctcgtcgtgttccgccgcgctgatctccgcctcccgcgacgcccgattccagaggatcgcttcttcggtttggccggccggtgcgtggggggttcaggaggcggggtctcggcggctgcaatgcatgctcgcatctcgtggcggcgtttcatcgcttcggtccgtttgtttttcggcttgttgcgctgaaattgagcgattcgtttcctcgattcaaggactactagtggggcgggggcatcctgcgtggtggctctggctgtctggtctgtatctgtatgatagtgggcgttggcagttgtgccgtcccggctagctgcggacttgtcttggcctagcagggaagtgatggagcacaagaaagctagagcagtggaggatcctgcccggttgatttgcgacgatgccctcaccgaggtattccgcaggctgcctgcccgtgcgctcgcggcctgcagactggtgtgcaagtcatggatgtccgtgctcacagatccacacttcatccatgagcacctgagccgtggccagcagaagctgctgctctttgcgactgacaggggaaacgacaggtcgctcgccatggtgctcgcggacaacaacgcatccatgtaccagctgtncaggcccgcggcgtctcggagcgtcttcgtgcacaattcttgcaatggcctgctctgcctaggtgacagcacaggagctgtcgaggtgctgaacccaacgactggtgaatcttttatggtgccgatgcccatgtacacggcagggagcagccaggtctcgtcct

SEQ ID NO: 8866 - DNA, 662 bp, Zea mays
  Predicted polypeptide sequence is orthologous to G1789, G1911
caaacctaatcagcaggatctactagctagctagctgttgagagcttgacacaaagaagcgaccgagcggtcgagctagcttccaccatgtcttggagccagagcgagaacgcgcggttcgagcgcgcgctggccacctacgaccgggacacgcccaggcggtgggagctcgtggccgccgcggtgggcggcgggaagaccgccgaggacgccaggcggcactacgccgacctcgtcgacgacgtcggcgacatcgagtccggcggctacggcgccaacgaccaaaacgccaacggcggcgccaacggcagcaacgggaacaacaggggcggcagagccaaccggccccagacatgaggggcgcctgccgcgggagaccgcaccagcacgccggccggacgacgttgcgcgcgtgcatgcaatgattgttcgtcgtgtacgtacgtgagtcctgagatatgtatgtatgttcgtgtgcctgtgtgtaactatatatatatatatgtgtatacatatatatcggcatgcatgcatatgcgcaaagtgcgcacaagtatatatgcgctgttgtggcagaagccgtgtctgatcagtgtgaccgagtgcgaggagctagcacgggcgcatagctgcagcctgctagctagctcctgatggatgtg

SEQ ID NO: 8867 - DNA, 478 bp, Zea mays
  Predicted polypeptide sequence is orthologous to G1789, G1911
atatatatgctacagatgctgagattttacatcgcaacacggggggaacggagatcgattgatcaacatcctatagctattgctagtagtaattctaattcacatgcgtgcttgaacagataatccgtccgacccactcgcttggcttgcttcttttgtagccacacgtgcttcttttttttggcgcgaagtgtacgtatgtaggacgtacttgttcagtggttctcatgatgcttgcctgccgcctagatcttcaggtcaggtgcttcagcctgtcgctgtcggcgtcgtcgtagccgccggggcaccctgtacgcggggaaggccaccttgccggcctcgatgtgctccaagtccttcaccagcagctcgtagtagcgcctgacctcgtccgccgacttgccacccacggcgcgcgcgatgttgtgccagcggtccggcgtgtccctgtcgtacaccgccaacgcctgctcgaaca

SEQ ID NO: 8868 - DNA, 544 bp, Zea mays
  Predicted polypeptide sequence is orthologous to G1789, G1911
aaatacataatatttatatatacacacaagtggacaagtaggagggagagggaacagaagcattggagatcgatgggtcggtcggtcgatcgcgcgtgactggctagcataggactcatcccatactacaattattactactaaattaacacatgcatatgcatgcatctaatctgattcttgctttcacacaccacttgcatgcacttgcagcatggaccattgcatgcatactgatactgtcccattaatcctatatacacacatgtttgcatcttctggatcatcgatcgttcgtcctatatgttcaattgacctcctagatcttcagctgtttcagcctgtcggcggccccgtagccggcggggtagcggtaggcggggaagggcaccttgccggactcgatgtggccgacgtcctcctccagcagctcgtagtagcgcctgacgtcgtccgcggacttcccgccgccgacggcgcaggcgatgttgtgccagcggtcgggcgtgtccttgtcgtacaccgccagcgcctgctcgaacag

SEQ ID NO: 8869 - DNA, 650 bp, Zea mays
  Predicted polypeptide sequence is orthologous to G1789, G1911
gcataaatacatgacttttaggctttacaccctccataactttagttcaaggggaccaatgaatacatgtggttatcaatcttatgtacactaggatcctacaaccacaggtagacagacataaacttgatcataaactatactatacacatattgacatatacacactggttcatcattttattctccaaccagagctggatttcctttggttccttcttggatccgtagagctttgttttctgcctctttgagcctccaacatttttttaacctcgggtccagaatccctgtgtcttgtgcttggggtacggcacattgcctgactcaatcatcttgacgtcgtaatcaagattttcatagtggcagcgcacttcctcggcagacttgatgcctcccatggcgctggacaccttgtcccaccggttgggtgtgccctcgccatagtaggcgagtgcctcttcaaacatcttgttctctttctggctccactgtgacatggagttgggagaggagctccacgaggcagacatatttgaagtatcctctgttggtgcgctaaggcttactgtatctagtgtctagactgaagtatttcgctcttcagaagctcttatggttttccccgcgtacctcggccgcgaccacgc

SEQ ID NO: 8870 - DNA, 472 bp, Zea mays
  misc_feature (33)..(33): n is a, c, g, or t
  Predicted polypeptide sequence is orthologous to G1789, G1911
tcggggggggcaccacgtctgtggaggaggtgngccgccgctaccagcagctcgccgtggacgtcgcgcagatcgagtccggcgaagtgcccttccactactggtacgccgccgccccgccgctgcatccaggcaccaacaacaacaacagtacctacgtgcccaacttggcccagaaaatggaatagattctgcaatcgctcgctccaaggatcagggcctttggactcgaccggccggcagcaagttgtaacaagcatttggccccgggattttgtttatttgtagtggttttctcgtagttaaaatatcgctactttatgcacgatatatatattctgctgtccatcttctttcgttgttctcaagtgacctgaaacatttctactgcaacatatttatgagaacaaacgctgcatgctcagaacgtagacattccaagaaaaaaaaaaaaaaaaaaaaaaaaaaaaaa

SEQ ID NO: 8871 - DNA, 779 bp, Zea mays
  Predicted polypeptide sequence is orthologous to G1789, G1911
ctttgagcctacagcaaaggaggacggcaacgtgaacagcaagcagttcacgtttgccaagtgcctataaatagtagccaccctatagcagcaacgagatcaaaacagcagagcttgcaagagctaaaaacgacttcagtccagccatccaacaagaagatcagtctacacataaaaccagagatgtctgggtccaggagctcttcgtctcacaacgttaccattgattccgagtggagcaaaaaggagaacaagctgttcgaggaggccctagcctgctacggcgcgggcacacccgaccgctggcacaaggtggcccgtgccatgggtggcatcaagacagccgacgaggttcgccgccatcacgagatccttaatgaggatgtcacgctcatcgaatccggcagagttccattccccaactacaacacgcagggagcttggaactaaggagtgaaggatgatgtgaagaaccaccagacaggaactactgctacgcatgaaatagatatcttagccattgaagtaaatgtgctgatatattgtgttaagaagtttatgattgctcaggtaataaataagaggagctagagaatacacataagtgtgttatgtgtaaatagctatatataggctgtgagcaaatcatcagttatgctatagaaaccagggaaccctatctgcccatagtgtgtactgtgaaattatagtcccctccctatggatgaatacttgtatagtaaagtgtggtgtaaaactcttgtaccagttttgtaaat

SEQ ID NO: 8872 - DNA, 574 bp, Zea mays
  Predicted polypeptide sequence is orthologous to G1789, G1911
atttcactttcaccgtagcatatatagcacgcaaacgctaccaggtagcagaatacagcaaaccggcctgacgacgacgtacacttggatggaatggaagccacgaaatagcataggtagggggtgtttcttatgtggacctattgctgctctaggctctagagataaggctctctccaagatcacatccacttcactgcggctggttggggtgcctcgtcatcctcttgtcaccgttgtccctgccccaagaactgctgctgctgcttccactgccaccagcaccagcaccagcagggctgctggactgggatcctcggccgccttcttcggtttcgatgtgcttcacgtccgtcttcaggtacttgtagtgcctcttcacgtcctcggctgtcttgccgcagccgactgcccgcgcaacgttgtgccagcggtctggtgtgtccttgtcatatactgccagcgcacgctcgaagagattgttttgactctcggtccaggacgaacccattgttttatcttcactcagcaagagaagacacctagctaggagagatgcagggcaagcaatggc

SEQ ID NO: 8873 - DNA, 900 bp, Zea mays
  Predicted polypeptide sequence is orthologous to G1793
gggtttgcgaaatcgtgacgcgagcacttgaagattcgcgaaagacagcgcgaccgacccacggcgatggccaccgtccaccctcaatccccggcgggtcccacccatctcccgcaggaggagcgacacggggacgccccggtaccgcccgccgtctccggcgaacccgccgccgcagcggaggcgggcggcgagatcgccgcgctcgacaagcagctcgccgtcgtcggcggcggcgaggagaggaggccggccggggccggggccggggccgccagcgcaggcgggggagggaagctggtggcggaggccatgcgcaagtacgctgccccgcggtcgtcgcgcttccacggcgtcaccaggtacgagcacggcggtgttctgcccgcctttcagtggctttgactttgaggttgtgctctggtttgatttgggcgtgcactgctgctctggttccggggcaggctcaagtggagcggcaagtacgaggcgcacctttgggacaacaccagccaggtcgaaggccgcaagcgcaagggcaagcacgtgtacttaggcagctatgtcgatgaagagcaggctgcaaaggcacatgatttggctgcccttaaatattggggcacagggccaaacaccaaactgaacttcaatatttctgattatgagaaagaaattgaggttatgaagaccatgtcccaagatgaatttgtggcctacataaggagacaaagcagttgtttctcaagaggtacttcatcataccggggtgtaaccaggtgctattcctgctttgctaaatgatcaaacaaaatatcatttggcttcttttgttttttatgttgcttttaactagggaagttttagttgtctgcaagtttgcaactttctctattcttattt

SEQ ID NO: 8874 - DNA, 755 bp, Zea mays
  Predicted polypeptide sequence is orthologous to G1794
ttttttttttttttttttcaggctcaaaggcaatcaagtccatggtaagatgtttcgtcagaaacagatacagggcatgaatgcaacagttaacgaaaatactgatccaatgacagaccgcagaaccgactctaccaacgttagcataacctcagcagcatactcctaaagccggccgtagaattaactagctcacacctgtgaagacaacgcgagggcgaggcacattagcacctatactagtagtcttcttcctcgatccagccattcgatggcccttcatggatggcgtcatagcccatgccttggggcaggaacttacgagaggtgttgcatccttgccgcaagcgcagtccggggaaggtgtttcttggtggcagagttctggcattatgcctagcggccacagaccgcgagtgatgatccagctgcccactccaccaggaggcagcttcgggtgttgctgctgctggcgtgtgttccgtcggtttatgacgcgtgccagatgcaggcctgcccgccgcagccggtgcatcgctcagctctccttcctccaggactggtgagtcttgtatcatccagtactcaactccagctgcctgtttgcccgcaacccccgagaaatgatacggaccacaggctgatgttacctcatcgtaatcggcatcagcagttggtttccctgcagatgcacttccaacagcatcccaggcttgaccttttctccgaacatcactctccgacaatgaaatgct

SEQ ID NO: 8875 - DNA, 750 bp, Zea mays
  Predicted polypeptide sequence is orthologous to G1804
gcaaaagatacactgacatgcatacggcatagtatggcccctgtcaaacaaacatggacgaaaacacagagctttgtgtttaattactactatcttacagttgctttattgtttggacaacccaggctcatgaacagcagcaggccaacgcggaagctctcgcccatgccccatatcgtccctcgcaaacgtttgtgtcgaccacatgggatactgttactaacggtgctgctaccgacaggtacaggatttttttcccatacaagcaactaagcaagcggactggaactgcacaattcgagacactcgtcaatcgtcacaattcaccacatggcgctgcccgagcggcgcatcccgcgaccgcccttcttggggctcacattctcccttgcctgctccaccatcttctccaccagcttctttttcttcgatagcagaatcgtcttctgctctgctctgaggcgatcgttctcctctttgaggtggatcacttcaacttccagctccaccgtatacgcctgcttcctggcgcgtgaccgggccgcggactcacggttcttgatcatccgccgctgccggcgctccacggtcttctcggtgcacgcgtcctcgggggagtcgcgcttccgcgcgctgccgccgccaccgccgccgccgtatttccggaccgtccctgccccttcggtgccaatgcagctcatcatctccgcctgcgtcatcgcgctcaccccgtccgacgaacccgggctc

SEQ ID NO: 8876 - DNA, 962 bp, Zea mays
  Predicted polypeptide sequence is orthologous to G1835
gcaccccgtaaagtccggtcgtctgttcccggagtaccgccccgcctttagacccaccttcgtaccgtccatccactccaactcgcacaagagggtggtggagatgcgccagaaggctgttcggagcggcgacccgtcgtgcgaccttctccatttcatccgccgccgggattgacgtcccggcatggcgtcgccggactgtcggtcggtctcgtcccccatatagctatatatgtatgcatgcatggttgcttcatcagtcgtcgtcgcccatcatggtcatcatcaccgcttcaccggtcaccgccatggatcgtctcccgcccatcatcacatgcattggtttgtgtcagcatccatccaatcccaatccgtcgccgggcgtcccgacgttgttagttcattaggtcttttttttcctcatcgggggctagtgttattttacctttgatccttttgtctattggttaattggttccccctggatgttttttgtttgtatagagagtgaaaaagagagaagaaatagatgagtcagagtggttactgcattgcaattgcagttgcttgcaagctaggtaggtgagaaggagagctaaaccagcagcagagggagacagatttagagaggaaactttgcagctagtcagtcagtcacttagaaaaaaaacaaggagagtgcttgaagcaggtgaaagggcaatttgttggtttgctaattagaagagaggttctgtcaggtcaggtcaggtcaggtagttgctatcattattcatgaggattttcaaacttaatagggggacagccatcatccatcatagtttgtatttggaactgggtatactgaactctgaaaattctttttgcagttcatctatgcttagggattgataagtgttgtctggtttcttctatattgatagtgctaccttttagccaaaaaaaaaaaaaaaaaaaaaaaa

SEQ ID NO: 8877 - DNA, 245 bp, Zea mays
  Predicted polypeptide sequence is orthologous to G1837
cacagctttttttttttttttttttttttttttttttttttttttttggacaaaacaccaatatgtattggtgggattaagtcaagtctttgcgcgatcataaaataaaactggttcgaaaaacgaagtacattttctggaactcaatggaaaaacggggaaaaattcagtaacaaaacccaaaaacttcaagcgaaatactggctggtgcgctgaaaaacattaggcagctttgggaagctccc

SEQ ID NO: 8878 - DNA, 204 bp, Zea mays
  misc_feature (33)..(33): n is a, c, g, or t
  Predicted polypeptide sequence is orthologous to G1837
ttgttttggcacccggaaattcggccattatgntcgggggggggggaaactagtattattcattaaatttgccaaaacaaggtgataggcagtggcggatttacaaccggggctgcctgggctgcagcccagatcacgtcccaacaatagcagtgaatacagcccacaaaagtccaaaaaaaaaaaaaaaaaaaaaaaaaaaaa

SEQ ID NO: 8879 - DNA, 749 bp, Zea mays
  Predicted polypeptide sequence is orthologous to G1852
tttttttttttttttgtttttttgaagaatgaccaccttgatagaaactactccagcaatcccattagcctgctatatcccttcagcgcaccccaaaagaatacaaaattaagggagcgcaagtgaaaagggttcaaagttcaaactcgcattagcctattgttttgttagtggcagcttccaaaatgttttggtagccacaagtattttctcggtactgcctgattctggttcactgtcatgcacctgtgccttccaccgaatcgactgagcgatctgtgctgccttggctactacgtctggcgaggcccgtataacggcagttccttctgggcgcagtatgcgatccatctccaacatgacatcaaacaggtcacatctgaaaaagaaagtcatacaaaaccatgtgtaaggttagtcatgtaaaggtaaaactatgataacaatcttggctaatccatttacttgaattctaacaagacatgttcattgaattaagaatgctaaaggtcaaatggtcaatacagtagtacagcagcaacccgcaaagtacttcagtttcctttgttttatttgttcacctaagtcaactctaaccagatacttctttcctagaaaatacatcctccaatcaaaaataagttcattaggacatcaagtccaaaggttgtggcgggagaatagagaccaaagattttagactcaggccgtgtttctttcggagtataatctgtccagattatataatc

SEQ ID NO: 8880 - DNA, 860 bp, Zea mays
  Predicted polypeptide sequence is orthologous to G1855
ggccttttccccccttctggagcttggggggaggcactctgcaccttcgtcttcgtcttggcgtcctccagcgctctgccttcctgagctggcttcttgtccgcaggatccatggcgaaggactacccagcttctccgaaagctcagcagctccaggaatccaagaagcagcgcctgacatacatcctcgtcgtaagcgcgctctgcatcgccttctacgtccttggcgcatggcagaacaccacgcttccaaagcccataggcaactcggcgatcacccgggttggctgcgatcccactgccgccacggcacagtcctctggctctgtgccgtcgtttgggccaggctccggcgaggtgcttgacttcgacgcacaccaccggctcaccatcaacaacacggacggcgatggggaactgcagcagttcccggcgtgccctctcaacttcagtgagtacacgccgtgtgaggaccgtaggcgcgggcgccggttcgaccgaaacatgctagtgtatcgggagcgccactgtcctggcaaggacgagcaggtccgatgcctcatcccagcaccgcctgggtacaggacccccttcaagtggcctcgtagcagggactacgcctatttcaacaacatcccccacaaggagctcagcattgagaaggcggtgcagaactggatccaggttgagggcgacaagttcaagttccccggtggtggcactatgttcccgcgtggtgctgatgcctacatagatgacatcaataagctcatctcgttatcagatgggaagatcagggacgctgttgacacaggttgcgggggtgctagttggggagcttacttgctggagagaaacat

SEQ ID NO: 8881 - DNA, 711 bp, Zea mays
  Predicted polypeptide sequence is orthologous to G1855
cacaccaagcatcatgttattagattgcaatatcacaccaaatatatgagtgaacatcttatacaccattgcaatgtgtcacatacgctacgtggctaatgatgtttgataccaattccagctacatggttcacatgcctcctatatacagatatcctgaagttaggataaaaaaatggcaatgaagacagaactgacaggcaagtcatgcctacattttcgcaaacaaaaaacagtaacaaggcgacgattattgtttttgcacgagcttcccggtccagtaagtcttgacagccactaggatcttgtcagtgttgaatggaccggactcatggtccatgatttggctcttccacctcatgcctccagtgatagcttgtaccttcaccaacacctctacgttgtccctgatgatcacagtcccctcaggccttagaattcggtccatctccagtaggatgtacgttatgtcacacctgtcctggtaactgctgaaaactttatcagcatggatgaggtcgtaggtcctcgggtacgttgagaaagcctcacaccaatcatggtacgtgccaataaaccctcgttcgtaaataacacccagggtgtcatgggccaagcctgaaggcacaacattcatcacccaaagagggtacttcatcaatgcagctgcaaagccacctatccccgcattcatgtccatcacattcctgt

SEQ ID NO: 8882 - DNA, 821 bp, Zea mays
  Predicted polypeptide sequence is orthologous to G1855
ttcttctgctgcggcggcggaggctctttcagttccatccatcttctccctcgtggctctccttcctctctcccgtagtcccgccgaccccccgcgccggccaaggaaatcaagcgaaaacgccagattttgattgttccacatcttctttcatctctgaggggtttcccgtcttcctcgcctgctctaatggctaaagaacaggatggatcccccaaggtgcgccacccagaattccaaaggatgcgcgtaactctcaccataggtgtcattggcctctgtgtcacagcatacattcttggtgcttggcaaggtacctcgaacggcattagttcccccttaataagtaccagaacccagtgcaaagatcccgtgcgatcatctggtgctcgcctggatttccaagcccaccaccaggtgggcttcaatgaatcggcgcttgctgtggagaaattcccaccttgccagctcaagtacagtgagtataccccttgccaagatccaaggaaagctaggaagttcccaaagaaaatgatgcagtacagggagcggcactgcccaaagaaagaagacatgctccggtgcttgatccctgcgcctccaaactatagcaaccccttccagtggccaaaaagtcgcgactatgcttggttcaataacattcctcatcgggagctcagtattgagaaggctgttcagaactggattcatgtcgagggagacctgcttagattccctggaggtggcactatgttcccacatggtgccgatgcttatattgatgacataaatgcccttgtaccattaaatgaaggcaacat

SEQ ID NO: 8883 - DNA, 683 bp, Zea mays
  Predicted polypeptide sequence is orthologous to G1855
caaatgaaaactaaataaatacctgttactattatggtcaccccaatatacgattaacaatgcctgcccggtgccatcgcattacaaactaaaacctagttcaacccctcgtgaaacagggccaggaacctacgcaagaccagcgaaaccttcccctgctacaaaaccgcttcctgtatctcaactagaggaccaaccaacccccccccccccccgtctcaaaactctcccttaccttcccatctgattgtagctagctacaaagaactagagaaaaggtgaaaagggacatacatactacactgagacgcaaaacgctgacgccatccctctcgaccggtagtaaaagtgtaaaacaggcttggttcacgctttcaagtgagctcggtgtcactcgtgtgctagtgctcctcctcggcttcggcggtccagtacgtcttgaccgccatgaggaccttctccgggttgaaggggccgtcctcgtggtccatgatgcggctctcccaccgcatccgcttggttattgcctggaccttcgtgagcacgtcgactgtgtcgcggatgatagctgtgccctcgggccttaatattctgtccatctccaagaggatgccagttatatcgcacctgtcttggtagatgctaaacagattgtcagcatgcaggaggtcatatgttcttgg

SEQ ID NO: 8884 - DNA, 803 bp, Zea mays
  Predicted polypeptide sequence is orthologous to G1863, G2334
ggtggacgtgccgctcgcagtacttgtggcccggcaccacgtcgcgggagcaccgccacttcttgccgtccgtgcgccggcaccgcccgggctccggctccatgctgctgcggtagtcgaagcacaggctccccaggcccatcactgcaacacgttcattcgatacggcaagacagtacaaacgcaaaaacaaatagaaatcggccgggggcggctgaagctgttgtcggtgcttagtgcttacgcgaggggaagcgctgcgggccgaaggaggacgcggcgacgctcttccagatagggagcacaaggtgcgccggcaccggcgcgcccgctgcgaagtagcggtagatgagcacctggtgctccagttcctgctgctgcatgaacgtcagcgctgacggcctcttgggcgtcgccgttgccggggacgcatccgcgtctcgctcgccgcccccgccgagccccaggcccagcccgagaaccagaggcgacgaggccgccactccggcgctcgtgtcggcgcaggagagacggggcagcttcgccggcggctgcggcgagtcggtctccttgtcctcggcggccattttggagactccgctgttgcgcttcctgtggcggtttggactctacggagggagcgcgcgggcagcttctcgatagaagggaagaagagacagcattcgttctcgacagaggaagtgtgaagtggtgggtatatttatgcgtgacggctcccgccgtctggtcgctcggtaaacttgtgtctgcggccggcggagcacggaggcgaaggaggagca

SEQ ID NO: 8885 - DNA, 1293 bp, Zea mays
  misc_feature (7)..(58): n is a, c, g, or t
  misc_feature (65)..(69): n is a, c, g, or t
  misc_feature (250)..(287): n is a, c, g, or t
  misc_feature (317)..(381): n is a, c, g, or t
  misc_feature (402)..(407): n is a, c, g, or t
  misc_feature (479)..(483): n is a, c, g, or t
  misc_feature (772)..(776): n is a, c, g, or t
  misc_feature (926)..(930): n is a, c, g, or t
  misc_feature (1121)..(1122): n is a, c, g, or t
  Predicted polypeptide sequence is orthologous to G1868
acccacnnnnnnnnnnnnnnnnnnnnnnnnnnnnnnnnnnnnnnnnnnnnnnnnnnnngaatctnnnnntgtgcagcctcacgacctggtggttaattaatataaccgaaccatacaatgcaacaacgggcacacaaacagtgaagtgcagtgcagcagtatgacgtatgaacaacaaacaggcgatactcgcagtaatcctcgacggatactggcttcttctatcacatgatgatatgcatcagcggcnnnnnnnnnnnnnnnnnnnnnnnnnnnnnnnnnnnnnncacgatccaaggaaggtgaaagttacaaannnnnnnnnnnnnnnnnnnnnnnnnnnnnnnnnnnnnnnnnnnnnnnnnnnnnnnnnnnnnnnnngacaaactacgaggtaaatgnnnnnntcacgctttgaggattagcatagtagcccatatgcccacttctatggctgcgggccgccgtcttgttgcagnnnnncatggtcagaactcagaaaagctcacacaaggcggatgcttggatggcgcactacaattgagccgagatcatcccgcaggttgccgaaaccgtcgtaggcgccgtggttctcagccctagggctgctccctgtactgctggagaccgacccgaaggcggtcgtcttctgcagaacgcccacaggggaggactccatcccgtggcttgaatcccagtagtcggtgagaaggttcagaggcgccgacaggtaatttctcgcttccacgttgccgttcttggccagaacctnnnnnaacggaccgcccatcgaagagtcacggaacatcgtcgcccaggttgcttctagctggctaacctcgtctcttttcgccgcaatgccgagaccagtcggactgtactcgcggctcagcttcagaggcgacagcatcagcttctcgtggatnnnnnatgtggaggccgacgatagctccgaggatgccatcggagcagatatcgagagctgtgacctctgagcctgcatgtcttctgcctcgggccatgaaaggcctccctgggcaggtggcgtcctgggccagtccacgaagtgttgcagggaggctgggttctggtgttcgttcatactctgtgagccgagcagnngttgacgttctccaaggaactgtgaggggaactcatcagtgaatccgatgaaacgaggccgaactctagccttgagctggtcacttcaaaaggattggtgttttgtttcgagaatgggaacacgctgcctgtgtttcctgtgttcatggaagtcagcatcgagtcgtgccg

SEQ ID NO: 8886 - DNA, 763 bp, Zea mays
  Predicted polypeptide sequence is orthologous to G1868
aataaccctcaataaagggaacaaaaagtggaagttccccgcggtggcggccggtttagaaataggggattccccggggtgcaagaatttggcccgaggcaggattcaacagggaattacaagtgggattttacctttattacccttggttcttcaacaattattaaccctaatacatcaggtacctttggggcaattaatgggacaaaacattaggggacaacaaattcaacaaattggggtaggaaaccttggtgcctaattttaacaacaacaggttttttcaattaaccaaataagtgcaatggaatttggtttttatttggaacaacaacaaattccatttaaccaagttcctggtgcctacccccagcaaattttttcaattaaccaaatgggagcaatggaatttcctggttaatttcagcaggaacaaattattccatttaaccaagtaagtggggggaaccctggtacctttttgaaacaaccccaggtggtgccgtttttccaacaaggtgggcctaaaggtggcacccttttacaaatggaacaaatggtgccaattaaccaacttggtttggcaaacccaggaggggttttccaacaacccatcattggtggtgccctcttttagatttcttatgagttatagttcaataataaagttttttgtctgatgtttgtggcttcccagaaataagaaagtacatttctagattcttatgtgaaaaaaaaaaaaaaaaaaactgaagggggggcc

SEQ ID NO: 8887 - DNA, 868 bp, Zea mays
  Predicted polypeptide sequence is orthologous to G1868
gttcattattatcccccctgcctttttgctttcgcaagccctgtatgtgtcctggccataaagatgcaatctttatcctctatgcacatacttcacccgaaaaaaagctaaaggggtcactgattggtgctgcttccttaaatcttgcatgtgtgggaactaggaggccattggtcacggggttgggtctgtgctcaggtgccagcaagatgcagggtgtgttgtcgagggtgaggaggcccttcactccgacgcagtggatggagctggagcaccaggccctgatctacaagcacttcgctgtgaatgcccctgtgccgtccagcttgctcctccctatcaaaagaagcctcaatccatggagcagccttggctccagctcattgggatgggcaccatttcgttccggctctgctgatgcagaaccaggaagatgccgccgcacagatggcaagaagtggcggtgctctagagatgctgtcggggaccaaaaatactgtgagcgacacataaaacgtggttgccaccgttcaagaaagcatgtggaaggccgaaaggcaacaccgaccactgcagatccaaccatggctgtttctggtggttcattgttgcacagccatgctgttgcttggcagcagcagggcaaaagctcagctgctaatgtgactgatccattctcactagggtccaacaggaatttgctggataagcagaatctaggtgaccagttctctgtatccacttccatggactcctttgacttctcatcatcacattcttccccaaaccaagccaaagttgcattttcactggtggccatgcagcacgaacatgatcagctgtatcttgtgcatggagccggcagctc

SEQ ID NO: 8888 - DNA, 788 bp, Zea mays
  Predicted polypeptide sequence is orthologous to G1868
caacaatgcacaccaacatccactctctcgtcaggctcctctcccccaaaaatgagcgctgagttctgcgctgctgccggtgtcgtggccatggagctcggagtcggagatgtgctggggctgcagcaaggcatcgcaatcaccgcgccatcgcccagggacagcgacctgggtcttctcaagcgagcaggcctcacccaggctgcggctgctgccccctacccctcccccttccttgacgaggagaagatgctcaggttctccaaggcggctcacacattgcactcaggcttggattttggaggcccaggtgagcaggctttcctgctgtccaggaccaagatgccatttactccctcgcagtggatggagctggagcaccaggctctgatatacaagtacctcaatgcaaaggcccccccataccttccagcctgctcatttcaatcagcaagagcttcagatcatccaatagaggtactgaaccagaaaactaaggttttctacttcaaaactactggcacttgcaaccaaccaagatagaagagaaatattactttgcaaaggtgcagcgttacatggtaaacaaaaaatgctggcagtggcagctctgtagtatttgaaactgcaactcattaggttcaatgtatgaatgccatggaatttcaaagatattacaccaaaaaggaaccaccattttgtacctaaacactcgtatgccataaaggataaccacagtaatgctttgaatatagatgctagagcttgacagacttctctaacgcagt

SEQ ID NO: 8889 - DNA, 904 bp, Zea mays
  Predicted polypeptide sequence is orthologous to G1868
ccggcgatgcacgccagcatccactccctcccgtcagcctcttcttctccccctgatgagcgctgagttctgtgctgccgctgctggtgctgtggccatggagctcggagtcggggatgtgatggggctgcagcaaggcatcgccgccgccaccgggccatcgtccggagacagcgacctgggtcttctcaagcgagcaggcctcgcccaggcagccacctcctacccctcccctttcctcgaccaacagaagatgctcaggttctccaaggcggcggcggctcacacgtcgccctcaggcctagacttcggaggaggcccgagcgagcaggctttcctgctgtccaggaccaagcggccgttcactccgtcgcagtggatggagctggagcaccaggctctcatatacaagtatctcaatgccaaggcccccataccttccagcctgctcgtttccatcagcaagagcttcaggtcatccaacagagtgagctggaggcctctttaccaaggctacgcaaacgcagactccgacccagaacctgggaggtgccggcggacagacggaaagaagtggcggtgctccaaggaggcgatgcctgatcacaagtactgcgagcgccacatcaataggaaccgccaccgttcaagaaagcctgtggaaaaccaacctagaaaggccaccaaggaggtgactaccgctgctgctggctcgttgccgtgtgccgggccacaaggtagcttgaagaaggcaaaagttaatgactccaagccaggcactggcagctattggacagatagcttaaacaggacaatgctgagcagagagaagggcaaacaaccgacggacgacgagtctttgctgctttagtcgacgaagaacagtcagccccacttgtccctg

SEQ ID NO: 8890 - DNA, 634 bp, Zea mays
  Predicted polypeptide sequence is orthologous to G1880
agctcaaacactaggcagcactggatcgatcgagctagcgatcttccactgtccacacaccatcaggcatcagcatctggttctatatcacacctcataacgcacgcgccaattcatgcaagccccgcggccggcgtcccgttggcaaaaaagcaagtattgatttagctagctaataagaagctgctagaggacgtcgtccatcgccatgccgtcctggcgccgccgcagcaagccgtcgaggggccgatcatcgtcgacctcggcgtcgccggcctctctcacgacggaggacatgtagccgcagctgcaggccacctcggcggaacggcgtccagctgcgggcgcgcgtggaacttgtggcggcagccgaggcaggtgatctggagaagcgtcgcgttcacctggcgcaaggcgtggtcccggaccgcgtgggcgcggctcatctcgacctgcgcctgccgccgcatccgcttggcgctcgccagctcccgctcggccagctccgcgtgccgcttcgcctgcgcgcgggcttcgtccgccgccgccttctccgccacagcttgccgcagctgctcccgcgcctcctcctcctcctccctcgctgcggccagcacctcgtcgcccgcgtccc

SEQ ID NO: 8891 - DNA, 516 bp, Zea mays
  Predicted polypeptide sequence is orthologous to G1888
ttttttttttttttttttagttgagaggattcaaactcatatttcacctctgcatggatgcaaaataaaaaaaacacctgctttgacgcatcttgtcctatgtgtgtttagagtgtggcacggtcgcatctctaccgaatgaaataaagtacagtgtagtagatgatatgatggtgacggttgtcttcattcatgctgccttaaggacttgctgttgcggctgcgcccgcggcttcccacttctagcggattcggagcgtgttcagcacccttcatccggaacatagcatgtaggttttgcataagttgatcctcatagagtaaaatctttttcagggcccatgatcactcccgagatcagtcagatgaaagccttagtcttgcacgccatagtagcatgtctttctggtatctgcatgaagttcaaaaaactgaagactggtacaagcagtttacggatagggaagaagctgagtcattagcatctgaacggcttctgcgcagcaacctggtgcc

SEQ ID NO: 8892 - DNA, 521 bp, Zea mays
  misc_feature (511)..(511): n is a, c, g, or t
  Predicted polypeptide sequence is orthologous to G1893
ccacgcgtccgctccaagcaactccacaacatctatcaatgattattcgacaaatactctggactcaagagattcagttaaggaagatgaagatagtgctgaagttgtgaatctgtgctctcctgacagctgtatgaatcaatcttcatgtacaaaaattaatggagaaaacagtgtccacttcaatgcagtaacagaattttctccaatggacagtagtgacctttgtacatcagatcaatccaagtcttcgagacggggtccaaggtcaagggaggattttcctcaagatcagtcctgttggtatgatgactgcggagatgagtctggaagaattggtgaattacaatggaagtcaagggaaaggacaagaagtattaatagaagtcgcaacgcagcatccacctcaaacaacaggacaagagagaggcaatcatacaattcttgcagctgcggccatctgggaagactatggagtcatggacagctgtttcttggccaacagcttgantctggccaag

SEQ ID NO: 8893 - DNA, 936 bp, Zea mays
  Predicted polypeptide sequence is orthologous to G1893
cagaggtgcctccactccaccatgggagacccctacgacaccaacttcctcagaggctactactcccacttccctccctccaacgctccccccgccacctccttccccagcagctactgcgcctcctcctacctccaccacccgcctcccccgtcccctcccatcagggaagccctccccctcctcagtaacctcacgccgtcgtcgtcaggaaccaaccaccaccaccaccagcactgcggcggcgacgtccaggaccacaaggactgcacacacgccacctcgtgcagcgacgaccaagaggcggccggggaggtcacggtggccttgcacatcggcctgcccagccccagcccctctccctctgagtcggcggcagacggtggcgagaaccaggaacaggcagcggaagggaggagcctgcaggagcaaggaggagaagaggaggaggaggaggccgccgccatgccggtgggctgcgcgtccatcgtcgggatcggcaggctgacgaaagggcagtactggatccccaccccgtcgcagatcctcattgggcccacccagttctcctgccccgtctgctacaagaccttcaaccgatacaacaacatgcagatgcacatgtggggccacgggtcgcagtaccgcaagggcccggagtcgctgcggggcacgcagccgacggcgatgctgcggctgccgtgctactgctgcgcggcgggctgccggaacaacatcgaccacccgcgggcgcgccccgctcaggacttccgcacgctgcagacgcactaccgccgcaggcacggcatcaagcccttcatgtgccgcaagtgcggcaagccctttcgcgtgcgcggcgactggcgcacccacgagaaagactgcggcaggctctggtactgcgcctgcggctccgactttcagcacaggcgctcc

SEQ ID NO: 8894 - DNA, 651 bp, Zea mays
  Predicted polypeptide sequence is orthologous to G1895
ttttttttttttttttttttttcagaaaaactgtgatatctttaaatttatatcttggggaactgcaatacatcattcactataccaactcaatcatcaagcatgtgggccaaaacaatcaatcaaacactgaagaataaaacaactcacacatggagccatacatcagttcgtagcagtggtacaacacatgcaactggtaaaaagagaggatcttgccttctgcttttctttgcttcttggtgaactaaccatggtattactcttcgagttcgattctggttccttcaatggagaccatataccagcttcgctctgcatcagcaagctctcaaatggtttcttaaatcttgcaaaatgatttgctattctgaagtctcctcctgttggttccctggggcttaacagtgggctcctctcagattcttcatcagcctcaattttaaattgcattacagcaatgtcggctgtggggatttccatgtgtacatggctatgctgctcaatacaattggaaaaacctatattttgcgctccctgaagtaatggagtcacttcactggcttctctccctggagttgatgtctgatgagtatgttgttcctcagtagccgtaccaaaacatgttgtgactttcacctgattgcattg

SEQ ID NO: 8895 - DNA, 1037 bp, Zea mays
  Predicted polypeptide sequence is orthologous to G1902
ccaagggctaccccgtgccggttgccaaggaggagaggccggcgccgggcggcgacccgtgcccgcggtgcgggtcgcgggacaccaagttctgctactacaacaactacaacacgtcgcagccgcgccacttgtgcaagtcgtgccgccgctactggaccaagggcgggtccctccgcaacgtccccgtcgggggcggcacccgcaagagcagcagcagctcctcatcatcctcggcggcgacgacgacgacgacgacgacgtcaacctcgcccggcgccgcgcccaaggccacgaaacggtcgaagaactctaagcgccgccgcgtcgcgcctgccccggaccccgccgcgcccggcacggacgcctccaccgccgacgtcgcgagcacggcaccgtccgcagcgacggtggctgcctcggagaagccgagcgcgacggagcacgcagcggcggctgtcgccactgagaagccgccggccgcgcctccggtgtccgtcggcgctttcgcggacacgtccccggcgccagatgctgggagcggcggcgttagggagctgctgccgcacccgagccgcttcgagtggccgtcgggctgcgacctggggccgccctactggggctggggcaccagcgtgctcgccgacaccgacccggcgctgttcctcaatctgccgtgagtgacccgtgacaacgccatggcgcccatggttaactagtcaaccatcatcacacggtcgacgagatgagaggaacagagcacgcagtgcgtcgggctcttgaagctaggtgctgtagtagtctcctaagcttactgttgtctagaccgacagtctcgcgtacttgtgtagttgtgttgatggtttttaatcgccgctttgtactgcaattctagtaaaaaggctagcatgggatagccgggctctgcacggatctgtgcttgctttgacagtttgatctgattggggtgctttcttattttaaggccatgagaatcgcaagaacagggagcggcgaacttcgaagaaaaaaaaaaa

SEQ ID NO: 8896 - DNA, 865 bp, Zea mays
  Predicted polypeptide sequence is orthologous to G1902
cgagctgggaaggaagagcccgcgttgctcgctcgctcgctcgcatgcagctttcccacacggcgccacgcatgcaggagcccgggcgccggcccgtaccgccgttcgcgggcgtcgacctccgccgccccaggggctaccccgctccggcggcgaaggaggcggaggaggagccggccccagctccggcgccgggcggcgacccgtgcccgcggtgcgggtcgcgggacaccaagttctgctactacaacaactacaacacgtcgcagccgcgccacttctgcaagtcgtgccgccgctactggaccaagggcgggtccctccgtaacgtccccgtcgggggcggcacccgcaagagcggctcctcgtcctcggcctcggcctcggcaacgccaacctcgaccggcgccgcacccaagagcccgaggtcgtccaagaactccaagcgtcgccgcgtcggcccggccccggcgccggaccccgcccctgccaccgccaccgccaccgctgacgtcgcgaacacggcaccgtcgacggaagccgcagcagcaacgcgtgccgcctcggagaagccagccgcgacggaacccgcagcggcaacgggtgccgcctcggagaagccggccgcgacggagctcgcagcagcggttgtctccacggagaaacctccggcggccgtcggcggtttcacggacacgtctactacggtgcccgagatcgggctcgcggatgtctgcagcggcggcgtgaaggagcttgtgccggacccgggccacttcgagtggccgtcggggtgcgatctggggtcctactggggcaccagcgtgttcgccgacaccgaccccggcgctgtttcctgaacctg

SEQ ID NO: 8897 - DNA, 743 bp, Zea mays
  Predicted polypeptide sequence is orthologous to G1909
cttgcttcattccgatccattccaccacccatctccctcctcagctcccctctccgctctccctccctcgctcgcgctctccacgcggatcaccggaggctagctagcaagctcgaccggcgcggccgatctagctcgcgcttgttggccgcttcagcttagcagcggcggcacgtcgtcaacctgtgctgtgagaaagactagtagagagagatacgtgtaaggatggctggcgcggggggtgcgacggctgtgaagcagccggcggcgggggcgcccgacgctggggccagcaggagcggggtcggggctggcgccgccggggcgccggtcgccgacccgcgcgccgaggcgctgcggtgcccgcgctgcgactcggccaacaccaagttctgctactacaacaactactcgctgtcgcagccgcggcacttctgcaaggcgtgcaagcgctactggacgcgcgggggcacgctccgcaacgtccccgtcggcgggggctgccgcaagaacaagcgctccaggagcagcggcgggcccggcgccggcgggaggaacgggtcctccgctgctgctgctgctgccgccgccgccgccgccgtcacgtcctcctcggcgccgtcgacgctgtccctcccgctgcatacggggtccctgccgtcgttgtcctcggcgctggggctgcccgggggcgcctcgctcgcgtcgctcctcctcgggaccgctggctctggcggtgacca

SEQ ID NO: 8898 - DNA, 573 bp, Zea mays
  Predicted polypeptide sequence is orthologous to G1927
ttttttttttttttttatcttttttttaaaaaataatttggagtgaaattttgaagaaaaaaaaaggtggtaaaccaataccgtcggtcatttatgtcacctctctctccctagatgtgatcaaataataaaataatcgatgtggtgtcttacagcaaagatatatgttttcataatggtattggacaaattttttggttgaggctgtgtatcagcaaatacaatgtttttctccactccgatgtcccttagactacattcacatactacattcaacggtgtgcactcccatacccctgttgccgtttagggggttcaaatccctttgaactcctctctacacgctacagtttaagtggagtttacaggaaaccaacagatgtgggggtgcggcagtaagccccctgcctcagtttacgtgtgcagcagtgtttgttagttgggaaaaattgataatagatgatgaataggtatggaaaatgatattttatggttgtagtggggtcaggaggagaatttaggggaaccgctgtagagggtggagatatagggggagatagctgacaaagcctt

SEQ ID NO: 8899 - DNA, 791 bp, Zea mays
  Predicted polypeptide sequence is orthologous to G1927, G2184
atgcacagaaactgaagctatattaataggttaattgcattcagtacatatatctgtcaaaatacaaatgagaacagtaacccattagtttcaaatattaccatcagatatgcttttcccccttgcattttaccgttttaaataggctctacaacctataatcatattaccaccctcaaaatgtttctacctcttcacccttttgaaagggaaatgatattcaaaccataaatggtaccgaggaccaaaaaatttacagaggacaaggtcaccaggttcccacttaatctgtcacgtaaaagaggatttccataaacccttgcaaaagttgagggcggagcctgaagtaaaggtccatataacagaagcaagtataaccagtagagatatgaacatcagcctgccacctctggtaacctgaatactaggggtgcctggttcttcccctgttgcttgctgtgacctgaagctagagatgtgctgaagtgttctgttgataaaagtgttttcttcacctgcagtttgatgtggtcggaagctagagatgcgctggagtgttctgttgataacagtgttttcgatttcagcagctaatgctggactactaggtacagagtccaacaaggctgatagagccgcattgaaccatgattgtgaagatgtggagctctggttatgtagctcatttgccgcatggatattcagagtgcctgatgcatgcgaggataagactacatgatcatgcttcatatggctccgcacagtaagagcagcctgattatatgtcctta

SEQ ID NO: 8900 - DNA, 843 bp, Zea mays
  Predicted polypeptide sequence is orthologous to G1927, G2184
gccaccagcaccaaccatccggcgagagcgagatggagaccccgccgcggggccggtggccgccaggcttccgcttcagccccaccgacgaggagcttgttctctacttcctgaagcgccggatcgcctccggccgcccctctccctacgtcgccgacgtctaagtgtacaagtcacacccctcccacctccccgagaggtcggcgctgcagacgggggacaggcagtggttcttcttcagccggatggaccgcaagtaccccaacggctcgcgcgccagccgcaccactggcgacggctactggaaggccacggggaaggaccgcttcatctgcggcggcggccgggcggttggcaacaagaagacgctggtgtaccaccatggccgcgccccgcgcggggagcgtacggactgggtcatgcacgagtataccctacttgccgatgcgctcccgcctgctgcgcagggtcgggagttctacgcgctttataagctgttccagaagagcggggccgggccaaagaacggcgaacagtacggtgctccctttcgagaggaggattggttggatgacgacgatgagagagtgattgcgggtgcagccgctaatcctgttcctaacaccaacagcccaccatctacaatggaggagcatgcaattactgaccgtgagcttccgattgagggtcttgatctaccactgtcagattttggaaatgatttggagttgttttctgaagcacagcctgtttcttcccatggtcaaggtcagggttggctcagtgaggggggtgacaaagctgaggtcgtggatgcttccattagcaatgatgttgtggtag

SEQ ID NO: 8901 - DNA, 732 bp, Zea mays
  Predicted polypeptide sequence is orthologous to G1928
ggatcatatgatctattattactacaattaatggatgcaatgtccaaccttaaaagatgatgaatgcatgcatgtattattactgtcacatatagctatggttttcttcccttgattggagcttaacttacatgttggccgatctcttccccaacccaaaaaaaaaaaaattatacaactccctgcgtacctctgtatcaccaatctgtcatcaccatccttggaccgggctaaagtttgatcggaacggtttgatcgcttgcgtggttaccacatgcatgaaatgatatcctgaacaaaaacaaaagatgaacaaaaggcacggtgcaccgagcggccggccctagctagctttgcctctgcacagcgacggcagcgatgaaatgcagcgatggcgacgtaccgatgacggctggcgagaggaaaaagaaagtagcttttatcgacctaactttgatggctgcccatgctgtgccattgctcgttgctgctttgctgctgctgctctgcctgagcctgtgcacgctgctgtggctcgtcgtaacagttcatgctggcgctggcactgatgatggcgcccatgcacgaggagtccaagccggcgaggccgaagatgtcgcggtgggagaaggcgcgcaggcctaggaaatccctggtcatgccgtcgcctccgccgccgccgccttcctcgccgccgcggccgtgggaggctgtcctcccgagcccggccat

SEQ ID NO: 8902 - DNA, 842 bp, Zea mays
  Predicted polypeptide sequence is orthologous to G1928
cttgacgagttaaatgcatgcctttcagcagattgctgcacacatccctctcgatttattgcctgccaccacacccctttttcttccgctatcttccttctcctagctagctagctaggtagacacacagtcacacacacatatcagtagtggtgtgtatatgatagtatacagcaagtgcaagatcatcaggcgaagctagctactagccgccctcctcagctcggaggcggcttggacttcacctagtatgttccaccatcagcaggagctcctacaggcagaagctgcggcggcagatcgggagagcagcatgtccaacaacctcacctcctccgcgcccggcggccccaacgcggcgccagctgctgctgcggccaccggcaataataacaagcgaaagcggagcctcccaggcaaccccgaccccgaggcggaggtcgtggctctgtctccggcgacgctgatggcgacgaaccgcttcttgtgcgagatctgcgggaaagggttccagcgggaccagaacctgcagctgcaccggcgcgggcacaacctgccgtggaagctgaagcagcggggcgcgggcaaggaggcgcagcggaagaaggtgtacgtgtgcccggaggcgtcgtgcgtgcaccacgacccggcccgcgcgctgggcgacctcacgggcatcaagaagcacttcttccgcaagcacggcgagaagaagtggaagtgcgacaagtgctccaagaggtacgccgtccactccgactggaaggcgcactccaagatctgcggcaccagggagtacaagtgcgactgcggcaccgtattctccaggtaaaattgaagta

SEQ ID NO: 8903 - DNA, 683 bp, Zea mays
  Predicted polypeptide sequence is orthologous to G1928
ttttttttttttttttttgaatgaatgaagtttatatataagaactgaaatgcccataaccgtagtacacccccaaatgaacatcaaaataagagccaagcaaaaaagtgaagtggattcgatcgatgatccgacttacccaatatgatcgagcaaagtccatgcatgcgtacgtgctgcagctcattcagaatatatatagtaatgattcatccatatatggcgagctgccatgatgatgtattgtactgatcagtactgacgacgatgccatgacgatgtaatgatgtctagactagacatgccactgcttgctgctcgggtggtggtgcccttgctcgtacgccgccggcgacgccgacgacatgcaggggtcgaaaccggccatgctgagtatgtcgccgtgggagaaggccctcagccccaagaagtccctggtgaggccttcattgccgcctccggccgctacggcggcggcattgccgctgccattgccggcgtcgcgatcagccggccgggtggtcctctcctccgctccaaagtgatgtggtgacccgaagccgagggcaccagcagcgccagtgccaggcacgttgcttgcagcagctgctgcggcgttggcggtgccagtgccagcattggtggtgctgctgctgtgagtgcccgccatctgtccctggttc

SEQ ID NO: 8904 - DNA, 656 bp, Zea mays
  misc_feature (650)..(650): n is a, c, g, or t
  Predicted polypeptide sequence is orthologous to G1932
ggagagaaaaatatttgcccgtcgatttcttgctttgcattgcgaagtcgcaaattgactagtggctagtgcacactgcacaggcaaactggctagtactactactacacaaaccgattgcccttactatttactacacaatccctttttgctagaattactatctccgacgctacatgaccatctcggcgggcggaggcaggttgaggtcgaacccgaggcccgccagcaccgacggcggcgaccgggagcagcagctccgctcccgctccccttcctccctctccaccggcgccgggtccaggaacaggcacggctgggtggccaccgtcgccgggaagagcccgaggcccaggccgagcgacgacggcgccggaggcatcggcggtggcgggtggccgtcgtcccttgacgacgacgacgacgacgactcggtgctgccgctcgcgctcgcagccagagcaggggccgtgcacggcgcttctcggacgacgtcgccggggtagttggtggtggcgcgcggcccgcggagcctgcgcgcggcggcgtcgtaggcccgcgcggcctgctcgggcgtgtcgaaggtgccgagccacacgcgcgccttccgcacggggtcccggatctccgccgcgtacctgccccacggncgcttc

SEQ ID NO: 8905 - DNA, 825 bp, Zea mays
  Predicted polypeptide sequence is orthologous to G1932
gcagctacccccactcgccggccaaccacacagggcgcgcggtggggatgcagcagatggagtgggacatgagaggaggagggcacggtagcgctgtcggggacggtgggcctggtggacgcggccttactgtcggaggcggcgtcgctctcgctgtcgggggaggggaccagcagcgcgtggaggcgcactaccgcggcgtccggaagcggccgtggggtcggtacgcggccgagatccgcgacccctggaggaagacgcgcgtgtggctgggcacctacgacacgcccgtcgaggccgccatggcctacgaccgcgccgccgtcgcgctgcgcggctccaaggccaggaccaacttcaccgcgggccgcggcggcgcccgggccacgcccgtccaggcccgcccgctcccgcaccccgcgctggcgcccggtcacttcagcgggctcgacgccacacactcgtcgccctggcacgtcgtctatctcccaccgcccaggttgcaccagcaggccctggcgccgccgatgcccctcgtggcagtggcaggcgacgtcgccacgtcgctgccgtccacggcgctggagctccggacggggcccaaggccctcccgttcgacctcgacgaaccgccgtcgttgctgttcggctcgctgtctccgtgaacgcacatggagacggagctctgtagagtcaggtagggatcgtggaccattgcacgcagtgttaggattgatcagtgagggtaatcggaaatggtgctcatgggtccggttgtatatatactagcactctagcagcaccctatttaaggaatcttgcctt

SEQ ID NO: 8906 - DNA, 802 bp, Zea mays
  Predicted polypeptide sequence is orthologous to G1935
acagatcaagaggatagagaacaacaccaatcggcaggtgaccttctccaagcgtcggaatggcctcatcaagaaggcctatgagctctccgttctatgcgacatcgacatcgcgctcatcatgttctcgccctccaatcgcctcagccacttctccggcaggcgcaggatcgaggacgtgatcacgaggtacatcaatctcccggagcacgacagaggaggagttgttcggaatagagagtatctgatgaagatgcttgctaaactcaaatgtgagggtaacatagccgaacaactcacacctaataaagagccaataaattccaacgtagaggagcttcagcaggagattaagacgtaccaacaccagatggaagtcttaaaggagcaacttaggatgttcgaaccagatctgacaacattgatgtcgatgaacgatttcgagacgtgtgagaaattcctcatggacaccctcacttgcgtggaggagcgaaagaaatatttgctgtgcaaccacgtggccccgttcgatccgtcggcctccgacatgcaacaacacgtagacatgttcgccctgccgccggcgccgcctcaccaacaggagcaacaaggggacgacctaggaggcgccgccagcgcgttcggtggcgatgtctcgtggttcgccgatgggatgccgacgtcgtcgatctttgccgcgtcggacccaatcttgtactttagggatcaggtgatgttcgactcgacgtcgacgatgcggcgtgactcgatggtggcaggggtggacccaggaatgacctcg

SEQ ID NO: 8907 - DNA, 918 bp, Zea mays
  Predicted polypeptide sequence is orthologous to G1938
ctcggagggagttggtgcctctgtgtctctgtgtgtgtggagatggaccccaagttccccccacccccaccgctaaacaaaacggagcccaccaccgcgacgaccaccaccacctcgaccgcgcagcagcagcagcagcagctggatcctaaggactaccagcagcagcagcagcagccggcgcagcacctgcaaatccaaatccaccagtcgcagcaggacggaggcggcggagggaaggagcagcagcagctgcaggtggtggcgcagcccggggagaggaggcagcaggcgctcgcgcccaagcggagctccaacaaggaccgacacaccaaggtcgacggcaggggccggcggatccggatgcccgcgctctgcgccgcgcggatcttccagctcacgcgggaactcggccacaagtccgacggcgagaccgtccagtggctgctgcagcaggccgagccggccatcgtcgccgccaccggcacgggcaccataccggcgtccgcgctcgcctccgtcgcgccctcgctcccgtcgcccacctccgggctcgccaggccgcaccaccacatgtgggcgccgtccgccggcttctcctcgccctccttcctgaactctgccgccgcgggcacgggcgatgccgccggtatcatgcagcggatggggatccccgcgggcttcgagctgccgggagcctccgccgccggagccaccctcggcgccggcggccacatcggctttgcgcccatgttcgctggacacgccgccgccatgccggggctcgagctcgggctatcgcaggacggccacatcggcgtgctcgccgcgcagtcgatcagccagttctaccaccaggtgggtgctgccgccggcggcggcggccagatgcatcacgcgcacgggcaccatcatcac

SEQ ID NO: 8908 - DNA, 859 bp, Zea mays
  Predicted polypeptide sequence is orthologous to G1938
cgcagcatcatcagctggatcctaaggactaccagcagcagacggcgcagcaccaggagcagcagcagcaccaccatcacccccacctgcaaatccaaatccaccagccgccgccgccgccgcaggacgggggcggcggagtgaaggagcagcagcagctgctgcaggtggtggcgcagcccggggatcggaggcagcaggcgctcgcccccaagcggagctccaacaaggaccgccacaccaaggtcgacggcaggggccgccggatccggatgccggcgctctgcgccgcgcggatcttccagctcacgcgggagctcggccacaagtccgacggcgagactgtgcagtggctgctgcagcaggccgagccggccatcgtcgccgccaccggcacgggcaccataccggcgtccgcgctcgcctccgtcgcgccctcgctcccgtcgcctacctccgggctcgccaggccgcaccaccaccacccgcaccacatgtgggcgccgtccgccggcttctcctcgccctccttcctgaattccgcgggcgcgggcgacggcaccggtatcggcggcatcatgcagcggatgggggtccccgcgggcctggagctgccgggaggcggcgccgccggcggccacatcggctttgcgcccatgttcgctggacacgccgcggccatgccggggctcgagctcggcctctcgcaggacggtcacatcggcgtgctcgccgcgcagtcgatcagccagttctaccaccagggtgggtgccgctgccggcggcagtggccagatgcagcacccgcacgggcaccagcatcaccatcatcagcagcaggaggacggggaggacgacc

SEQ ID NO: 8909 - DNA, 759 bp, Zea mays
  Predicted polypeptide sequence is orthologous to G1948
cctcccgctggttacaccaatggaggccgtcctacggcatccatcgctctcgcgcaccaggcctccgaacctgaaccctcccacaacgccatctccatctcttcatgcaccatctcttctccgcctccgcgcgcgccggctcatcgccgccgcggtgttccaggaccagaagccgaaggagccagcaagcaagggaggtgatgacgaggaggaggcgtacggcgaggtggaccgcatcgtctccagccgcacagtcagcagcccggtgttcgcggaggacggctcggccaccgccgccgtcgccacggagttcctggtggagtggaaggacgggcacgagccgtcgtgggtgcccgcggaggccatagccgcggacgtggtggccgagtacgagacgccgtggtggacggcggccaagaaggcggactcggaggcgctggcggcgctgctcgcggacgagacgttgcggcgggaccccgacgcggaggacgcgcaggggcgcaccgcggcgcacttcgccgcggggctggggtccgaggagtgcctgcgcgcgctcggcgcggctggagcggacgtgggccgtcgggagcgcgcggggggcgggctcacgccgctacacatggcggtcgggtacggccgcgcgggcgccgtgcgcgcgctgctggagctgggcgccgacccggaggcccccgacgggcagggccgcacgccgctggagctggtccaggaggtgctcgccagggcgcccaagggcacccc

SEQ ID NO: 8910 - DNA, 531 bp, Zea mays
  Predicted polypeptide sequence is orthologous to G1948
tttttttttttttttaaaaagagagtttccaagcgggaaggcttgaaactgcaattccggtgaaaatatgatactcacaaaagtttcatcctaaaatacaacccgggcagtgctttgaatacccgacgaataaaacgcaatcaccttcatcaagtaatctctatcacctgcggcgacggtggtgcagtgctgccgccatcaatcaccgcctgcagaccccgactgctgctgctcgaacttctgcacgagctcggtgtccacgttctcggcgggctcccacgtggcctcctcaatgtcgacccatttgacaaggtactcccagctgtcccccccttccgccgtcgctgtcgccgcctgcctcttgtcgagcacggcctcggccacggcgtactccagcccggcctcgaagtcgctcaccaggtcctccgccacccacgccgccttcacccactccctctcgccgccgtcgcgccactccaccaggtactcccgccacttgccttcgccgcggccgtcgatcaccgtcgtgcc

SEQ ID NO: 8911 - DNA, 861 bp, Zea mays
  misc_feature (2)..(2): n is a, c, g, or t
  misc_feature (11)..(11): n is a, c, g, or t
  misc_feature (858)..(858): n is a, c, g, or t
  Predicted polypeptide sequence is orthologous to G1950
tnctggtccgnattcccggccgaccccgcgtccgcgtcgacttttccggcggcgaggagaggcgaccgccggagaagagctcttccgcgccgccgagtccggcgacgccgccgcgttcgcctccctcgcccccgccgacctctccctgcgcaacgaggacggccgctccctcctccacgtcgccgccgctgccggccatccccaggtggtgctcgcgcttgcccagtgcggtggtgacgccgcggctagcgtgctgaatgcgcaggacgaggaggggtgggcgccgatccactccgccgcgagctccggcaactctcaaatcgtcgacatcctgcttgagcgaggtgctgatgctaacctggttactgatggtggccgaactgctcttcattatgctgcgagtaaagggaggcttaacatagctgaaaaactaatagcccatggtgctaatgtcaacaagaaagacaagtttggctgcacacctttgcatagagctgcaagcactggaaacgcggagctgtgtgaattcctcattgaggaaggtgctgaagttgatgctgttgacaggacaggacaaacacctcttacgcatgctgttatatgcgagaataaaggggttgctcttctgctaattagacatggtgctgatgttgatgttgaggacaaggaaggctacactgcccttggccgagcatcgaacagcttcagacctgcactcatcgatgcagccaaggcaatgctcgaaagatgatctggtgctctggtcaaaaacgatgggaagtgtgatacgagaaactgtgctgagtcgaggtgtaaagcttgttctggtgtgtaaacacggggctctctacagatcanatt

SEQ ID NO: 8912 - DNA, 848 bp, Zea mays
  Predicted polypeptide sequence is orthologous to G1950
caaccttcaagcatcgccatggctgcgtcgacaagtgcaggccttgggctgttcgatgctccgccaaggacagtgtagccttcctcttgtcctcagcatcagcatcagcaccatgtctaatcaacagaagagcaacctggaacacaattgtaggagcaaaactagtaataatctctatcggtccgcatttggaatccgtccgtattgtggagttgtcccggtgtacgagcttcgccgctgatggcgctcgcgcgtctcgctcacgctttggtttagggttattacgatttacgagcgcgtttatcgattctaatcgttttggagaggacgaacagacggtttctgaatctggtggtggagaacctgaacgccgacttgtgttctctgctccgcctgaatctggcctgcggtcctgccatctcttctgttcatcagcagctgcagcctgcagctgaggccgcaatggcgcggtcagaagcagcaatatcctgacgaacgcggagagacaggccaacagaagtatttcagagttcggattcttgtgggggaaaaggcaattgacaattcactaattcacttacgcaaaagatggcagcaatatactattacagtgcacactgtacagtcaccatgacgcggccggcacagctaggagcctaggatggtccctccctcctgctcatcagtgctcactctaggtggtcatgcggccgtagcgacatgaacatggccgcgtagtgtctgagccgccggtccccgtcgtcgggcccgccccaccacggcggcgccgccaggtccgccgacgtccgggccctgtacctgcgccacgcgagctggatgttgacggc

SEQ ID NO: 8913 - DNA, 716 bp, Zea mays
  Predicted polypeptide sequence is orthologous to G1957
ttttttttttttttttttcgaaaaacatgactaattaagattcaacaaggcatgcacgccacctatggtgtaataaggtccctgatcagtagatcaccatcgttcatcgtctctctgcgcactctacgccgccgctgctactaggtgtcgccgtcgacatactccacttcggcgggagcaggtgccggtgccggtgcatcgtcgccgctgcactcaacattgaacccgaagagcctgaagctcctcgcccccgagggtgccactgccacctcgatgtcatggccggcgatggtggcggacgccaccgttgcacccccattattcatggccgcggttccgataactatcggcctcggccacgccggcacggtggcagcgtcgccgaagctgatatcgacgtcgcggcgccggcgctggcagtggcggtactcgatgaagtatcggccgccgccgctgcgggagaaggtgacggtgtcccccgcggcaagtcgtgcggcgcggacgaagcggctccaccccttggtcatgacatagctctggctgctcccccagtaggagtagcggaactgccacagcgccccgccgcggtcctggaagcacagctgcgtcgacccggcgccggccgccgggaagaaccgctccgcgtgctgctttggcaccaccagccggttgagcttgcctacgtcgctcggggtcagcaccttgtcgaacatgtg

SEQ ID NO: 8914 - DNA, 836 bp, Zea mays
  Predicted polypeptide sequence is orthologous to G1957
cggccggggagcaagtagtagtagtagtaggctgctgctgtagagatagatcgtacgagtacggagtaggagaacgacgaccacgcggcttctccggctgccatgccttcacaagtcaaggttcaaggagcacctcgctttcccggaagagtaggatgaggaggaggacgcctgctgcgtcggcggcgcactagtcctccacccgccgacgttctcctcctctgagccggcggcggcggcgcagtcgaggttcaccccgaacaggcgcacccgcttcgaggctgacgacgccacggcggggggcggcggctcggcgtgctgccctggcgttggcggtaaccgtaccggcacggagtccagcatcaccgtcgtggagggctgctggtgcggcctgtagaagagaagttgcctggtgccggccccgtaggcgtcgtagccgacgtggcggcggcgggtgtcaaggtagagcggggagggcgagggcggcaggtggtggagcaccgtcgtcgtcgtcgtcgtcgtcgtcctggcggcaccgaccccagctgctgggtagtggtggtggtgcgcgtgcgccgccgccgcccacggcgcgtaggggacgacggcggaggggagagggaggcggtggtggtggtactggtggtgcacgacgggcgggtcgggtcggcgccgccagtcgatgaagagcctgccgcgcgccgcctcgccgacgccgcggccgaaggagacggtgtccccggcgtcgaggcgcttctccttgacgaagcggctccagcccttggtcatcacgtagctctggctgctgttccagtaggagtagcggaagccgcagg

SEQ ID NO: 8915 - DNA, 647 bp, Zea mays
  Predicted polypeptide sequence is orthologous to G1957
cacatcaacttcacagtttgttctctatcggacccacaaattaaaacatataggtacagatgacacacacatacatacacacacatctctctctgtctgttgtctctcgttccagctccttggcagcttgatgcttcctgcaaacctcccacgcatgcccggccccctgctaccaaatcccctacagaaagtagggttttctggaagccatggaaaaaaaaataaaaattaaaaaaaaaaaaacggaacagcaaaaaggcagcagctttcttctgggggcgggaatggaaggaaaattgcccggaaaacaagggatctctctccacttccttccttcctttttttttccccccgggaacaggtcaattcaatcctgtcacttcgtgtgcaagtaaaactagggggctgctgctgctgctaacaactacaactgctactactttggctgtttggattctgcaggcataatcttaaatctcctcgtcatgctggaatggactgccccagttgttgtaagcgaaggggctttggtgcatgtacccgaacatcgccgttggtgtctccggctccggccccgggccgcagtcgaggtttacgccgaacaaccggagccgccgcgacggtggcggcggtgccaaaactgcact

SEQ ID NO: 8916 - DNA, 694 bp, Zea mays
  Predicted polypeptide sequence is orthologous to G1957
ggggaaaacactgatcgatcctagtgtttatatgtgtatcttctcaaaccaactcatcaaaaaagcgaagagcagccaaaaacaaggaaatcaaaacatcaagtcctaacttctataatcaaaggttataatgtattaataaaaaaaaaaagagaagaaggtaaaatatgagaagaaccgaaacaagcagaaagaaagaatcgttgaactttcctttgatttttgcctttaggtcacagatcgagatccaaagctgaacgcgcctccctcttggaggaagacgacgacgacggaaacgacgccgcggaggactccccgccatggcgaggcaattctagtagccttaaagttggagtcctttgctgccacccgggcatctgcaatgacaatgcatcgccctgatggctagcctcgccgccgccatctgggttgttgtccaggttgacgccgaacagccgcacgcgcttcgcggcggtcgtcgggctctcgatgaccggcaccgagtcaagaaggaccggccgtgacgcggcggtgacgccggcggcgctcggttgcaccgtgtagtgatgcagcggcagcgagaacgggcgcggctggggcggcggcgcgtgatgaggaggcatcctggccgagccgaaaaacaggagctgcctccccacggtcggcgcggggtaggtcgtcgtcatgctgcgga

SEQ ID NO: 8917 - DNA, 851 bp, Zea mays
  Predicted polypeptide sequence is orthologous to G1958
gaaaagcacccctaaggtgtcctgagctaatgargcagacaattgaccatytatcatgtaaaaagtcatcttcagaaatacagaacagctagatacagmccagagttatctgaaggctcttctgaaaagaaagtggcatcaaaagaagatataccatctattgacttgaaagggagttttgatctcactgaagcacttaggctccagttggaacttcaaaagcggcttcatgaacagcttgagatacaaagaagtttgcagctaagaatcgaggaacaagggaagtgtcttcagatgatgctagagcagcagtgcatacccggggcagaaaaggcgcaggatgcttcaaccgctgcagatgaattgaggtcaccttctgagattccagaatcttctaccgtcaaggaagttccagaaaacagtcaaaatggatcaaccaagcaaacaaaataagctaagggccgatgaagttgcaagcatgaaatgtgtttcatgayccgattggctgtttccaggcttaaatcaagttgtttttgtccttccgtgggaacagatgaacgctatagttaacttccttgcaaagcctggctaggtgcatgtaactaggagttagttgtatattacctaccctcacggtatcactgaatcccagtgttatgcggatgatgtagtcttcagaagacagcgcaagcacattgtcagggctttgacttgttttgccccccattacttaggtatcaagtagcgtctcctaggcatttgattatgggctaattcaagtgtttacaataatgtttagcacctgttgtttaaaacatgtcatggtaccaaaatatgacgaagctgtattg

SEQ ID NO: 8918 - DNA, 851 bp, Zea mays
  Predicted polypeptide sequence is orthologous to G1958
gcacgagaatcagtcagcttcatctcatagtagggagatttgtcctgttgctagtcctcccaatagcagcaatgcttcagttgccaaacaacggatgagatggaccccagaactccatgaatgttttgtagatgctgtaaatcagcttggcggtagcgaaaaagctactcctaagggtgtgctaaagcttatgaaagttgatggtttgactatatatcatgtcaaaagccacctgcagaagtaccgcacagcccgctataaaccagacctgtcagaaggtacatcggaaaaaaggacagccactgaagagctggtcctggacctgaaaacgagcatggatcttactgaagcactgcgccttcagatggaagtccagaaacggcttcatgaacagcttgagattcagcgaaaattgcagttgcggattgaagagcaaggaaagtatctgcagatgatgtttgaaaagcagagtcaatcgagcacggagaaagtccaggatccatcctcaagggatacaacagctaaaccgtcatctaatcagagccagtctacaaacaaggattgtggtgcaaccatggacccaaatggaacaggaggcatcgtacggactgcagaactgggagaacgttcgtctgaattaggtgtaaaacagaaactcgtagagatcgaagaatctggtaccgaagtagccacaggcgacagatctaagatctcccaagagaagcggcgcaaactgcaagatagttaacatatcggttgcactattcagacatagctgttcaaaccgtttgcttggtgaaaaattggtaatctgtgtgtcgattcgactattgatccgtgagtccattggt

SEQ ID NO: 8919 - DNA, 722 bp, Zea mays
  Predicted polypeptide sequence is orthologous to G1968
ggtaaaaaaacgacattattttttttatcatacataggcacatacatacaatcattaaaatgaatagccaaaataacctgaaaaggtggacatatcagttaaaagaataggtaagggtgagtattgcccggtagcaattttggagttatgtaaaatacatcggatatcacatggataaggaagtttttagtgaaagaagtagattttttttaaaagcaatacaaattgccaaaagaatatgtggcatgttgttgtcactgtacggaagaagctttgatcggaccaaggcaactcatgctgggtgcagagcagctgcgctacgacctccggctcctagccatggggtagcaagtcgaacctggcccagccggcctccctgaccctgactaaccctccggcctccattgtgactgtgattgtgtgtagatgttggtgtctgaggtgcttgcttggtgaagaccagtacaggtgcttttataccgtttaggaacagtgctgcagacgggagcatgttcttcaaattcttcttaaaaaaacaaaaggtggccatcaatatgtttaaagaaacgacggtccatgattgggatgaagcagtttatggcctgctgatacaaacaaatgataggttcattattcagtgtagaatgtgtcgacgtccttattccatgtggttctaaatcagcataccgggaagaagaagaactgaacaaatgcaaaaaatg

SEQ ID NO: 8920 - DNA, 640 bp, Zea mays
  misc_feature (2)..(24): n is a, c, g, or t
  misc_feature (242)..(264): n is a, c, g, or t
  misc_feature (290)..(307): n is a, c, g, or t
  misc_feature (419)..(440): n is a, c, g, or t
  misc_feature (553)..(553): n is a, c, g, or t
  Predicted polypeptide sequence is orthologous to G1983
cnnnnnnnnnnnnnnnnnnnnnnnctgcagcccgcaaggcatctctcgcaagaggatcgacatggccgccgcctctgccgctgctctccgcggcctcgtggtcgtcctcgccgtcctctccgtcgtctccacgtggggcgcggtggccacgatcaacgtcaaggatacgtgctccttcacggcgcacccgaatctgtgcgagaaggccatgaccaagctgatggggcagaacggcgtgcccnnnnnnnnnnnnnnnnnnnnnnngacgtcggcctgagatcgattagctnnnnnnnnnnnnnnnnnntcgccttcgcgatatctagtgtgctgtaacattggtgtgccctgccgtgtttgatcgtccacctgagagtgagatgatggaggatcgattgcaagtttcgttgtcgtgagannnnnnnnnnnnnnnnnnnnnncaagatctcacctggatcatcacctcacctttggccgtaagtcccctcggggcattacggcgacaagagagcgtccaggtctagcgctgcgtttcgtcgaggtcgtcgtttgngattgcatgcgtttccgtcgcgacctgatgatgagtaccacggtcgctagctaatcctccaccccttaggccgtccccatgcgccag

SEQ ID NO: 8921 - DNA, 746 bp, Zea mays
  Predicted polypeptide sequence is orthologous to G2010, G2347
cttccactcatgagaggcacggcaccagagctccagctccacatcgccagctcccgggccgcacctcgatcgcccaggccggcctcctccctcgccgccggcgccgccatggaccgcaagagcaagtccgccaagggcgccgcgagctcggcagcggcgtccatggccgcgctcgccgcagccgccgcggccggcgacagcagctcgggccccgccggcggcgtctgtcgttgcggcaggcggcggcggcgggccgaggtgccaggcggagcggtgcaacgcgaacctgatgaccgaggagaagccgtacaaccggaggcacaaggtgtgcgaggcgcactccaaggcccccgtcgtgctcgtcgccggcctccgccagcgcttctgccagcaatgcagccggttccacgagctgtcggagttcgacgacgtcaagcgcagctgccgcctgcgtctggccggccacaacgagcggcgccggaagagctcggccgacgcgcacgccggcggcggcaataatggattccgccaacacgccgaccagaacggccgcggcgacccggccgggaaccacttccagatcagataaagcatgctctctctcttctgtcatgcagcaggatatgctagcatcatcactaccgatagatatttatgcgtctatcgtctacccgccccgaaaaccctagttatatatatatatatatataatatatatatatatatatatatatatatagacatat

SEQ ID NO: 8922 - DNA, 838 bp, Zea mays
  misc_feature (9)..(9): n is a, c, g, or t
  misc_feature (697)..(697): n is a, c, g, or t
  misc_feature (761)..(761): n is a, c, g, or t
  misc_feature (768)..(768): n is a, c, g, or t
  misc_feature (822)..(822): n is a, c, g, or t
  misc_feature (835)..(835): n is a, c, g, or t
  Predicted polypeptide sequence is orthologous to G2035
ttggtccgnattccgggccgacccagcgtccgaaattgattaggcatcagaactgaggagaactgtcagcgatatcaagcacaatgttcaggcacagcttagcgagaatgctaagaccaacaaacgagtgactgggattcgcaaagagttgcagaaactgcatagagaagctatccagaacacaatcaattcagtcaccttggtagcgaccctgattgcctccattgccttcgtggccatattcaatctgccaggtcaatacttccaggatgtgactagtgggggagacattggtgaggccgaaatagccaagcttaccggtttccgtgtcttctgccttctgaacgctactgctctcttcatctccctcgcggtggtcgtggtgcagatcaccttggttgcctgggaaactggtgcccagaagcaagttatcaagatcgtgaataagctcatgtggacggcatgccttagcacgggtgtggcttttatctcgctggcctatgttgtagttggcccgcagcatgcctggatggccttcacggcatcagccatcggagggccgatcatgattggaactttcctgttcctagcctatctgctgttgcgcccacggttcaagttcggcgaagacagacagcgccgcatcaagagggcaagcggcagcaaatccttctcctggtcaatccatgatgggttntcagatctggaagccttctctgatcatgagaagaagatctatgccctgtaggaggtgtaacagntactacntcctgcagaagcaactgggagagtacaaatggttcatgtatatatttggtttanccgtttagcctanccg

SEQ ID NO: 8923 - DNA, 854 bp, Zea mays
  misc_feature (636)..(636): n is a, c, g, or t
  misc_feature (679)..(679): n is a, c, g, or t
  misc_feature (801)..(801): n is a, c, g, or t
  Predicted polypeptide sequence is orthologous to G2035
gcagagttccctgacaacgcaaggagtgttgaccgtaggaactttgtacacatagagtacttgttgaggagagggaagaagcagcttgagcagctcaagaatcctgatattactggactcgctacccttgtagtaaagaaatgagcaagagaagaaggaagacaagtcagacaaaacagaagacgagaagaggttcctaccataacacttaagcaaggaatcctgtacacttctctcctggggttgtgacttgtatattgtcaaggatcacttggatgtggtaaatgctatactggacactgatgatagctgcataaggattgtgcgaaaaaacgggaagacatccctacatactgctgcaaggattggataccatcgtattgtcaaggcactcatagagagggatccaggaattgttccgatcaaggataggaagggacaaactgcacttcacatggctgtgaaaggcaagaacacagatgtagtggaagagttactgatggctgatgtttccattctcaatgtgcgggacaagaagggaaatactgctttgcacatagctacatggaaatgggagaattttgggattatgaaacaccgcagacgtggcttcgacgaaacggaggcgtaggcganggattcgacattatgaaaaaccagagaagatactacactctanaatggacatgaatcctctattaccagggaaggatgatgtttattacactgaaacagacgctgtctcacatccgttacccgcactagacgcacccagtctttctacagagagaatcgcgccgntctttgatctgccattcgctgaatctgccattcgctgctgttgtttctggaca

SEQ ID NO: 8924 - DNA, 865 bp, Zea mays
  Predicted polypeptide sequence is orthologous to G2035
aaaaaacaagagcattaccggcaccaatcaatcaggctggcagtggagtgacagcggcggcaacaccacgcccacgcggcgccggagccgatcccccgatggatctcccgccgctctcccaccaggccctcttcgccgccgtccgatccgccgacgcgcccgccgtccgcgcggtcctggccgacgccgaggcgtcggccacctccttggccgcgctcgccgccgctcagacggacgccggggaaaccgcgctgtacgttgccgcggaggccggcagcgaggaggtcgtgcgcctcctcctccctctctacgacttcgaggcagccaccgtccgctcacgccttgacctcgacgccttccatgtcgccgccaagcagggccacaccggggttgtgaaagagttcttggggcggtggccagggctttgctcagtctgtgactcttccaacactagtcccctctactcggctgctgtcaaggatcacttggatgtggtaaatgctatactggacactgatgatagctgcataaagattgtgcggaagaatgggaaaacatccctacatactgctgcaagaattggataccatcgtattgtcaaagcactcatagagagagatccaggaatcgttccgatcaatgataggaagggacaaactgcacttcacatggctgtgaagggcaaaaatacagatgtagtggaagagttattgatggctgatgtttccattctcaatgtgagggacaagaaaggaaatactgctttgcacatagctacacggaaatggaggccccagaatatctcaatgtgaaaaacatgtcgtatgtaagccatggtggtttcttagtggagcagagcatctat

SEQ ID NO: 8925 - DNA, 1361 bp, Zea mays
  Predicted polypeptide sequence is orthologous to G2051
gcacgcggtaccaaccgcgccacgtccacggggtactggaaggccccttgcaaggaccgccgcatcgcctgcgacggcggcgtctacggcctccgcaagacgctcgtcttctaccgcggccgcgcccccggcggcgagcgcaccgcctgggtcatgcacgagtaccgcctctgccaggacctcgcccacggcacttgcaacttcatcggtgcttacgcgctttgccgcgtgatcaagcggcaggagggtgggctgccgcagggcgagagctgcgcgaaaggagccgccggcagcgcgagatcagggcagatgagcaaggtctccagcagctcgtccctcgtcagcaacgaccagctcagcgcgtcgttcacccctcctcctacactggacgtgggcaccatggctggatccggcaacgcgttccagagccccgttgggtacgggtacggcgtgccgacgacggcgacggccacggccaccactgcggggctgccgtcgagcgcactgcctccgcccctgctcatcatgccgtctccccacgacacgttttccatcgtcggcggcggcggcgacggcgactccctccctgccgcggccgagtcgcgttcgcacgcgcacctgttcgacaccgtgggaatggggatgggcggcgtctcggagcaggagctgaaatgggacagcttcgcctgcccaagcacggtctcgagtggtaggtgtacagctcatcctagtttgaaatgaaatcgcctgtttgttggtcactcgatcggtcgtgacctcgacggcggcccggccggccgtgcgtgtatgaacgtctctctgcgcaggtgccaacatggcggcggcgagtccggcgatgctgtgccggcaggcgagcgacggcttcgacgacctgctggcggccttcttcttctcggatgacaacaggatcgtcttctgaacccaatgcacagcacaggggtaaatgctgctctgatcaactcaagatgttcatactgggaaataaaaagtgacctctgctttcccagaaatggcgattatatttttcacagccaaggaatgggagatactacgtactgggagttcactcgtgttggctacagagtgagggcattttatttaccgtgcggttttttctgtagcacgggtgcggtctgtgtacgacggccgtgtgtcacttcctaaattctcacgcgtgtgtcatttgcccccccccctactactagttacatttactagcagtagtacttgggtgattgccctcccctgttctgtgtacgacagagctaatgcagtattcccatgctttgaagcaaaaaaaaaaaaaaaaaaaaaaaaaaaaaaaaaaaactcgggggggg

SEQ ID NO: 8926 - DNA, 845 bp, Zea mays
  Predicted polypeptide sequence is orthologous to G2067, G2115, G2294
acatatatgatggtgaagaacccaagcagcaatggagttctcacggcgactcccttctccgacagcaaagccaggccggagcgcggcgtaggtggcgaggcggcggggaggccgtacaggggagtgcggatgcggagctgggggtcgtgggtgtcggagatcagggcgcccaaccagaagcgccggatctggctcggctcctacgccacgcccgaggccgcggcgcgcgcctacgatgccgctctgctctgcctcaaggtcaagggctccaacgccgtcctcaacttccccgccgccgccgcctcctcctcatcatcatcctcctccacatccgcttcctcgtcccaccagcgtgctgacagccgcggccacccggacgacgacccagctgctgccggcggcggcatgtcaccgaggtccatccagcgcgccgcggccgcggctgccgcggcgaccgacgacgacgccggcatgggcgccagcgccgctgacgacaggtgctcctccagcgccggcgcgacgaccccgacgtctgcctcgctgtccacgcagggcagcaccgccgatcacgtcggccaggagcagcacgcgacgacaacatccgccgcggccagcaccggctcgccgcccgagggggaggaggagctgtggacggacctggacctggaggcgttcgcctcgcccaagttcatggatctactaatggacaccggcgccgcgccgtactcgtcgacgtgggaggagcccgaggacgacggcgacggcgagttgatgaggctgtggagtttctgctaggcctctaaacatcaatcgctgtgcagctagggtgcaatgcatgcatttca

SEQ ID NO: 8927 - DNA, 855 bp, Zea mays
  Predicted polypeptide sequence is orthologous to G2067, G2115, G2294
cagccacacacaacgactgacctaccccatgctatctctgcatatttgcgttcttgatcgcgctcttattactcctcaccgtcgacatcacgcgcacgcatcgaactttgtatagcagctagagcaccagagccaggagcggcgcggcacgggacatggtgaagggcgcgcatttccaggacgcggcggtcgacggcggcgccggcggcaatgcggaggcggcgatgcagggcggcgccaagcggcagtacaagggcgtgcggatgcggagctggggctcgtgggtgtcggaggtccgggcgcccagccagaagacgcggatatggctcggctcctactccaccgccgaggccgccgcgcgcgcctacgacgccgccctgctctgcctcaagggctccgccgccgccgacctcaacttccccgtgcacctccccttccacgtccccgccgccgccgccatgtcgcccaagtccatccagcgcgtcgccgccgccgccgccgccgccagtggcggcgccacatgcagcccgccggcgccactcctccgtgcagctacggcgacgcgtcgtcgtcgtctggcgttagctccccggagaccggccggaacgctggcctgtgctacggcacggcgcactacgacgacatggacatggacttggcgggcgacgccgacgcggacctcgccgcgctcgcggacatcgaggccttcttccagtcgcctaagtgcatggagtacgccatgatggacccgtgcagcacgttcttcgcaccggcgcccgtggctacggacgcggccagcgagtgggcggaggaaggcgagatcgacctctggagcttctcgtccctcaactgatc

SEQ ID NO: 8928 - DNA, 755 bp, Zea mays
  misc_feature (1)..(2): n is a, c, g, or t
  misc_feature (22)..(23): n is a, c, g, or t
  misc_feature (45)..(46): n is a, c, g, or t
  misc_feature (52)..(53): n is a, c, g, or t
  misc_feature (60)..(60): n is a, c, g, or t
  misc_feature (72)..(74): n is a, c, g, or t
  misc_feature (76)..(76): n is a, c, g, or t
  misc_feature (79)..(79): n is a, c, g, or t
  misc_feature (83)..(83): n is a, c, g, or t
  misc_feature (134)..(134): n is a, c, g, or t
  misc_feature (137)..(137): n is a, c, g, or t
  misc_feature (140)..(140): n is a, c, g, or t
  misc_feature (143)..(143): n is a, c, g, or t
  misc_feature (146)..(146): n is a, c, g, or t
  Predicted polypeptide sequence is orthologous to G2071
nngatggaccctgcagcacggnnggaacttcggacgcgggggggnnggagannattacanaaagaagggcannntngangagnaggagggaacctcgcatcagcgcgatagagccctaacaaggaggaggaggnggnggnagnggnggatccgctggcgcggcgagggggcggcatgtcgcttacgctggaggagctgcagagctcgctctgcgagccggggcgcaacttcgggtccatgaacatggacgagttcatggccaacatatggaacgccgaggagttccaggccgccaccgccaccgccaccggcggctgcatcaagcaggagggcacgcagcgggagccgatgatgcccgtggcgaatggaacaggtgagaggggaggattggttcggcaggccaacgcggcggcgcaggccgtggtgcagccccagatggggagcggcggtggcggcggcggcgtcgccgccagcgggcggcagcaggtgacgctggccgacatgacgctggaggacttcctggtgaaggctggcgtcgtgcgaggagccttcgccggccacggccacgcggtcgtcggcatggccccaatcccagccgggcggatgggcatccagcagcagcacgcggctcccacgatgtcgtaccaagtggcagcgccggcgcccaacgccgtgtacccggttatggggaacggcacgggggaccacaaacggtaccccagggccatcgcgggggggccggcgactcagtgcgt

SEQ ID NO: 8929 - DNA, 818 bp, Zea mays
  Predicted polypeptide sequence is orthologous to G2071
gtggaagttggccaatccattcagagaattttgaaatcatttaaccagcttaaaaatgctaccacacgtagccccagttgtaggaaaatacaatcaatcacatccacatccgtcctggacttaatcatttatcaatttctctacaactttacttcacatacaaggtattgcttgagtcaaatatatgggcatgatagactgatagtttgaacgcagaactctctggacatcagtagctgccaaccagacaataatattgtatcatgccaacaagtcacatgaccacaagtttagagatctttcattttcttcaataataattgttgaggtttcaaaccgtgcattgccaatcaagtcaacaaaggaggaaaattgatatgcatgatcatagggctatagtatattcatgatgtgatgctgttagggttgactgtaatatacttcatgacaagggaatctacacattatagaattccttttgtagaaaacaacttcctacacatcaacaaagttcgctgctagtactaaattgaaagagtctagtctatagcttgtaaccagagcaaaagtatcttcttcaaaatgggaagcaattacctcattcttttgcttctccagcatttcgacctgtttttttgcaactcatcgttcaactctttaagttttgccacctcagcttccaactccatcatatacgcctgtttcctcccacgcgacctcgcggccaactcccggttcttgatcatccggcgttgcctcctctcaaccaccttcctcacagcttgggggcttccttcccctcaaaccagcacaaaaaa

SEQ ID NO: 8930 - DNA, 862 bp, Zea mays
  Predicted polypeptide sequence is orthologous to G2071
ggatcttttaaaatcattcattctctgcacaagctctggaagatggcaaaacctaaacaactctgcacaagctctggagtctggatgtgccagcaagatgcaaaacctaggcaactctgcacaagctctggaggatgactgaagccacaactcttgcgaccggcttcactccattttgttctctactacgtacataatttacatgtcagttttcgactccaccaatacggtactccagtactacgtaagcggcagaagggagctaacagtacaatcatttagattatgttcatgttcatgggttcatcgctacactataggagagaaattatctacagatcccaaacgcccctgcaggtacgtagcaagtgcaagtcatgtgctgttctaggcaatcgtcaccagggggccgtcaacgttcttcgcaagcacagccgtttcttccgtccgaatggatccttcaacatttctgatacctcgttgttctgcatttccataatttctgcctgtttcctctccagttcctgattctgctctctgagtttctgaacttcggcttctaactccattgtataagcctgtttgcgcgctcgggacctcgcggcggactccctgttcttgatcatcctccgccgccgcctctccaccactttctccactccgcctccatgccttctcccccgaatcattctttcaaacgaaaaagtttgcggctccgtcagcgacgacaggtcgctgtatcccttcccgacagaatcaagctggctcaccgctgtttgcacagccatggcgctgcctcccatgcctgccgccctgggcggtatcaggggcagatccaccatgccgaccggtgcaaacccta

SEQ ID NO: 8931 - DNA, 830 bp, Zea mays
  Predicted polypeptide sequence is orthologous to G2071
gattgagcccgcgcacgagcccatcgctttcgctttggcgtcttcgagaacccgcaagcaacctatatagcccgccgcgaattccgcctggcttcctcgtcgcccgcctcgtcgtcgcgccgcagtgagaggagggggaggcgatggatctcaacgaatgcgagaggagggggccggcggggccggatccgctgtcgaggcaggggtcgatctactcgctcacgttcgacgagttccagaacacgctcggcgggatggggggagggcttggcaaggacttcggctccatgaacatggacgagctgctgcggagcatctggaccgccgaggagagccaggccatggcgtcggcttcggcctcggcctcggcctcggtgtccgcgctgggggcagccgtcgacggcggggcggcgctgcagagacaggggtctctcgcgctgccgcgcactctcagcgtcaagacggtggacgaggtctggcgggacttcgtgcgggaggcgccgcccgggacggctggcggcgaggagccgcagcccaaccgacagccgactctcggggagatgacgctggaggagttcctggtcagggccggggtcgtccgtgacaaccctgccgcggcagctgctgctgtccctgcgcagccggttgctccacggccgattcaggcggtcagtaatggcgcctccatctttttcggcaactttgggggcgccaatgacgccggggctggagcgatggtgtttgcgccggtggggatcggggatcaggccatgggcaacgggttgatgcctggggtggctgggatggcaggtggtgcggtcaccgtgagt

SEQ ID NO: 8932 - DNA, 853 bp, Zea mays
  Predicted polypeptide sequence is orthologous to G2114
ccacgcgtccggttcttgcagagtagagggacgtagaaggaaagggaaacaagtttatctaggaagttatgataccgaggaaaaagcggccagggcttatgatgttgctgctattaaatactggggcgaaaataccagactgaactttccgatttcacaatacggcaaggagttggaggacataagggatttgtctcgagaggaatgtgtgacatacttgagaaggaggagcagctgcttttcaagaggagcttctatttatagaggagtgacaagaaggcagaaagacgggagatggcaagcacgcataggactggttgctggaactagagacatttacctgggaacattcaaaacagaggaagaagctgcagaggcttatgatattgctgccattgagatacgtggcaaaaacgctgtgaccaattttgaccgaagcaactatgtcgataagggtatgcactgtatagaaggcgaaggcttgaggctgcttgcatccaagccagaagaatgacttccaagttcaatgcagtgattgtcgatcgagcagatttggccagacgtatatgcagcttagttggtacatatacagataggagaaccggttgcagtttgtcaatattcctgctttacatgacttgggattacagttaaatcgacccgctagcaaaaaaaagtgtgcaaatgttagtagatttggccagacatatatgaagattttggggttgtatcataaggcctcgtaggatagatctttctgcaaatgttagcgaagccagtgtttatgttctgtttgctagattagcgttatcagtttgcacgttccccttttttttcaaaaaaaaaaaaaaaa

SEQ ID NO: 8933 - DNA, 848 bp, Zea mays
  misc_feature (17)..(17): n is a, c, g, or t
  misc_feature (61)..(61): n is a, c, g, or t
  Predicted polypeptide sequence is orthologous to G2115
gccagtatcggtccggnattcccggctcgacccagcgtccggttgaatcattctgaaccanagcagcgttttgttgctgtacaacagcttgggaggattattaactcaacaagttctactgaagctgatttgaaatatccaaactatgaccaaaatttcctcatatctgtttcaacagtaacatcccttttggtaactcatacatgggacagcgtagcagcattggctctccatgactcttctatgctattaaggaatcatgcaatggcattgcttactgaatatgtgccttttgttgataggaagcacctgcagtccttcctttcatccagtaacggtatcctgactggtttgggacaactttctggtgtaattgaagagggctattttacacgaatgtctttgctgttgttttctaaggcatgtctttattctaatcctgaagatatcgctttgatacctgaatgtgtttggcagaagttggaaaacatgcaaacatcaactggaggttttggatatatggagaaagatctctgcctagctctgtgccaactaaaaagtgaatcagatgctacaactgttgcaaaagttctttctggatgtaatagtcaaccagtcagccctgatttcaagagcatccgtgaatcaatcctccaggtgatgtcctctttgagttctattgaagcatactttgagttcttcgcagccagatctgcacaagaacatgaggaacttgaagaagccgagattgaattggagcttattgaaaaagagaaagtcagttctaactttgttgagcataccaatgatacgatggtgcttgccatgccatcatatgaccgtgatgg

SEQ ID NO: 8934 - DNA, 991 bp, Zea mays
  Predicted polypeptide sequence is orthologous to G2116
gcacgagctcgtctccgccgcgccccaagcaccgccacagcagctccgtcgatggctcgggcttcttcttctcacccggcgccggcggtggcgcggggaaggatgccgccgcgtcgctggctgaggtcttggaggccaagaagtccatgactcccgagcaactggccgagctcgccgccatcgaccccaagcgcgccaagagaattctagctaacagacaatcagcagctagatcaaaagaaagaaaggctcgttatatgacagaccttgagcggaaggtccaaactcttcagactgaagccaccaccctgtcagctcaacttacactatttcagagggacacgaccggactttctacagaaaatgcagagcttaagataaggttacaggccatggagcaacaagctcaactccgtgatgctctgaatgatgcactaaagcaggagttggagaggcttaaacatgctactggtgagatgaccaattccagcgaggcatataacatgagattccaacatgttccatacaactcttccttcttcccgctttcccagcaaaatgcatccccacaccttggtagcacccagctgccactgccgttccacccaccccatcccaacgtgccaaaccaccagatggtgtcccaccgaaacactctcccggacataatgcagcaagagtctctcggacggctgcagggtttggacattgggaaggggccactggttgtgaagttagagagcagctcgatctctgcaagtgaaagcagcagcaccttctaacgaggcctacaagtgaaaacccaccgtttcagtaggttccattgttcatagtagcctgacatccttgtgctgcttcctgctctgtaagcccatttgttatttaattcattcaattagttgaaattatacgctgtcgcactggctgatcaatcatgttgtagaatggtccatgaacccttcaattctgtttgttttgggttcgtttcctg

SEQ ID NO: 8935 - DNA, 1149 bp, Zea mays
  Predicted polypeptide sequence is orthologous to G2116
gcacgacgttcttctccaccttcatggacatcgagaagatctcatcttccgggccctccgaccgcgaccgcgccgccgagacgtcgtctcccccgcgccccaagcaccgccacagcagctccgtcgacggctcgggtctcttcttctcgcccggcattggcggcggcgcgggcaaggatgctgcggcgtcgctggccgaggtcatggaggccaagaaggccatgactcccgagcagctggccgagctcgccgccatcgaccccaagcgcgccaagagaattctagctaacaggcaatcagctgctagatcgaaagaaagaaaggctcgttatataacagaacttgagcgtaaggtccaaactcttcagactgaagccaccaccctttcagctcaactcacactatttcagagggacacgactggactttctgcagaaaatgcagagcttaagataaggttgcatgccatggagcaacaggctcaactccgcgatgctctgaatgatgcactaaagcaggagctggagaggcttaagcttgttactggtgagatgaccaattccagtgagacatataacatgagatttcagcatattccatacaactcttccttctttccgctttcccagcaaaatgcatctccacaccctggtaccacccagttgccaccaccgttccacccaccccatcccaatgtgccaaaccaccagatgctgtcccacccaaacactctcccagacataatgcagcaagagtctcttggacggctgcagggtttggacattggaaaggggccactggttgtcaagtcagagagcagctcgatctctgctagtgaaagcagcagcaccttctaacgaggcctaccaatgagaatctgccgtttcaatacgtcccattgttcataatagcctgacatccttgtgctgcttcctgctctgtaagcttatttgttatttaattcattcaattagttgaaattgttccttgtcgcactggcagatcgatccatgttgtagaatgatccaggaacccttctagtctgtttatgttttgggaccatttcatgtttatgtgttcggtattagggcatttggattttggagtgaaattctgtgatgataaaaaaaaaggggggcccggtaccca

SEQ ID NO: 8936 - DNA, 546 bp, Zea mays
  Predicted polypeptide sequence is orthologous to G2140, G2765
acacgttgatcagagagtagctagaggaatataattctgttacatttcataaccctctctctcatgcactcacgcctttatgcagccaggcaacacgccggcatctcacctcccataggccacgcacacgttacatggagttcacccactccgggcccaacagcctctggttcaacttacgctcacgtgtacctctccttggcccagctggctcctctttctcctttgaacggcccacattgtccagtttagctcccgcgccttcaggttcagcagcttgtggcgccctgctggtaacatccccccggcgacgagaacctgcttgcccccaagcaggtgcattgggaaatgtttgcttcaatgtctcaagatcttcccaagttgccaacgacgatgacaatcctgaccacttgataagcccttgagccacaccactggtattcatccgacgttgtaacacttgtacagggatttgtagaccttggtggtgttggggagcaggctgcggagcttggcgaggtggccgttgatgcgctggcggcggct

SEQ ID NO: 8937 - DNA, 781 bp, Zea mays
  Predicted polypeptide sequence is orthologous to G2140, G2765
cagcgtggtgacctcggagccgacgacgctgagccgcagcagccgcagcgcgtgcctgacgtccgcgaacacgtctgcgccgtcgtcgcagctgagcgtcgccctgacgaggacgccgcctccggccgacggcggcgccgcgccgccatggaccagctcgacgacgacgtcgtccgcgtcggccgggacggcggcgcagcggtctcggatgtgcgccgcggtggacttgagcttcttcacgtgggttatcacctcagccaacaccgcggccttgtccatctgcatgcagatgccaggcacagagttgggcctcagatttgagttgggctcggtatgggctatgctatctggcaataaaggttagaaattgggcctagctagagccagatattgttgggcctttcctctactgggcttcggcccagtttcaacgctgagtcggtgaccaagtttgctgcagtgccaagccgcgtcatcctcgccggcagtggaccggtagcccgagcccggcgcgctggtgcaaccgaccccccgccgccaccgcgtcggcgccttgtcggagcagggcaccatggtccggagcgtggcgaggtgcgcgttgatcctctccctccggcgccgctccgcctcgctgtggctcttgagcgccatcgccgccttgtcgtcctggaggtggtctcccttcctcctcgtcgcctcctccgcggaggccgcggcgtcgaccagcggcacgctgccgtccaagatggcaggcgacgtcgacgacgctcccgctcccgct

SEQ ID NO: 8938 - DNA, 618 bp, Zea mays
  Predicted polypeptide sequence is orthologous to G2140, G2765
ttttttttttttttttttgagattaacttctttccaattttacttccagtatttcgcctacttttactaatactcactaaaccagccgaatttctacaaaaatcaggactgcgaaaaaccaagaagattaatgctggtaaaatattgtttcagtctttcacaaagtgtgtgtgccagatgattcattcacacaagtgatgaagtgaatcattgagggtggaaggatcacacaccgacctgcctggtatcaggaaccatcctcctgagcgtagccagatgagcgttgatcctctcccggcgccgccgctcggcctcgctgtggactttcagggccctcgcctccgtcgcactcctccccgaccccgacgacgacgacatgtccggcggcggcgctacccgcacggccggtggagcggcgctttcctgctgccggggcagaagaactggactacccccggccccgagcgctgaagggtcacggccatcgtatggctgcagctcctgcttcccttgcagaggttggcgcgcagccattgaaccaggcatcatcctcacctgcagtgcaggttcgtttcactgcatgcaaacaaagagaccggaccgttgaaagaatacctg

SEQ ID NO: 8939 - DNA, 813 bp, Zea mays
  Predicted polypeptide sequence is orthologous to G2140, G2765
ggaagccacaccttggccagcttcgttcgccagtccagcaccagcaccagcagcaccaccaccaacctcggagctagccaagaccggccggaagctagggctagccatgtgggacggaggcgtcgagcacgggagccaggaggccgcgcaccagctgctcccgtggctcggcgcggcgcccttctccgagccggcggccgtggcgggcctcggcgccgccatgggggcctacgcctgcgacggcgtcggcgggctcgggcatggcggggtgttcggcttcggtttcgacgccgcggtgcagcagcagcagcagcagcagcgcgcggcggacgggagcggcaaggcggtggtggtgtccgggctgctggggagcctgcaggcggagctggggcggatgacggcacgggagatgatggacgccaaggcgctggcggcctcgcgcagccacagcgaggccgagcgccgccgccggcagcggatcaacggccacctcgccaggctcaggagccttctccccaacaccaccaagacggacaaagcgtcgctgctggccgaggtgctggaccacgtgaaggagctgaagcgccagacctcggcgatgatggcggccaccgacgccgacgccgacgccgacgacgaaggcgccgggcggacgcaggcgcaggcgcaggcgcagctgctgccgacggaggccgacgagctgtgcgtggacgcgggggccgacggcgccggccggctcgtggtgcgcgcgtcgctctgctgcgaggaccgcccggacctcatcccggacatcgtctgcgcgctggccgccct

SEQ ID NO: 8940 - DNA, 803 bp, Zea mays
  Predicted polypeptide sequence is orthologous to G2140, G2765
agcgcgtgcctgacgtccgcgaacacgtctgcgccgtcgtcgcagctgagcgtcgccctgacgaggacgccgcctccggccgacggcggcgccgcgccgccatggaccagctcgacgacgacgtcgtccgcgtcggccgggacggcggcgcagcggtctcggatgtgcgccgcggtggacttgagcttcttcacgtgggttatcacctcagccaacaccgcggccttgtccatcttgtcggagcagggcaccatggtccggagcgtggcgaggtgcgcgttgatcctctccctccggcgccgctccgcctcgctgtggctcttgagcgccatcgccgccttgtcgtcctggaggtggtctcccttcctcctcgtcgcctcctccgcggaggccgcggcgtcgaccagcggcacgctgccgtccaagatggcaggcgacgtcgacgacgctcccgctcccgctcccagctggctagcaagcagcccgtagtcaccaccatgtccatggctaccgccgtagaacccgtcgaggagcccggcgtcggcgaaggggacggagcctatgtcgtccatttcgtcgtggaaagcttcgaggccgacggcgacgatccacgaggcacaagaacataacagcgcagcagctgccaactagtgcttcgtggcctcgtgggagcactgtatatataacgaattactcggcaggtgccaagcaggcaagagctgttgccttttccgatggaaacaggggctcggggcagggacagggcagctcttgcatccagcaagttgcaggcacaacgggcc

SEQ ID NO: 8941 - DNA, 707 bp, Zea mays
  Predicted polypeptide sequence is orthologous to G2140, G2765
gatcgagagctagccagacgtgtgagctagctagcttgttggctgttgccgtgttcgcagcttcgcacgtactcgcgacttcgcaagccatcggcttcccgcctctcttcctttcaaaaaaaaagaaagaaacagctaaaggctcaagcaacacggtggcgcctgtcgggattgacgaagcagcggaggtggcgatggaccgggagtgctcaccgctggcagcaacgacgcggagcgggacgggcagaagccacagcgaggcggagcggaagcggcggcagcgcatcaacgcccacctcgccacgctccgcaccctcctccctgcggcgtcgcgggtacgtaagactgacgtcacgtccttgctcttcaggagctgaccgaacgtggaagttcatcatcgaactcgatagcgaacacggttacgtacgtgtgcgtgtaccaattaatcatgcacatggacaaggcggcgctgctaggggaggtggtgcggcacgtgcgggagctgcggggcgaggcggacgccgcggcggcgggcgcggcagtggccgtcccgggggaaggagacgaggtcggcgtcgaggagggccatcatcaccgcttctgccacggcggggagagggccgccaggagcgtcaggacgtgggtgtgctgcttcgaccgcccggggctcaatgtccgagatgggccgcgccgggcggtccgccagc

SEQ ID NO: 8942 - DNA, 1091 bp, Zea mays
  Predicted polypeptide sequence is orthologous to G2141
ccacgcgtccgcaaggcagtgatgctggacgaaatcataaactacgtgcagtccctgcaacggcaagtcgagttcctgtccatgaaactggccaccgtgaacccgcagctggacttcaacagcctgcccaacctcctcctccctaaagacgtgagggggacacgcacgcataacatgatcgctcgcttcgcattactacgtttggttcctagctcacacgagtcatattccattcctgtctgtctgtctgtgatcagatacaccagccctgtgggccgccgcatttcccgctggagacctcaggcgctccgctgccgtacctgagccagcctcaccatgggagccctctaggctgctgcatggacacccaggggggctctatgcacccgctcgacgcggcgttctgccggccgatgaaccctcagcatcctttcctcaacggtgctagcgacgcggcgtctcaggtcgggactttctggcaagacgaccttcaaagcgtggttcacatggacatcggccaaagccaggagatcgctcccacctcttccaacagctacaacggttcattgcagacagtccacatgaaaatggagctttgaggcatggccggggaaaaagaaagaaagaaaaccccagtccgaagctcgacgccgtcgtcccccctgtacatacggagaagagaggacacagctcgcaccggaagcagcgggctcttggggggtccaatccaacctaacgacgttggcccctagcagtgtttcagcctctaattttccccacccccgcccaatggtgtgacgattctttctttgaacaagatgcggaagaccgccgcgccggcagctgctcgcaccatccccgtcgcctgtttcgtttcagctttagcaagatcccgccggcgcggtgcgtcccagactctcccccagtatattccttcccgatcagagaccccccgcacgtaatgtcatttgtattgccgtcatatttgtagctgatatatatatagtgtatatttaagatcgccatttctcgtcaaaaaaaaaaaaaaaaagaaagaaaaaaactcgagggggggcccggtacccaattcg

SEQ ID NO: 8943 - DNA, 780 bp, Zea mays
  Predicted polypeptide sequence is orthologous to G2141
cttagcagcaggctcttgcgtccgtcttgcccttttgcttccgcctcctgcccttaaaatctttcaccaccccctcccgtcgcggtcaaattggcgatcctcgtttggggagggccaagaaaccagagctctctctccgatgcccaccaacgtcaggtgattgaggaacgttggtgtttctggataattggagatgtactcaggccagcaatctgatcaaggtcctagtgcaaatagtggcagagaattctccgaggcaaattggaattcttacacaatgcatcaaaagatagcttatagtggacaacatgggtttggaccttacggcatgggcttagaagataggctggggttgtatcaatcttcatctggtacattaagtcatgacatccaaatgagtgatgagcatagcggaggtgtgaagaagaggaaaggagtggaggactgtgtcacattgttgcctaatgcaggtgatcaacaaacagaaggttcatctcagccagaaaggaattcaatggaggaggggaacagaaagatttcgcccaaaatacaaagcaaggaagattcttctgatggtgatggtactaaagaggactatgttcatatccgggcaaagcgaggtcaagccactaacagccacagcctcgcagaaagactgaggagaaaaaagataagtgagagaatgaagcttcttcaagatcttgttcctggatgcagtaagatcactggcaaggcagtcatgctcgatgagattatcaactatgtacagtcattgcaacg

SEQ ID NO: 8944 - DNA, 881 bp, Zea mays
  Predicted polypeptide sequence is orthologous to G2141
aaaaaaaagcattggaaactactaacaaaacaaggctcctcgcgttgcatcacatcctgcagcagctcatttggtcgctgtgccaagtgccaacacgcagcccactgttactgcactgcgcgccatgccatgaatgcacgcgaccgccgaaacagacagaatttccagccatctatccaggcaacgccacaggccagcgccacgagcttttcctcagttccttctgaacacgataaaaaaacctgaccgatgcagcagcacaggcacagccgtgggtcgacgcggttcaaggcgtcgcgctgagcaggcgctgctgctcccggcaccagcaggcagctatacgcggccccctgcgcgcccgcacgttcgccgatcagatactcctcagatggaagaagccctttttttgcatcttttactagtatgtgcagctgggcatgttcagtcacatttgaaacccgtcctgcgacggcccgatgctcaggtcctgggacgacgggtacgccatctgctgctgcgcgacgtcactgaatgccccattcaatgcgtggggcggcatctgagacccgtcctttgcgcttaactgtgcctgcatgattctcctgaacacgtccggattggccatgccggcagcgccgccctggatcaggcctggctgcgagagctgcagctgtgggtgcatcatttccggggagaatccaagggaagacgaaggaacgccagggaagcggagaagatctttcgatagaagcccttctatgttgaggtcgagccttgggtttaccgttgcgagcttcattgataaaaactcgacttgtctttgcagggactggacatagttgaagatctcgtcaagcatcaccgccttcccagtgactttg

SEQ ID NO: 8945 - DNA, 871 bp, Zea mays
  misc_feature (5)..(5): n is a, c, g, or t
  misc_feature (8)..(8): n is a, c, g, or t
  misc_feature (14)..(15): n is a, c, g, or t
  misc_feature (22)..(22): n is a, c, g, or t
  misc_feature (505)..(505): n is a, c, g, or t
  misc_feature (695)..(695): n is a, c, g, or t
  misc_feature (717)..(717): n is a, c, g, or t
  misc_feature (767)..(767): n is a, c, g, or t
  misc_feature (808)..(808): n is a, c, g, or t
  misc_feature (863)..(863): n is a, c, g, or t
  Predicted polypeptide sequence is orthologous to G2142
cccgnacnccacgnncgtccgnaaaaatgccttccatgggtcaaatatgtattttcgatcattctggaaaaagcacagagtaaaggccaaatcccaggagattccccacctgacccttcacatttcgtgagaaatggatcctcccctggatctaatttcactgggaaactcgatgataatcacacatctgcagctgcatcaggggcactggaccaggcagaaactaatcacgtggctagcggctgctacaaatcagcagaaactccggcgaatattacaaataatgctatatctcagtcccaacctcaacggacaggtccgtcccctgtggatgactctgcagtgaaaagtgaaatgcttaacagccaggagttggcaatagatgaaggaatgatcagtgtgtccagtacctattcccaagagttacttaagtcgttgtctcacgcccttcagagctcaggtgtagatctgtcccaaaccagcatctctgtgcagatcaacctgngaaagcgtgctggcaagcgatctgctgctggtgtgtcctccaactccaaggaaccaccaccagccgatccagcatctagtaacgaactaggcggccatcacctgacaacgttgggagctagcgctgacggtctcccccacgcgacgaagcggcataaacggggcaacagctgatgatgggccatcaccanacgacagacggattgatcattncttttttttttgggttctcccagcccacgggaggctctctcttggatggntgacatcgcgtgctcgtgacgggctgaaaccccgctgattnctttttgattgatcgctcccgccacatcccctgtctagcccatggttttacgtanaggacgaa

SEQ ID NO: 8946 - DNA, 847 bp, Zea mays
  Predicted polypeptide sequence is orthologous to G2142
ctccaccaccaccagcagggcaccagcagcagtgggcgctccccttcgccggcgccgggcaggtcaggctgccgccgcagcaggcgcctccggatagaaagggccggggcggcgccggtggcggcgtcatggagtctggctccagatccagcggcggggcggggttcgacgacgacgacggcctcacgacgcgccgcgaggtctcctcttcgctccaagatttgacagtaagggtggaccggaagggtgggagctgcagcgatggtggtacggatcagcggccaaacacaccgcggtcaaaacactcggccacagagcagcgcagacgcagcaagatcaatgataggtttcagatacttagggagctgttgccacacagtgatcaaaagagagacaaagcaacatttctcttggaggttattgaatatatacggtttttgcaagagaaggtgcaaaaatatgaggcaacatttccagaatggaaccaagaaaatgcaaagatgcttccatggtcaaatatgtattttcgatcattctggaaaaatgcacagagtaaaggccaaatctcaggagattccccgcctgacccttcacatttcatgagaaatggatcctcccctggatctaatttcactgggaaacttgatgataatcacaacatagtgacatctgcagctgcatcaggggcacaggatcaggtagaaaccgaccacatggctagcggatgctacagatcagcagaaactacggcgaatttttacaataatgctatgtctcagtcccaactctcatggactggtccgtcccctgtggatgactctgcagtgaacagtgagacgcttaacaa

SEQ ID NO: 8947 - DNA, 853 bp, Zea mays
  Predicted polypeptide sequence is orthologous to G2144
cccgtgtcctcctcccctcgttccctcgtcccggacgcctccgccgcgccgatgcgccccgcctcgccgccgcaggagctccccgccgccgggggcgagatccaggcggcgctggcccctgccaatgcctccaccgcgggcgcccgcggaggcggaggctccttcacggcgctgctgggactccccacctcgcaggccatggagctgctcctcccccgcacgacgccccccgccctagccacagcgcccgcgccaaccttcccctccgacccgcacctcgtggaccgcgccgcgcgcttatccacgttcgcgcccccgtccccgtccccatcctccacgtccccggcccggcccctccccgccgccgctaacgccggcaagcgcaaggccgaccccgtcgaccgtgcctccaaggggaaggcggcgaagaaggggaagacggcggaggagaagctcgcgggcggcgacggcgacgacgagaagccggcgtacgtgcacgtgcgggccaggcggggccaggccacggacagccacagcctcgccgagcgggcgagacgcgagaagatcaatgcgaggatggagctgctcaaggagctggtccccggctgcagtaaggtatcaggaacagcattggtgctagatgagatcatcaatcatgttcagtctctccaaaggcaagttgagtacttgtcaatgaggctcgcagctgtaaacccaagggtcgattttggtgggctagacagctttctgaccacagagtgtggaaggatagcaggcttcaactgcaagaacggaatcgacttggagcaggtaacctggccagaaatgggtgttcatggagcaaggcagctga

SEQ ID NO: 8948 - DNA, 635 bp, Zea mays
  Predicted polypeptide sequence is orthologous to G2146
gcggccgcccgcacgtctgttagtgcgcgcttggcgctgacctgcatctgcagcgcggccacgtagtcggcggcctcctccagcagcgcgggcgtgggtagcttccggcagcccgggacgaggcggcccagcacgcggagccgctcctgcaccttaccctccttaccctttagcgccgccgccttgtctctggcctgcaccggcggaggcgggcggcgccgccgccggaccttgccgcccgccttgacgagcacgcggcggcggctgcaggccgcgccggcgagcaggatggcgcggctccaccgcgtctggccgcgcgcggtcagcgccagcgccgagtcggccgccgccttcacggcgcgcggctggccgccgcccgtggcgcggagcgcgtccagcaggcgccgcccgtacaccccgcgcaccgcgccgctgcgccacttgctggcccgactcggcggcgtcgcggagccgccctggacgtccgggacgacgacggcgacggacagggcgaggagatcatcgccgcgcgacttgccagcctggccgccccccgccgcccgatcaagatggggcaagggatttggggagggagggaaagggtcgagcacggggcgatctacccgtaccgattg

SEQ ID NO: 8949 - DNA, 603 bp, Zea mays
  Predicted polypeptide sequence is orthologous to G2146
acactgtgacataaagtatcaattaaattggtagaaaattttgtagagaatatgaaaggaaacaaaactgctgggagcgcaaagaatgatacacacatgacgtgactacggacgactcgctatacatataaacagaggtcgatcgatctatacatgacatgcatgcttatatactcagcaaataccacgtatcatcggctgtagacgactcgtacggccacacaaatcacatagctggagctgaggcccagcactagctagggatggctagtggtgtcaccgtcgtgatggccgtcgccgccaccaatcccgccatggttagtcgcggcgatgagctccgacagcgccctaagaagctcgaccctcgcccggagacgcacgatgtagtcggcggtacggaggagcaggcgctcggcaggcatcgccgcggcgccgggcaccagccgccggagctcgcgaactttccgccccaaagccatctccccaagccgccgccggcggcttccgtggcacggcgaccgacgcctccttccctccatgtatctggcaacggcgagtgccagaagaagatcgatcgtgcgtacgcgacgaccccaacacaat

SEQ ID NO: 8950 - DNA, 289 bp, Zea mays
  Predicted polypeptide sequence is orthologous to G2147
ctgcgtcgacttctaccgcaactcaaaggaataggataggattaggagggggaggggggtctataacaccaccggttccattatattggccaagacgggagaaggtcgtcaatgcaattgcacccagcgtctgtctcgcccacaggaatgtaggccaggccgatattctattttaaacattttccagtagcctagtaaggacttgttcggttagttctcaaaacatgtggattgagtgagattaggtgagtttgaatctcaaaaaaaaaaaaaaaaaaaaaaaaaaaaa

SEQ ID NO: 8951 - DNA, 727 bp, Zea mays
  Predicted polypeptide sequence is orthologous to G2150
aggtaccggtccggaattcccgggtcgacccacgcgtccgcgtgaaggttaccgggaaggccgtgatgctggacgagatcataaactacgtacagtcgctgcagtgccaggtggagttcctgtcgatgaagctgtcgacggtcgacccgcgccgggagctcgacgtgggctgcttcgtcgtccccaaagacgacgtaacgatgcaggccaacaggctgtgcgcgcccgcgacgtcgtcgtcgagctcagccttctgctacgccgcgcggagtgttgttacgaacgccaaaggattcgagacgccgctgcccttggcgaaccatggcgtcgcggcggacgacaggccacttgagcggcggactcgagacgcaggtccccaggcggggagcttgtgggaagaggacgatctgcagagcctggtcctgatgggattccggggccgttgatcgttgacgctctgattaggctaggccgctagggacgacagttcgtttccaccgaccgccaaccaaagcgagagttgcagggccacgtaacagcagggttgggctccaatcattgggaactctccatgattgtacacagacaggacgcttacacgctaatttccagctcggcggaggccaagaaacgaaacaaaaaaaaaaggcgaaaagaagatgtttttttctcgcattccccctcacgaatttgcagtttaatcgatgtaagataactcaatgtaatt

SEQ ID NO: 8952 - DNA, 808 bp, Zea mays
  Predicted polypeptide sequence is orthologous to G2150
gccctcttcccacaagctcctcccccccatctgaaattcacggcaggtttctcacctcttcgcccttgacgcgtcacgcgtccacagttttggagtggatcgatcgcacagctagcgatacgatcgagatggacgaacttggcaaataagcttgctgtacgtacgtacgtacctggggactcgcgttctcatcagcaggtccttcgagtggccgccgctccgcggtgccggcgtggttcacggtggccgccgacgaaggaggagccatttcgaaggctttggcgtccgacgcagcaacgcccagccgcgcggcggtgccgggagctgggggcgtggtggtgtagcagaacgccgggctcgagccctcgagcgcgtggtaggctgctggcagtggcagtggctgctgtgccatggagatggaggacgtcgcggcggcgcacatcttgttggcctgcaatccgttacgcatatagttctcaagaaatgggcaacgcgatcaaaaaggaagatcatccactacttcatttcatttcgagtggtggtggtgaggaggagtaggaggaggaggaaattacgtacgtcgtctctggggacgaagctgtcgtccgcgccgagttcgaggcgcgggttgacggtcgacagcttcatcgacaagaactgtcgcgaaatcaagaaccgtcttgctcagattcagaagctacagctcgtactttgttttacaagagagttctttaatgtctgatacagaggagacagactctacgcacctctactttgcgttgcagcgactgcacgtagtttatgatct

SEQ ID NO: 8953 - DNA, 580 bp, Zea mays
  Predicted polypeptide sequence is orthologous to G2192
ttttttttttttttttttttttttttttttgggagatgctcctatttctatttgtaagtatttatgacttcagtttttggacatggatacatgtagagaaactagagacagacacatgccagtagtgaaagcttttacagatggttggaccaaacatcggttgagctctgcagttctatttcctgtgactaatctgagctgccacaggagctcccatggacctcagctacctcgggcaccattagcctgaccaccggttgagccgtcccggagccagacgacgctgacgcgcctgacaacgccgggatgacgtcgaggcactcctggaaggcggggtcgcaagacaagagcacccactcgttggcatcgtccaggtacttgacgtcgaactcgccgggcgccagccccagcctcatggccacctcccccttcaccggcgcgacgcctgcggagctcggcaccctgaacctgacgatgtcccctttgtagctcgccttgacagggaccacgctggcgtccccgccgggcaaaggcttgggccatgcggccttcttcaaagggggggggggggcttggcatg

SEQ ID NO: 8954 - DNA, 769 bp, Zea mays
  misc_feature (7)..(18): n is a, c, g, or t
  misc_feature (469)..(473): n is a, c, g, or t
  Predicted polypeptide sequence is orthologous to G2192
catgtannnnnnnnnnnntaaaatacaatgatacatttatcaaacacaatgaaacagctaaagctaactagcaacaaaactaccaagtggaactgaactttcgagtctacattgatcaaagcaaaaggctgacacgcatatcaaccagagcttccacaagaactgccaaagtgggctgcaatatcgctaaccagtagcctaatgacatggctgccagaaagccgcgagatctccatgcattcttccaagtctgcattgcacgccaactttacccactcatggtcatcatcgagatacttgatatcgaacgtgccaacatccatccttagcctcttcgctacctcctctttcaatacaataacaccacctgagcatgggaaacggaacctcacaatatcttccttaaaactcgcctttatcgttacagtccctgaatgcttcattgacaccaagttgttgggaggggccnnnnntggttggtccgatgttgaagtgaagagattcttcaaatctttggagctaccagaatcttcaatcagcatccttgaaagtggtagttgtggttcttggaaaggttctttgttgaactcctcttgattaagttgaggttctgcgaacattgaagcgattggcttacaaacaaatgtttggttcgctggacttccctggcatgagccttccgaagtgcgtgaatttatgctgccttctccagatgaacttctcgagtgagaagctttgtcagcttcaagctgcacgtcattgttattgt

SEQ ID NO: 8955 - DNA, 668 bp, Zea mays
  Predicted polypeptide sequence is orthologous to G2192
tacagaccataacaatgacacacagcttgaagctgacaaggcgtctcactcgagaagttcgtctggagaaggcagcataaattcacgcacttcggaaggctcatgccagagaagtccagcgaaccagacatttgtttgcaagccaattgcttcaacattcgcagaacctcaacttaatccagaggagttcaataaagagcctttccaagaaccacaactaccactttccaggatgctcattgaagattctggtagctccaaagatttgaagaatctcttcacttcaacatctgaccaaccatttttggcccctcccaataatttggtgccaatgaagcattcagggtctgtaacgataaaggcgagttttaaagaagatattgtgaggttccgtttctcatgctcaggcagtgttattgtattgaaagaggaggtagcgaaaaggctaaggatggatgttggcacgtttgatatcaagtatctagatgatgaccatgaatgggtaaagttgacgtgtaattcagacttggaagaatgcatggagatctcacggctttcgggtagccatgtcatcaggttatctgttagcgatattgcgacacactttggcagttcttggggaagctccggttgatatgcctgtcagccttttgctctgatcaatgggt

SEQ ID NO: 8956 - DNA, 1013 bp, Zea mays
  Predicted polypeptide sequence is orthologous to G2192
acccacgcgtccgctggagtcatcgccgccgggccggtcgcggtcggatccccccgctccgcctcctctccttcgattcgttgcttcccgcttcaaatccaagccaccaccctttccttcccatggcttccgacgccccggcggagcaaccggcgacgcagcagaagcccaccagggtctcgctgtcctatgaggagatctccaagctcttctccctccccatcgctgaggcggcctccatcctcggagtctgcaccagtgtcttgaagaggatctgccgcacccacgggattgttaggtggccatatcgtaagcttgtttctgggaaagctggggatgacacaaaaggtcctgatagcgacaaagccaacgaactccttgaggtatcaaaaatcgcgaaacaaaaggctcccagtgcatcaggcccatcagtagtgtcatcaagcacttcccaaggagcggcaaagtctcaacagggcaattctaaggcaggacagttttcagtttcgccaccaacaggtaaacataacgcatcactaagtttgacccatagccaagccaaggccatcccttgctatatggatgatttcaagtacggattcccgtcatctggcttgtcttgtgaaactatgaaatggtggggcacaagcagcgacacagactatgtgcctaccaaagatggaagccatgaaccccatgaatcaacaacacatgagccatcaaagggcatgactgatgatgacgagttggactggggagcagatgaagcggaagctgaagctgatggcactgttacggcagaggcatcggcacagctgtgctcgctgagaaggaaagcagtagatgacgggcgcaaactattgaatggtcacaaccgcaggggccaagaattctctaggctgaacaaaaggcagaagacagcgctagcccaggtatttggggcttcactgccagaatgttgtattactcgtgtctagtgagtgaagaacaactgtagctgtgttttccctcct

SEQ ID NO: 8957 - DNA, 188 bp, Zea mays
  Predicted polypeptide sequence is orthologous to G2192
acaccaactcaagtaaccttgtgattagtttgtttaatttacatgcaccaccattttcaagctgcaactaaaaaatacaagcggaccatgtggactccataaagatgtcatgaatttcacaggtacaacgttcaaacacctctttttcagcattttgtgtgtgtgtgggggggggggggggggggggg

SEQ ID NO: 8958 - DNA, 1037 bp, Zea mays
  misc_feature (618)..(618): n is a, c, g, or t
  misc_feature (810)..(810): n is a, c, g, or t
  Predicted polypeptide sequence is orthologous to G2226
cccgggctgcaggtcgagacggagtcggtggtgcagcggctcccctgcggccacctcttccaccgcgcatgcctcgagacctggatcgactacgaccacgccacctgcccgctgtgccgccaccgcctcctgccccccgccgctgccgccgacgaggtgccccggattgcctgattagcgccctaggaattgagagtaggcgtagcactctgcacctcgcagcagcagtgtctctgtacaggttttttttttcttttcctttttgttcgggggagagagaggacagaacggagattgaaggaagaaaatggtggcaacaaagctgttcccctttcgtttcaaaaaaaaaaaattatatattgtacaccgacttgagcaaaactcaaaattgtctttgggcttgtgctggggtggacgcaaaaaccactatcttgctgtgaataagggattctataatagtggcacgactagattaccctttcgtatgtggttgctttatttgtgattgtacacgcattgatgtttttaaaagaatttttgggggggaaagtaagaaaagataatcaaaggggtcactttaataagctcttttgtttggctttgattaaaaaacatcanaaaagtctggtggacagcggcgttgggtcttttttagtgccggaaattttctttatccactccaaaccgaaggagagtggatttttggaaaccaagtttattaaaatttttattgttatgaccatttttttttataggtccccacgggatttgtttaatatggggcggtgcgtggtttttaattatacaaanaagggggtgcacgcccaaaaactggtagttctccacaaatttctcgaaacctcaagtatgtgtccgaacctccttctttttattggaatccattctgggtcacaattttgggggtggcgtgggttttatggaaacgtctttctgactggaaatattttgaccgtgttaaaggacagacctttctggtttgtaaaacccaatctccttaataaaaaaacttggtattt

SEQ ID NO: 8959 - DNA, 606 bp, Zea mays
  Predicted polypeptide sequence is orthologous to G2227
ccgtcccgtcccctcccctcccctcccctccgctcccgtcgtctaccctcactcgaaactccgaatcgaaaccggcggagttcaatttggggatttcggcacctcgttccccgaaattttctggatctgagtctgtcggccgttctcgatttgcgtctggagtgtgcctgcgagttttcaggctcgatttggtcggggcctcgggggtcccggtcttttcgatttcggggatggactcgtctccggtgtcctattggtgctacagctgcagccgcttcgtgagggtatctccgtcaactgtcgtctgcccggagtgtgatggcggcttcctagagcagtttacgcagccgccgccccgcggcggcggtgggagcggccggcgcgggacgatgaacccggtcatcgtgctccgcggcggatcgctttcagggttcgagctctactacgacgacggcgcgggcgaagggctgcggccgctgcccggtgacgtccagcacctcctcatggggtccggtttccaccgcctgctcgaccagttctcgcggttggaggccgcggctccgcgtcccaccggcgtcgaaggctgcggtggagtccatgccatcg

SEQ ID NO: 8960 - DNA, 1431 bp, Zea mays
  misc_feature (416)..(416): n is a, c, g, or t
  Predicted polypeptide sequence is orthologous to G2227
ggcacgaggccctgtcgtcgtctcccctcacccgaagccccgattcgaaaccggcggcgttcgatttggggatttcggcgtctcgctccccggaatttcttggatctgagtctgtccgccgtcttcgatttgcggctgcagtgagcctgcgagttttccggctctgatttgggcggggtcttcgatttcggggatggcgtcgtctccggtgtcctactggtgctacagctgcagccgcttcgtgagggtatctccgtccaccgtcgtctgcccggagtgcgatggcggcttcctggagcagtttacgcagccgccgccgcgcggcggcggcgggagcggccggcgcgggacgatgaacccggtcatcgtgctccgcggcggatcgctttccgggttcgagctctactacgacgacngcgcgggcgaagggctgcggccgctgcccggtgacgtccagcacctcctcatggggtccggtttccaccgcctgctcgaccagttctcgcggctggaggcggcggctccgcgtccgccggcgtcaaaggctgcggtggagtccatgccgtcggtgacggtcgccggaggtggtgctcactgtgccgtgtgccaggaggcttttgagcctggcgccgccggccgggagatgccgtgcaagcacgtctaccaccaggactgcatccttccctggctctcgctccgcaactcctgccccgtctgccgccaagagcttccggccgcagccaccccagatgcggaggcggatgctggcctcaccatatggcgactaccacgcggtggattcgccgtagggaggttcgccggagggcctagagagcagctcccggtcgtctacactgagctggacggcggcttcagtaacggagttgggccgaggcgggtgacgtggccagagggagatggccaagtggatggcggtgaaggtcggattcgccgcctacttaggaatctatttggctgttttggtcatggcagctggccagctagttcatcgcagtcccgtagtggctgagcacagttttccttggtaacaagttttcaattgatagtgaagaactagggctagtgtaagaatggaacccagattataatttcttggggcttttgatgtaaatgaaggcctagcattccccccttcctttgtctcatttaagaattattaagagatgactgtgagcaaacatcttggagcgagctttgcaaccaaattaggccaaacacaagtgcaagccttcaagaaaggaatagcaatgagtgttttggggaaataaatctttttcaatattttaggtagagagaacaattgttgtatttgcaaacccactgttcgtgtacatactggattggttgaacatgaattcccattctgctatgtgctatatcttatattgacaaaaaaaaaaaaaaaaaaaa

SEQ ID NO: 8961 - DNA, 924 bp, Zea mays
  Predicted polypeptide sequence is orthologous to G2239
gccgtctccgcccaaaccctagccccggcacccgggggacgacgccatgtacgccgccgccgtgttggcagcggtctctgcggtatccgtcgttgcggcgcagtccccggagccgcgcgacaaccaaacggtcgccgacgtgatgagcatctctatattcatggccgtattcttccccgtcttcgtcgtgcttcttgccttcgcctgcctccacttgttccgggcccccgacgacgacgacccccaggctccggacgcggcgtcggcaccggagtggccccgcggagggggcagccgcaagggagggctcgatgccgccgcgatcgctgcgctgccgctagtgttcttccgagaggtgagacagcaccggatcgtggacgggcgcgaggacgcgctcgagtgctcggtctgcctcctcgagttcgacgacgacgacgccctccgcctcctcccgacgtgcccgcacgcgttccacccggagtgcatcggcctctggctcgagaggcacgccacctgcccgctttgccgcgccagcgtcctcgacgacgcgccaccagccccggcagcgcagctggagcttcatacggcgccaccgctgacgccggactcgtcgcccgttcacgcggctatcgtgctaatcggcggcgccggcgcaagcgaggtaggcgaagaagaggaccggactacgatccagcgcctcgcgaggaaccgccgcgcggcggggcggcaggcgctgccgcggtccaactcgacgggccacagcgccagcgacggcgggatggagcggttcgcgctgcggctcccggagcacgtgcgccttgagctcctcatgtcccacaggctgaggcacgtgacgagcgcggtagcatccgtgcgcgtcatggagggtagcgcccacgacaccagtacggtgggcgggagcgt

SEQ ID NO: 8962 - DNA, 771 bp, Zea mays
  Predicted polypeptide sequence is orthologous to G2251
ccatacatatcactctccgctccgccattgttgctccttattagtagttcgtcccgcgtcccttgacagttctatctatccccaccacaaataagagaccacctctctgccttcttctcggaggtcggagaagagctctctgcttcattcggccggtccaactccaccgaccgatccaatccaacccactgaccatggggttcccgccggtgtgctgctgcgcccccatccccaagccggtcgtcgccttctgcaacctgctcggcgccatcaaggacgccgtcctgctgacgctcgccgccgtgggcttcccgcacgacgccgcgcgcggctcggcggacgcccaccagcccgaggaggtgaagacccggctccccgccgtggagtacgcccagctcctggccgagcagcagccgtcgcccgccacccacgcggcctgcatcgtttgcctggacacgctggaggcggcggacgaggtgcggcggctgggcaactgcgcgcacgccttccaccgggcctgcatcgaccgttggatcgacctaggccggacgacgtgcccgctgtgccgctccgacctcctgcccagcccccggggccgggccgggctgctcgggctgggccggctcgccagccgtctcacgcgcgttcgcgtttggtgaggaccgtctcggaggccacttttaccttttcggtggccaggccgcggtcgcagcccatcccggtggggccggaacggcgcggacacgttagcgaccgcgaccgggccgcccg

SEQ ID NO: 8963 - DNA, 710 bp, Zea mays
  Predicted polypeptide sequence is orthologous to G2251
tttttttttttttttggaaaaaaaactgattacgtagtatgggtaaacatctctagactacactacagcaatgtgatctgaactctgaaaccctccaatacaagcgcgtcgccgtcttcagagacagcagcaggatgagatggccaccaaggtcactcaagggatacatcagccgaccaagaaggatccagaattaggttctgctgatcatcatccgcgggccgcggcgagcaaaagcagggtccatgattgaatgccaagtccactcagaatccttggcgtccttttttttgttacgttctcggcatcaccaacaacaaattatggacctggaccaccgtggaaccgaagatcccctttccgttacgctccccctccccaaaaggctaatcacttcgatacaggcgctgaagctacagcaaagaacacacgcatcgtacacacacacactagacaacacctgatggatggatccatgaccatggcgcgcctcaaagtgggaattattgcgcctaaaacagaacgctgtggtggctggcgaccagttgatgacgcagagggccacactgcaggccgtggtcctgcgaatcgtccatcctgtaaacagccggcaccacggaggtccggttcggtggcaggttcccagcgccgtgctggtgctgcttggcctcggccgccgccgccgacgagaagggcccgcctatcaccgc

SEQ ID NO: 8964 - DNA, 717 bp, Zea mays
  Predicted polypeptide sequence is orthologous to G2290
tttttttttttttttttttttttttgagagaggagcagctctcgctggatttactacctggtcgctacaacacagtctgcttgcaacctgcaatacaaccaacagtctctttccgactgcgcaaactacacacaggacctaaccaaatcctgacaccgaaacccaaatcaagcagctactggtcctgaacgaccaactctaaccagtacgcgtggtcactgtaaggcctacgactcctacgataatacaacatggatacagtttgatgcacactacgcatctcgtacgtggaaacggccagtcattgctatagctctagttaacctagctagggatcatgtgttgccccctttaattcgctataacacaatatcccctacgtcgctcttccttctctcgttgcgcttcgcagcacccttctctgtcctcgtcgaacgttgggtgcccttcgcttcgccggttgctctggtgtcgtacctgggcctttctcgaccgaatcaacgtctacagcagcggctgcagactcgactggttgggtgcttgcgggtggcacagcactgctcgagttggtgtagctagggttatcgtttcctgaagattctagcccggagttggcatttgattggtccacgagaccgtttactaatgttttcttggtcgtcgacccgttctttttgttctgggttggggggcccgcatcatttggtatggattctg

SEQ ID NO: 8965 - DNA, 859 bp, Zea mays
  Predicted polypeptide sequence is orthologous to G2290
gctaggaggtcgatctgatcgcatcggccggggtctgccgccctgcccatggccggcgccgccggtgacaggtcggaggaggacgtcggcgccgactggccgttcggtggcgtcgacgccttcacggagtactcatcctttttcgcggagcccggctggccgggcggcctagccggggaactcatcccggtgctggatctgcccgaggcagcagcaccgctgcccgcccaactgtccacggagccatcggaggagcctgcgcccgccaggtcgggggacgccggcgcgtcgtcgagctcgagcggggacggcgccgcgccggggaacggcgacggcgacgacgatcggaaggcggcgccggccgccgaggcagcgggtaggaaaccggcggcgaagaaggggcagaagcgggcgcggcagccgcggttcgcgttcatgaccaagaccgagctcgatcacctcgacgacggctatagatggaggaagtatggccagaaagctgtcaagaacagccctttcccaaggagttactacaggtgcaccaacagcaaatgcacagtgaagaagcgcgtggagaggtcctccgacgacccctccgtggtcatcaccacctacgagggccagcactgccacagcatcggtccattccagcgcggcggcggcggaggcgcagccgcggcgcggtaccacagcgcggcggccgtcgcgctggcggagcaaatgtattcgtcgtcgacgacgtcgtcgttcatcccagcagcgcggcagcagctcttcagcttgccgccgttgcacccgcagagctccccgccgtcctcggagacgacgccgccgccggtcgttagctcggtgactacta

SEQ ID NO: 8966 - DNA, 377 bp, Zea mays
  Predicted polypeptide sequence is orthologous to G2291
tgactgtgtttttttttttttgtattccctgcgtttagtcagctgagttcaaccatggtcacgcgctctgcaaagaccggcttcgccggcgacggaagcacgtccagccatgaccagcgctctgcaaagagaagtatgggtggctgatcgcaactcgcaagagaactgagaagcgatggccatcaagattgacagaagaagtcgtcaaccggcttcattggtcatcctccacaacgaaagaaagaaagcagaggatggtcagattgaaagaaaaaaaaacatgtgtgatggctgttgcacacccatatgtggccgtacctgtgctcgccgatccgaagcaacacgacgaaaaaaaaaaaaaaaaaaaaaaaaaaaaa

SEQ ID NO: 8967 - DNA, 364 bp, Zea mays
  Predicted polypeptide sequence is orthologous to G2291
cggccattatggcctcggcttggttttaaacgttagtaattgctacgaagtagcataatttatttggagcgcattctgtttttattgatgcctgactttagcaagcactccatatcttcatctatcttttttataagtttgacttcatgtgacttattttagaagcgtgagctcacaaactttctcttatttggtctctgtatgggggaattatattattttataatctctgttcgttcagtcagtcattgcgaactctcttctaatcgctcactttattgaccgtgttgtaccaacacatattgcacgaagtaaacaataacatcggttaccccaaaaaaaaaaaaaaaaaaaaaaaaaaaaa

SEQ ID NO: 8968 - DNA, 1426 bp, Zea mays
  Predicted polypeptide sequence is orthologous to G2311
gaagacatgggttagggtttccgcgtcggctagtttggacgcatggctgctgcaggagagtagagaccacagcgcgcgaggcgaggagaataagctatgggcgcgccgaagcagaaatggacgtcggaagaggaggatgcgctccgcgccggcgtgcgcaagcacggcgccggcaaatggcggaccatccagaaggaccccgagttcagcccggtcctctcctcccgctccaacatcgacctcaaggacaaatggaggaatttaagtttcagtgcaagtggactgggatcaagtaaactgcgggttccaaagataactggaccctcatcttccccatcatctagctcgcagcctctgcttctcccagcggcaaacaaatttactgaagctacactgcctgcagatgctgagaaaaagccacaggatgggaaaactctgccaaagtatggtgccatgatcatggaagctcttttggaattgaatgagccgaatggttcagatattgctgcaatcttcggcttcatagagcaaaggtatgcggtacaaccgaccttcagaagatttctagcctcaaagttacggcgacttgcagactcaaacaaaattgaaaagatcgataagtcctataggatcccagactcccttgcaacaaggactccagctccaatgaatgcttcagctccaaaacagaaggatccatcaaagccatcgaaggtgtcaaaggccataggattgttttctgcctccagccctgcactagaggctgcgatggcagctgctgtcaaggtggctgacgcggaggcaaaagcacatgatgcgcatgatcagacgatggaggcagaaaggatcttcaagatggccgaggataccgagtctctcctcataattgcagcagagatctatgatcgatgttcaaggggagagataaccacgttagttccagtggcacaaagggagatttgagatctattggagtctctcttgtgttgtttgttgtacatggataggttctggaatccagtggcccggattgctcctgttgtatgatgtaaccgtttgtgttgtactatctccgttctccgatatttgtcttaccctagttcatttttaaaataaaatgcgacaaataaaaaagaacggagtgagtacttaggatgtgccctagggttaacaaaataacatcagcgcaccgcctgccttcaaaattctgtaatatgtaaccccgtctttcccagcctgtcactgcaagctgcgatcgtgtatcctgatgtcagtattgtattatttttccttggcatgatgagagaatagggaagtgttctaaacagatgaagtagggtaggaaggtgatgtgttcttggtatgcgataacaataatctgtgccgcacttgtacctttcaatttgagaatgttgtgttagaccct

SEQ ID NO: 8969 - DNA, 1301 bp, Zea mays
  Predicted polypeptide sequence is orthologous to G2311
cgttaaataaaataaattagaaagctatctatccaggtggattagggtttttgcctcggctagcagtagtagctaatttggacgcaggagatacggagtagggcgaaccgcgaggagagcaagctatgggcgcgccgaagcagaagtggacgtcggaagaggaggatgcgctccgccgtggcgttcgcaagcacggcgccggcaaatggcggaccatccagaaggacccccagttcagcccgatcctctcctcccgctccaatatcgacctcaaggacaaatggaggaatttaagtttcagtgcaagtggactgggatcgagtaaagtacgggttccaaagataactggatcctcatcttcaccatcatctagctcacaggctctgcttctcccagcggcaaataatgttacagaagctatgctgcctgcagatgctgacaaaaagccacgggatgggaaaactccgccaaagtatggtgccatgattatggaagctctttcggaattgaatcagccgaatggttcagatattgatgcaatcttcgacttcataaagcaaaggcatgtggtgcaatcgacctttagaagatttctaccctcaaagttacggcgacttgcagactcaaacaaaattgaaaaggtcgataacttctataggctcccagattcatttgcaacaaggactccagctcaaataaaagtttcagatccaaaacagaaggatccatctaaggcgtcaaagaccataggcttgtttgctgcctccagccctgcactagaggcagcgatggcagctgctgtcaaggtgactgacgccgaggcaaaagcacatgatgcacatgatcagatgatggaggcagaaaggatgctgaagatggctgaggataccgagtctatcctcacaattgcagcagagatctatgatcgatgttcaaggggggagataaccacattagttccagtggcgcaaagggagttttgaaatctattggagactcttgtcttgtacatgggataggttttggaatccggaggcccttacttgggatatgccctagggttaataacaacagcgcaccgcctgtcttcagactttgtaatgatatgtaatcccatctttcccattcccagcctgtcactgcaagctgcggtcgtgaatcctgatggcagtaaagttttttttttgttgacatgacgaaagaatagagcaggaaaaagtggtttaaacagatgaggtagggtagtaggatggtaaagtgttactggtataagataatataatgtgccgcagttattttcc

SEQ ID NO: 8970 - DNA, 660 bp, Zea mays
  Predicted polypeptide sequence is orthologous to G2319
cagcaccagcaggactgtcttggctgtgatgtcgtccatctccttcagcttctgcaggtgggcttccaccgggaccggcgcgtccgcgtcgaacatgtcgccgacgaacctgtacacatgcgcaaacggcatgtcctcgggtgacaacgggagctcgatctgctgttggtcctccacgacgcccatcgccgacgcttcacttgcgctgccgccgccgccgccaccgccgccagcccagtctatgctggtgccgctcaagctcggcgccccgatgaagcggttgccaccggcggcgaatgccgctgctgctgcccctgtaaccgaagcgcgtgcccactccaagtccaagccttgcatcccgccgccgctgctggccgcggggacgacgacactcgggctgctccagccgatggaaccgtgatgggcgacggcgtcgggctcggccagacctggcatgccgaccggcgcgcaagtaggttgccggccgtgcagcagcggcatggcggccgcgctgctaccaccggccaccgagctctgctgctgtatggcgaagtggcgccccgggtacatcggcggcagcccggcggccagcccaagcttctggaccttgaggaagtacttctgcgcgtggctccgtatctggactgtcctcttggtgcc

SEQ ID NO: 8971 - DNA, 697 bp, Zea mays
  Predicted polypeptide sequence is orthologous to G2319
tttgcacataatttctatgaagttcctgcataggcccttagacgaggacatgtctagcacagatcggtttactcgtaccgatcgactttgagaactagtgacgtaaaaatccctattttttatctagcaggaaatttgtaatcacaggattcaaaaccaatcccgccataacgtaactggctacaaaatattgtcgacctacaagctacagggagggaagttgtcttggaggttggccagcacccgtaggatggtgtccacgactacagggtccgcgcccagcagcctctgcagctgcgcctcgaccggccacatcgcgccacagccgaagacgtctccgacgaacctgtacacctgagcgaagcgcaggtcgtcctgagacaacgggagctgaaccgtctcgacgtccggcgccagggcaccaccatagtcggcggcagaacggcgagggtgcggcggcggcacggcgaggcccagcttcttgtccgctctgagaaagtgcttctgggcgtggctgcgtatctgcgtgcccgtcttggtggcgacgaacgcctggaccctcttccagtcgcggccgaacagcagcagcgcgtggaggaagcggccgtgctcgtcggcggtccacctctcccgcggcctgctcaccacgtacggcttccgggacttcttcgtcccggccgacgacttgttcactgcg

SEQ ID NO: 8972 - DNA, 129 bp, Zea mays
  Predicted polypeptide sequence is orthologous to G2343
atcaactacctcaggccggacatccgccgaggccggttcacggcggaggaggagaagctcatcatcagcctgcacgccattgttggcaacaggtgggcccacattgccagccacttgcccgggcggacg

SEQ ID NO: 8973 - DNA, 614 bp, Zea mays
  Predicted polypeptide sequence is orthologous to G2348
aggcattattgttacttctccaatagccaacttaggcgcctagtgcatttgctagtgaaaacactgactttggaggggatacaaattgaactaactgatgagaaaaatatgccacttgtgactgagatgtttttaccggcactgctgccagcctgatacgactgttaggtggcttaagccctcactgattgttacttatcctggtggtgccacgagaatgcgacttgttacgactgtggcggttgcggctgttttgtgtttcacagcttgtcttgttcttttccatccgcatggggtaggggtgcttgcagctccagtgaagaggtacttgtcgagtgactccgcatcgtagttgatgttatagatcagatattctattttgccgtgccgctctgctctgtctgtatcatttgcgctttgttaaggcatagcttgtgtatctgatttttttgtaagggaaccaacacgcaggtgcctttcatctgtgcaaaactggcatcttttgtttttttcagactgtaagtataggcgccggaagctctgacctgctaatgtttgggcatgtaaacttctaatgtagtgcattagttaatggaaaataaaaaaaaaaaaaa

SEQ ID NO: 8974 - DNA, 582 bp, Zea mays
  Predicted polypeptide sequence is orthologous to G2348
agcgagtgaaatcgggtacctaggaattaggagcagagcgagtgaaatgggggcaaaaaagagagaagggccctcttggatgatttgatcaagaatcaagaagatctcgtcacctgtctgtccctgccccttccttctcctctctcggggagggagggagggtcagggaggattggttagtcgttggattaggttggggagtgggagtagttaggtaatctgtcctagttcatcaatcaacgaggttttctttttctctttttgggttttcgatggaattgtttttgtccgtccgtccatgcaaccaagaaagaaaagaaatttccaaggcccatggagaatctgtacaaaagagtggctacgtgcaagaggagcgttgagtctgtgagcaggaccaagcagcagcagcagctaggttgttcagtcaggcagtggatgagctgtgtgtgtgagagagagacatctatttgtggcgttttcccttttttcccccttttctctcctgattattgtatgttgtaatatcctgctgtgattgaaatgaaatcaagctgtataatactggtagtattattatgaatc

SEQ ID NO: 8975 - DNA, 685 bp, Zea mays
  Predicted polypeptide sequence is orthologous to G2348
gaacgtcctttaatgggctgagtgcatctaataataaaataggaataagctaggtgtccctttcaaaaaaagaaaaaacatacatataaacttttttatataaaaaaaaaataaaaacaaagtgacatcctggagtgaggtaaccctgcaattccctcattatgttatgtagtaatgggagtctgtgatgtttaggctttcggatctgcaaactctaaaacagggtgatatcccttgaacctcttttgtgatatcctagcctcaagtgcacatcaatgcacacacatactgggtgtaaggagcacaaccccaaacggggaaagtagacagaacattatagagacggccatgtgccttgaaccagcaacaggccaacagttaactcaactgcaacattcttcttctttttcctctgcattttcttatataacaaaaaaaaaagaatatgaatgggaagatgcctctggagagcaaaaacaatggcaattcctcttcattggctcctgtaattgaatcagggtactagttccctaagcacctatcaatgtctatcattttaggatctcttcagtatatgttgttggtttttagttggcaaagttctatcaatttcacccagcctcctttactactaccttactgttcaggtcaaaactgttttttttttttttgggggggggggggg

SEQ ID NO: 8976 - DNA, 629 bp, Zea mays
  Predicted polypeptide sequence is orthologous to G2372
ggcacagcaactgcctactttgcttgcgttgcgcccaaaaaaggtcaaaaacatcaagaacacgcaaagaattaccctcacgttcactgcatatttgcattgactaatggctgtacaactcaactcataggcttcatgtatacatgggtcagactaccgtcaatgtaaaccgcaagcaatcccaggtgggctctcttggaatcttcactaccgtcatgtaatcattagtgctaacatatagctaagtcaaatttgaaatggcaggaacgttttgcagattcactttggtctttgggctgtccaaagcacgcaggaagttgtcttgtaaaaacacggtatggtttgtgggcagcaagtcttgatgccgcagttatggtttgtggtgcgcagctgcttggtcttgcagtttagttgccctcaggttcattcttaacattgctcggctcatcgacagccattgccctggcacacacatgaggagcttgaatggagaaaccattgtcttctgccttgggttccagtactctatgttcagatgcaactctgccaccatcctgtactttggtatcattttcaccaaattttctcttaactttcatacctacctgtactttggtatcattttcacc

SEQ ID NO: 8977 - DNA, 402 bp, Zea mays
  Predicted polypeptide sequence is orthologous to G2375
aatcggttttttttttttttttttacgtgttcagggcgtaattcattatcaaatcgtaggatcaatatacatttttgatgatttttcttgttttgtctgctcccagacacgcaacccatttagttctaatccttcgccacagcctccaattgactggattcgggggtgactggcgtcggcgagtcctgcagctcatacaggcgcttcgctgtggaccctgtcccacatgtcagtggtctggcggttggacacttccatgtgggctccgcatgtcggtgagatttcgggttgtatagagtgccaactccagcagctgaatcgatccccgaataccctagtgacggcggcggagatggacgaccgaggcggcggcggggacgccaatatgtggccgtggtgggc

SEQ ID NO: 8978 - DNA, 571 bp, Zea mays
  misc_feature (545)..(546): n is a, c, g, or t
  misc_feature (548)..(548): n is a, c, g, or t
  misc_feature (565)..(565): n is a, c, g, or t
  Predicted polypeptide sequence is orthologous to G2379
ggagctagcgagggcaatcgagaccttcgcggatatgtacgagcgcatggaagcagccaagcagcgacacgcagaggagatggagaggcagcgaatcaagttcctcaaggatctggagctgaagcggatgcggtcttttgtggacatgcagctgcagctttcgagggcaaagcacgccaggaagggtgatgcttcctcggagatgctcatgtctctcgctgcactgcccttcctcagcagctctgcttatctttaagggcctgttcagttagggatggattctccaatcccctcaatccacccctagccttaaattggaagagtttggtaaaggaatattttgaccttcaattaggaatttaggatacagtgagttggttgctgtgctagacttgttcgtggattgtttgtgtttcctaagatactgtaatttttcatacgaaccacggaggtattgcaggtcttcaaaatttaaatgtaccttgcaatgcattatgcccaagttttttcttagatggaatgaaatttactggtttacaacaaannanaataaaaaaaaaaaaanaaaaaa

SEQ ID NO: 8979 - DNA, 1334 bp, Zea mays
  Predicted polypeptide sequence is orthologous to G2383
gccttggagtcccatcagtaaagcacatgtttcctttctgtgattcctcaagccccatggacttaccgctttaccaacaactgcagctaagcccgtcttccccaaagacggaccaatccagcagcttctactgctacccatgctcccctcccttcgccgccgccgacgccagctttcccctcagctaccagatcggtagtgccgcggccgccgacgccacccctccacaagccgtgatcaactcgccggacctgccggtgcaggcgctgatggaccacgcgccggcgccggctacagagctgggcgcctgcgccagtggtgcagaaggatccggcgccagcctcgacagggcggctgccgcggcgaggaaagaccggcacagcaagatatgcaccgccggcgggatgagggaccgccggatgcggctctcccttgacgtcgcgcgcaaattcttcgcgctgcaggacatgcttggcttcgacaaggcaagcaagacggtacagtggctcctcaacacgtccaagtccgccatccaggagatcatggccgacgacgcgtcttcggagtgcgtggaggacggctccagcagcctctccgtcgacggcaagcacaacccggcagagcagctgggaggaggaggagatcagaagcccaagggtaattgccgcggcgaggggaagaagccggccaaggcaagtaaagcggcggccaccccgaagccgccaagaaaatcggccaataacgcacaccaggtccccgacaaggagacgagggcgaaagcgagggagagggcgagggagcggaccaaggagaagcaccggatgcgctgggtaaagcttgcgtccgcaattgacgtggaggcggcggctgcctcggtgccgagcgacaggccgagctcgaacaatttgagccaccactcatcgttgtccatgaatatgccttgtgctgccgctgaattggaggagagggagaggtgttcatcagctctcagcaatagatcagcaggtaggatgcaagaaatcacaggggcgagcgacgtggtcctgggctttggcaacggaggatacggcgacggcggcggcaactactactgccaagagcaatgggaactcggtggagtcgtctttcagcagaactcacgcttctactgaacactacgggcgcactagacttcgtaattggctgtgtgacgatgaactaagtttggtcatcgcatgatgatgtattatagctagctagcatgcactgtggcgttgattcaataatggaattaatcggtgtcgtcgatttggtgatttccgaactgaaaaaaaaaaaaaaaaaaaaaaaaaaaa

SEQ ID NO: 8980 - DNA, 569 bp, Zea mays
  misc_feature (31)..(31): n is a, c, g, or t
  Predicted polypeptide sequence is orthologous to G2404
ttttttttttttttttggtgaaaaaaattgntaagttccatatgcaaataaatactaggatcatgtgtgtacagcaagcgtgcgtgtactagatactgtactcaacaagcgtgcgtgcagacggctgctggactgtacagcaacaatagaactaatcttttgcatttcaattggattatacttaatgaaagtgtggttcagacactagaaagaatagggacttcaggtcttcgagacagtggtcttgcaaaccggacaagcgttcttccgagaaagccactgctttatgcagtgcacgtgatagctgtggccacagctcagcttcccagtttcctcgtgtacttcgaactcttcctggaaaaaggaaatggaaccgatacatgtcacatgtgtatcaggtgccgagcagaagtgcatgaagtgaggcctgtgagtgggaaggagaaagagaagggacatacttgacagatgctacatctcctgtccatttccgtagaaaaatgtctggggttgaacgcggagtactttaccatcctaaggctttgaatgatctcgtcctcacgaagccc

SEQ ID NO: 8981 - DNA, 751 bp, Zea mays
  Predicted polypeptide sequence is orthologous to G2455
tttttttttttttttttttgaacaaaattttccatttatttagtaatgttgtacaccatgcatgcatatatcatatatagcatcaaacatgttaattactgcacgcaatgcaggattcatgcatgcaagtacgcaacaggtctgaaaacacaggttgtcaaaaaacttaataaggcttacaaaatccaagcacgacatatcacactgcatatatatatgtgtaaggcgaagagctcgatccgtaatcatcgtcttccctagttgctgccgccgccgccgtcagcgacgctgaggccgaaatggagccgagggagatgagcccaattctttgctgcagcactgaatgcttccctgtggctaatctctgggttgctcgtctttatcctttgtatttcttccttgatgaatctgttgtatgctgatggaacacgctgtctcttctctgagggtcgtattggtggcacttgtggctgattgtttgacactggatacatgggaggcgttcgtagatttcttgacgaggcttgctcgtagctcccaaaattgttatactgaaaccctctgttctggacaacctggttgtctgggacagtgcgtgcctgctgatggaagggactgagatccatggacagcaccattgtacaatgcccacatttaacagtcaccacgttgtatgaacaactgcttggcacattcaccaccaggatagtgttgcaatagttgcagttgacatagcaagcatgctcggatg

SEQ ID NO: 8982 - DNA, 707 bp, Zea mays
  Predicted polypeptide sequence is orthologous to G2455
ttttttttttttttctgttatatagtaaaaggtgtccttgaaggggagaagggaaaactaaagctttttttttgttacaaaaaaattgggacgttgggaaagaattatgtgtgctgtttggtccagaaaggtacacagatatgtatagtagtgctcctgtttgcccttcatatttcatgatgccaaatcttcaccatgaaatcagaacattttctgaaaaacagattgtttgggacgttagatttgggtacggggtagaaaaggcctttgtataggactaaaggcatagctacggtggaaccagtacccatggcagagcacttggaacagttgggtagctctgaatgaaggggaaaaaacgaaaggaaactcgctgcacacacacagagagagcacttgaacaggatcaccataggctaacagcttcgaagaaaaaaaacgaaaggaaacaagtggctggagatcgagaaagatagagagagagaaagagagagagagagactataccaccaggatagtgttgcaatagttgcagttgacatagcaagcatgctcggatgcaaactgggctgacatttcttagcttcttggatctccaagtacgtacccgctgttcgtcgttgttgtgaaggcgagatctagagggaggaaggaagaaagcaaagccagcaagcgatatggatgaacaaaacaatgtctcctgtgcc

SEQ ID NO: 8983 - DNA, 928 bp, Zea mays
  misc_feature (15)..(15): n is a, c, g, or t
  misc_feature (682)..(682): n is a, c, g, or t
  Predicted polypeptide sequence is orthologous to G2455
cagttttccgtccgnattcccggctcgaccccgcgtccggtagcttttaattaaattgagctgtacctgttggtcttcctcctcgctcttcttggttctcgctggttgccgggagctgggatcgaaagtactgctgttgttcgcacggcgaggcggcggcggagaccggtcagaaggaatgtcttcggcccaaatcgcgccggcagatcatgtgtgctatgtgcactgcagcttctgcaacacagttctcgcggtgagtgtcccggggaatagcatgctcaacatcgtgacagttcggtgtggacactgcgcaaatctactgtcagtgaacctgagagcactgacgcactcactcccagaacaagatcatcagctccaggagaacatcaaggtccatggcatcaacggcactttgcatgatgatcatcagtgcggccatttggatcagctcggttcttcttcgtcgtcaaggttccggcggcttccagtgatgtgttcgccacagaacgagcagcacctgctgcaggaacaaacacttaacaacaatgctcgtcctccggagaagaggcagcgggttccgtcggcgtataacagattcatcaaggaagagatacgcaggatcaaagcgaacaaccccgacattaaccacagggaagccttcagcacggcagccaagaattgngcacattatccaaacatccatttcggtttaaacgactccgggcgagaggggcagaagaagctcgtggatcatgaggcggcggcgtctgtcgtcgcagtcgcagcagcaccgactgctgctataaagatcagggtttctactgatgggagcagatagatgtgtaaattgattgaacatcatcgaccgggtggagaatgatacccaaaactgtttattatatgtctgggagtaacagttaaattaact

SEQ ID NO: 8984 - DNA, 2090 bp, Zea mays
  misc_feature (72)..(99): n is a, c, g, or t
  misc_feature (137)..(141): n is a, c, g, or t
  misc_feature (268)..(318): n is a, c, g, or t
  misc_feature (430)..(522): n is a, c, g, or t
  misc_feature (965)..(1004): n is a, c, g, or t
  misc_feature (1081)..(1085): n is a, c, g, or t
  misc_feature (1127)..(1167): n is a, c, g, or t
  misc_feature (1250)..(1267): n is a, c, g, or t
  misc_feature (1278)..(1309): n is a, c, g, or t
  misc_feature (1318)..(1349): n is a, c, g, or t
  misc_feature (1439)..(1452): n is a, c, g, or t
  misc_feature (1708)..(1733): n is a, c, g, or t
  misc_feature (1810)..(1815): n is a, c, g, or t
  misc_feature (1975)..(1997): n is a, c, g, or t
  Predicted polypeptide sequence is orthologous to G2456
gcacgaggtggtggaccggagctagtagctgccagccacacatttcggtcgtcggaaccacatatcatgatnnnnnnnnnnnnnnnnnnnnnnnnnnnngccgcctgctgcttcccgctggaccacctcgcgccgtnnnnnaccgagcagctctgctacgtgcactgcaactgctgcgacaccatcctcgccgtcggcgtgccttgcagcagcctgttcaagacggtgacggtgcgttgtggccactgcgccaacctactctccgtcnnnnnnnnnnnnnnnnnnnnnnnnnnnnnnnnnnnnnnnnnnnnnnnnnnnctcaacttcgctcactccttgctgtcacccacatccccgcatggcctcttggacgagttggctctccagcaggcgccgagcttcctgatggagcaggcgagtgccaacctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagccgaactgcccaagaccgccccgtcggtaaacaggcctccggagaagcggcagagagtcccgtcggcatacaaccggttcatcaaggacgagatccagcgcatcaaggccggcaacccggacatcacccaccgggaggcgttcagcgcagccgcaaagaattgggcccatttcccacacatccacttcggcctcatgccggaccagggcctcaagaagaccttcaagactcatcaggatggcgctgaagacatgctactcaaagacgatctctacgccgcagcggctgcagctgcagcagccaacatgggcatcactccattctaataactctgtgtggggatagaaatggagaataatcaagttagagcgcgcatcaagtaggccactgatgatccgtaggtacagacttgattgtctcctctatatatcccttttcnnnnnnnnnnnnnnnnnnnnnnnnnnnnnnnnnnnnnnnnaccccttcaactcgccagtagagagctcgttgtgcctctccaatcccatgtttgcgtatgtctgctcaacaacatgnnnnnaccatggagaacaagttgaacatctgttagatctatcaagannnnnnnnnnnnnnnnnnnnnnnnnnnnnnnnnnnnnnnnntttcgtgggtagaggaggcactagatactgtgccagatcggggtctggtagtggcagttgggtgattacgacggagtgggatnnnnnnnnnnnnnnnnnngtgggacgacnnnnnnnnnnnnnnnnnnnnnnnnnnnnnnnncggccgccnnnnnnnnnnnnnnnnnnnnnnnnnnnnnnnnaagatcagtgatccggccggggacgctgcagcgctcgtgccgccctcgccggcttcgggtagcgaggagacgccggtgaaggtgacgcgnnnnnnnnnnnnnnagcgtcccgcggggtacccgtcttcgccgaggagcgcggcaagcacgccgccggcctctccactagggactaccccgcccatctcgccgtttgccggcgctggtggtcgcttcagaaggaaatcatcatccgacgcatatgagagggcaacccctccagggacgaccagccaccctcctcccttcgaagtgtgaaccggctgcaccctcacacttgttttgctccttgacaagcatctcttcacctataataaggnnnnnnnnnnnnnnnnnnnnnnnnnnatcaagaggggaacggggatgagttgcgggtttacctctgctgtgatatattgtaggtgccactatgtgtattgttnnnnnntatctactacgtggcataggttgtattctagtatgttgaaagctcatggtgccgtgctgtatcaataaggtgttatgcgcatagagtggctcaggaccagggctgcgtttgcgctttgccactggctgtgttgtatgtttcttctgctgctatgccattnnnnnnnnnnnnnnnnnnnnnnntggcgtcgtgcttgtagtgttagctgggtttgaagcggactacatgtaggtttgttcaatgtctggtatctattagctgaaggtgtttgcctg

SEQ ID NO: 8985 - DNA, 1415 bp, Zea mays
  Predicted polypeptide sequence is orthologous to G2456
ccacgcgtccggcatttcccctctctccagcacattgctgcttccacagttccacacacataaggccaccacagcaaataaaggcactgctgcactctctctctctctctctctctctctctctctctacgcgaaaagaaaagaggaaagtgggatagctcaatctctccttccaccgtctctcagttctcactctagcgctctctctctccacatatatatcagtaggatggatgtgcaaacctagcttgttgctgcctttctagctgagaactgagctgtagctgttggtacggttttcctcctcgctcttcttctccttcttcttgctgctggttgccgggagctgagatcgatcgagagcactgctgttgttcgtgcggccggaggcggcggcgcgcggcagggggcggagacgacgaccgatcggtcagaaggaatgtcgtcggcccaaatcgcgccggcggaccatgtgtgctatgtgcactgcaacttctgcaacacagttctcgcggtgagtgtcccggggaacagcatgctcagcatggtgacagttcggtgtgggcactgcacaaatctactgtcagtgaatctgagagcactcatgcactcagtcccagaacaagatcagctccaggagaacatcagggtccatggcacgttgcgtgagcatcatcagtgcggcggcggccaccatctggagctgggctcttcgtcgtcctcaaggttccggctgccgatgatgatgtcgtacgcgccgcagaacgagcacttgctgcaggaacagacactgaacaacgctcgtccggctcctgagaagaggcagcgggttccgtcggcgtataacagattcatcaaggaagagattcgcaggatcaaggcgaacaaccccgacattagccacagggaagccttcagcacagcagccaagaactgggcacattatccgaacatccatttcggcttaaactccggccgagagggtggcaagaataagctcgtggacgaggctgtcgcggcggtggcggtggctccgaagaagatccaaggtttctactgatcgatgccggtcgatcgagggatcagcgctcgtcgtcatcaactggccggccgggtgtggaagaattaataataccacacaaattataaatgtactgtgatgagtaaattaaagagttatagtggggaatgaagggagagagagatatatagcaatacgtatattaccttaccttattaatgagtgcaaaaaaaacacttgtgaaggtttctactgatgcatgagtgggaagtgaagcatcatacaatcacatgaattatattactactggcatggtgggcgccatgcatggtttaaattaaccgagaagacgacttaataaatcattatttgacctaaaaaaaaaaaaaaaaaa

SEQ ID NO: 8986 - DNA, 1573 bp, Zea mays
  Predicted polypeptide sequence is orthologous to G2456
tctctctctagttgccaaatcggagcggcagcaacgacagatccaatacatataggttccattgcatcacacatcagtcactccaaaaccatcaaatcacacgcccatcagatcacacaggcaaagaggagagagagagagaggagggtgggtgaggaggaagatgatgagagatatatcctactaaactatccatccatccatcaatcaggtagcccggcagcaatcgcgtgccgcctttccactcacgtacaccaccaccaccaccacctctcagcacagcagtcggctcggttcgttcgttgccgcgtcaaatcggggcaagaagccagcagctagccagccccctgtcgcagtgttgcttcgcgtgccctgctgttgcttgcaccgcgcacgtacgtacctggagcaagctgcggtcgattgatcgaccggtggttcgctgtcgccgcggtcggcatgtcgtcctcgtcctcgtcctcctcggccgccacggtgttcccgccgtccccgcagctgccgccgcctctcctggtggagaacctgccgccgctgcatcagcttacgccgccggtagccgcggcggccgcgccggcctccgagcagctctgctacgtgcactgccacttctgcgacaccgtcctcgtcgtgagcgtgcctacgagcagcctgttcaagacggtgacggtacgatgcggccactgcagcagcttgctcaccgtcaacatgaggggcctcctcttcccgggcacgccggcgaacacagccgcggccgccgcggccgcgccgccaccaccaccagctgctgctgtcaccagtactaccgccaccatgaccacggcgccgccgccgccgccagccacctcggtcaacaacaacgggcagttccacttcatcccccactcgctcgacctcgcgctgcccatccctccccaccaatccctcctgctggacgagatatccagcgccgcgaacccgagcctgcagttgctggagcagcacggcctcggcggcatgattaccagcggcaggaacgcggccgcgccgcacccgcacccgccccagccccaggcgcctgcagcgggtaaaggggccaaagagccgtcgccgcgcgctaactccgccatcaacagacctccggagaagaggcagcgcgtgccgtcggcgtacaaccgcttcatcaaggacgaaatccaacgcatcaaggctggcaatcccgacatctcgcacagggaggccttcagcgcggcggccaagaactgggcgcactttccacacatccactttggactcatgccagatcaccaggggcccaagaagacaagcctgctacctcaggatcaccagagaagcgacggcggcgggctactaaaggaagggctgtacgctgcggcagccaacatgggggttgctccatactaatattagagtagcaaagctgctacgtactgttagggctctatggactactacgaagctatggacgtgtttggtaggctgcatatgggccggccaggctggtaagatacagcgtacgcttgtttggttgctaaaaaaaaaaaaaaaaaaaaaa

SEQ ID NO: 8987 - DNA, 1605 bp, Zea mays
  Predicted polypeptide sequence is orthologous to G2456
aactcctcatcctcactaccaaccaaggcactttctcgcctcccccgtcttcgcccccttcttttctctctctctctctctctctctctctctctctctctctctctctgtaagttgccaaatcgcagctgcagcaacaaccgatccaatacatactaggttccattgcatcacacatcagtcactccaaaccatcaaatcacacacccatcagatcacaaaggcaaagaggagagagagagaaagagggatgatgaggacgacgatgagagagagatactactaaactatctatccatcaatcaatcaggtagcccggcagcaatcgcgtgccgcctttccactcacgtacaccaccacctcccaggctcagctcggttcgttcgttgccgcgtcaaatcgggacaagaagccagccggacctgttgcagtgttgcttcgcctgcctgctgctgttgcttgcgccacgcacgcacgtacctgaagaaagcagcgacggattgatcgaccggtggttcgctgtcgccacggccggcatgtcgtcctcgtcctcgtcctcgtcgtcctccgccgccacggtgttcccgcggtccccgcagctgccgcctccggtcctggtggagaacggcctcacgccgctgcatcagcttacgccggtagccgcggccgcgccggccgccgagcagctctgctacgtgcactgctacttctgcgacaccgtcctcgtcgtgagcgtgcctacgagcagcttgttcaagacggtgacggtacgatgcggccactgcagcagcttgctcaccgtcgacatgaggggcctcctcttcccgggcacgccgacggacacggtcgcgggggccgcaccaccaccagctgctgacactagtacgactaccaccaccatcaccacggcgccgccgccggccaactcggtcaacaacgggcagttccacctcccccactcgctcaaccacccttaccaccaatccctcctggtggacgagatatccagcgccgcgaacccgagcctgcagttgcagctggagcagcacggcggcctcggcggcctgatactcggcggcagcaggaacacggccgcgccgcctccgccgcagccgcctgcagcgggtaaaggggccaaagagccgtcgccgcgcgttaatcccgccgtcaacagacctccggagaagaggcagcgcgtgccgtcggcctacaaccgcttcatcaaggacgaaatccaacgcatcaaggctggcaatcccaacatctcgcacagggaggccttcagcgcggcggccaagaactgggcgcactttccacatatccactttggactcatgccggatcaccaggggctcaagacgacaagcctgctacctcaggatcaccagagaaaggacgggcttcttaaggaagggctctacgcggcggcggcggcggccgcagctcatgcggcagccaacatggggattgctccatactaattaatttacaattactcctcctcaagcttgctactgatggtaccttgcttccgagaatctcccttctttacattagcttgttaaacgttccaaatcacgtatgttccttcaaaaaaaaaaaaaa

SEQ ID NO: 8988 - DNA, 1267 bp, Zea mays
  Predicted polypeptide sequence is orthologous to G2456
cacatccactcgcccaagccggccttcgtccctgcccaacgctgcttcactctctccagcgatagatagcatcatcctctccacctgcacaggagacgacgaagcagcaccatcgtccgcggtcctttgcttcttctggcgccatgacgtcgccggtgccggagacgttcagcctgcaggaccagcagccgccgccgccgccgccagcggagcaggagcagatctgctacgtgcactgcagctactgcgacaccatcctcgcggtgggcgtgccgtgcagcagcctgttccagacggtcaccgtgcggtgcggccactgcgccaacctgctctacgtcaacctccgcgccctcctgctgccgccggcgacggcgcccgcggccgccaaccatctaccgcccttcggccaggctctcctctccccgacctcaccgcacggtctactcgatgctgagacgatgtcgtcgtcgtcgttccaagcgccgagcctgccgagcgctgaaccgccgagcgccgcctgcgtgagcggcatcacgagcatcaacaacaccgcctgcggtggcaacaacgccgcgtcggccatggcgccgccaccggccaaacctgcactgcacgagccgccgcagctgcccaggagcgcagcgtcagcgaacaagacttcagagaagcggcagagagttccttccgcatacaaccgtttcatcaaagatgagatccagcgcatcaaggccagcaatcccgacatcactcacagggaagctttcagcgcggctgccaagaattgggcccatttcccacacatccatttcggcctcatgcccgatcagggtctgaagaagcaccccatgcaaactcaggagggagctgaatgcatgcttttcaaggacggtctatacgccgccgccgccgccgccacagcggcgtccagcatgggcatctctccattctgatgacttcagctccaccgcggaatggtctatagcgttctgcctctctgtgcgcgcctagccgcttagggttctgatgtctcagttccctcgttatctcccggttgcttgagtgagagatagcttcaatgtctatcccagccggagaatctcgaaatgtctctcagtacccatatatctctaatagttctcctcagtttccagcttcttactttgttaatttgttattatgcaacctctagagaggttgttatgtgtatgacgatgtgcggcctcttatctttatatggacataattcgagctgggttaaaaaaaaaaa

SEQ ID NO: 8989 - DNA, 971 bp, Zea mays
  Predicted polypeptide sequence is orthologous to G2456
ctctctctctcacacacacacacagacacaaataaaaagaaatcagtagttcgatttctcctctcacctttacacatatctccgtatttacaaattaggttgttgatgtaggctgtacgcacctgctggtttgctactcgatcctatatatcgtccaatcctatctgacctctcgacatctggtccttgattactcgtcctttttgcttggtgcctgtgtatatcgtcgccccggccgcttgagctagcttcctctagtgctcgctctcgtcgtcgatcggttgtttgcatagcccacggcgagccgaagcaatgtcgtcggcgcccctgcagatcgcgccggtgccggagcatgtgtgctacgtgcactgcaacttctgcaacacaattctcgcggagaatttcaccgtccaaaatatgggttttactgaaaattaccctgagtacgcaccttcgtaccgcatgccaacgacgctgtcagcgaaaggtgatctggatcatatgctgcacgtgcgcgggtcaaatgactgtggattttttgtgatgagttacatgaagtcttatgatcacaatgcaggtgtcatatcttctttcaatcaactagacaattcccgagacctacgtgctcatgcccttcatcaactcacattcaatcgcatcaacaaggtgttgccacttccattagatatccagagatttatgtttgcgcgcaattagtgaaatatgtcagaactaagcaatggtgtgggcaatgtaccgtactgtggtattttggccattattgtcagttaacaattgtaagaagcttccttatatgtgctgtttcagaacaaatgtcatgctactttgtcttaggggtgttacccaggttctttctgtgaactttagttggctggatacttatggttatgttgcgaatatgtgaacatcatatgttttcacttctgggtgctttaaatatgatctgtttt

SEQ ID NO: 8990 - DNA, 930 bp, Zea mays
  Predicted polypeptide sequence is orthologous to G2456
ctcccgtgcacacccatccactcgccgcccaagcccttagcttcctgcccaacgctgctgcgcttcacgctccatcgcccctcatccaataactccaacaaagaccgggttgcttcgatctgcacacaacagaagaagcacgcccatccgcggctcttgcttcttttggcaccatgatgtcgtcggcgccggaggagacgctgttcaacctggaccagcagcagcctccgccggcggagcaggagcagatctgctacgtgcactgcagctactgcgacaccatcctcgcggtgggcgtgccgtgcagcagcttgttccagacagtcaccgtgcggtgcggccactgctccaacctgctctacgtcaacctccgcgccctcctgctgccggcggcggcggccaataaccagctaccacccttcggccagcctctcctctcccccacctccccgcacggtctacttgcgccgagcctgccgggtgctgaaccgccgagcgcttgcgtgagcggcgtcacgagcatcaacaacacgtgcggtggcaacaccaccacgtcgtcggccatgtcgtccatggcgccgccaccggccaaacatgcactgcaggaggcgcagcagctgcccaggaccgcagcgtcggtgaacagaacttcagagaagcggcagagagttccttccgcgtacaaccgtttcatcaaagatgaaatccagcgcatcaaggccagcaatccggacatcactcacagggaagctttcagcgcggctgccaagaattgggcccatttcccccacatccatttcggcctcatgcccgatcagggcttgaagaagaaccctatgcaaaatcaggagggagctgagtgcatgcttttcatggacggtctctacgccagcatgggcttttctccattctgacttcacgtcttcaccc

SEQ ID NO: 8991 - DNA, 1001 bp, Zea mays
  Predicted polypeptide sequence is orthologous to G2457, G2459
gcacgagcacacagctagcagacagccagacacgcgctgctttctgatctctccccggatcggaggctcctcccaacataccaccctgccagccgcgccgccacgtccacgccggccggccaccaagcaagcatggatatggtttcgcagtccgagcacctgtgctacgtccgctgcacctactgcaacaccgtgctcgcggttggggttccatgcaagaggctgatggacacggtgactgtcaagtgcggccactgcaacaacctctcctacctcagtccacggccccccatggtgcagccgctctcgccgactgatcaccctttggggccattccagtgtcagggaccctgcaacgactgcaggaggaaccaaccgctgccgctggcttcgccgtcatcaactgagctaagcccgagaatgcccttcgtagtcaagcccccggagaagaaacaccgcctcccatctgcttataatcgcttcatgagggaggagattcagcgcatcaaagctgcgaagccagatatccctcacagggaggccttcagcatggctgccaagaattgggcaaagtgtgacccgcgctgctcgacggctgcctctaccgaaacttctaacagcgctcctgctgagcctagagttgtgcccactccccagttaactgagccacgctttgacctggaggatagggccaaggggcaagtcattgagagcttcgacatcttcaagcatattgagcgcagcatctagaggtcgttcgatgccgctgttgtagcccagtatcgatcgagtaccatcagctatatgtataacctatcccgtatcgccgtcgtcgcctcgcaatcatgcatccccatcctgtacttttacccccgtacgtgttactgttgctgttattctcgttatggttggattgtacgcaccatttaattatgaacagctgctacctatatatataatatttgccttcttttttgttcctaaaaaaaaaaaaaaaaaaa

SEQ ID NO: 8992 - DNA, 893 bp, Zea mays
  Predicted polypeptide sequence is orthologous to G2457, G2459
ctcccctttctttgtctgcctgtgcttattagtatctcgcctcaccacgcagctagctagcagacagccagacacgcgctgctttcagatatctcaccggaccgtcgtcgtcggcccctccgagaacataccaccgcgcccgccgccgcgcgcgccaccacgtccacgtacgccggccggccaccaagcaagcatggatacggtttcacagtccgagcacctgtgctacgtccgctgcacctactgcaacaccgtgctcgcggttggggttccatgcaagaggctcatggacacggtgactgtcaagtgcggccactgcaacaacctctcctacctcagtccacggccccccatggtgcagccgctctcgccgactgatcatcccttggggccattccagtgtcagggaccctgcagtgagtgcaggaggaaccaaccgctgccgctggcctcgccgacatcgactgacctcaccccgagaatgcccttcgttgtcaagcccccggagaagaaacatcgcctcccatctgcttacaatcgcttcatgagggaggagattcagcgcatcaaagctgcgaagccagatatccctcacagggaggccttcagcatggctgccaagaattgggcgaagtgtgacccgcgctgctcgacgactgcctctactgccacttctaacagcgctcctgagcctgctagagtcgtcgtgcccactcctcatgtaactgagccacgctttgatctggaggatagggccaaggagcatgtcattgagagcttcgacatcttcaagcagattgagcgcaacatctagatgtctccatttcgagtaccatcagctctatatataacctatgcatgcatatgcatccccatcttgtactttttacccc

SEQ ID NO: 8993 - DNA, 616 bp, Zea mays
  Predicted polypeptide sequence is orthologous to G2457, G2459
aagggcaaaaaaggatttattaagccgccttcccggttaatttaaaccagggagggggccccccaggccagaagaaaaaaaattcaggggattggatgaggcttcccttcccacccaggcatcaaaaaaaaccttcacaagggttttttttgcccccattaaaaagggaagggaaaaaacgtattggtatatatccctcccccccttcattccccactaaaactttttaatttacccatcacagaaaatttaaaatttggggggaattattaattcttccccccccggccggccagttgaagaaaaaaagggctgatccctcgatcgaccgggatcaataaaaaaaaaccttggatttttttcggagcccccgcccccgccgcgacagccccgcccacaaacttattcttgccccccccccggccggagtttaagccaaaagggaggttcggaaaaggggcccagttcttggcggcggggctgaaggcttccctggggctaaggggggggttgttccccttgatcctgcaaatctcttccttgatgaatctgttaaacgccaacggaacccgctgccccttctcaggagccggacaaaggttgttcagggtctgtt

SEQ ID NO: 8994 - DNA, 703 bp, Zea mays
  Predicted polypeptide sequence is orthologous to G2465
atcactcttctttcttttatctttaatcacaaaaaacagagagcaaaatgctggatcacatcgtattcaagctagcatatccacgtgtgtacgtctgactgtctgtacctccggacgtaagcagctaaaattaaaagccaagctggggaccgaccgacggcgtttcattaggcagaggcggtctgcgacgacgacgatgacacggccggcgagccagagcaggcgtccccattgcgccgcgcgccggagcagctgctcgactgcctctccggacccggacgcggtcgcggtcgcggtgcgggcgtcaacgtcgtcgccaccggcgcgtacaccttgtcggcggctgttgtcgtcgttcccgacgcgtcgccggctaggtgcacgtgcacctgctgcggctgcgctgcggctgccgcagcgtactccggcggtggcacccagatgccccccaccacgacgaactgcggtgcggccggcggcgcaacgacgctggtgccgccgctctggaccgccgccgccgccgagttcggacgccgagtgtggagacgatacttctgcaaatggctcttgacctcgtcgttggtgaggccgtcgacattcatgagctcccggatctgcttgggcgtcgccacgtgggacccgccgagctgctgcagcgcctgcaggaaccggcggtggagctccggggcccagcaccgccgcg

SEQ ID NO: 8995 - DNA, 876 bp, Zea mays
  Predicted polypeptide sequence is orthologous to G2465
cccattcccttcccttttcccctcccgcgcctctgcctctctctctctctcgtcgtcttctaccggcacggcgcagcacggagcatggagatggacccgccgccgccgccacccctgcacgccgaccgccgcctccgcttccgcgactacctgctcgcgctggaggaggagcgacgcaagatccaggtgtttcagcgcgagctgcccctctgcctcgacctcgtcacacagactatcgagggaatgaggagtcacatggacagcgtcgtcgtcggcagcgaggagacggtgagcgaccacggcggccccgtgctcgaggagttcatgccgctcaagcccacaaccctctcgtcctcctcctcccagccccagtcccaggacgatcacgacagcgcccactaccttgaacaccgtcgcgctgccgccgccacggccaacgacgttgtcgatgccgacaaggacgacgaggcgctgggagatccggagacggcagcagccagcagcagcaggccgttgccacatccggagacgaagaaggcgatgccggactggctgcagtccgtgcagctctggagcaaccaacaacagccctccgtgtccccaccgcagcaccaggatgagctgctgctgccgtgcaggccggtggcgctcaacgcctgcaggaagtccgggggcgcgttccagccgttcgagaaggagaagaagaaggaggacaaggaggagaagcagcgcgccgagctggagctgccgctgccggccgcggcgagctcggccgtggtcggggacagctgcgacagggccggcgccaccgacaccgacaccgacacggccgagaacaataaagctagcagcaccaaaggcggcaaggacaaggag

SEQ ID NO: 8996 - DNA, 693 bp, Zea mays
  Predicted polypeptide sequence is orthologous to G2465
ggtctgcagggcgcgtaccactcttcttttttcatctttaatcacaaaaacagagagcaaaatgctggatcatattatcgtattcaagctagcacgaagaaggagctcccagattcacgtgtgtacgtctgactgtctgtacctccggacgtaataatcagctaaaattaaaagccgagttggcgaccgaccgaccgacggcgtttcattaggcagaggcggtatgcgacgacgacgacaacacggccggcgagccagaacaggcgtccccgctgcgccgcgcgccggaacagctgctcgactgcctctccggacgcggtcgcggtcgcggtcgcggtgcgggcgtcaacgtcgtcgccaccggcgcgtacaccttgtcggcggctgttgtcgtcgttcccgacgcgtcgccggctaggtgcacctgctgcggctgcgctgcggctgccgcagcgacagcgacagcggcagcgtactccggcggtggcacccagatgccccccaccacgacgaactgcggtgcggccggcggagcaacgacgctggtgccgccgctctggaccgccgccgccgccgagttcggccgccgagtgtggagacgatacttctgcaaatggctcttgacctcgtcgttggtgaggccgtcgacattcatgagctcccgtatctgcttgggcgtcgccacgtgggacc
